United States Patent 9,328,346 (POLYCOMB-ASSOCIATED NON-CODING RNAS) - sequence listing, part 147

SEQ ID NO: 192393 - RNA, 137918 nt, Homo sapiens
aagugagggcggcgaugagagcgaaaguugcgcucggcucgucgcugggggcuugaagcggcuccgcgcucugcccguuugggccucccccgacucggacucgcgcccgugggcucccgccgcgcccgcccggccccgcgccggccccgcgcccccucccccgucucggcgcccccuccucaggagccgcggguccccgccacuuucgcacggccccggcccccgccgaugccggccaugguggagaagggccccgaggucucagggaagcggagagggaggaacaacgcggccgccuccgccuccgccgccgccgccuccgccgccgccucggccgccugcgccucgccagccgccacugccgccucgggcgccgccgccuccucagccucggccgccgccgccucagccgccgccgcccccaauaauggccagaauaaaaguuuggcggcggcggcgcccaauggcaacagcagcagcaacuccugggaggaaggcagcucgggcucguccagcgacgaggagcacgguagguggcagccgcccccgcggccccgggccccgcgccccgcgccgcgcugaccgccguauucugcuucccccgcagguggcgguggcaugagggucggaccccaguaccaggcgguggugcccgacuucgaccccggugaguagcggccccggccggccggcggcggggaugagcgggagccccggguccccggcgagcccgagggggcgggagcccgccgacaacuuucuuuuugugcguucgcccugccguccguggggagaacagcagggcgaggacgaggaggcgcacacgcacacgaguguucugcaaacgugccucugcacccgggggaggccaggucgcccccagcagggccggcgccgcugcccccuugcgccuccgaggacugcggguggcgucggagguggccacaccuggccugggggcgcugggggucccugcguccaggugagcugcgccucggccagggguaaggguggcagugccggagaguuaguguccugcgagcgccccggacuuaggagguccccagagaccccuuucucggaacccuucccaaaggcugcuccccacgccuuugcuccuccucucagccucugggcucuugcuggcuccugacugcccucccauccagaaggcgaguagaagaacgaccccccaaaaccagucaauaaaagaaguguguuuuccagagggcgccugccuggggaagagagucucgcguguggcaguuggauuuuaggaccuauuuguaaauguguguauuuccuuuuuuuuggaggaagagauugugaaauugagaagcaucagaagcuuuagccuaacaaaugcuuuucaccuacaagaaagcccuacacccuagaauggaacacuuaguucccuggcugcuauucuguguagaagcaaauuuaaagugguacaagaaaaaaaauccgaucagacaaaggaauucgucagauuuuaaugcaugagauucuagccagugucuguaugagacugucuuuaaagguuguugguauggaaaauguuugaaagaacguaggauuuauuucagaaauaaaauucaaaagagcaucuuguaaagcuggaguuaacaauccuccaugguuggagggcuuuagagcugggguucuguauguggguuauaccacuaguuuauuugaaaagauaaacgcauacauguuuuuuccuuggaaacaagacugcagaaaauugcaaugaucuaguccuugaaaaaggcgauugcucucaagcuguuauuaagguacuaaacugcacuuugaagugaaaauacauagagguccuaggugagcucuuggacacucuggaaauaaaugacuuccuaaauuggccuucuaaauuuugauuuguugacguaaaucuguuaaauuuauuugucuaauacucgcguuuguguuucuuuuaaguccauguuaguguuuuugauaguuuccucuucuccccaauucuuuuuuuuuuuuuugguagucacuucucguuuaugagugacaggauagaacuagguggccaggcuauaucucuuguaugcuuggcuccuccguuccuugguuggccaccaggggaagcauacuguuuuuugguuacaguugacccugucuucauuuuguaggucaagucuaucuuugcuuuaaaacacagaacauaaagcuuguuaccaaauuuuccuaauguauuauuuuuaaaaaucgacuuccacaaaucuuugaguaaguugguaggcuuuuugauacauuuuuguuaacauaaauuuugaaaacuuuauguagauguguuggaugugacuaaggaaaagggcauauuugucaacaacaggaauuagauuucugacauucaucgaaauauugacaucagcucugcauuguuaguaaugaguuugacuucuuuggaguuauacuuuucuuugaaacagcaaauauaauauuuugaacugucuuugggcuuuuuguuggaauagauaugagcauaaacuugcuagugaccagcuauucuaaaauggaaaacauuuaucagauugcaguagcucacaccuguagucccaacacuuggggaggccaaggcuggaggaucucuggagcucaggaguuggagaccagccugggcaauguagucagacucugucucaacaaaaaauaaaaaaauuagcugggcaugguggcaugugccuguaguuucagcuacgggggggucugaggcuggaggaucucugggaagucaaggcugcagugagcagugaucuggccauugcacuccagccugggugacagagugagacccugucucagaaauaaaaaggaaaacaucuaacuguuuugcugcauagucuugcugccaauugguugaguauugauauuaaaauuuccaaauuucuuuuuuuuuuuuuugagacggagucuugcucugucccucaggcuggagugcgcaguggugugaucucagcucacugcaagcuccgccucccagguucacgccauucuccugccucagccuccagaguagcagggacuacaggcgcccaccaacacuccuggcuaauuuuuuguauuuuuaguggagacgggguuucaccgugucagccaggauggucuugaucuccugaccucgugauccgcccgucucggccucucauagugcugggauuacaggcaugugccaccgcgcccggccccaaauuucuuuauuuuguguuuguuuuaaucuggaaaggaaucuaacugguguaaaguaauuucaaaccuuguuuugccaaccuaagcagggggacacaguuuucuagauauggcagaaaauugagacuuuacuauuuccuagugguuuuuuaugugucuuuucauuuaacuuaaaagcuuaaggggaaggaaggcuuccauuuuggaauagaaaugauacaacauuuuuuuuuuuuuuaauacggaguuucacucuuguugcccacgcuggagugcaauggcgugaucugggcucaccgcaaccucugccuccuggguucaagcaauuuuccugccucauccuccuaaguagcugggauuacaggcaugcgccaccaugccuggcuaauuuuuuguauuuauaguagagacaggguuucuccauguugaucaggcuggucuggaacuccugaacgcaggugauccacccaccucagccuuccaaauuacugggauuacaggggugagccaccgugcccagccaacugauguuuguuuuauagcaaaauucuuucuuagcuguuuaagacuuaagacagguucuuuccaugacugcaauuuaagaguagugaauugaguaauaaauuaagaauugagaguuugauccuuacuaguuuuuauuuccuccuccuacuuguuuuuuucuuuuuucuuuuauuuuuugagaccaagucucacucuguugcccaggcuggagugcaguggcacgaucuuggcucacugcaaccuccaccuccgagguucaagugauucuccugccucagccuccagaguagcugggauuacaggugcccaccaccacgcccaacuaauuuuuguguuuuuauuagagaugcgguuucaccauguuggccaggcuggucucgaacucuuugcuucaggugaucuccccgccuuguccuuccaaagugcugggauuacaggcgugaaccacugugacugccccuccccccgccuuuuuuuuuuuuuuugagacggagucuugaucuguugcccaggcuggagugcaauggcacaaucuugacucacugcaaccuccaucucccagguucaagugauucuccugccucagccucccaaguaguuggaacuacaggugcgugccaccaugccuggcuaauuuuuguguuuuuaguagagacgggguuucaccauauuggccaggcuggucuugaacuccugaccucaggugaucugccccccucggccucccaaagugcugggauuacaggcgugagccaccaugcccugucccuaccucaguuuugagugugucuuuguucuucucuuuuacuagaauuugaacagagagguggacgugaaacuuaacaggcagcuuuuuuucuuuucuuuuuuuauuauaguaaaauaaguaacuaugguagagaugcaugaauggaggaauuugacuuugauuuuuuuuuuuugagacagagucucgcucuuucacccaggcuggagugcaguggcaugaucucagcucacugcaaccuccaucuccuggguucaagcgauccuccugcugcagccuccugaguagcugggauuacagacgcacaccaccacacccggcuaguuuuuguaguuuuaguagagaugagguuucaccuuguuggccaggcuggucucgaacuccugaccucaggugauccacccaccuuggcuucccaaagugcugggauuucaggcgugagccacugcgcccgaccuuuuuuuuuuuuuuuuuuuuuuuuuugaaauggagucuuucuauguugcccaggcuggagugcaguggcacaaucagcucacacagccucugccucccggguucaagcaguucuccugccucagccuccucaguagccgggauuacaggcgugugccacuaugucuggcuaauuuugguauuuuugcaauuuuuuuuuuuuuugagauggaguuuuuuucucuuguugcucaggcuggggugcaauggcaugaucucgaucucggcucaccucaaccuccaccucucagguucaagcaauucuccugccucagccucccgaguagccgggauuacaggcaugggccaccacacccagcuaauuuuguauuuuuaguagggauaggguuucuccauguuggucaggcuggucgugaacucccaaccucaggugauuugccugccuuggccucccagagugcugggauuauaggcgugagccacugcgcagcccuaauuuugguauuuuugguagagauggguuucaccauguuggccaggcuggucucgaacuccugaccucaggugauccacucaccucggccucccaaaguguugggauuacaggugugagccacugugcccggccugauuuuuuugucagauuuuacuuauuugcgguaugccagcuugacccuauuuagguuugaaagcaaaugguuggagcuaagacuaucugauauuuccuaugcaguucaaaggaagauuuaauucugucaugccuuacaaagagugaaugagguggauagagcacguuagucuuaaaauccugauucaguucuuuuuuuuuuuuuuuuuugagacggugucucgcucuguuguccaggcuggagugcagugguguaauccgggcucacugcaagcuccgcauccuggguucaugccguucuccugccucagccucccgaguagcugggacuacaggcgccugccaccacgcccggcuaauuuuuuuguauuuuaaguagagacgggguuccaccauguuagccaggauggucucaaucuccugaccucgugauccgcccgccucggccucccagagugcugggauuacaggcgugagccgccacgccuggcccugauucaguucuuauaaaauaauuaauaccuagauuagaucgguguaguguggcauugcuugguaguuagaauaccauuuguguuuacacugaaauaaaaaguuuuaccaacuuuuaaagaguuaaaaaaaaaaagaguuaaaaaccuaagugcagcccuacacuuuuaacuuaggcuuuguucuuacauguguuguccagacugccuuuccaugcugucugccgcagauuaugcugaguugucauugguuucuuuuaauauucaguaguuacagaauaauaggguaagaggggggaugcuuaucuauccuaccucugguugguucuuuccuacauaagcaaagcaucacuuauuuugaaaugaauaauguuuuucuuuccuuuuuuuuccuuuuuuuuuugagauagggucacacucugucaccaguauaguggugugaucauggcggcagugaacuugaaccuccugggcgcacacuauccucccauccauacuuuaccucgaaaguagcugggacuacagauguccacgaccaugccugacuaguuuuuuuguauuuuuuguagagacaagaguuuugccacguaguccaggcuggucucgaacuccuuggcucaagccaucugccugccuuggccucccaaagugcugggcuuacaggugugagccaccguguucagccauuauuauuacuauuuuuuaauuuuuuuuauucucuuuauacacguccuuggugcuucagaggcguacauuguuaaugaugaauauuuuugagauaguggcccuuuaaaaaagcaaccuuuauuuugaauguuuaauccaauguauuuaaucagaucugaaaauuugugguugucauuggcuuaacugucacuucagaguugacuucugucagaaaacuguguuauguuuucauguggaauagguaauuuuacugaacagggugucuugauaugccuuucauuuguuuucacuggugauucuauguucugcuuuuuuuaugcuuuagaucauuguaaaaaaaauauggugaaugcuuugugguuuuguuuuguuuuguuuuuuuuuuuugaaacaaggucuugcucugucacacaggcuagagugcaguggcccugauguuggcucacuucaaccucugccucccagacucaagugauccuccccccucagccucaucaguugcugggaauacaugugcacaucaccacgcuugagcccaggcuggucucuaacucuugugcucaagcagucuuccugccuuggccucccaaagugcugggaucacaggcaugugccuggcaaugcuuugugauuuauuuauuuaauuauuauuauuauuuuuuugagacggagucucgcucugucacccaggcuggggugcuggagugcaguggcgcgaucucagcucacuacaagcuccgccucccggguucacgcccuucuccugccucagccucucugaguagcugggauuacaggcgcccaccaccacgcccggcuaauuuuuuauauuuuuaguagagaugggguuucaccguggucuugaucuccugaccucgugauccgcccaccucggccucccaaagugcugggauuacaagcgugagccaccgcgcccagccagugauugauugauugauuuuaguuuuauuuuuuauuguauuuugagacagaguuuugcucuugucacccaggcuggagagcaauggugugaccuuggcucacugcaaccucugucucccagguucaagugcuucuccugccucagccucccgaguagcuaggacuacaggugugugccaccaugcccagcuaauuuuuuuuuuuuuuuuuuugaagacggagucucacucuguuccccaggcuggagugcaguggcgugaucucagcucacugcaaguuccgccuccuggguucacgccauucuccugccucagccucccgaguagcugggacuacaggugcccgccaacacgccuggcuaauuuuuuguauuuuuaguagagaugggguuucaccauguuagccaggauggucucgaucuccugaccucgugaucugcccgucuuggccucccaaagugcugggauuacaggcgugagccaccgcgcccggcugcuaauuuuuguauucuuaguagagaugguauuucgcuggcugggcaugguggcucacaccuguaaucccagcacuuugggaggccgaggcaggcggaucacuugaggucgggaguucaagaccaaccuggccaacaugaugaaaccccucucuacuaaaaacacaaaaauuagcugggcgugguggugcaugccuguaaucccagcuacucagaaggcugaggcaggagaauugcuugaacccaggcugcaaagguugcagugagcguagauggcaccacugcacuccagccuaggugacaaagugagacucugucucaaaaaaaaaagacgggguuucacuaugguggccaggcugguuucgaacucuugaccucaggugauugacccgccuuggccucccaaagugcugggauuacaggcuugagccaccgcacccgaccaaacacugauuuaauacuaggcaauauuugcuucagguacagcuaaagccucauucccgccuucuuucuucauuaauucacaguugguuuauauuauuucugugauaguuugcaucuucugagaagcagaugacaagacagaauuagaugugcaagagguucauuaggguaugcuugugaaggauaaagagaggaaggagguguagguggcaagagccuuuacacuggaagcaugugugacaccugugaaagaagagagggaaggaaugaugauuaaugauugauagaggaaccucaaacugcagugcagcuugcaguucagagaaaaucucagccagaguagauuguuagaagagucuguugggcaggaaugguccuucuuugugaacaucugcuguguucagucauuggcugggagcagccuagaguagccuagccuugguaugggugcuguaguagauuucugguagcuggggcugucaguuaacuacacuccuugcaacauuuucucucuugaagggaaaucugaguggcacacucaaggcugucagaauucccauacguguuuuuguacuuaaauacauguguguaauuccagcacuuugggagggugaggcgggaggaucaccugagaucaggaguucgagaccagccuggccaacauggcgaaaccccgucucuacuaaaaauauaaaaauuagcuggguguggucgcggguaccuguaaucccagcuacuugggaggcugaggcgggagaauugcuugagcccgggaggcggagauugcagugagccgagguugugccacugcacuccagacuggacgacagagcuagacuccgucucaaaaaaaaaaaaaaagugauaauauguuuucuuguuauuguuaguguuuuuguaaauggaauaaucuaugcuauucauguacuuuuaugcuuuccaaacaaguacauuuccacuagcaagguaaacaacuuuguuuucaccuugucuucgucaugguguuaguuagguuauuaauuuuuuuuaaaugcuauccuuuaauggcuuauauuagcauuuuuuucuuuucuuuucuuuucuuuuuuuuuuuuuuuuuuuggagauggaguuucgcucuuguuuuguuccccaggcuagaaaugcagugacgcagucuccucucacuguaaccuccgccuccccgguucaagugauuguccugccucagccucccguguagcuaggauuacaggcaugugcuaccacgccuggcuaauuuuaaaaaauauuuuuaguagagaagggguuucaccaugcuggccaggccgguuuugaacuccugaccucaagugaucucccgcaucggccucccaaaguccuaggauuacagacgugauccacugugccuggccucuucuuucuuuuuuuguagacuugauaucguucugccucuuaggcuggagugcaguggcaugaucacagcacacuacagccucagccuccagggcucaagugauccuccugucucaguuuccugagaagcugggacuacaggcaugagccaguaugccugacugauuuuugaacuuuuuguagagacgggguuuugccaaguugcccagacuggucuccaacuccugggcucaaccaguccuucugcuguguccucccaaaguguugagauuacaggcaugagucacugugccuguaauuaaguuuuccaauuaaugaugagguuaagugucuuauguuuuuaauuuuuaauuuuuaauuuuuuuaagaccuuuuuuuuccccuuuuuugagaugaguucuuacucuugucgcccaggcuggagugcaguggcgugaucauagcguacuguagccuugaacuucuagggcucaagugaucuucauaccucaguuucuggaguaguuuggacuacaguuguucaccaccacacccagcaaagaaugugacaaaaaguacuaaguguguuuuagcuaaguaucgauaagaaaagagugucuuuuuauuuauuuuuuauuuguuuauauguacuuuuugagacagggucuggcucugucauccaggcuggagugcaguuguguaauuuuggcucccugcauccucagccucucaggcucaaguaaucuucccaccuuggccuccggaguagcuggguuuauaggcucuugccacuaugcccagcuaauauuuguauuuuuuguagagaugggguuucagguuuuguuggucuuaacccuggcccaggggugucuguaaauuuuuuuuucuuuuuuuugccacucaguuuccuccugugaauguaucuuucuuuugcuauuuuucuuuuuuuucccccuuagggucuugcucuguugcccaggcuggagugcgguggcuuaaucucagcucacugcaaccuucaucuccugggcucacaugauccucccaccucagcuuccgagguagcugggacuacaggagugugccaccacgccuggcuaauuuuuguguuuuuuuguagagacaggguuucaccauguuuccuaggcuguuuugcuguuuuucuauaggguguugguuuuuauagguuuugguuuuuuguauggauuugugugaguucuuuuuauuuauauauuuggauauucuuuguuagaauugcacauauguuuuuuguuuuuucuuuaauauuauguguguugcggggaggaggauugaguuuauuugacuaggaagggauaaaaauacauuccugacuggagacuguacucagagauuggucuugguguauaccccugauuucuaagaugaauguuacugagaauugacaauuuuuuuuguugauuguuguguuuccacuaaguuauucaucucauuuuggccugcuauuagcuaguugacccaaaucacagugcuggaugacuugaaaagcucugauuuaauuuuugccuaguauauaguuauaguagcauauagguuaaagguuaaaguuacagcuuugauccuauaauggucaguuaguuucccacgaaagguuaaaaugcuauagacuaaaacuaacagcugucuuagggauuugccacuccuuauaaggcaauggguaguguguggauagggagguacaacuugucaucacuaacaaaacccucgaaagaaugaucuauccagguugcuuacucugugccaggcuaguuuuaacacacaucaaaucauuugacccucacaacagucauaugauguaaaguuacuaucuccauuuuccagaugaggaaacagaggcauugagaggcuuagucuuaugguugaaccuaauaacuugccgugguaauccaguccgagaggcccucagcuguaagaggcaccuuuauuuuauguuucaguaagaaaggaaaaggaucaacaagauagacuguuaauuuuaaguauuauaagaauucugauuuauaaguauaaucagaauucaauuuaguguauuuuagagagggucagccagaauccucuuuaagagaaaacacuuaggcugggugcaguugcucacuccuguaaucccagcacuuugggaggcugaggcagguggaucucccaaggucaggaauucaagaucagccuggccaaaauggugaaacccugucucuacuaaaaauacaaaaaauuagccaggcuauaaucccagcauuuugggaggcugaggcgcgagaauugccugaaccugggagguggagcuacagugagccgagaucgugccacugcacuccagccugggugacagagcaauauuccaucucaaaaaaaaaaaaaaaaaaaaaaggaaaagaaaaaacacuuaggagcaagacuuuauuggauccauugauuaguuguuuccauguggccccagguguuggggaauuuuauguuucggguugccagagccaacuuguaguccaguuacauuccucuucuuccuggcagugagaacaccggugaaaugggaggugguuagcuugguugccuggggacaaauuggacugaguugcuuuauuccugcauguauguugaaauagucaucuucacaacuuagaauauaguuggaguuuuuuuuagaagagccauuuauuuugauggugugacugaaggcuauacauacagucauguauugcaaaacaaaugucauuuuggucaaggacaguggucccauaagauuauaauggaacuaaaaaauuucugucgccuaguaacuucaccuugucuauagugcaacagcguguagcauuacuuagguguuugugugguguugguguaaacaaaccuacugcacugccagucuuacaaaaucuagcacauggaguuauguauaguacauaguacuugguaaugacaauaacuguauuacugguuuguggauuuacuaugcuauacuuuguaugguuauuuuagaguguauuccuacuuauaaaaauuaucaguuugcuguaaaacagccucaggcagguccuucaggagguauuccagaaggaaggcauuguuacucuagaauaugacaccuccaugggucuuauugccucugaagaccuuccagugggacaaggaagguauggaguuggaagauggugauauugaugauccugacuguaggcuaggccaaugugugugucuuugugguuuuuuuuguuuuuguuuuugaaauggagucucgcucuguugcacaggcuggaguccaguggcaugaucucggcucacugcaaccucugcuucccugcuuccagugauucuccugccucagccucgugaauagcugggauuacaggugcgcgccaccaugccuggcuaauuuuuguauuuuuaguagaaauaggguuucaucauauugggcaggcuggccuugaacucccgaccucaagugaucugccugcuucggccuccgaaagugcugggauuacaggcaugagccaccgugcccggccuaauuuuuguauuuuuaguagagacgggguuuugccauguuggccaggcuggucuugaacuccugaccucaggugauuugccugucuuggccucccacagugcugggauuacaggugugagccacugcaccugacuguauuuacacccauacucucccugaagguuguaguuccugcccugcuuuacuuuuacuggcauagaagcugcugggcuugguguucugcuuucaaacuuagcguggauauagggaguucagcggggaggaagagaagaguaggugcuuaacuaguuuugaucuuacucaguaccagagaguguucugggagcuaguggugucauguaugucugauuucuuugagggugguagcguaguuuuuugaaccaccaaaucagguuuuaaguuuuuuuuuuuuuuuuggaggggagauagggucucacccugucccccaggcuggagugcaguggcgggaacauggcccacugcaugcagccuugacuucuugggcaccagugauccuccugccucagccucccagguagcugggauuacaggugugaggcacugcaccuggcuguuaaguauuaucuaguauaaacucgucagagcuaaauaggggcugaauuuucuaagaauaugugcuugguuugggucuuuucuugaauaggcuuuuguuuuuguuuuuuugauuuuuuuggguuuuguguuaguuuuuuuuuuuuuuuuugagacgaagucucacucugucgcccaggcuggagugcaguggugugaucuuagcucacugcagccucugccucccggauucaagugguucuccugccucagccucccaaguagcugggauuauaggcaugcuccaccacgucuggcugauuuuguauuuuuaguagagacgggguuuuuccauguuggucaggcuggucucgaacuucuaaccuuaggugauccgucugccuuggccucccaaagugcugggauuauaggcgugagccaccgcgcccggcugaguaggcauuuuuuaauggacauuugauaaggaccaagugcaacuguauaucaaauggaaaucuagggaaaaauugucuuuuaaauugcaguuaaaagcugauuaucccuauugucucuugcuuuccuuauaaugaauuuguauaaauuggagaugcacaucuugcauagauguguuuucuuuuuuuuauauaaaguggugcaagucacaucacaaaauugacuauuuuuuggccagguguggugacucaugcguguaaucccagugcuuugggaagcugaggcaagugggucaccugaggucaggaguuugagaccagccaggccaauauggugaaaaccugucucuacuaaaaauagaaaaaagcuagccaggcgugguugcucaugccuguaaucccagcacuuugagaggcugaggugggcagaucacgaggucaggaguuugagaccagccuggccaacaugguaaaaccccauaucuacuaaaaguauaaaaauuagccgggugugguggcaccugccuuuaaucccagcuacucaggaggcugaggcaggagaaucgcuugaacccgggagguggaggcugcagugagcugagaucgugccacugcacacuagccugggcaacagagcgagacucugucucaagaaaaaccacaaaguacaaaaaauuagccagguguggcggugcacgccucuaaucccagcuacuugggaggcugaggcaggagaauugguugaaccggggaggcagagguugccaucagccgagaucacgcuacugcacucaagcccgggcgaaacagagagacuccaucucaaaaaaaaaaacaacaaaauuaaccguuuuacaaugaacaauucaguggcauucagugcacucgcauuguuguggagccacugcccuugucuaguuccgaaacauuuucaucacccuaaaaagaaaaucucacauguguuagaaugaagaaugaguuacuucuuauucuccauucucaguaccaggcaaccacuaaccugcuuuuuguuucuggauuacuuauucuggaacuuucacguaaauggguaugugaccuucaugucuggcuucuaucacuuaguguaauguuuucaagguucauucauguugaagcuugagucaguauugguacuuucugugcuucauugcuuuuguuuuguguuguuguuuuuuuuguuuugccuuguuuuuguuuuuugagauggagucuugcucugucguccaggcugaagggcaguggcgugaucucaacucauugcaaccucugccucccucguucaagcgauucuccugccucagccucccaaguagcugggauuauaggugcgcaccaccaugccuggcugauuuuuguauuuuuaguagaaaugggguuucaccauuuuggccaggcuggucuugagcucccgaccucaggugauacaccugucucggccucccaaagugcugggguuacaggugccuggccuaauuuuaaaauuuuuuuuuuguggagagacgggguuuguuuauguuggccaggcuggucucuaacuccugaccucaagcacuccuccugccucagccucccaaaaugcugagcuuauaggcaugagccacuacaccuggcucauucauuuguugauggacauuuagcuuguuguuaccuuuugauuauugugaaccgugcuguuauguacauucauguacagguauuuaucuguuuucauccuuuuagggguauauaucuauuaguggaauugcuggguuauggaguaauucugugcuucacuuuuuuuuuuuuuuuuuuuuuuuuaaauuuuuauuuugagacaggcucuugcucuguugcccaggcuggggugacagugguaugaucucagcucacugcaaccucugccucccggguucaagcaauucuccugccucagccuccugaguagcugggguuacaugugcaugccacuacaccuggcuaauuuuuguauuuuuaguagagauggagaaacauguuggccaggcucgucuugaacucccgaccucaggugauccgccugccucggccucucaaagugcugggauuacagaugugagccacugugccuggucugugcuuaacuuuuugaggaaccauuaaauuguuuuucacaguagcuuaaccauuuuauacuccaugauuaacguaugaggguuucaauauucuacuuuuuauuuucuguuuuuugagauggagucucacucuguuguccaggcuggagugcauuggugcgaucucggcucacugcaguuuccgccuuccagguucaagugauucuccugccucagcuuccugagaagaugggauuguaagcauguaccaccaaguguggcuaauuuuuuuuuuguauuuuuuaguagagacaggguuucaccguguuggccaggcugaucaggcugguccugaccucaggugaucugccugucucggccucccaaagugcugggauuacaggcgugaaaaugcuacugaugacagugcagagaguccugagaugcuuagaguaguggaguuacucgauccuucccugugguggaggguugggaguugaagaaaccaggaaguccuauaugaaaugguccuuuaaggccgggugcaguggcucaccccuguaaucccagcacuuugggaggccgaggcaggcagaucacgaggucaagagauugagcccacccuggacaacaugacaacauggugaaacccugucucuacuaaacauacaaaaauuagcugggaguaguuccagcuacucgggaggcugaggcaggagaaucgcuugaacccuggagguggagguugcagugagccgagauugcgccauugcgcuccagccugggcaacaagagcgaaacuccaucucaaaaaaaaaaaaaagagaaaucguccuuuaagucaagccuuaaaacguaggaauuaccuaguuaauuugaauauuaauauuauaugauauauaagcuguacauguuauaaaaauuauuuugaaaaguuuaaucuuuaaaauuuuaguuuagauuuuccuuguaguuaucuagagcugugcuguccaauaguguagccacuagcuacauauaacuauugaaauuuaaauuaauuaaaauuaaauaaaauuaaaaauucaguccuucuguuacacuaggcacauuuuagauauucagccaucauauauagcuaguaggugccauauuggacagcucagaauagaguauuuuuauccucccagcaaguucaguuggguggcaaugaucuagacauuuugaugaaaugaaagcuucauuauuauugcuauuauuauuauuauuuuugugugugugugacagagugucgcucuguuccccaggcuggagugcaguggcgccaucucagcuuacugcaagcucgcccacccgcguucacaccauucuccugccuuagccuccugaguagcugggacuguaggcgcccaccaccacgcccggcuaauuuuuuaguagagacgagguuucaccguauuagccaggauggucucaaucuccugaccucaugauccacccgccucagccucccaaagugcagggauuacaggcgugagccaccgugcccagcccaaaagcuucguuauuauuaauuuuuauaauucagacguuuugccucuuuugucaagugcaugaaauuugagauggguacagcugagaaauguaugauggcugugugcugaauuccucuagggguguauuuguuuaaauauugccaauaagguguucaaaauaagguuauuugaaagagcaaguugaaauggaaagcuuaggagagcuuaguuuuuuguuuguuuguuuuuuugagauggaguuucgcucuuguugcccagacuggaguggaauggugugaucuuggcucacugcagccuccgcccccacaccauucaggcgauucuccugucucagccuccugaguagcugugauuacaggugcucaccaccacgccuggcuaauuuuuuguauuguuaguagagauaggguuucaccauguuggccaggcuggucucuccugaccucuggugauccucccacuuuggccucccaaaguguagggauuacaggcaugagccaccaugcccggccucagccuauaguucuuuuaaugcccuugucuacuaauucuaucaucugugucauuucugggucaguuucaguugcuugauucuuuuuuuucuuccucuuuuuggguugucuuuuccaccuacuuugcuuaucuguugauuuuuggaugccagacaucaugaauuuuacuuuguuggaggcuggauauuuuuguauuucuauaaauauucuugaguuuuguucugagaugugguuaaaauacuuaaaaauaguuugaugaagucuugcuuuuaagcucuguuaggugagaucaaaaccauuuuaguguagggcuaaguauuucccacuauugagucaaaauccuuuuggggauucugugugauagcccauggacuaugugguuuuccacucuggcugugaggaacuggcacucuuccuguucccaugugagccuuguggauuguuccauuugauucuuuuggguauuuuauuuauauuuuuagagaaggugucuugcucugucacucaggcuggagugcaguuuugugaucauagcuccuugcagccucaaacuccugggcucaagccaugcaccccauauagcuggggcuauaccaugccugguuauuuuuauuguuuuagagauagggucucacuguguugcccaggcuggccuugaagacuccaggguucaagcgaucaucccuccucagccuccccaguagcugggauuacaggauuuugccaucacaucuggcuaaggggguguggaaccagggacaaagaccaaauacauauuucauaauauacuacacaagguaaaucugguucaugucacucuaccuugacuggaagcauaaguauagauuuugccauguugcccaggcuggucuugagcuccuagccucaagcgguccccucuucccaaaccuuggccucccaaaggugcuaggauugcaggcaugagccacugcacuuccugaguagcugggauuacaggugcgcgccaccacgcccgcuaauuuguuuuggauuuuuaguagagacgggguuuugggccaggcuggucuugaacuccugcucuuaagcgaucugcccgccucagccucccaaagugcugggauuacaggugugagccaccacgcccggucugauuuuuguauuuuuuguagggauggggguuuccccauguuacccaggcugcucuugaacuccuggcuucaagcaauccaccugcuucggccucccaaaguggugggauuucaggaguaagccacugcacccagccuuguucauuucaauauuccugaugaaguacuccaucugaucucauuugcucuuagaaaucugcuugcugguuacccugugcaguggcucacacuuguaaucccagcacuuugggagacugagguaggaggauugcuugaugccaggagcuagagaucagcuugggcaacauagcaagaccuugucucuacgugcaccuguaguccuggcuacuugggagguugagaugggaggauugcuugaacccauggguuugaggcugcuaugagguaugaucacaccacugcauuuuagccugagagacaggagacaguaucucuuagcaaaaaaaaaaaaaaagaaaaaacaaaucugacuaccguauugaugauucuaguccagaauuuuccaaaggaguauaggugguuuuuuugguuguuguuguuguuuguuuuguuuuuugagauggugcgagucucgcuuuuuuuguuuuguuuuguuuuuuugagauggagucuugcucugucgcccacgcuggaaugcaguggcacaaucucggcucauugcaaccuucgccucccggguucaagcaguucuugugccucagccucccgaguagcugggacuacaggcgugcgccaccacgccuggcuaaguuuuguauuuuugguagaguugggguuucaccguguuggccuggcugguaucaaacucaugaccucaggugguccgccauucucagccucccaaaguuuuggaauuacaggugugagccaucgcaccuggccuuuuuuuuucuuuuuuaaacauauuuauuuaucauuuuuuuuuuuuuuugagacggagucucguucugucgcccaggcgggagugcuguggcgcgaucucugcucacugcaagcuccgccuuccggguucacgccauucuccugccucagccucccgaguagcugggacuacaggcgcccgccacugcgcccggcuaauuuuuuguauuuuuaguagagacgggguuucaccauggucucgaucuccugaccucgugauccgcccgccucggccucccaaagugcugggauuacaggcaugagccaccgcgccccgccauccuuuuuuuuuuuuuuaaagagguggaguauaacuauguugcccaggcugaucuugaacuccuggccucaagcaguccucuaccuuggccucacaaagugcugggauuacaggagugaaccaccgcgccuggcugagauagguuguuuuuugaauuaacuauucuuuuuuuuuuuuuuuuuuuuuuuugagacagaguuucgcuguuguugcccaggcuggagugcaguggugcaaugaucuaggcucacugcaaccucugccucccagguuuaagggauucgccugccucagcuucccaagcagcugggauuacaggcaugugccacuacacccggcugauuuuguauuuuugguagagacgggguuucuccauguuggucaggcuggucuugaguucccaaccucaggugaucuacccuccuuggccucccaacgugcugggauuauaggcgugagccacugcacccagccauguuuuuaagauuuuuaaacaucuggcucuuuuuuuuuuuuuuuuuugagacggagucucgcuuugucaccuaggcuggaguccaguggcgccaucucggcucacugcaagcuccgcuuccuggauucacuccauucuccugccucagccccccgaguagcugggacuacaggcacccgccaccaugcccggcuaauuuuuugcauuuuuaguagagacgggguuucaccacguuagccagcauggucucgaucucuugaccucgugauccgcccgccucggccucccaaagugcugggauuacaagcaugagccacugcacccagcccuucuggcucuuuuuaaaugucagauauugauaacucccagacugaauuaagauuuuauaugucagaugauuaacuaucauuuugaguuguugcuuaguucucugcuugcuuggcaacaggucaguuuccaugguauugccauuuuuguaccgcauucuuaguggagcugagagguugggggugaggcuacagggccgaacucuauaaacuagaauagcuaaacuuuuauccaguuugguguauaaaauuuuuugauauacagcucaggaaaagcauauaaaaaacaaaaauaaaaauaauuucugaauaauuuuuuuuuuuuuuugagacggagucucgcucugucgcccaggcuggagugcaguggcgugaucucggcucacugcaagcuccaccucccggguucauaccauucuccugccucagccucccgaguagcugggaguacaggcacgugccaccaugcccagcuaauuuuuuguauuuuuaguagagacgggguuucaccauguuggccaggauggucucgaucucuugaccucgugaugugcccgccuuggccucccaaagugcugggauuacaggcgugagccauagugcccggcccccccgcccccaccuuuuuuugagacagagucuuauucucacccagccuggagugcaguguuaacgaucuuggcucacugcaaccucuuccuccugggcucaagugauucuucugcuucagccucccaaguagcuggaacuacagguguaugucgucaugccuggcuaaauuuuuuuuuuuaauauuuuuuaguagagacgggguuucaccauguugucccagcuggucucgaaccccugggcucaagcaauccacccaucguggccuccugcagugcugggguuauaggcaugagccaccuuggccugcauaauucuuuuuuuuuuuuuuuuuugagauggaguuucgcucuugucgcucaggcuggagugcaauggugcgaucucggcucaccgcaaccuccaccuccuggauucaagcaauucuccugccucagccucccaaguagcugggauuacaggugugcaccaccaugccuagcuaauuuuguauuuuuaguagagacaggguuucuccauguuggucaggcuggucuccaacucccgaccucagauuaucugcccaaccuuggccucccaaagugcugguauuacaggugugagccaccacgccuggccauuaauucuuuuuuaagaaagaguuucauugcuauuaaacaaguuugaaaaucacaguuucugcuugaguagaaaauacaaacuuggguuucuaccacuacacuuucacaacaugcuuuugacuccagauuugaggggggauuucuccccaacaggagguaggccaucaguucugcagugggcagcagcugggcauccucuaauugaauucaguucugacacugucuacacuacccgcuuagagauggauggugacacaucacacagguugaggacucaguccuaucuuugauagugaacguaaaccuucauuuauuuugucugugguucugaccagccagcugcaaauuucaagaguuccugcagauaccuccuugacuucaauuacuuugcuagaguaacuuacagaacucagggaaauguguuuauccauuuauuacaaaagauacauguguauauguguguguguguguguguguguguguguguguguguguguguauguguguguguguauauauauauuuaaauuuuauuugaguuagggucuuuccccaguugccaaggcuggagugcaguggugcgaucacagcucacugcagcuucaacuucuuggacucaggcuauccucccaucucagccuccugaguaggugaaacuauauacacacagcaccaugcccagcuaauuaaauuuuuuuuugguagagauggggucuugcuguauugcccaggcuggucuugaacuccugggcucaagcaguccuccggccuuggauucccaaagugcugcaauuacaggugugagucaucauguuuggccuacaaaggauauuuggaaggaugcaaauaaacagucaggugaagagauacauauagggccaggauugaaauggucccuagcacuggcacuucugucuucuuggaguugggaugggccacccuccccucacauggcugugcuucucuuuacuccugcaaucccccauguguuuggcucccuacaagccauguucagcucccugcaagcucucugaacccaauccuuucagguuuuuaugaaggccucauuacguagggaugacugauuaaaucuuuuggccauuggugaugaauuaaaaguucagucccucuccccuccuuggagguugaggugggaguugaaaccauuugucauccuaagcuaacaaacgguugccagcuauuggucaacucauuggcauacaaaaagacacauuacuuugaagauaccgaggauuuuaggaguugaagggccaggaaacaggaaggccaaauauauauuucacaauaucacaauauguuauuaagagcaaauagugauagaaaagugaaagugaugauagcagaaauguaaaguguagguucuauaaacagugcagaugagaacaaagcuaacaguuaucaggcagucuaaaugcaugcaguuuuuuaccuuagacacauucguucguugacuguuuaauuguaaagaaaaaucaauuuaagaacauguaugaaauugcauuuauacucuggaaaaaugagauguaaguagguauuuuguauuuuuuagcguuucaagagcauaauuccccuuaugguaugucuguugccuugcuuucacacauuccacuuguguacauguuuuugggaacucauuauguaagaaaguaauggacuucuuacacuucuguuagguaaaaccauaguaauuggcugggcaugauggcauggggugggaggaucacuugaggacaagaguuugagcuugcaguacacugaucuuugcugugaauagucacugcacuccagccggggcaacgaagacacugucucuuucuuuuuuuuuuuuuuuuuuuuuugauggagucuugcucugucgcccaggcuggagugcaguggcacagacuuggcucacugcaaccuccacuucccagguucaagggauucuccugccucaggcucccaaguagcugggacuacaggugccugccaccauaccuggcuaauuuuuguauuuuuaguagagacgggguuucaccauauuggccagacuggucucgaacuccugaccuugugaucugccugccucggcuucccacaguccugggauuacaggcgugagccaccgugccuggcccaagacucuaucucaaauaaaaaagaacacaguaauuuuucucuuuuaugggauacuacacuuacauaaguuucuuuuuuuuuucuuuuuuuuuuuuuuuugugagacagagucuugcuuuuccccugccaggcuggaguggaguggcaugaucucagucacugcaaccuccgcuuccuggguucaagugauucccgugccucagccuccugaguagcugggauuacaggcgugccccaccacgucuggcuaauuuuuguauuuuuaguagagauggggucucaccauguuuucccaggcuguucucaaacuccugagcucagguggauccccccugccucggccucccaaaguguugggauuacagucgugagccacugugccugucugggauguuugccauauuuguuucaucaguauauauuucuuugcuuggguugaguacagggacugaugccuguaaucccagcacuuagggaggccgaggugggaggauuacuggaacccaggaaguugaggcugcagaccaaccuaggcaacagagugagaccaugucuucagggggaaaaaaaaagcgcugggcaugggcauauaccuauagucucagcuacucuggaggaugaggugagaggaucgcuugagcccaggaauuugaggcugccaugagccgucaucaugcccaugccaauguacuccagccugggcaagaaagucgacccugucucaaaacuaaacuaaacaaauuucucuggcugaaguuuaguaauuugcuuuuaagugacguuuguacauuuuagaaaauaacuuuguauauuagacaucauuuaugguacuuaccguuuuccauggucauaaaauaccuagucuagugugauaaaugccaggugauagagguaugccuggggcauaaaccuaggggcuuggugggauggggugagaugguugaaauaguauguagaaggaaaggcuuuccagaguuuacucuuaggguggcucuugaagggcaagugaaggaaagacauuucaggcugagggaagacacguuuagauggaguccuguggauggagagugcuggacuuguuugcgaagucaggaguaguuugauaugaucagaugcuuagggaggugauugguaaagugguggaaggugagauuguggaacagguaggcauggacccuaucacaagcguccuggcuuguguaucuagcuaaaggaucugucugucugucugucugucuuuauauuuuuugagacggaguuucgcucuuguugcccaggcuggagugcaaugaugcaaucuugguucauugcaaccuccgccucccagguucaagugauucuccugccuuagccuucuaaguagcugggauugcaggcgugcacuacacgcccagcuaacuuuuuauuuuuaguagaguugggguuucaccauguugguuaggcuggucuugaacuccuaaccucaggugauucaccucccucagccucccaaaaugcugagauuacagaugugagccaccccaccuggcccaugccucuaucuaucuaucugucugucugucuaucuaucuauucuaucuaaucuuuuuuuuuuuuuuuuuuuuuuuuggagucagguucuugcucuguugcccaggcuggacuguaguggcgugaucuugccucacugcagccucugccucccggguucaagcgaucuuccugccucagccucccugguagcugggacuacagaugugugccaccaugccuggcaaguuuuuauauuuuugguagagaugggguuucacuauguuggccaggcugaucucaaacuccugaccucaggugaucugcccaccucagccucccaaagugcugggauuacaugcgugagccacugugccuggccuguuaaguauuaccauaaacucuucuccuaucugucuuguaaguuauguacaccucaucuauguucuugauguagcuuguuacuuagucuguuauaguaauaaucucuuuaauuauuagcuuuuaugucuucuccauuguccacugacagccauaacugcguauaucuuuuuguauaccugucuacagaccagccauccuagguugaagaauagaauuacuucucauugcuuccacaguuccugucuuccuuuaaaucaucauguauaacacaaauuauacaguagcuuucuuguaaaucuccugcuucuguauuuuauaucuguuaggcugggugcagugacucacuucuguaaucccagcacuuugggaggccaaggugggaggauugcuuaaggccaggaguuugagaccagccugggcaaaauagggagacaccccgucaccacacacuuauacacacacacacacacccccccacacccaccaugaaaaaaauuagucgcggcggggugcgguggcucacgccuguaaucccagcacuuugggaggccaaggcaggcagaucacaugaggucgggaguucaauaccagccugaccaacauggagaaaccccaucucuacuaaaaauacaaaacuaucugggcgugguugcacaugccuguaaucccagcuacccuggagucugaggcaggagaaucacuugaacccgggaggcagagguuguggugagccgagaucgugccguuguacuucagcaucaacaagagcgaaaccgucucacaaaaaaaauuagucgggcacaaugguaugcaucuguggucacagcuauuugggagacugagcuaggaagauugcuugagcucaggaauucaaggcucagugagcucugauuguggcacugcacuccaucccgggccacagagacucuguuucuaauaaauaaauaaaauguaaauuagcuguuccucuguggcuuacaaccuuccaguggcucccauuucacuuagaguaaaagugaaagcccucaccgugguccccuccuuuuuugcugcuccauuacucuuucuuuaucuccuucacuucauucagaucauugcucaauaaggccucuccuaaccuaccuaucugcaaguaucucuagaauaugacuuaaaaacaaucuaaacacagaugucacaacuaaaaaaaauuaauacuuaguccuuagugucauuaaauuucuggucaccuauuguuaaauaguugcuuuguuugaaggucacugcaaccugcauuuccugagcccaagcuauccuccuguuucagccucccgaguagcagagacuacaggugugcaccaccaugcccagcuaguuuuuuagaauuuuuuguagagacaggaucuaacugcguugccuaggcuggucuugaacuccuggccucaagugauccucucaccuuggccucccaguaugcugggauuacaggcacaagccacuacaucuagacacgaauuucugauuuaaauaauucuuuguaagaacacuucuuaggaggcauuugaauggauaacugucuuaacugucuugcacaccagucuuugucuuuuuuuuuuuuuuuuuuuuuuuuuugagaaaaggucuugcccugucacccaagcuggagugcacuggugcaaucacagcuuacugcagccuugaacuccugggcucaaaugauccucccaccuuggccuccaaaguguuuggauuacaggcaugagccacugagcccagccucagguugucuuucuccugcuuuacuauuucauuuuuuucuuuucgucuucuagcguacuguaaauuuacauauauuuuaaugucuguacuagaauauaagcucaacaaggguagggcucuuuguguguagacauugcucaguacauaguuggcacgaaauaaaaucacuuaaaugaaugaaugagugaaauacaaaggcggaauuugacuguaaaacagucuuguuggagaagguauauggggaauaggggaaagagagggccucuuuucgcccuccuacauugauacagauagaucucaguuggucucugaucuuguuuguagggauuuuguuggaugaaugcaaggugggauggucuucagauuguaccaauuuagcuggcauugcuaaccaacuguuggaaucucugaaaauaaaagaucuugaaauuccucccccucuccccgcaaagagaaauacgaaggcagacaacuggguaaauuguccuaccccuaacugccauccacagaaaaguaacauuuuguuuuauuugauuaacugugcuugacaacauuagaaacaguggaaaaucaucugggacuugggcagguagaaacuccagagguaggacuggaggaggggcuguguaaccucucuuucuuacucuuaagaauaaccuuuuuaucuacccgagauuuauuggcuccuuaaaaucauaacuaaaaccuguagccucuuucagcagaaagcaaugcuuagaguaagacuucuacuacacugccagcccgaaggcuugaacagaaggcaaguggaagcccuaaaacuuuggcuguuccuggcacgauuccagucccacucucccuacccucacccacagcuuccccaucacugucugcuugggaaccgugagcauuguucucaucuugugcuucuuucugaguuaucaggcagccggaaggccagauucccuugucuucccucuuuucauggacucugcauuuucuuuucugauccuguuuuucaccuugaucuucuuggaacuuuucccugagcccuuuuaaacucacgguauaucagcaaaauuccccuaaucuucaguuucuucugugauuuccgccccccgccccacacauucuuauucugacugaaaauaggccaucuccugaugacacugccucccugcagcccuccgaaagaguacuugccugccccuccaucccuuuuguguuacuaggcuucacaguagcauguccucuuuuucuuuguugccauuucuuuacuuuucuucucgccucccuaaaaacaccucugaaugugaugucaugaguuuguacuaugcgcuccugauuuuugcugcuuaauccagugugcuguggaggauugaaccucuuaugauggaguuccccucuuuaacucuaguaaugcuucuugccuuaaagucugcuuugucuaauaucaguauagcuaugccaguuuucuuuuuguucguguuugaauggcaucuuuuucugucuuuuuuauuuucaaccuuucuuuauucuugaugucuugguuaugucugaacagguuuucauccacaucuuaaaagcacaucuuugcuuuuaacuugcauuuaguuucauucacaguuucauuuaauguauuuauugauauaucuguauuuagaucuaacucagagauuucuauuugacccaccuguucuguguggguuuguuuuguuaguccuuuugaucuuccuuugcauugauuuaguauuuauuguuauucuucccucuuccuuagcuugguaauugugugcuauuuggaaaaaauacuauucucugaguaguuauccuagagauaacaauuuacuuccuuuauuuauuuauuauuuauuuauuuauuuauuuauuuauuuauuuauuuugagacggagucucgcucugucgcccaggcuggagugcaauggcgcgaucuuggcucacugcaagcuccgccuccuggguucacgccauucuccugccucagccucccgaguagcugggauuauaggcgcccaccaccacgccuggcuaauuuuuuguauuuuuaguagagacaggguuucgccauguuagccaggauggucuugauccccugaucuccugauccacccaccucggccucccaaagugcugagauuacaggcgugagccacagcgccuggccaacuuccuuaauuuauuaaucucauguugacuuggcuucucaagaaggcuuaagaauccuaaagggaagcugggugcgguggcucacgccuguaaucccagcaguuugggaggccgaggcaggcggaucaugaagucaggagaucgagaccauccuggcuaacacggugaaaccccaucucuacuaaaaaaaauacaaaacauuagcugggcaugguggcgggcaccuguagucccagcuacuugggaggcugaggcggguggaucaugaggugaggagaucgagaccauccuggcuaacauggugaaaccccaucucuacuaaaaaaaauacaaaacauuagcugggcaugguggcgggcaccuguagucccagcuacuugggaggcugaggcaggagaaugacaugaaccugggaggcggagcuugcagugagcugaaauugcgccacugcacuccagccugggcgacagagggagacuccgucucacauaaauaaauaaauaauaaaauaaggcugugcaugguggcucacggcuguaaucccagcacugugggaggccgaagugggcggaucaccugacgucaggaguucaagaccagccuggccaacauggugaaacccuaccucuacaaaaaauauacaaaaauuagcugggcguggugccacccaccuguaaucccagcuacuugggaggcuuaggcagagaaucucuugaacccaggaggcagagguuacagugagccaagaucaugccaacugcacuccagccugggcaucagucuaaaauaaauaaauaaauaaaauucacaccuaggacaucacaauaaaauagaucgcuugagcccaggaguucgagaccagccugggcaaccuggugaaacacucucucuacaaaaaguacaaaaauuagccaggugugauggugcguaccuauagucacagcuacuucggagacugagguaggaggaacacuugagccuaggaggucgagguuccagugagcugagaucuuaccccuacacuccagccugggugauaggacgagacccugucuccuccucagaaaaaaaaaaaaagcauuacuuaaucucuuagccucuuaauggcccccucuggaauaggcaaauaagggggaaacugugggggaaagcccaauaccuacacuucccuuuuguuuuuucuggaagucuuccccuuuuuccccagcuggaaugcaguggcacaaucauggcucaacugcagccuuaauccccugcgcucaaguaauccuuagccucccaaguagcugggacuacaggugcaugcuaccauacaccuggcuaauuaaaaaagaaaaauuauuuuuguagagauaagguguuacuguguugcccaggcuggucuggaacuccucaccucaagggauccucuugccugggccucccaaaguguugggauuacgggcgugaaccacugugccuggccugaaguucccuuucugaaggcagcagucucucuugcauuccaggucuaucuuguuacuuuuuuuuuuuuuuuuuuuuuuuugaggcagaguuucacucguucccaggauggagugcaauggcacgaucuuggcucgccgcaaccuccaccuccuggauucaagcgauucuccugccucagccucccgaguagcugggauuacaggcaugcgcuacuaugcccggcuaauuuuguauuuuuaguagagacaggguuucuccauguuggucaggcuugucucgaacuccugaccucagguaaucuccccgcuucggccucccaaagugcugggauuacaggcaugagcaaccgcgccuggcuuuuuuuuuuuuuuuaaauagagacagugucucacuauguuggccagguuggucuugaacuccuggcuucaagcaauccucuugccucagccccucaaagugcuagauuacaggcaugagccauugugcccaguuguuacuuuucugauuccuucaaacagauguuaauauuuuguucacuuuuuccaguuguucuguagugggaggggucugaaugacuugguuuccuagaagggaaguagguaguuucuaccuuucuguuacguagucuaguauaauuucugugucuuuucuuauuucaguaugccuaaugauauucuucccagagccgcugugaaugacugcauagguugaacacaacaacacagugacccuaauccuuccgauaccuuggcuucuuaguuccuugaccucuauuccugggauccuguucucugcccuaccucagccacccauuccuuugaguuacuguuaccugaaauucauacccuuuuaucucuguuucagacuuagcacucuacauccuccugaucuuuccagcugaugcccuuccagcaucccugugaucuuugacuccaucaugacgucaguucauugauuauaccaccuuuucccuugauguuucuuacgcuuuuguucagcuuaaauuccagucauuagaacacaaccucuccuccuauuccuuugucuucuuguuucauuaguucuuuuggcuaugccacaaccuguguuuuacucucauuccccggaaaauagagcauacaacaaagcuuuuacugggcuaauacuuuacuugaaguuagaaugaaggggaaaauagaaagugagacaggaaaggagggaaagcaaauacagagugcuacguuauccagcaggcuacagcaucauaagaaccuuagcuggcugcucagucauguuggaaaucucuggagaaucauggcaccucucagaauacuucuggggacagguuugagggaggauggcugagagauuuauuuguuggcucccucucauauccugucucuuacuggucagaguugccugaaggaucuuaauuauucuauacuuuuggguuuguuacuuggcuucucuaugcagcugcuggaaaagcagcugauuugggguaacagggcuucugccacagcaggcacagugaggaccaccaaagccuaccuguuaacacuggggagguagagaccacuagugguaggcugaguucauaugauccucccagauugcaggauuuugcuugugcugcugagccugcuucagcugggaaguagaacagcaggcaggaccgaguggauuuuggaaaguguguaugagcugcauuuguuauaccuuguguaauccaacuuuuugccuauucuuugcuugcuuucccauagcucaauguggcuggagaaaccauacugaucacucugacuucacagucaugauuaccaagaccaagaggcuuuuauuauagguuauagucuguuuuccuauuccaauuacucuucuagauaguuuaaaugucuuacuuuaauccucuaauucucccugccuuauccucccuuuauuucauuggggaaaaaaccugaaucaauuagaagaaaacuacucacuccccuuaccagaugugcuaccugucuacaucugugccugguacucugccuucuguaacugcuagcuaaggccaaacccugugcacguauacuaggcuccaugcuuuucuaccuguuuaaggauaaucacuccaguaguucauccuuuauuugcaucaucaaauuuuucaucucuguuguaucauucuuaucagcguauuaaacgggcuauuacuucuuguuuaaaaacuuuuuugccgggugugguggcucacgcccguaaucccaacacuuugggaggccaaggcuggcggaucaccugaggucaggagauugagaccagccuggccaauguggggaaaccccaucucuacuaaaaauacaaaaauuagcugggcgugguggcgggugccuguaaucccaguuacucaggagacugaggcaggagaaucgcuugaacccgggaggcagagguugcagugagcugagauugugccccugcacuccagccugggcgacagagugagacucugucuuaaaaaaaaaaaaaaacacacacacacaccaaaaaaacaaacuucuuuugguuauucugauucuguauauucuuucuuuucuccuauucuuuuacacauuucauucaggcuuuugcccccacugcuccucuagaguugcucuugaggugaucaauugcuccauguugcuaaauccagcaaucuguuugcagucuucaccuuauuugaaauaucuaacccaagagacauaugugucugugugugcguguauauauauauguauauaauauguaugaaggguuuauauaugcauaaauuuaaaagggguguguguguguguguguguguaaaauugaccgacaugacugugaaggccaggaagucccaaaaucugcagcuggcaaucuggaaucccgagauagcugacaggguaaguuccaguucaaguccgaaggcacgagagccaggugagccagugucucagcucaagcagugagacccagaggaguucccucuuaaacucagccuuuuuguucucuucaggcuuucuguggguuguaugagucccacccacauuaaggagggcagucugcuuuacucaguccacggauucaaauguucauuuuaucugaaagcacugucacagauagacccagaauaauguuugaccaaacaucugggcacucuaugcuguaguccaguugaugcauaaaauuaaccauuacagaaccuuuucuucacuugacauuuagaacaggaugccaauauagucccuauaagagcuagucccuggcuucagcuccacuacccgcucccccgcuuuucucucucucucucucuuuucuuuuuuuguuuuuuuggagacugagucuugcucuguugcccagugacucacugcaacuccaaaaaaaaaaaaagccuuacuaauaaaacucuuagccucuuaguggaucccucuggaaugggccaauaagggggaaagcccaauaccugaacuucucaaugaaaauccuggguucaaacaauucuugugcuucagccucccgagaggugggauuacaggcacccaccgccaugcccggccaauuuuuguauuuuuaguagagacgguguuccaccaaguuggccaggcuagucucgaacuccugaccucaagugauccacccacuucggccucccaaagugcugggauuacaggcgugaggcaccacgcucggccuccccuuuucucuacugcagucagaggugccaacuugcucuuuuuuuuuuuuuuuuugagacggucucgcucugucacccaggcuggagugcaguggcaugaucucugcucacugcaaacuccaccuccugggcccaagcgauccucccaccucagccccuccccaaguagcugggacuacaggcgugcgccaccacaugccuggcucauuuuuguauucaacacgcuguuuccugaccguagcuggauaggcuucuguguugggggcuuugcacucauucaucugccugaagugccuccuugcugcugggcaccuccuccccauccacauagcccauggccuuauucuugccacguguacugaaaugugacauucucaugaggguuuuccucaucagucugucucaguuuucagcugcauccccggcacuuccuguuccccuuccuuguuuuucuuuuuucucauuuacucuuaucgucaucuaacacacuuccuuauuuaucuuguuuauuguaugauuccuucaacuagacgguaaacugugaggugagaggagagcuuuuuaaaaucuuguugccuuaacagccucccccccccccaccacugcuucuagaauagugccuggugcaaauuugccucucaguaacaaguuuucuguuuauuuaaaaauacggacggaauuucgaagcuuugugauagagauaaaaaaaauggacaggagcuuuucccaggagguauacaaaguauaggugucuggccuggaacucuccacaaagaauaccuuuauugcucuacaaaugcuauuuguagucuaaacauggaugagcugauacaauucugaaggcaccuugcagccuucucuccuugcuucuagcuccacgugugugcgagucugcauaugugaguguaagggcagcacuguguuaaagagauuuacaaacaucuuuuuaauccucauaacaauccuacaccacacaugucaucauccccuuuguacagaccauaaaacugauauuuagagagcuuaaacgucuugcuugaggccucaagugguaaguggcagaacucagcuugaagugacuugacuauuauuacauuauaugugaccuccuagauaaagagaugccuccuuauuuuguguaaggcagaaguggggagucuugggcagauuacuuaaccacugcuauaguuuggaugugguuuguccuuagcaaaccucauguugaaauuugaucuccaguguuggaggugggcccuaauggaagguguuugugccauggggcuggaacccucauaaauagauuaaugcccuccugggugaggggugagugaguucuuacuccuuuaguuccuacaagagcugguuguuaaaaagagcuggcgccucucucuugcugcuucucuggccaugugaccucuucacaugcuggcuccccuucaccuuccgccauguguggaagcagccugaggcuuucaccagaugccccaucuuccagccggcggaaucaugagccaagugaauuucuuuucuuugucaguuacccagugucauguauuccuuuauaggaacacuaaagggacuaagacaaccccuuuagguccuaaucauauacauacuuauagauucaaaguaucugcuuagcauguacuccauucaaagcaacuguucaaagguaagaauccuaucagggaucagugcagaaauacgacaccuuacacauuucucagcuuucaccuucccagagcuuccucggauugguccuccuguuaguuuccuggaucugaagguaauaccucauccagaagauaagaaggguaguggggacugucaccacgaaggagcuuuccuuuucugguucaaguuauuucccagcuccacucaccuccggacuguuucaugaagaauuccagaaguccccuucucccucauaggaaagugcaccgaaccacucagauuuaauggcuuaaaacaacugcugguauuugaggauuuguucaggugggcaguugugguucugggcuaaugggggccggugucaucugcuugcuccacugugaucuggaacagcugggccuuuuuucuugguuacuguguagucucacgaccucuccuuuuccagugaggucugcaguaggaccugauggcuuaugcagugguucagggcaaacauucccagaggaaggaaacagaaacugccaguucuuuuugaaguguaggcccagaacugguauaucaucacuucugucacauuuccccgaugacuuugugucucugaccaucccaaacucacugugagaagugacugcauggggugugggaguagguccauugggaguggacuaguccagaccuuuuuuuuuuuuuugagacggagucuugcugugucgccugggcuggagugcaguggcgcaaucucggcucacggcaagccucgccucccagguucacgccguucuccugccucagccucccgaguagcugggacuacaggcacccgccaccaugcccagcuaauuuuuuuuuuuuuuaaguagagacgggguuucaccguguuagccaggauggucucgaucuccugaccucaugauccgccugccuuggccucccaaagugcugggauuacaggugugagccaucacgcccggcccaguccagacuauuuuugagaauaaaaaggggccuauuaaaaauuaugucagguugacagacauaaacuggaacuguccucaccuagucuggacauguggguaucauuaucaucucuacaacuuggagaaaacaacacauaggugugaccuugaaucuugaaucuguuuuccugcaguucuccuaaugugaaaaugugacugcauugaguaugcaugugauguuuuaaauugaauauagcuucuaagcagaacccaucaacucuucuuuucuguucuguucuuuacuuuucuuucuuuuuuuucuuuucuuuuuuugagacagggucucacucugucgaccagguuggagugcgguggcgcgaucucgucucacugcaaccucugccuccaggguucaagcgauucuccugccuuagccucccaaguagcugggacuacagacuacaagcgugagccaccacgcccagcuaauuuuuuuguauuuuuaguagagacgggguuucaccauguuggccaggcuggucuugaacuccugaccucaaguagucugcacgccuuggccucccaaagugcugggauuacaggcgugagccaccgugccgagccaccaucagauuuucuuggugggcacugaaugaugacagaaagaguuuaauuuaacacuggagggaaaaauuggcuuugaauuuccugagaaauaauuucguuuguuggguuuuuuuuuuuuuuuugagauggagucucgcucugucacccaggcuggagugcaguggcaugaucucggcucacugcaaguugcgcauccuggguucacgccauucuccugccucagccucuccaaguagcugggacuacaggcccccaccaccacgcccggcucauuuuuuguauuuuuaguagagacgggguuucaacguguucucgauguccugaccucgugaucugccugccucggccucccaaagugcugggauuacaagcgcgagccaccgcgcccggccaguuuguugguuucuaauagagagcuuuccugaaggauuuuucguucuuuuuucuuuuuuccccccugcaaggggaauuuuucaagacugauuuugacugcaugcuauccuuuccuuuccuuuccuuuccuuuccuuuccuuuccuuuccuuuccuuuccuuuccuuuccuuuccuuuuccuuuuccuuuuccuuuccuuuccuuuuccuuuccuuuccuuucuucuccccuccccuccccuccccuccccuccccuccccuccccucuccuccccucuccucucuccucucucgucucuccucuccucuuucuuuucuuuuuuuugagacaggaucucacucugucaccuagacugagugcagugaagugauuauagcccccugcagccucaaacuccugggcucaagcaguucucccacuucagccuccugaguagcugagacuauuugugccacuacaucuggcuaauuuuuaaauuuuuuuuacagaugggggucucacuguguugcccaggcugaucuuagacuccuggacacaagccauccuccugccucagcaucccaaaagugcugggauuacaggcauaagccacugugccuggccagcuguuuucaaccuauaugcugaccuggaucuaauccucucauaagauaaaauuucacucugcugauuaaucagaucauuuuaaaggucucaucuagcucuaagagacucuaauaauccaauagaaagugguuacaaacaccgaaaguacaauugggaagauauaauaaaggcuuucacaguucauaugugaucuggggucagaugggauucaggaaacuccauacuuuguguuuuucuaauauuaaaaaaauuuuuauauagagauggggucuugccauauuauauugcccaggauacuguugaacucccaggcucaacugauugucccuccuuggccucuuaaagugcuaggauuacaggcuugagccaccaugcuuggcuaccccauaauuugaaggagaguuaguugcaauuaaaaauggagguuuuuuuuucuuuucucuuugagacggaguuuugcucugucacccaggcuagacuacaauggcaugaucucagcuuacagcaacuucugccucccgcauugaagcgauucuccugucucagccuucuuaguagcuggaauuacaggcguucgccaacacgcccggcuaacuuuguauuuuuaguagagacaggguuucaccauguuggccaggcuggucucgaacuccugaccucaggugauccacccaccucagccuccccaagugcugggauuacaggcaugagccaccguacccaguccuggaguuuguucuuaacagaauaucaaaucuugagaaguugacuauaaaagaaaauucuaaaauuaaaaauucuauucucuguauaauacauagaagguagauuuuugagguaugacauuuaagaugugaggugccucuaaaauguacacauacaugcuuguguacuccacguaauugugccucaaggagguagggugaggcuuucugucuuuccugaaacauguuacucuuguucagugcuuggaaaaaggaugugguuagauggaguacuggcuugauacaauucucugucuugcccaggguugaggguggugucaaugaaaauucucaauuugaaugccauguaauaggcuccuuauuaauccugacuacaguauaaaaaacaggcugggcuucauggcucacaccuguaaucccagugcuuugguuggccgaggcaggagggucacuggaggccaggauuucaaggcuucagugagcuauaugauuaugccacugcacuccauccugggugacagagcaaaacccugucucaaaaaccaaccaaccaaccaacccgcaaaaccaaaacagaucucuccaagcuucggcagauuugaguaauuaugugaucucuucuugacugaacaagucacuugucagaugaauaucugguucccacuaucuagggacagaagguucccacuaacauugauuucagguaaugcauaacaaauaaauacuaaguuuuuugacaucuuuccacaacauguuuauauuacguguguguguguauguauguguguguguauguguguauauauauauauauguauauauauauacacacacacguacauacauauauauauguguguauauauauauauuuuuugggacagagucuugcucuaucgcucaggcuggagugcaguggcgcgaucucgacucacgacaaccucuaccucccagguucaagugauucuccugccucagccuccugaguagcuggaauuacaggcacgugccaccaugccuggcuaauuuuuguauuuuuuuuuuuuuuuaaguacagaagggguuucaccacguuggucaggcuggucucaaacuccugaccucaggugauccgcccaccucggccucccaaagugauaggauuacaggugugagccaccaugccuggccuuuuuuuaaagagauggagucuggcuguguuggccugguuggucuugaacuccuggccucaagcaguccuccugccuuggccuccuaaagugcuaggauuacaggcaugagccauugcacccaguccaauguuuccuaguuuuucuuaugcaaacuuuuaaauucuucucaguauauaugucuaaaaucuucuguuacaaaaaaauacugaagcugcugcacacggcggcucaugccuauaaucccagcacuuugggcggcccaggcggguggaucacuugaggucaggaguuugagaccagccuggccaccauggugaaaacccaucucuacuaaaaauacaaaaaguagccgggugucauggcaggugccuguauucccagcuacucgggaggcugaggugggagaacugcuugaacccaggaggcggagguugcagugagcugagaucacuccacugcacuccagucugggugacagagugagacuuugucucaaaaaagaaauggaagcaauguauauuuauuaaaauauguauauacauauacagaaaugagcuaaaaguagcuauauuauuauuaaaauuguaugcaauaaugauugcauagcauguugguaugaauaugaccauaauuugacgcaaguugacacauuuuuuuuucuaauauucuguauuacaacuaaucugcauggauuguuuuucugcauguaaucucugcuuacuugguuuaacuuuuuggucgaguccuggaaguggaauuggugaauuaaaaauuuagauauaaacucccaaauugagccaggcguggugucaugcaccuguaguccuagcugcuaaggugggaagaucacuuaugcccagcaauugcagugggcuaugauugagccauugcacuccagccuugguaaugcagugagaaacauaaaaguuucucccucccucccucccuucugacagagagucucacucugucgcccaggcuggaguguagugucaccacugcaaccuccgccucccagguucacgccauucucccaccucagccuccugaguaguugggacuacaggcaccugccaccacacccggcuaauuuuuuguuuuuguauuuuuaguagagaugggguuucaccguguuagccaggauggucuugaucuccugaccucgugaucugcccgccuuggccucccaaagugcugugaugauaggcgugagcaaccacacccggcagugagaaacuguuucuaaaaaaaauuuuuuuuaacguagaaaucuuuuccuuuuuuugagauggaguuuugcucuugucgcccaggcuggagugcaguggcgugaucuuggcgcacugcaaccucugccuccuggguucaagcgauucuccugccucagccucccaaguagcugggauuacaggugccugccaccacaccccgcuaacuuuuuguauuuguuuacuagagauaggguuucacuauguuggccaggcuggucucgaacuucugaccucaggcuauuucuucccccagggccucccaaagugcugagaauacaggugugagccacugcgccuggccauagaaaucuuuucauauguuuguagaucauucuucuuugaguauucucuauuuuuuaccuucacccguuuuacugaguuucuuauugguuuauaagaauuuuuuuugcugggugcaguggcucacaccuguaaucccagcccuuuuuggggccgaggcaggcggaucaccugaggucaggaguucgagaccagccuggccaacauggugaaacccccgucucuacuacaaauacaaaaauuagcugggcaugguggugcacgccuguaaucccagcuauuuggaagacugaggcauguggaucacuugaacccgggagguggagguugcagugagcugagaucgcaccauugcacuccagccugggugacaagagugaaacucuguuucaaaaaaacaaaacaaaacaaaacaaaacucuuugcauauugaaggaacuuacuagcaagccuuuugacauagacuuuguaaauguuuuucuuuugaugauuauauauaugguuaguuuggcuguguacaaguuuuuuuuguuuguuuguuuguuuuuuuauuuuuuuuuuuuugagacggagucuuacucugucgcccaggcuggagugcaguggcacaaucucggcucacggcaaccuccgccuccuguguucaagcgauucuccugccucagccucccgaguaguugggauuacaggcgcccgccaccaugcccagcuaauuuuuguauuuuuaguagagacgggguuuuacuauguuggugaggcuggucucgaaccuccugaccucaguugaucuaccugccuuggccucccaaagugcugggauuacagacuugagccacugcaccuggccgcauauauauauuuuauuuuuuuauuuaaaaaaauguuucugagacaggaucucacuauguugcugaggcuggaguucaguggugugaucauggcccaccgcagccuuggccuccugggcuuaggugauccucccaucucagccucccaaguagcuaggaccacaggcaccaucgugcuuggcuaauguuuaguauuuuuuuguagagucgagauuuuugccauguugcccagguagucucgaacuuaggaguucaaaacgauuugccugccuuggccucuucaagugcugagauuacaggcuugagucaccucacauggcugcaaagcgauuuuuuuugagacacauuuaguuuuuucggugaugucaguaauuuuacaauuaaagaaaaaguuaucugaacaaagggagagugcccuuaaauugcuaagagggagcauugcuuuguuuuuuucuaguuucguugugucuuacaguguucaaacacuguacuggaaguaaauaauuaaguuuaaaauaauuuucuucuccaguguuugauuauccauuucuuuuuguuccaauuucuguaucugaaaaacaauauuggcuucaaaaacgaacaaaaaaaaauuuaacuucccccagauugcagauuuaccauguaaauguguuuccacccuguuuucaagcuaaugugacaaauuugcuacauuauaaagaacagaaaccuguguacagauuuuggggauagcacacauaaaauaguccaaggacauuaucaacucaggugcagaaguucuugcugaaguucuauuaacaauuguguuuaaaaacaccagaugggagcagauuuaaagagggagauucuaauggaagguuaguugggauuuguagggaagagagagaaggauuuuaauugaaaagauacuagaccguauucuuaccuuuauagcguugucuucuuuucuuucuuuucuuuuuuuuugagucauauuuucguucuugucacccaggcuagagugcaguggugugaucucggcucacugcaaccucagccucccgaguagcuggaauuacaggccccugccaccaugcccagcucauuuuuguauuuucaguagagaugggguuuugccauguuggccaggcuggucucgaacuccugacuucaagugagcuacuggccuuggucuucucaaagguugggauuacaggugugagccaccucgccuggccuauaguaguguuuuuuuuucuuuucuuuucuuuuuuucuugagacggagucuugcuauguuguccaggcuggagugcaguggcacaaucuuggcuuacugcaaccucugccucccugguucaagcaauucugcugucucagugaguagcugagauuacaggugcgaaccaccacauccggguaauguuuguauuuuuaguggagacgggguuucgccaugcuggccaggcugaucucuaacuccugaugucaggugcuccgccugccucagccucugaaagugcugggauugcaggcgugaacuacugugcccagccuaguaguauuuucuauccaaguuuuggauguaauucucuugggauuuuuuuccuaauuuguacagcuaccacuguacuguucaugacuguauccaugggaacauaaguaggaugacauaaguuuauaacuuguugcuaggcagaucuagcuuguaauguauuaagauuuucccauuaaaaagcauuuggaugguuuucuuuugugcggugaagguaacuaaacagcguaauuuggaauuaaaacugugaaguuguauaaauuccuucuaggagaaccaacuacucuuuguuuucuuucuuucuuuuuuuuuuuuuuuuuugagacaagaucucuuuuugucacccaggcuggacuacagugacaugaucagguuucacugcagccuggaccuccuggacacaaaugauccuccuaccucagccuucuccuccccuuuaccagcuccuccccuucccuuccccagcucucccccuccaguagcugggaauacauguaugcaucagcaugucuggcuaauuaauuuauuuuuuaauuuuuauuuauuuauuuauuuauuuauuuauuuauuuauuuauuuauuuauuuauugagauggagucucgcucuguuguccaggcuggagugcaauggcgugaucuuggcucuuuguaucuuccuccuccuggguucaagagauucuccugccucagccucccuaguagcugggauuacaggcaccugccauuaugccuggcugauuuuuguaguuuuguggagaugcaguuucaccauguuggccgggcuggucuugaacucccagccucagaagaucugcccaccucagccucccaaagugcugggguuacaggugugacacugagcucagccuauucauucauucauucauucauucauucauucaugagacggagucucgcucuguccccaggcuggagugcaauggcaugaccucggcucacugcaaccuccgccuccuggguucaagugauucucugccucagccucaugagcagcugggauuacaggcaucugccaccacacccggcuaauuuuguguuuuuaguagagauggcguuucaccauguuagucaggcuggucuugaauucccaaccucaggugauccgccugccucagcuucccagagugcugggaugacaggcgugagccgccacacccagccauauauauauguauuuuuuauuugaguuugcguuuugccguguugcccaggcuggucuugaacuccggaauuucagaucgcccaccucagccuccuaaagugcugggagccgcugugcccagccuagucauguuuuuaauuaauugaaugucugaaauggaagauaaugaguuaaaauaauugugucuuaagccuguccucuucagcuaaaacagucaguauuuagauauguaugaacgagaugugaacacuugauccauccuaaaguacauagcagauuucaagaugaugacagguaucuuggguaguucuuccgacucucaaagacuugguggacuaaccaagaaaaccucauggagaucgagacaccugucuuguauuuugguugcaauuuuuuaaaauuaauuuuuaaaaaauguaauauuaguguaaaauaacuaaauuucaaaaaaguuuagaaugagauguaauugaggucacauagcucuuuucugcagaggcuaucacacuuaacaccuuaucugauuguaauuuaaagaauuuuuugaggcuggacacguuggcucacgccuguaauuccagcauuuugggagacugagguaggagggacacuugagcccagccugggcaacauagugaaaccccgucuuacagaaaauuaaaaaauuagcuggcugucguagugugcaccucugguuccagguacuuuggagucugaagugggaggaucacuugagccagggagguugaggcugcagugaacugccauugcacuccagccugggugacagagcaagaucccugucucagaagaaaaacagaaaagaggcugggugugguggcucacgccuguaaucccagcacuuugggaggcugaggcagguggaucacgaggucaggagaucgagaccguccuggccaacauguugaaaccccaucucuacuaaaaauacaaaaaaaauuagcugggcuugguggcgcgugccuguggucccagcuacuuggaaggcugaggcaagagaauugcuugaacccggaagguggagguugcagugacccgaaauugcaccacugcacuccagccuugcggcagagugagacucggccuuaaaaaaaaagaaaaccagaaaagaauuauguaagcaguuauucaauaauaaauaauauuuaugcagcugggcacagugguucacaccuguaguccuagcacuuuuggaggcugaggcggguggaucacuugagcccaggaguucgggaccaaccugggcaacauggcaaaaccccaucucuacaaaaaguacaaaaauuagccgguuauggugguguucuccuuuagucccagcuauucaggaagcugaggugggcggaucacuugugcccaggagguugaggcugcagugagccaagaugucgccacugcacuccagucccaacaacagagugagacccugucucaauuaaaaaaaaaauaauaauauuuaugccguuuuuuuguaccagcuacuaugauaggugcuuuauaggacaauuuggggaaguaauugcuguuaacuccauuuuacucauauaaggaaagugacgcuugcacaagguuuaauauuucuugcccacuaacauguaugcuucaagaaagcaggggcuauguguuacuucugucuagcccccuccuguaucuagcauaguuucuuugggguuuggguagugugucaaauacaguggaaaggcugguuuuacaaagaugauuguuguaucuucauuuauuaccuuugaacuuguagcuucauagggaaaucaugggaauuugagcagcacugaaucugcauguauuaaaaaaacuugcaucauuucuggauuucauguggugaauauuugauaguaccucucgugauuugauaagguccauuauuuggggacaagggugguuaacauagggauugauggaauugugacuccauucuguuguggcguguuuaguuuuuaccucuuucccuuuacuccucgugccccagcugcgucuguguccauuguccuuucaguuucuuacucuaauugaaagaauacauagguaaagaaggaaucugauagaaggaauaaacuucuuugacgguauuaacaagugucugaucuugauuaguguaaguuguauucagugccucauguuucuuaccuuugaauuguagaaaauaaaauuuuagaucugguuaagauucuugagauuauuuggcaggaggaaauugaagcgcaguucaguuccauagaauguuguugaaugcguuucuucauuuguuaagagugauaauauuugucucauaggguugauacaaggaggaagagauacucuuuauaaaaaagucuuaggccgauuugaugauaauacuaauaguuaaacuuguucagaaguuaaucugggcugggcaugguggcucacaccuguaauuucagcacuuugggaggcagaggugggaaggaucgcuugagcccagaaauuccagaccagccugggcaacaaagugagaccucgucucuauaaaaauuauaaaaauaagccggguaugguggcacaugccuauggucccagguacucgggaugcugagauggaaggaucacaugagcccaggaagucgaggcuguggugagcuaugaucauugccacugcacuccagccuaggugacagagugagacccugucuauuaaaaaaaguuagucuguguuagcauaguaucggcagaaaaguauucugacacaguauaggagggaucaggguaugggggaaugagucaggaaggccauuuuaaagauuuuacaguguccuaaacuugauagugaaggcuaagcauuagaaauggaagagauuggcugggcgcaguggcucacgccuguaaucccugcacuuugggaggccgaggcgggcagaucacgaggucaggagaucaagaccauccuggcuaacacggugaaacccugucucuacuaaaaacacaaaaaauuagccgggcgugguggcgggugccuguagucccagcuacuuggcaggcugaggcaggagaauggcgugaacccgggaggcggagcuugcacagugagcccagaucaugccacugcacuccagccugggcgacagagcgagacuccgucucaaaaaaaagaggaauggaagagauuagaaaagaugugaacaaaccuuauagagcuuccaggaaaggaagaaagguaaaaacauugagauuuggaauguugaguaaugggauaguauaaacaguauagcaguauagagaugucacuaauguuuuagaaacugaaauaauagauuaaugcaugguaauuaccuugccagaacugaaaagcggugguagugaugcuggaggaagcagauugcugcugcagaacugcagcaaggccuaggagguggaggcaccagguaucuucagaggcccagguguggugugguuggcccuaagcugaugggcugacugaaagucuccaggaauucuuccugucucuagauuaugcuucauuccagcaguccaggaauuagacuuucccuagccuagcacaagacaaguuuacuuuugguagaguuugaaccagagcuguacccuagacuugaaauggggaggacggguggaaacuaucuggacguggugggggagacguaucuaugaagugaaaguuuguauauugaauggucauuccagaauucuuaauagccuggcuuauacucuccagcaaauuagaagguucuucuuugggagaaaacuggcccagaugcuaacaauugaguguuacccuguauuccaguuauuaccgccuaacaacuguugcuguuacuauugucuuuaaacaacaacaaucguuuuauuaucucacacuuucuggugaugaggauuuaggaagacaucaguugggcagcucuggcuuggguuucucugacuuaaguuguguucacaugguggcuggagcugaacaguagggugcugaaguggccuuggcuggccagacagcuuucuuccuggugucucagcaugggcugauuugugcuccucacaacauuauggccucugacugcuuacaagaaagugcaggcuuccaaagcaaguaucgcaagaaaacugacuauuaacugauucacuuuucaugacccagccucggaagucacauaggcuccuuuccgauguagucacaagucuagucagcuucaagggcagggaacauagauuccaucucuugguaggaguacagaaguggaauugcagucagaguguaaggggucccugugggaugacaugagaaacauucugugaccaccuuuggaaaacacaaucuaccacauuuucucauuuggucacaauaauucacauuccuccuucuugucacuugugcucacacccucucccaucacaucgcucccccuuccugcuauggcauuaacuucaaguucagcaucuugucaccugaaucaagcccaguuguggccacccaaagcuccucaggugugguuccucuagagcugaacucaugugacgucaagagaaggaaucuguugcuuccucugacuuaaaauggcaggacaagcuuaggauaauugcuguagacacaucugcccagaaaagaggaaacaggaggcacaguaguuucucauccauugccauucugaaauucagcagggcacacguuaccaauuccuugauuuggucucaguucuggugccugggaaugauuguuucaggcucugguuucugcugagaauuuuguuuugucuucugaguuacccuuuucccuaagaaauggcugauuuuuauagcugaguaguuuucuuagccuuugugcuuucgguaguuuuggaggaacaaaaaaaccuuccccucauuuuguacuguuuuugucucuuucaguccaaacugguauaauuccuuugaaaauuuugugggcucucucugugucaauuuguaaccuacuacauuagacaggaaccacacuuagccuguuugugguagguccuucauuuccuugggcuccuugugugucaccagccuuaguauucuuagaagcccuguuguuugauggagaggaucuuaaaauccuuagaaggcucuuggucucuuggaaaggacagugcagaaccuucuuagaucuuuuugagguuuuaagaaaguauuacagucacagucuggguuuguucuuuaccacugagaauuuugagaauuguuucuuuuuuuaaaauucugccuggaaauauccuuagguagaucauggaguuuauuaggugcauuuccuguuuuccacauuucuaaaggccacauuuuccacuacuuagacaacaggggacccuuuuccuguaauguacaauaguaguuuucauaguuucuauuaagcuuuuccugauaguuuccuuguugaggcccuucaggcuuuugcugauagccucuuaaaggccuugcaauuuccaccugccacccagccccaaagccaguagcacaguucuggguuuuuguugcagcaucucacuuccaggugccaaaaucuguuccuuagucuugcugccugaaaaaugacccccaaaaguuagugacuuaaaauaauuccgugauuucuguaggucaggaauuuaggaagagcuugauugggcaauuguggcucagguucuugcuuuggcugcagucagaugguagagcugaagaguagugcacaggcaaggcagugugcacagcuggagagggccgagcugagccgccuccacaaggucucugugugaauuuguuugugcugcuucuucagggcacucagacugcccacauagcuuuguguccaaauguauguccugugggaggaugagcagaaucuguauuaccuuuuaugaugacuuagucuuggaaguuacaucacaucauuucugcucuagucaacaacuugccugggguucuaggggaggaaaacagaccucauaucuuagugucaguuggccacacuguaagaaggugauauggggugggagauaaugugaucagcucuagaaaaauguaauccaccauagcucuuagugaaacaguuacaucccugucugaucaccuugcaggggagucuugccauuaauaagcaccagcuguguaugugacauuaaaacuuacuuuuuaguacuuccuucuuaacugugacuuaacagucaaggauuaucaggcacaugaagaaaaagccauaacagucuaacacagacagauaaaaagaaaccaagugaagaaauaggaaauacagguugcauaagaaaagcucaaauuugaaaaaacaaaaaagcuugaagagcuaagagaaaaugcaugacauaaaagcaagaagguauaaaguagggguccauucagagaacaagaaagagcucuuggaaaauaggauugcaggacaaauuuucaauaggaaaccaaggaaaucuuccagaaaguaguaggcaaagacagacaaaaagagaaagacaaugccugauuggcuucuugacugaaacauauuuaggugggaagaggaaguguggaaaugugaauaaggacuguauacuaaugauaaugaauuaauauuaauuuuugcuuaagugugauaauagcacugugguuauagaggagaaugcccuuaggcuuagaagaugcauacuaaaggaacugucaugauauuugcauuuuucagaugguugugugcacacacgugcgcucacacacagugggagagggagggagaagggagagcgguuauguacaagagagacaacuaaagcaauuaugauauaauauuaguaauugaugaugaauacaaaaacaaaacagaagggaauacuuuagaguuaauggauugguucaggagcuccaacaucugcacuguuagauguucuagagagagaaaagauaauugagaggaaacaauauuaaaucaacacauuaaaaauguucagaagugaaaaucacaaaucuccacauugagcagacccacugagugcccagcgcagggaauaaaagaaaaaauagauugguacaucacacugagauuucagaacacugagaauagagaagaucucaaaauccuccaguggaagcaagucaaguuacagcaguggacugagaaucuguaugacacuagaaucuaggugacaguggagcaguguccucagaauucuaggagcauacccaucuaggauuuuuuuuucuucuuuuuugagauggagucucgcucuuucgcugggcuggaaugcgguggugugaucucggcucacugcacccuccgccuccuggguucaaccaguucuccugccucagccucccaaguagcugggguuacagguguggaccaccaugcuuggcuaauuuuuuguauuuuuaguagagacgggguuuccccaccaugcuggccaggcuggucuugaacuccugaccucaugaucuggccaccccagccucccaaagugcugggauuacaggcgugagccacugcaccuggcccaauuuaggauucuaugccaaacuguaguaugaacauaaagacaucuuuauuuuuauuuauuuauuuuauuuauuuuugagacggagucuccaucugucgcccuggcuggggcccaguggcaagaucuccacucauugcagccuccgccucccggauucagggaguuauccugccucagccuccuaaguaguugggacuacagacgcgugccaccacaccugguuaauuuuuguauuuuuaguagagacggaguuuugccauguugaccaggcugaucucaaacuucugaccucaagugagccgccuaccuugugcucccaaagugcugagaucacaggcauauaccaccaugcucggccuauuauuuuuaauuugauggucauauuauuccagauuuggccaaugggauuuccuucaagcugacuccuguguccuuuugacaaauaucuauaauccuuuauuuauuuuuauuuuuuugagacagaguccuguucugucacccaagcuggaauguaguggcgugaucucgccucacugcaacccccgccucccggguucagacaauucuccugccucagccuuuggaguagcugagaucacaggcaugcgccaccacaccuggcuaauuuuuguauuuuuaguagagacgggguuucaccaugucggcgaggcuggucuugaacucuugaucucaggugaucugccugccuuggccucccgaagugcugggauuacaggcaugagccauugcaccuagcccucuauaauccuuuaaaugcuuguuuaugguaucuuagaauauuucaaauuuaucuuguauguucucugccucauccuggagucaacuguuugucuaaggaggagccauucucuugaaguggagaauaguauuauagaaaccaauaucuuggcacuagcuguauuuauugcugccaggauauuguuguuuucagcccucuuagugggcagaacaaguagaucuauguguauuuauuuauuagacauauuuauugucuauaucucugccuacacauauauauaaccaugaauuuuaccacaaaugccaccauuuugauccaacaucauaggauucauuuuagcccuuuuccuuuccuuauuuguagcucucgucucugacagugagaaucuugguucucauccuuaauauaguuacucauuugcuuaaucucccugaaagcuuggcccagacauggaauccagcaaaggauaaggugaagggaauucuuaaagagaaaucuugggauaauagcuguguaggcauucaccaguuaguccagauuggugagugaagacagggcuccaaagggguguugucaagaaauaaacaaccaauagauagccugauguguugagacuuacacauguaguagaaguuuggaggugaauuagugauacauauacagaaaaccaaacaagcaaaaaaaacaaaaaaaaaauagaauuauuaauuccagguaaaaaaaucacacauaaucacaccacugaacucuggccugggugacagagugagacccugucucuuaacaaacauaaauuaaaaaucagguaaaacaaauuguacaagaauggacuuacaacaacagaaugcaacaggauucagcuaugaauaguauuuacuagucauaaacuacgagagugccauaacacugaacuuagggagcaauuuagggaauaaacugagaaaaaaaguacacaggggccuuaggaccuaagcagcuagugugauaucacuuguggauguuuaguaugcauuuuggguaccagccccuuuugaacacugucuuugaggggaaauuguccacuccacaguagaagcuauuaauauguuuucccauccucucuuguaguuugucauagaugugugacuucuauuccaugcaccagggcaagacuaggauuaggaagcaagugaugugaaguagacaagcauggcugccagguuucagaggcagcguuuucuagcggugguguccacuaugcacugccaaguguccuuguguuuaacaccugcagcaguuaagaccuccacugaagcaguucugugggguaauucugguguuguccuaguugcauggcuuguaaaucugguuugaugaccuuccuguagagccauuuaguugcuuauauuagcuagaaugggcuuuguuuacuguaaaaaaucugguugacgaaauuggcauuaggaaugauccucaagaaaaugaauugguuaucuaacuugguuguguaugaaggcagugaagaaaggugagagcuuaaagaaucauaguggccuugggccgggcgcgguggcucacaccuguaaucccagcacuuugggaggccgagaugggcggaucacgaggucaggagaugagaccauccuggcuaacauggugaaaccccgucucuacuaaaaauacaaaaaguuagccgggugagguggcgggcaccuguagucccagcuacucaggaggcugaggcaggagaauggugugaaccugggaggugcagcuugcagggagccgagaucgcaccacugcacuccagccugggcgacagagcgagacuccaccgcaaaaaaaaaaaaaaaaagaaucauaguggccaugggcaugguggcuggugcccauaauccuggcacuuugggaggcugaggugggagaaucacuugaggucaggaauuagaggccugcagugagugccacugcacuucagccugagggacagagcacagagcaagauccugcuucaauaaauggauggauggguggguggguggguggguggauggaggaaucauagugaucagcagugcuuaaugacugagauuagucuauucugaaguauguuaauaaagcuugaaggaucagaggaagagaguaggaaaaaagcacacacauucuacaaaccucgccacauccacucaguuaaaagacagaacaggauucccuuggauguugggaaagggaagucagacgugaaaguuguagacaggauuaagccacuuaauuuuccuauuaaauggacucuagagaguaaguucaugcuucucauuuuacugauggagaagcaguaccacauacuuggugaaauuccugugucugcaaaacauugguuauucugcaauuguuauauauaaagggauaaacauugaaguuauuggucucuuccuucucauugguauuguggguguucuuuaccaacugaguuaggaacugacuugagauauuuuaaacuuacgggacuugauuuagagcacuuacucuuagauguuaaauauuugguuugcucuuuauugaauaacuuaauuaucuuauuacuaauaauuccuguauuagacaaugagacuuagacucauaauagaauacagguaucuuaaugagaauguucucauuuaaaacacuaacuccuaauucacuagcagcuaauaaaacuaacauuguugcacaguacauuguugacuaguuagaagaauuugacaguauguuuggugcugagaccagcucggucggggagacccuaacccagcggcgcuagaggaauuaaagacacacacacacaaauauagaggugugaagugggaaaucaggggucucacagccuucagagcugaguauugcuauuaauaaaggguguagaauuugaaaauaggccaggcgugguggcccacgccuguaaucccagcacuuuaggaggccgaggaaggcggaucaugaggucaggagguugagaugagccugaccaacacagugaaaccccgucucuacuaaaaauacaaaaauuagcugggcgugguggcgggugccuguaaucccagcugcucaggagguugaggcaggagaauugcuugaaccuggaaggcagagguugcagugagccgagauugcgccacugcacucuagccugggcaacagagugagacuccaucucaaaaaaaaaaaagaaaaagaaaaaagaauuugaaaauagcuugagagacuagagaagaagugaacugauuuauuuuauauuuauguaucuuauuuuuuggcuuguugaccagaagugaauugauaugaauaagcacacuugcaaaauaaauggguuauuuauuuauuuauagagacagggucuugcuuuguuucccaggcuagaguacaguggcaccaucauagcucacuacugcugcuggcaacuucugggcucaacggguccuccugucuugaccucccaaagugcugggauuauaggcaugagccgucaugccuggcccccuaauuauuuagauagcccuguagaccugauuucuuguggcugaaggucucucaaauugauucucaguaggcuucauaaauaaaagggaacuuacacuggaggaucuuuaugcugaauuggcuuagaauaaguagaaauugcuaggaauguuuuauuuuuguuuauuuaauuugcuaaaucugcuuuagauaugagccuuguaacuggauuucuuaaaaguguccuuaugauugaaucuauuugugguguuuggauugauuauuuuaaguuccuacuauguaccagacguuugcuacuuguuuuaacuugcuguuuaaucucuuugaagaaggaacuguuuccuccauuuuuauagaagagaaaauugaaacuuaaagagauuagagaacucuccuucagucuaggcagagcugggauuccauuucaggacuguuaugcuacaccaaauaaaugcuugcugcguuaaagaaugacuuaacagugaacaccuuaagucuucauugcccaguuacgugaauggaagaaaggcugagcagugaauuacaaacacucucuccucuagucuucuggcaguguuccuuuaccuaauucuguguccucaaacgcccuguuuucuuuaggugauuauauuauuuguuucuuuuaagcuugccugucugcuuguucuucugaacaguucccuucaaauguuacaccauccacccacaucuguauuucaguauuuuauuguguccuuucauugagacucuaauuugggugaaaauucuccaaacuacauuucuuuuuagcauauucuauuuuugucaccuagaaucagccucccagcugacuuuuucccauagauacguaacaaccaccugcuuuaacauuuucuaucuuccacuuaacaaaaauauuacuguugauaaauaaugaauacuuagcauguauaacugugcaaauaaaaugggaggaauguguaucgggaagauuugaggggaguguggauaaaaaacuguuugaaaauaccagcuguugaauuuuauaguguuacucuuuuuauuuuuauuuuuuaguuuuauuauuacuauuuuuugagauggaguuucgcuuugucgccaggcuggagugcagugacgugaucuuggcucacugcaaccucuaucuccuggguucaagcgauucuccugccucagccucccgaguagcuggaacuagaggcgcgcgccagccaauuuuuguauuuuuaguagagacaggguuucaccauguuggcaaggaugaucucgaucucuugaccucaugaucuuccugccucggccucccaaagugcugggauuacaggcgugagcuacugcacccagccuauuauuauuuuuuaauugagacuugucuuacuuucacccaggcuggaguguaguggugcaaucuugccucacuggagccuccgccuccugggcucaaucgauccucccaccucagccuccugaguagcugggaccacaggcacucgcuaccgugcccagcuaauuuuuucuauuuuugguagagacaggguuuugccacguuguccaggcuggccucggcuucccaaagcguugggauuacaggcaugagccaccacgugcagccuauaguguuauucuuuaguaguuccuaaaaggcuuguguuagauguuuauagcugauaguugugguuugaaucuguguccccagccaaaucuugugucgaauugucauccccaguguuggaggugggggcccaugauuggaucauggggguggauaucccccuuggugcuauuuucaugauagugagugagcucucgggcgaucgggucgucuaaaaguguguagcaccucccucuugucucucuugcuccuccucuggccauguuauaugugcuugcuuucccuuugccuuccaccaugauuauaaguuuacugaggccucccuagaagcugagcagaugccagcaucaugcuuccuguacagccugcagaaccuugagccauugaaaccucuucucuuuauaaauuaccuagucucaucucagguauuuccuucuuucuuucuuucuuucuuucuuucuuucuuucuuucuuucuuucuuucuuucuuucuuucuuuuuuuuuuuuuuuuuuuugagacggagucuggcucugucgcccaggccggagugcaguggugcgaucuccacucacugcaagcucugccucccggguucacgccauucuccugccucagccucccgaguagcugggacuacaggugccugccaccacgccuggcuaauuuuuuguauuuuuaguagagacaggguuucaccguguuagccaggaugguuucgaacuccugaccucaggugaucugcccgccucagccucccaaagugucgggauuacaggucugagccauugcgcccggccagguauuuuuuuauagcagugugagaacagacuaauacaauagccaucauguaaaauacaguuuccauuuugagccaggcacuuggguaaaaaugaagaguagguaaaagacaagauguaguucuaauuugagcuugucauuuaguauuugaguaaugccgcauaauggcuguggguuuccgaugacacacaccuuuucaugauguggguggccuagggaguaguguguuuguuggaaccacaguucucugcagagggaauaugauuaagucugaucuuuguaauuuagaauuaaugaggccaggcgcacuagcugacaccuguaauaccagcacuuugagaggcgaagauggggaggaucacuugagccugaguuugagaccagccugggcaagauagugagaaccugucucuacaagaaaauaaagaaaaaaauuuuuaaaaaaagaaaaaaaauauagaauugguaucuuggccacaccucuuucccugugguugaguuuuuuuuuuuuuuuuuuuuccuguucuuuuccuuuuuuuuugagacaagaucucuucgucaccuaggcuggagugcagugacaugaucaaggcuugcugcagugucagucuccugggcuuaaaggauccuccugucucagucucccaaguagcugggacuggagguaggugacacuagccuggcucacuuuaaaaacauuuuuuguagagauaaggucuugccauguugcccaggguggucucaaacuccuggccucaagccauccucccuccucagccucccaaagugcuggggucucuggcauucaccaccgcggacaaccuuuuuuuuuuuuuuuuuuuuuuuuuaagcuaaauuuuguugaauauuuggauaggcaauacaggcauaugguacaaaauuaaaagaugcaaaaggguuaugcacaagagaaguacauuucuuaggcauuccuggccuuccauuuucccuuccuggaggcaguuuucugauuuauuuucuacaaggauucuguuuaaauacuggagaauaucugaccuguuguacuuuacuuuagaauggcaggaagcugaaugacucaugggcauuuuucccuuugugaagcucauugacauuccuuccucucaauaccuuaacuauggcauguuuuauaauuugcuuuuguuuuugcuuuaucacaguauuuuccuauguuuuuuauagucuuaauuuuuaagcacugcuuuagguaucuauuaauaguucagaaaguugcgaagauuacaagcucauauuugugaaagugucuggcacauaauaggugaucaauaaauauuuccuucuagcuugucuguccccuaucucccacugguuguauguaugaaacaaaaaaaugaaggagaaggcugagcauaguggcucauaccuguaauccuagcacuuugggaggcugaggcgagcgaauugccugaggucaggaguuaaagaccagccuggccaacauggugaaaccccgucucuacuaaaaauacaaaaauuagccggguguggucacaggcgucuguaaucccagcuacucaggaggcugaggcaagagaauuccuugaaccugggagguggagguugcggucagucgagaucgcgccacugcacuccagccugggcaacagagugagacuuuuugucacacacacacacacacacacacacacacacacacacgugaaauaaaccuaugaaccaacuaaugcaguggauuccaaaauuaagauuaagcuuguguaaguuguaauguuucuugauguacccauuuauuugaguggaaacagauucuuuucauucuuugaaaucacuuugcugagauuuuuuuauuuuuuuuauuuuuuuuuuggagacagagucucgcugugucgcccagacuggagugcaguggugugaucuaggcucacugcaaccuccaccucccggguucaagcgauucuccugccucagccuccugaguagcuaggauuauaggcaugugccaccacacucagcuaauuuuuguauuucaguagagguaggguuucaccauguaggccaggcuggucucaaacuccugaccucaagcgauccgccugcucagccucccugaguauugggauuauaggugugagccacggugucccgccaagcugagacauuuuuaagaaaauguuucuguuuuuuuguuuauuuguuuguuuugagauggagucucacucugucacccaggcuggagugcaguggugccaucacugcaaccucugccuccuggguucaagcaauucuccuguuccagccuccuagguaacugggacugcaggcuugccaccauauaccuggcugauuuuuuguauuuuuaguagagaugggguuuuaccauguuggccaggcuggucuugaacuucugacucaagcgaucuacccaccucagccucccaaagugcugggauuacucccacagcaccugcucagaaaagguuucuuuucuuuucuuuuuuuuuuugagaucaggucucacucugucgcccaggguguagugcagucgcgcaaucucagcucacugcaaccuccgccuuccagguucaggugauucucuugccucagccucccaagcaggugggauuucaggcauacaccaccaugcauggcucauuuuuguauuuuuaguagagagggguuucaccauguuggccaggauggucgcgaacuccugaccucaugugauccacccgcaucagccucccaaagugcugggauuauaagcgugaaucacugcaccuggcuagaaacaucuucuaaagccuaaucuuuuuuuuuuuuccuuauauaauuuagguugacuauguaaacccaaaacacauaggguagaaacucgugaaaaauauuuuugaggauaucuuugcaaaguguugugccucacggugcuggauauggaugugugcuuagugucagugcauagauuuaggauuucccaccuguauguaugcuuuuggugaguccuuuuaggcgauauguccucauguucaaggaguaauggcauacugguucauuuaaacccauguuuuaauccuaauuuaagaccgauuuacuucuucuuggagcuaauuucuuaacuuuucugaugauguuuuuguugcuuaaguuaagacuaauauaacacagaagucuuacucauccuuuuugauauuagagauuuugguuuauuaaucuaguggaauuuuaaauaucauuuuacauguuuacucucaagaucugaugauugacugacugggugcaguggaucacaccuguaaucucagcacuuugggaggccaaggcgggcagaucacuugaggucaggaguucgagaccagccuggcuaacauggugaaacccugucuguaguaaaaauacaaaaauuagccggacuugguggugcgugccuguaaucccagcuacuggggagacagaggugagagaaucacuugaaccccagaggcggagguugcagugagccuagaucacuccauugcacuccagccugggcgacagagugagacuccgucucaaaaaaaaaaaaaaaaaaaaagaagauugaauuaagggcaaacuuggaacaggccaguuucccauuauauugccucucugaaacaagugaaagaguuuucuuuaugagggguguucuuuuuaauuuaauuuaauuaauuuuuauuuauuuauuuugagacagagucuugcucuguugcccaggcuggagugcaguggcaugaucucggcucacuguaaccucugccucccagguucaggugauucuccugccucagccucccaaguaauugggauuacagaugcccaccgccacacccagcuaauuuuuguauuuuuaguggagacgggguuucaccauauuggugaggcuggucuugaccucugaaccucagaugaucuacccaccucggcuucccaaaguguugggguuacaggugugagccacugugcugggccuucuuuuuaaaaaagguuuuucuggccaggugcgguggcuuuaauccauaugugugagaccaggcacgguggcucaugccuguaaucccagcacuuugggaggcagaucaccugaggcaugagaagugcuugaacuagggagguaagaaguugcagugagccaagaucacaccauugcacuccaggcugggugagagugagacucugaaaaaaauaauaauaaaaaugguuuucuuacuuuuaugacuugaauuauggaaaguuuuuagaaugugacucuuuucucaggaacaggauggcuaccuaccuaccccccauccuuuuccuguaugcuauggauuaucagaccccucacuuggguuccucuuacaucaccaaggugugcuugucaauacccagaaaccaacacugauacauuacuaaguuccacauuuuauuuagauuccaauaguuuucccauuaauguccauuucuguucuagaauccaauccagguuacuguaugcauugcauuuaauuaugaugucuccccaguuugcuguuuuucacaugacuagacuaggguuaugaauuuggggaauucauaugauuggaguggugggagguguagugcaugcuacuccaugauuuauugcugguaauguuaaucguggccaagguuguuucccuacuguauacacucaccaccuuccauacuuauuuuuuuggaaacaaguuaguaaguccaaccuacacucaagucggggagauuuaagcuccaucuccuagaggggaguggggaauauuuacauaaauuauuugaaauucucccacgaggaagcugcuuuuucuaggaaaggucuuugcccguuauucuaccgacuuacuggacuuuuuauuugacuuuuuaaaaagaagcucuuuagauaaaaucuccauaaauacuuagauaaauuacugcaauuuuauauuugcauaugaacaaguggaguuuuguugaugcaggguugcauuggccuucacuaucaaaacaaaugucucaucugaucagcauuuauaaauagugagguaccagaaucauuaaggcucauaaagucuuccguuuuuauuuuggcuauucuggugguggguaacaauauuaacaacaauaaaaauucaucuuauuuuacuggagauuccugcaaaguggcagaauaccaggacaaggaaccaauucuggcacacaugugucaaacaagaaagcucugggaauguaauaauguaauaaaguguggucgagagagcucugggcuggaauaggcaugggguccuugacacuaucaccucugccaagacacuucauguguaugguuuccccaccuuuaaguaaacucuauuuaugaaguucuuuguagcuuuaauaguuucuagaguugcuugaauuuggggugacuucuugcaaggguaaugugaaguagugucacauggacaguaacggagagguaucugcugcugccauuuauauaauaaaucugaauuuggaggcagagaaaggaggcagaaaguuugguaaggacguuauugcaaccugaauaagccacuuagggccuagaucaguguuugggaaugugggagaagacagccauagucaagaagcgugaaguaguuaauguugaguuauuuuuaggugguuuuucuguucuuuuuacuccagacacugacuuucguaauaagauaaauaaucuggugagucgcaugcucauggugugcugaggcauuuagccaagcagcuuaugcauguauuaucucauuuaauucugucacuaugagguagagauuaucuuuaaccauugguuccaaaugagaaagcccuguuugaaauaauuuuuccaguguauuuaaauuuuguagguacacaccuagaauuucaaacugauggucugaguucugagcccaucuguuuaauucauccuaauggguuaucuuguggauaugcugauuauaguaaaacaacuuuaagaaugugauauacauuaugagugauacuugugguuugaauggguuuuuuuaaacaacaugaaaauuugaagauauuuugcauagauuugcuuuuggguaaaacuuuuuuuuuuuucauaucuucuguaauuaacuucuuuccccccuuuuuugagauggggucucauucugucacccaggcuggagugcagcuugauguaugaucauggcuuacugcagccuuggacuccugggcuccagcaauccucccaccuuagccucccaaguagcuggaaguacaggagugcaacaccaugcccuguagagacggagucuugcuguguuuccuaggcugaucucuaacuccuggcuucaagugguucucccuacuuggccucccacaguuugauuagagaugugaaccacugugcccagccaaaauuaacuuuuuaaucuauucuaaaucaagaagaaaauagaugugucuuuucugggacuaguaaugagaaauugacagcaucugguuuuuggcuguuguuaaagugugauuauuacuauacugguaugcugauaaagagauugcaugguaauuuucauccuuucaucuaaaaacauaauauuauaaggauagauauuuccuuaguauggggugacuuguguagauuacuaucucauaaauugguucagauuaguuuuuaaaaagggcaaaauuguauauuagugauauugcucagcucuuuuucaaagggauaaagcacuguaaagagagaauguggggguagaagucuaauaaaauccucacaaaucuggaucaguaacagaaaagucaguuauaggccaggugccauggcucaugcuuguaaucccagcacugugggaagcugaggcagguggauugcuugagcccaggaauucgagaccagccugggcagcauggugaaacccugucuguacuaaaaauacaaaaaauuagcugggcgugaugguggguaccuguaguccuagcuacuugggaguccaaggugggaggauugccucaacccaggaggcgcagguugcagugagucgagauugugccgcugcacuccagccugggcaacagggugagaacuugucucaaaaaagaaagaaagaaaagucacuuauaauuaugugggcuuuaaaaaaccugacugauagugcucuguuuuuaguuucaccaaaagauagguaguacuuccauccucuuucaugaaacuacaguaugucuauucucaauguuucaaaaccuuguaagacucagagggaagaaauaguuucucauuaagaaaaauuuagucaacaguauaauuauguauuaagugcuucaggaaaagcaaugggggaaaguauuuccuacaguauuaggucucucauuagaggugagcagagggaguuccuucagcgcaggacgggcauuucugcaggugaagugggaugagacaaccggcuauagcaagauguuagcauauguaguuagcuuauggaaacauaauuugaauuggacaugaguuuuuguuuguuuuugaggcagagucuugcucuguugcccaggcucuauugcaauggcacgaucauggcucacugcagccuugaacucuuggacucaaggaguucacccaccucagcaacccaaguagcuggaacuacaggugugagccacaaugccuugcuaauuuuuuuuuuuauuuuuuguagugacagggucucacuuuguugcccaggcuggucucaaauuccugaccucaagcaauccuccagccuuggccucucaaagugcugggauuauaggcgugagcacugugcccugccuaugaguuguuauagacugggugauuuuguaguaggcagcaguuuguugucauuugcauguuguacuucauguaugguuuucccaagucauuaaauguacauacuucugcaacuuuuuauuuuuuauuuuuucuggugaaaagauauacauauauuuagaauuagccagcuggacucaguuuagaugaccccaauuuuguuggcaacauccaaagcaucauaaucaggagcuaguugaacguaugccuccuucucuccaucaggccgaaucaggguguugaccgggccacaucaaugucauagagcuucuucacagccuguuugaucuggugccuguuggcuuuaacaucuacaaugaacacaagugucuuguuguccucgcucuucuucauggcagacucaguggucagcggcaacuugaugauaauaugguggucaagcuuguuucuccugggggcgcucuucugaggauauuugggcugccccuggagucgcaguguuuugggccgcuggaaggugggugauguguggaucuuuuuuuuuuccggcuguggacgccuuucaacacugcuuucuuggccuucacagccuuugcuuuggcuucggcuugaggaggggcaggagcuuccuucuuugcuuucggugccaucuugugaaaagggcucugcagcuuuuaauguguacaguuuccaugauaugauuguaccagauuauaagauuauguuggacauuugaguucuuuccaauuuauugcuguuuucagcagcacuugaugaauaacuuuguagauaaguuuuugcaaagcuuuaugaauauuuucuuuugggauaaauugcuagaggcucggguaaacauugccaaacuacccuucagaaagccugaacuuauuuacaguacacuuaugguaugguuuggcucuguguccccacgcaaaucucaucuuguagcuccuauaacucccacauauuguaggagggaccuggugguagauaauugaaucaugaggccagaucuuuccugugcuuuucucuugcuagcaaaugagucucaugagauaucuaauaguuuuaaaaaggggauuuucccugcacaagugcuccucucugccugcugccauccacguaagacugaguugcuccuccuugccguccgccaugacugugaggcuuccccagcugcauggaacuguuaaauccaguuaaaccucuuuguuuuguaaauugcccagucucugguaugucuuuaucagcauugugaaaacagacuaaugcaacuucucucaacauuucuaguggacagguuuucuauguucccuucuaacauccuguuuugccaaacuuuugcaaagaauuucauauugucuuuuuuccuaauucaaccuuuuguaaggaacucuuacaacauugguguaaagguauguccuuagcuggugguacaguaguuagaaguuuucucuggguuauggugauauugggaguaauuguguuauaggauaaucugggcucucuguauuucauaagauuguggugccucaccaucagucagacuguagcuucagggcuuuuuuuucucuuggauugcuugguggugaaauaucaauacagccuugcccauucugauuaguguguuacauuacugauagggcaguguuaagagaaauaggagaaaccugagccuaaaacauuucacugugaaauuaauuggucucugaaguguuuugucuuuguuuagguuugacgaucguauguggcgaaauuacauuggugguaaaugauaagcuuguuauauugauaacauggaagaaaaguguuucugguuucucuuagagaaaaucgauucccaguccaaggcaccugugaguccaagagaaugagagaagguaagauguuauuaguuagaaacugacuauacaauuccaguuucuagugcagaguugacuucaguagcauuugauuagcaucuaacuuccuucuugggggaaucagaaaagggacauagauuaggcauuagcugaacucagauuacuggaaagugauugagucaguucuauuuuuuauuuuuauuuuuugagacagucucacuccgucacccgcuggagugcaguggugcagucuuggcucaugucaaccuccgccuccuggguucaagugauucucaucccucagccucucuaguagcuggaauugcaggugugagccaccacgcccagcuggguuugguuuuuuuugcauuuuuaguagagccagguuuucaccauguuguccaggcuguucuugaaaucuugaccucaaaucgucuacccgccugagccucccaaagugcugggauuacagguaugagccaccaugccuggcuuugagccaguucuaagggaaauuauucauuuauuuuugucagcuuguaauauugcaaaucauaguauuuuugaaauaaccuucccaugggaauagaguuuaugcccuuaaaggguagagugcuauuauaaagagagauacaagaagagagggaguggguggcauuccagagaucaggucuacaugaguugcugcccagccuucuugguucucaaacuugucggucuggauugcuguguuuaaggaaagggaauagaacaauauacucccuuucuaaaauuuuucauuaauuggcuaccuaaccuauguuaugcauauuaauuuacuuaacauuuaugaaguacuuauaauaugcuagacacugaagauacuauggucugaaagauggcaaauaauagaggagaaagaaaaucauaauugcuauuauuuaugaaguauuaaguacaggcaguucuuaagcauucgacuuaguauuuuucaacuuuaagaugguacaaaagugauacacacucaguagaaacuguauuuugaauuuugaucuuuuccucggcuagcaauaugugguguaauacccuuacaugagauauucaacccuuuuuuuuuguuguuuuuuggagacagaguuuugcucuuguugcccgggcuggaaugcaguggcgcaaucucacugcaaccucugccucccggguucaagcgauucuucugccucagccucccgaguagcugggauuacaggcaugcaccaccaugccugacuaauucuguguuuuuaguagagauagaguuucuccauguuggucaggcuggucucaaacuccugaccucuggugauccacccaccucagccucccaaaguacugggauuauagguaugagccaccacaccuggccucaacacuuuuuuuuuuuuuuuuuuuaaauaaaauaggcuuuguuagauggccuugcccaacuacaggcuaauguaaguguucugagcauguuuaagguaggcuaggcuaugaugcccauuagguuagguguauuaagugcauuuuuggauuacaauauuuucaauuugugauacauuuaucaggacuaacacuguuguaagcugaggagcaucuguauguaccagguacuuaauauuaagguggccuuucuaauucucauagaaacccaugcaagguaggcauuauccucuccauuuuucuuuaggguuagugaagcuaaguagcuuguucgucaucacucaauaacaaagugguuaaaaugggauacaaguccaccaugggauugagucccagaugggaguucagaugcugaccaguguuaggaucuaagugcaagucacuuaacuccucuuuucaaauguggacuacaacaguucuuaucucauagggcuuuuuugguguguguuaugugacagauaggugaagugguuagcccaguuacuggcacguaguaauaguuaauaauuauauuagaucauacuggcucaaaagccauuaauaguaguuacugcugguaguugagucuuacaaagccauuguuuucuccacaugucuuuaugcaaaucauuaaugacaagagccuaaacugugauagagaagguguccccaguguuaugagaguauugaagaggaauggacugcuaaccuggacuaggagaguaagcagacuuacaaagauggugauccuugaggggucuugaagcauuauuaggaguuagcuggugggaaaagauaaagagaaggaaguggguuagaggaaagucauggcaaagcaaaaaggcccagaaauguaaugacugugugagggauagaguccugagggugagacauagguuagaaagauaagcaggccagauuaugaagggucuugcaugccauggguuuuuucccuaaagacagcgggggaagcagcagaaggacuuuuuauuuuggaauaauuuuagauuuacaggaaaguuguaaagauaguacaaagaguuuccauauacccuacacccaguuuccccguuauuaacaucuuacauuaguaugguacauuuguuacaauuagugauugauugauuuguaauuauuaccugaaguucauaauuuauucuuauguucuuaguuuuuaccuaauaccccuuuucuguuccagaaucccaucgaagauaccacauuacauuuaguugccuuguugcuuuagguuccucuuggcugugacaguuucucaagauuuuucuuguuuuugaugauguuuuaguuuuaagaaguacuaaucagaaauuuugcaggauguuucucaauugggauuugucuggcauuuuucucauuauuguacuaagguuaugaguuugggguaggaagaccacagacguagagugccauuucaucccauccaaggguacauaccaucaacaugacugaugacugcucauguugaccaguguugccuggcggaguacuuuacaguggaaacgucugaguuugucagaaguuucagcuguaaaguacucuuccaucuccugcuccgccccuuuccauacaacccccuuuuuuggaaagaggucacuaugcacagcccacacugaaggggaagggaguuaugauccauaucucaggaaggacuuuuaacguggaaagugauuugaucagaauuauguuccagggccaggcacgguggcucaugcccauaauuccagcacuuugggaggggaggcaggaggaucaguugagcccaggaguuugaggcugcggugagcuauggucauaucacugcacuccauccuggacaaacagggcaagaccuuguuucuuaaaaaaauaaagaaugggcugggcguaguggcucacaccuguaaucccagcacuuugggaggccaaggcagguggaucaagugaggucaggaguucgagaccagccuggccaacauggugaaaccccaucucuacuaaaaauaugaaaacuagccgggcgugguggugggugccuguaaucccagcugcucgggaggcugaaggaggagaauugcuugaacccaggagauggagguugcagugagcugacaugguaccacugugcuccagccuuggcaacagagugagacucugucucaauaauaauaauaauaaugauaauaauaaaaaauaaugaauugugcuucagaaagauugcucuagcuaguggagaaacugaaucuggggagaccgaauuuagccugcaaccuuuaagacaggacaagaugagaaaccaugaaguuggaaacugaaggucaguggcagcaggguuggagagcgauggauuugagaaaagucgaagagauuaguggauggggcucaguggguuuugcagagugugugugcucgagugcuaguagcagaugaggggacuccaagaugacuugccagccauauugcugggaguuggugacuauacaagugauaguguuaauuuuuuuagguaaacaagaagaaacagcuuguuguugauagugggaagggugaaugagagggcaauaagcugugucaagaugcuuuuugaguuguucuuggcuuauaugcguauucugucuugagauaaagauuuagaagucauuaccauaauaaaugugguuugagaaauuugcaguguuagauguuauggcauaggaagaguaauuaauaccagaugaaaaagaggaacccagggaacacugauguuuaaaaaagugguagagaaaacguggggaaaggucaacuuuuguuaaaaucucuuauucauguggcuguuuaauuccucuacaucacauccucucuucuguucacccuggagguguaaaacacuauaccaaaggacagaacacacuauacacguuuagaacauuucuucugaggauaguuacugcugcgguaaugcagguacuguuguggugaugcuaaugagaauaaaucuugcuaaaauuaagaaucaagacagcugaagaccuauggaaagcaauugaccgaacaguacuacuucaggucagguaagcaguggcaguacaagaaugaagaauggauucuuuguuaccaagcaauuaacaaucuaguuggguauuuacuggguaauacaauacaaaguaagcaaugguaauugguuauguguaugucaguuguggcaugauaguuucuaccucggcuaucugcugaagcccuuucugucugucuucucucccuguccagcuuuguucuugccugccuuuuuauuuuuuacagucccucuccuuuuuugcaggggggcggggcggugcuagugggaguauacauaccccucguuaaccaccugugauguaaguuaagauuuuuuuuuaaauguuucuguuuuuuaaaaacaagugaauagagcauuuauuaucauggaggauaaaauccucaaagaaaaaaucuguuuagcuuuuaaauucuucgugaaaucgcuaaucuuugaggcgaaaaauuuuuucccguaaauuuaggagaacaugagauuugaguuuuuaaggacuuuauagcgugccuauguuuauuguagauuuuaauuccagagagcuggugauuggaaaucauggaccuauuuguuccaauuuaaacuuucagcauuuaaaaaggaagagauaagagagaaccagacaggagguauauaguuuguagaaagauacagauauuuaauguaaucccagcacuuugagaggcugaagcgggcagaucaccugaagucgggaguuugagaccagccugaccaacauggagaaacccugucucuacuaaaaauacaaaauuagccaggcgugguggcacauuccuguaauccuaucuacuugggaugcugaggcaggagaaucgcuugaacccaggaggcggagguugcagugagcugagaucgcgccacugcacuccagccuaggcaacaagagugaaacucggucugaaaaaaaaaaaaaagagaaaagaaaagauacagguauugaaauaccaaaguugcuucugacuuccucauuuuauagagagugaacuguugucaguugagaauucuuaagccauuuaacuuaaaugcuaaaauacuuaauguggauaucauggggaggaaaaauguucuuuacauucuuugguuuuugaucauaauguauggugucuuuaaaaucuaggcauuguagcauaaugguuaacaccaccgacucugucuucugcuguuuucauaccucuuccuuaagcuucgacucagcuucacugcucauaggugugauguugggcagcuuacuucaucucucugugcuuuaauuuucucaucuauaaaauggauagucguaagauugaaaugaacuaaggcacgucaaaguacacagugccuagcacauaguaagcauuuauaacuguuacagcaauaguaaucauauauacucuugccauucccuuugauuucuaucuuuuugauuacccaacgucagaagccaaaaauuuuggagucauaaaacguuuuuuggucccuaacauaauuaaguuaaauuuacucaugcguagcaucucaggauauauugaaaguauggguggccaguccauacauuuaagaauaagaauuauaagaauuuagagacagagccuugcuuuguaccccaggcuggagugcaguggugugaccucagcucacugcaaccucugccuccuggguucaagcaauucuccggccucagccuccugaguagcugggauuacaggugugugccaccaugcccgacuaauuuuuauauuuuuaguagagacgggguuucaccauguuggacaggcuggucucaaacucuugacagcaagugaucugccugccuuggccucucccaaagugcugggguuacaggcaugagccacuucacccggccagaauuuaccuuuuuaaaaagcuuuauuuauuaucuuuuugaguccuacugaugaguaauuuggaguuucauguguccuuuuuauauagguauuagaguaugacaaugacaucuauaaugggauagaauuuaaauuuuaaagcaaaccaaacagcuguccuauuuaugagugcuaacuuaaagaugguuugauaacaugaagguaacgguacuaugaaugugaauguaaugacccuauauauacacaauaaauauacacaauauauauacaguucucuguuuauacuuuucagcuucaguuuucuuguucugaauuuaagcaagaagguagcauuuaauucauagcuuauugugcuacuccuguuuucauaccucuuccuuaagcuucugguaaaauuaaaacauuucaaguagaguuuaggauuguagaaaacaaggcauguuguuaaaaccuguaauugugagcgugucuuaaaaugacaagauuauuauauauauauauauauuuauuuauuuuacuuauuuauugauugauuuugagauggagucuugcucuugucgcccaggcuggagugcagcgguguugucucaguucacugcaaccucugccucccggguucaagcaauucuagugccucagccucccaaguagcugggauuacaggcaccugccaccaugccuggcuaauuuuuguauuuuuaguagagaugggguuucaccauguuggccaggcuggucuugaacuccugaccucaggugauccacccaucuuggccucccaaagugcugggauugcaggugugagccaccgcacccagcccuaucuuauaauuauugauagcaagaaaagcauauucaccauuuguuucaguucucauuguuuucgcuuccccuucuguguuuauccauuuggccauucucuuucuuguguucaucuuucuguucugacucaggucauugaggauaugguuggacccugaaugguagaaacacaacucccucuuccccucgacuccacagacuuaaugugauuuuuuaggguauaggggaggggguuaugagaaugugggaacccaagcagguguucuaauggcuguggaguaaccugucuucuccuuccaguuaguuucuguguuuuguuuguuuguuuguuuuaaagagacagggucucucccucugucgcccaggcuggagugcagcagggugaucauagcucacuacagccuugaacucuugggcucaagcaauccuuuagccucacccucugaaguagcugggacuacaggugcuuaccaccauaucuggcuaacuuuuaaaaacuuucagagauagggucucacuguguugcccaggcuggccuugaacuucuggccucagcugauccucccaccucagccuccugaguagccuugcuuuuuaaauaacagcuuuacuacaauaaaauuaacaaaacacgcaguucacuuauuuaaaauaugcaaaauucagugguuuucgguauauucagaguuguguaacuaucaccacaaaucaaauuuaaaacauuuuaucaucccaugaagaaaugcuguaccuguuagcaguggcacccuguuauuucaaaugcccuacagccucuggcaaucacuaaucaucuuucugucuggacgguucauguaaauaaaaucauacaauaggcuguggauuuuugugcaugugacuggcugcuuucacuuagcauaguguuucaaguuucauacugagcauguguuaguguuuuauuuucauggcaguauaaaguucugucauauagacauacugcauuuuuuuauucaaucgguugaugggcauuuggguuguuucuaccuuuuagcuguugaguaaugcugcuaugaaaauuuauauacaaauuauuauguggauauauguuuuuauuucuuugggcuguauaccuaggaguggauuuucuggguuauaugauaauuuuuuuucuuuuuugagauggagucucgcucuguugcccagucuggagugcaguggugcgaucucggcucacugcaagcuccaccuccuguuacgccauuuuccugccuuagccucccgaguagcugggacuacaggcgcccgccaccacacccagcuaauuuuuuuuuguauuuuuaguagagacgggguuucaccauguuagccaggauggucuccaucuccugaccucaugauccgcccgccucggcuucccaaagugcugggauuacaggugugagccaccacgcccggccucuggguuauaugauaaucuuuugaggaauggcaccauuuuauauucccaacauuuuagccaaauaaucugacuaaaaacaggcaaaagagcugaauagacauuucuccagggaagauacucagauggccaauaaacuuauccaauaugcucaaccucuuuauucagggaaaugcaaaucaaaaccacagugagagacuacuucacaccugcuggcuagaaucaaaaagucagauaauaacaaguguuggugaggauguguagaaauuggaacucucauacccugcuggugggaauguaaauguaaauugcuguucugcucccaaacaguugacaaguaaaauauagcauuauagagugagaaauaacucagaguuucagaguagaacugaaaauauacuagaagaguauuuuccuuaguguuggacuagaugauuuuaaauuugaacacagacauuguaucagguaacaucaaaucauacagugaaggguuucucacaauguacacaaaauaguauuugucugcuuaacacugggauuugcaaagaacagugaaauauuacaguguuacaaagcaagaucuuccucucuuuaaaugccuguuaaccugauuuuaagaauaucuuuauuguauacaucuuauucuuuaaauguaccccauaacuaauaguaccaauuuuauguuuucaacauuuaaguuaugauauuauacauuuccuuuaacuugcuuuuucuauucaaacugguugauagcuguagaucugauuuuguuuucuauauuuaauucccuugaagucacauaccacgguuuauccaaucccugauuuuuuuuuuuuuuuuuuuuaagacagagucucccucuguggcccaggcuggagugcacuggcaggaucucggcucacugcaagcuccgucuccuggguucacgucauucuccugccucagccuccugaguagcugggacuacagucgcccacuaccaugcccggcuaauuuuuguauuuuuaguagagacgggguuucacuguguuagccaggauggucucgaucuccugaccuugugauccgcccgccuuggccucccaaagugcugggauuacaggcgugagccauggcucacgugagacagaguuucacucuuuuugcccaggcuagagugcaauggcacgaucucggcucaccgcaaccuccgccucccggguucaagugauucuccugccucagccucccaaguagcugggauuacaggcaugugccaccaugccuggcuaauguuguguuuuuaguagagacaggguuucuccauguugcucaggcuggucucgaacucccgacuucaggugauccgcccgccgccgccucgccaagugcugggauuacaggggugagccaccgcgcccagcccccguugauguauuuuaaagauuuuccucuauuuuuguccuauagacgauucuguaguaacuaucuauguuauuauguagauaggguucuucagauaaacagaacuacuagaauauguauggguguaucuauguguacauauauucagagauuuauuuuaaggaauugguuuauguaguuguaggggccugacgagucugaaaucugugcaggccuauaagaaggaguuagggccuuagucucaacuucuggaaaaaucucaauuucugcucuuaugaccuuuaggugaacuggauaaggcccacccacauuauggaggguaaucaagagauuauagauguuaaccauaucuacuaaauacuuuucacaguaacaccuagauuaauguuugauuaaauaacuggcuacuagagucuagccaaguugacacagaaaacuaagcaacacacuguccuuccaugugcaccagagacuuucagacuuuaaaaaaccuccaccaauaguuuauacacauacuuaaugaaaccauaugcugauguuuucuguucuuauucuuuuuuuuaaaaugcugauuaggaacccaaaauucaaugugaguagaucugaccagcaauuugaaaaacauugcauauauauguagucuagaaauggaauugcuggcuugcaagguauccacacguccacuuuacuauacauugccaguuuuuuucucugaaguaguugaaccacuguacagcccuacuagccgugugaauaaaccuucuuucuuacccccuugauggcaacugguaauugcaguuuccuuguagaccuaauuauuccagauaggucugggcuuauuuuuuaaggucuuuaaaacuugauaaaaaucgacuuuaggccgggcacgguggcucaugccuguaaucccagcacuuugggaggccgaggcgggcggaucaugagaccauccuggcuaacacggugaaacccugucucuacuaaaaauacaaaaaauuagcagggcgugguggcaggcgccuguagucccagcuacaggcuggggcaggagaaugacaugaacccgggaggcggagcuugcagugagccaagaucugcacucuagccugggcgacagagcaagacuccaccucaaaaaaaaaaaaaaaaaaaaaaaagucaacuuuaaacaaagagaccugccuguguuggcaccuucagcaaauauuaguaucuacccagaaauuaaugacauuucuuuauuuucauuguauuuauauuuuuugauuuacauauagcaaaacugaauaauuuuuggugcacauuuuugugaguguuaagacauguauacaauacuccucccuuauccaugaaagguauguuucaagaccucugguggaugccugaaacuguggguaguacugaacccuauauauauacuaugguucuuccuaugcauacauaccuaugauaaagauuaauuuauaaguuagacacacugagagaucaacaacaaaaaauaauaaaaugaacaauuauaacaauaugccaacaucgccaauacuuuggggcuguuaguaaguaaaauacaggggacuugaacacaaaugcugcgaugcuaugacaguccagcugauaacuaagaugacccaagugacuaaugggcacauagcaccuacagaggggauguggugcacaaauggaugauucagguacuauuccuggaauuuucauuugaauguuuucagaccacaguugaucauggguaacugaaaucacagaaagcaaauuccaaugcggggcaccacuggaguuucauauaccaccaccacaauuaggauaccaaagaguuccagcuccuccaaaagcuaccucagacuuucuuaagcuuccucacacuucuagacccuggaaaccuuggaucuauucauuaucccuguacuuuugccuuuuucagagugucguaugaaugaacuuguacuggcuucuuucacucacuguaaugcuuuggaaguaggucuagguuguugaauauauuaguaguucacuauuuuuguugcuguguacuguuccaguauauggauguacuacaguugguuuauccauuuacgcauugaaaacaucugaauauuucacaguuuuuuuuuuuuuuuuuccccaaggcagaagaauuuuucuuaguacagaacaaaaugaaaagucucccaugucuacuucuauccacacagacccggcaaccauccgauuucucaauuuuuuccccacccuucccgccuuucuauuccacaaaaccgccauugucaucauggcccauccccaaugagccgcugggcacaccucccagacggggucguggccgggcagaggggcuccucgcuucccaguaggggcggccgggcagaagcgccccucaccucccggauggggcggcuggccgggcggggggcugacccccccaccacccucccggacggggcggcuggccgggcagaggggcuccucacuucccaguaggggcggccaggcagaggcgccccucaccucccggacggggcggccggccgggcggggggcugacccccccaccucccucccggacagggcggcuggccgacccccccccaccucccucccggacggggcggcuggccgggcagaggggcuccucacuucccaguaggggcggccgggcagaggcgccccucaccucccggacggggcggcuggccagguggggggcugauccccccaccucccucccggacggggcggcuggcugggcggggggcugaccccccaccucccucccggacugggcggcuggccgggcggggggcugaccccccccaccucccucccggacggggcggcuggccgggcagagggguccucacuucccaguaggggcggccgggcagaggcgccccucaccucccggacggggcggcuggccgggcgaggggcugaccccccaccucccuccuggacggggcggcuggccgggcggggggcugacccccccaccucccucccggacggggcggcuggccgggcagaggggcuccucacuucccaguaggggcggccgggcagaggcgccccucaccucccggacggggcggccggccgggcggggggcugaccccccaccucccucccggacggggcggcuggccgggcagaggggcuccucacuucccaguaggggcggccgggccgaggagccccucaccucccggacggggcggcuggccgggcggggggcugacccccccccaccucccucccggacggggcggcuggccgggcagggggcugacccccccuccccccucccggacgggguggcuggccgggcagaggggcuccucacuucccagucggggcggccgggcaaaggagccccucaccucccggacggggcggcuggccgggcagggggcugaccccccccccaccucccucccggacgggguggcugccgggcggagacgcuccucacuucccagacgggguggcugccggacggaggggcuccucacuucucagacggggcgguugccaggcagaggguuuccucacuucucagacggggcggccgggcagagacgcuccucaccucccagacaggguugcggcccagcagaggcgcuccucacaucccagacagggcggcggggcagaggugcuccccacaucucagacgaugggcggccgggcagagacgcuccucacuuccuagaugggauggcggcggggaagaggcgcuccucgcuuccuagaugggauggcggccgggcagagacgcuccucacuuuccagacugggcagccaggcagagaggcuccucauaucccagacgauggggggccaggcagagacgcuccucacuucccagacgggguggcggcugggcagaggcugcaaucucggcacuuuggggggccaaggcaggcggcugggagguggagguuguagcgagcugagaucacgccacugcacuccagccugggcaccauugagcacugagugaacgagacuccgucugcaaucccggcaccucgggaggccgaggcuggcggaucacucgcgguuaggagcuggagaccagcccggccaacacagcaaaaccccgucuccaccaaaaaaaaaaacgaaaaccagucaggcguggcggcgcgcgccugcaaucgcaggcacucggcaggcugaggcaggagaaucaggcagggagguugcagugagccgagauggcagcaguaccguccagcuuuggcucggcaucagagggagaccguggaaggagaccguggagagagagggagacgagagggagagggagagggagagcuguuucacaguuuuugaugauugugaauaacgcugccuaugugugcaggugcuuuuuuuuguuuguuuguuuugagguggugucucgcucugucgcccaggcuggagugcaguggcgcgaucuuggcucacugcaagcuccgccuccuggguucaagccauucuccugccucagccuccugaguagcugggucugcaggcacacaccaccacaccuggcuaauuuuuguauuuuuguggagaugggguuucacaguauuggucaggcuggucucgaaccccugaccucaggugauccugagccucccaaagugcugggauuacaggcgugagucacugcucccagccugugugcagguuuuauugugaacauaugcuaauucuguaggguauauggcugaacagugggguugcuagaucagucauuugguaaauauaauuaugucuuuguaaaaaacugcaaaacuuucccagaauggcuuuauaauuuugcauuuacaccagcaguguaugagaauuucaguuguucccauucuugucagcacuuuguaguguugaugccuuuuauuuuagacagccuaacagguaaauaaugguuucucaucauggcuuuaauuuacauuuuccuaauggcuaaugauguagagcaucuuuucaucuaauauacccccuuuauaucuacuuuggcgaagugacuguucaaaucuuuuggccauuuuaaaaaaauuguguuauuuuccuuauuguugacuuugaaaguucuuuauguauucuggauagaaguccuuuguugcauaugcgauaugcaaauauuuucuuacaguccguaguguaucucaacagugccuuuugcagagcaaaaguuuuuaaauuuuauuuuuaguauaccauuaaaaaauguuugguggauugugauuuugguacuguaucuaagaucuccuuucccaauccaaggucaaaaagauuuccauguguuuuucuuuagaaauucuauaauuuuucaguuuuacacuuaguucugucaucuguuuugagauaauuuugagguauggauccaaauuuuuuuaaaaaaauguuuguuuuguuuuugcaugugaauauucauuuguuccugcaucauuuguugaaaagauuauuauuuuuggcuugauuuugccuucgugccuuuauggaaaaucauuugauccuguaugugugguucuguuuuuggacucuauuccauuuauuucccuuuuuuuuucuuuuuuuuuuuugagacagaaucucgcucugucacccaggcuggagugcaguggugcaaucuuggcucacugcaagcuccgccucucgcguucacgccauucuccugccucagucucccgaguagcugggacuacaggcgcccgccaccacgcccggcuaauuuuuuguauuuuuaguauagacgggguuucaucauguuagccaggauggucuugauccccugacuucaugauccuccugccucggccucccaaagugcugggauuacaggcgugagccacugcaccuggccuuuucucugucuuuaugccaauaccauacauucuugauuacugauuuuuuguaauuagucuugauuuagauaguguaagucuuccaacuuugcucuuuuucaaaauugcauuggcugucucauuuacuuugccuuucuuuaugaauuguagaauauuuaucaauuacggcaaaagaaggugcuacaauuuugauuggaguugcauugaaucuuuagagcaguuugggaagaaugccuucuuaauaauaagucuauaucuaugaucuauuucuucaucuucuuagaucaucuuuaguuucucucagcaguguuuuguaguuuucaguguacacaucuuacuuuaucccuaaguuauuucauauuugaugcuaaugaucuuuaauuuugauuuuugauuuuuuuuuuauugcugguauauagaaauagaauugacuauuuacuauuaauauuauuuccuacaaccuuacuaaacuuguuuauucugguaccauuuuguagauucuacaaaauguagauuuucuacacagauaaucgugcaguuuugauuguaccuuuccacuguggaugccuuuauuuuuguuuuacuuuagacuuuuauuggaaauacagcaggacuuauuugucuuuguauucccuuuggggucccuccccacacauaccuuugaugacuuuuguuuuagauucuuuguagcguuagcauuguucugaagucagaacuauguauauaucuauaaaaaagguauacuugggcugggcgugguggcucacaccuguaaucccagcacuuugggaggccaaggcaggcagaucaugaggucaggaguucgagaccagccuggccaauaugaugaaaccccgucucuacuaaaaauaaaaaauuagcugggugugguggugcacaccuguagucccagcuacucaagaggcugaggcaggagaauugcuugagccugggaggcagagguugcagggagccaagaucacaccacugcacuccagccugcgugacugagugagacugucucaaaaaagaagguaaacucaaaggcggucacuccaucuuuuuugucauauuucuuucucaucuacauccucuucccaucugcaacagaaauucaacuuuuaauuuuaccuaauucauacuuuucacacuuuggguccuuuucacuauucuguuacgguucuuuaaaguaacugccucucagauuuuacuaaaaauguaaaauuuccucuuuaugaaaccuagaacacauugguagacaaaauuaaagaugggagaucuggugguaucauaaaagaagaaauucgucaaccagacuguggguuuccuagauuuuuguuuauaguagguuguauguuauauuuaguugcauuuuucccccuagaguuuagguuccauaacuuucaucauauuuucagaguaauuuauuuaaaggaaaaaaaguggccaaaauuaaccuuuagaaugaauaagucugggccuaaccagugugaagguauggucacugaaccuccuguuucucgagucuuugccuucugaagauauguguauuguaauagaugacagccgcuugcgguuaauucaguaauacaugucagcuccaccccuggcacuuuuaaaccuuuuggccuacuauuuugcaaaacagauuuuuaagaauuaguaugcauuuuagaaguuuccuuucagguuaaacuuuuuaaauaguuauucuuuaauaaugcuguuaaaagaauuuugggauuucuauugccaagucacuaaaaaguaacucaggcagagaaggguaagggugcugcaagcacacaugaagaauuaacauuuuaaaagaaccuuugagcaccuuggcaccuguggauuucuucuuggaugucucaugccuaaaagcagagcagcauacuguaaaaucaguaaaaguaggaaaggacuugcaaguagaaauguuucagcagacucucgccucccccaucuccauccucacucugauguuaaguguggggcccauugggccagauacagguaaaaaggugggugaugucauuaaaagguauuguuacuuauagcuuauuauauguguuaaauuuuaauaagaauuuucuuuuuucuuucucccaagccaaacuggcaagacgcagucaagaacgggacaaucuuggcauguuggucuggucacccaaucaaaaucugucagaagcaaaguguaagucuuggagcacuuuauuuuccaccuuucuuguuuaauguaagguuuuaaagguaccuuugaagguaaaagcuucuauauguauuaaauuucuuuucuauuuuaagauaaauaauuuaaagaguuuuaaaguguauauuucuuuuuuuaaaauuuuuuauuuuuugagauggauucuggcucuguugcccaggcuggagugcagcagcacgaucugggcucacugcaaucucugcuuccuggguucaugugauucuccagccccagccuccugaauagcugggauuacaggcacccauuaccacacccagcuaauuuuuguauuuuuaguagagaugggguuuugccauguuggccaggcuggucucaaacuccugacuucaggugauccgccugccauggccucccaaaauguugggauuacaggugugagccacugcgcccugugaucuguuccauuuuugaacauguucuuucuuacagagcacuaaaaaucugccucccuguaauuuguaaaagcuuuguuuuccugaacuuugcuaaauaaguuugcuuccauauguguccuuuaaauguucagucaucguaucuccuuuacugucugaguccaagcuaguugcuucaggugccuuuucagaugguuuuuuuggggaucucuuuucaucuccuguuguccuucuaaguguguuccaguuggccacaauguccaucuuaaauuguacucagaacugaauaugaagaauacugagcauuuuuugaaccuuuaugccagcacaguacuaaaauguuuuucauacuccuguaucauucaguguucacaguaacccaggaggaagauuuuuucucuguuuuacagauggcaucccauaguucaaagagucagaggguuguaaaaguagcacagauagugaguggcggaaccccaaguaguucacuccugggucauaaucucacuuauuucucaggcuguguucauuuagccuguuagccacuaucuuucuguuauuacaguuuaaaguuguauuagucacuuuuccuauuguauugcuuauuggagucuuuggagucagaauuuaauuuuaauguuaucuuauuuuucauagaccuagaagaaaagggcagaauauguaaaguuaauugauuuuuaaacagugguguugccuauaaaauaaauuuacaguuuuauuguaagcccugauuacaaucguuuuaaguuuaaaguugguuaaaacuuuaaacuuuaaaaaaacuaaccuguccacugaggcucccaguggacagcgagcucggcuuguggcugagacacacuugagccaggccagaggcauaggaggaccaaauuugacagauaucaauacacgauucuuacugaggccuuugaaacggacccuuguccuggaauuacugucagaaaagaaccggccagaaaaacagacucccgagccacgaguccagguuugguuucagaauuggagagguggagcacggaaaagaagccagagcagcgccagcguggaggccaccugggcgcagguccccccgaucccagacccuggucagccuggggugcugaccccuacuguuccaccagcggggcuuccccgggggucccaagcaaugugggcaacuucucuugggaaucggaggaugcuuugggccaagcucuccucugggggcgcgcugauguuccgugcgcgaauguggcccccgcugaccuggagauggcagccagugcgcucggccacgcuuagggagaugucccuugaucuccgcccucgggcccagugcugcuuccgggucccucuugccaccagcccuucccacagcuggaagcuggcagugcugggccucaaguucaucccggggcacccggccugcuccccauacaccagucccuagcucugcgggggcuggggcugcacccuccugcuguggagcagcagccgagguggggcuggcagcugggggaggcgccugggugcgccgugaccugggagcagcccucuccgccccagcccccgcagcucugaccguaucccgccucucugccucuuuccuggccauagucacagccacagccaucgcaggacccggcugagcgcuaggaacagguuccuugucuuccuccagaauccaacucgcacgggaggccccagcaccccugcccccaacccgcugcggagucugaaccucaagcggcugcauagcaaacccguggaaaugaccugucagugucaggcaguggaagacagaugaacuaagcaagggcucaucgguaguguucacguuaugaaaauugaagagaaauaucaagauuuauuuacuuugucacggaagggcuuccagacauaccuuucagggaaaucgaguuguuaggguggaagggccuuggggugcaugagaccuagggguuuuccuuagauggcauaaaaaaggauugacuuuauagaauacaucugucuuuccauuuauuaaccgaguaaacacggagcacugagagugaacaaaguccacuagcgagaaggcaggaugaggacggcuuuguagaaaugcauuauuuucuaucaggaaagagcaaugauuucuacucugggaaaaaaacaaaacaaacacuuaccuaaaaguaauauuuacauauuguugaaaguucauagauaaaaguauaaagaauaaaaaaaauucaccuauuauuccaucacccagaggugauaaucguuaaacauuuugggguauuucuuccaauuuuuuuuguauguauuuauauaagugagaugauagauuaucuguguguguguauguguguauugucuuccugagcaucggaccuaagcaguuuccacguuguuaaaacugcuuauaaagguuuuaaauaacuagguguaauacuuuauuacauggauaugucaguauguuuaacaauuacucuauugaaaauuuaggugucucaguuuuggaagaauauggaagucuugguuguccagcauuuauucugacauuaaguagaaauaagugauuuaggacauauuucuagcagauacuaaaaaacuguguauaggaugucuggagaucccuggcuuuucuuguguguguguguguguuuuuuuuuuccucuucuuuucaaaguggcuguucagaguucugccucuuaggguuacugaaagcuuauaaaguuauguuguaauuauaaaaauaaaugcuauuuuagaaaauucaaauaguacauaaugcauaauauauaauuguuuuccacaaaaugugaacuguuaucagucugcucauaaguacaucugggacuuuguuucaucucaguauaucuacaguuaucuaauuuuuuuuuacuguaacuaguauggauguaucauaauuuagccuuuuuuuaaacaaaauuaccuguauuaccuauugaugaauauuuauaaucuuaguucuuuuuuuaaacucuguuuuuuaaaaaaccugauccguagaaugacucuaguuuaacauuaaugaauuguacauuucuuuuuuuuuuuuuugagacagagguuuauucuuauugcccaggcuggagugcaguugugcgaucuuggcucacugcaaccuccaccuccugggcucaagagagucuccugccucagcuucccaaguagcugggacuacacacgcaggccccugcaccuggccuugaauuguacauuucagaauagcuagaagagggcugagugcggugucucaccccuguaaucccaacaguuugagaggcugaggcgagcugaucacuugagcucaagaguuugagaccagucugggcaacauggugaaaccccaugucucucaaaaaguccaaaaguuagcugggugcguggcaugugccuguagucccagcacuuggaggcagagaugaggaugcuugagcucaggaguucaagaccagccugggcaacauagaucuccccucuauuaaaaaaaaacggggaggcgggggcuagaagagaauaauuuugaauguuccuaauauagagaaaauguaaauauuuaggauuauggauaucccaguuacccugauuugauuauaugaauguaucaaauuaucacauguacccuggaaauauguacaucugauauguaucaguaaaauaaaauacauacauuuuaagagaggaucuuggcucuguuguccaugcuggagcucaguggcacagucauagcucacugcagccuugaacuccugggcucaagcugucauuuuaaaaaaagcaauagugaagauuuuugccccuuaauacauuucuuauuuucuuguuuaaaauagauuuuauauuuuagagacauuuuagcuucacagcuaaauugagcagaagguacagagugcccauuuaucuucugcccccacacacccacacccucccccagugugaacauccugcgcuggaguccaccaaagggauacguuuguuacaaucaagcagccuacagugacacauucuuaucacccgaaauucauaguuuacauuaagcuucacucuuguguuguauguucuguggauuccgacaaauguauaaugaccuguccaccaauguaguuaucaucguuucacugguuuaagaaaccucugugcuccaccuguucaucucccucucugccuccuaaacccuggcaacuguugaucguuuuacuguuucuguagaaugccuuccagcuggaaucauauaguauguagccuuuucaaauuggcuucuuucacuuagcaauaugcauuuaagguuccacugucucuuuucauggcuggauaguucauuucuuuuuagugcugaauaauauaccguugucuagcuaugccacaguuuaucugguguauugucaugcuaggaaccccucucccacccccacauuacaaacagacugaugucuucugucgucuucuccuuuuuuacaucguuguuucaacugaaauuauuggauuauauuuuuuccuucacuuacauuaaacucauacauacuuugugccuggacuucauucuuuucaguguaccuggcucuauauuuauucuuuuaggugaaucuuagauuugugguaacaaguucuguccaaaaguaucucaauucagauuauacggaauucguguuuaucuacugaguuuucauuuacguuuuauauugaacagcuuuuugucugggaauguaccaggagugaaagguucaggaaucucauacuguaauggagagacagaaaaaaugaacaugugagcaaauaauuuauguguaguuuuccuaggcaacucuuccuuuuuagagguagaaacacuggggucuacagaaguaaagucaaguguuuaaggucccauagccaguuauuacaguagccaaguuuuagcuagaucucuugucuccagacaauauuuaccacaccugucugccuuuguaggcugcuucauuuaauaaacuguaauucaacgcuuaaaacauuaauacuauacuaguuuuuuugggcugugucuaaguaaaacccauuuaaugagagauauaacuuaugggauaugccuagaaaauguggccuguagagagacauuucauguugaggaagcguaaauaauucccaauaacauagauuagaacaaugaguuuaaauauuaagugaucauggaaaauuacuugaugaaaccauggcuugagauuucagcaacaaaggagugaaugaaguacaaucugccaucauguguaaucuggaggguggcagacugagaaacugaaaaauguucacuuauuggagaagaguacaguugacucauaugauuuuuacaucaagcaucucccauguaccacugagucaguauucugauguucccguugggacucagcagaaggugcuagcuuuccuagguagaaacaaagaguugaagaugguugacauuugauugaaauguggaagaaugaguaggaguuugcuggcuggaccaggggcauaagugcacacuagacagaagaaaugauagcauuuccuuuuuuuuuuuuuuuuuuugagauagaggucucgcucuguugcccaugcuggaguacaguggcgugaucuuggcucacugcaaccucugccuccuggguucaagcaguucuccugcuucagcccugcgaguagcugggauuacaugcgugugccaccacacccggcuaauuguguguuuuuaguagagacaggguuuuaccauguuggccaggcuggucuugaacuccugaccucaggugauccuccugccuuggucucccaaaguguuggaauuauaggcgugagccacugcgcccggccagcauuuucauuuuuaaaggugugaagauguggagaggaaauccagcacuuaauuuuggagauuugccugacugugacaaguguuguccuggggcagagagaaaugaaacuagaaaggcaggccagcuucuuaaagguuuggaggaucucuugacggaguuuuagcuagaacugauaugauuuacacugaaaagcucuugacaguccugugguuuagagaagaguagagaagagguuuauuggugguaguaagguguugaugcaauuccaagucagagaaguugauugccuaaccgggucagugcuguuaaaaggcggcaugauggaaauucaggaagucaagucaggaguaucuuaacuugccccaaagagauggagaccauagaauugugggcuuagugacugguucaggcagccuuuaacaugccuguaaagacuauuaaaugccguuaaguauaggugcacuguuccaucauuuacuccacacguuucuguugaaccccuaugaggcacuccguugcugugauacgguaucaucucuccucaguccccacugugauauugugcagccacccuuugcauggauuccacacccuaccucugcacauccuguuuauaccauuccaggcugcccgccuuuggggacuccauccucauuccaguugaucugcacccuaaaugcccaccuugcucagcccuacccaccagcuuuaggauaccaccucuugccuucaugcagacaccacugcacugcgcaguguacuuuugacaguccccucuugucacugugcuuacguguagaccuaccucaaguuuggacuucguuuguuuagagaagcagcugaacguuaacaaagugggcguauuagaguuuaaaauauauguagaguuuaggccagauuguaggcccagucugguuccuuuuacugacuuaggaaaaacaaaguuuacccaggcacgugugguuaaauauaaugcaaaacugugguccaagggucuuaaugaaauggauagauuaaucugaggauuuuuuuuuuguugcuugauuauuauuauuuuuuuuaagguagggcuugaaaagaaggggaguggaacuagaggggaagcucggguauagccuugucuguuguuuauagucugcuuuuuaaaaauauauaaucaacuaaauugcucaugcugaaugauguugauaguucccagaaggagcaaauuucucagaugggcugcuguugccuuggguguagaauuuagcaaggugacuuuuggcuauuggauauccauagaaacagauggucuugcucauuuaugcauuaugcauuuuauaaguuauauauaguaaguguuugugcaguuauuuaaguguuugcauuuuggguuuuuuauuuuauaaaaaugaggaaaaacugguccagugguaagaaucauggaucucuguguuaaaauagacaaaaauggaaaucguuagcugugccaaaaacaagcuggcugauuuuuuugagacagagucucgcacugaugccugggcuagagugcaguggcgcaaucucagcucacugcaaccucugccucccagguucaagcuauucuccugccucagccucccuaguagcuggaauuacaggcacccgccaccaugcccagcuaauuuuuuguauuuuuaguagacacgggguuucaccauguuggccaggcuggucucaaacuccugaccuugggauuugccugccucagccucccaaagugcugggauuacaggcgugagucaccgcgcccggccugauuuuuuuuuuaagcuagcuauuaacuauauaaggaaaaaaauugcauguaacaugguggagguagauaauuuaaaguugugucaaaagacaaguuuaaguuagggauuuaaaaguaaguuuuagcuuucuuggaauaagagccguaccuaugacauacgcacaauucauuucuacuuuaggauguuugacuuacuauauuguacaugaaaguuuagaguaauaugaauaauguguaauauaucauauauaauucuaaacuuucauguagauacauaguaaaugucaggugucucuauucagagcaucccaguagcuuuucaauucauuguaaguuaaagucaaaagaaccugacacacccugggcagcauggcaaaacuccaucucuacaaaaaaauuaaccagucaugauggugcacaccuguagucccagacuguugggaggcugagaugggaggaucacuugagcccaggagguccaggcugcagugagcugugauugcgccacugcacuccagccugggcaacagcaggacccugucuuaaaaaaaggaaaaaagaaaauaauaauaacacaaaaaaagaacuugauguccacauggcucaccccccaguucauucugguuauugcuuaagugucacuauaucagagaagccuucuuugaccacacaaaccacucacugucuuaacucacuuucuuucauucugcuuaucaucaccggacaucguauuaucuacuuuaugucucucgucucucuccacuguaguguaaaacugaguggaggaacuugguauguguguucaguucucugucaguccccucuuggcaugugguggguguauaauaaauaaguuauugaaugaaugagaagguggugggagugcaggauuccccuggauagagauuugcaaauacaggcuuuucugccauuugcucuguaacuuggguugucuggaaucuuauaacauuuccuucuuugucccuuaccuuguggcuaucauuuguuuacucaguaacuugcacaacugcuuguguaccaagcgcuagcaggcacuggcgaaauacacgaacaguccgacaagucccugcccaaguguagcuuacagucuacgggaagcugcacugguaaauaaguucauugagcgccgugaaggagaagugugcuuaaacaaauaccacauauucucacuuacaagugggagcuaaacauugggugcacauggccauaaagaugggaccaauaaauaagacacuggggacuaccuaggauggggagagguggggacaagggcuuaaaaagaaccugugcugagugagucauggguucauuuguaccccagaccucagcaucacgcagugugucuuuguaacaaaccugcacacgugcccccgauucuaaaauaaaaaguugagggaaaaaaacaaaacaaaacaacuuauucuuugacuugggugugagcagcaguagcgauaggguaagccuauauuggccuaguuuucagcuuuuuaaaaauauauggcuagaagagguugaaacuugugauuaaaaugagucuuuugagugugugaaaaguauuuucaucacuuuaauuuuuuuaagugcucuagaacuagcuaaaaugggcaaaacguacuagaauaaacauagcugaaugaguugaauuuacaaacuaguggaagccuucuauuaaacaguaauuuaccuuguaaucauauuaaugucuaaucuguaucuuuauacagaaaaacguuucauuguguucaguuuuaguuuauccuuucuguugacaguggacauccauuaucaguucuugacuauuacaaauauuacugcuggggaagcauucuuggaccuauuucuugaugcccaucuagaauauauaugcuaaguucugagagaucagugccaaauuauuuucaaaguggucaaacugguuuacacugcuaccagcaaaaugcagaauuuauuugcuccacauccucuccaauaauugcuguuguuggacuuauacguguuagaccagucuagugugaguauaacacuguuucauauaccaaggaauuuugcuguuuuaguuaggucuguuaauggcauugguguuaugaaacaaauauucccacauuuuaaaaagagguguauauugauauauguagggaugaaaugaaauaauugggauuuacuuuaaaauucuucagcacauguaaagcacauuuugggaucaguucaccaaauuguucuguggaugcagauuaaaguauuguuuccguguuuaauuuacuguccugugguuauguaggacaguauaccuacccuuagaaaacacuugcugaauguuuaagaguacugggucauaauauaugaaagcugcucucaaguaguucaggaaaaaguuaacacacacacacacacacacacacacacacacgcuuauuuuuauuauuaaaaauagccucuaacuuaccccaccauguggacauaaccacuauuaaaguuugcuuccggaucuuuucgguaugcuuauaugcacucugauuuuaagcacaaaugguuacaucuucuauguagugguuuucaacuuuaauuuuccugcaauuaaaaauuaaaccgaguuuugauccugaauaauaucacaucuuguagcauacuuuauucaacuacaucucuccuuccuuccuuccuuccuuccuuccuuccuuccuuccuuccuucuuuuucuuuuucuuuuuuuuuuuuuuuuugagacagucuugcucugucgcacaggcuggagugcauuggcacagucucagcccauugcaaccuccgccucccagguucaagcaauucucgugccucagccucccgaguagcuggaauuacaggcauguaccaccacaccuggcuaauuuucauauuuuuaguagaguugggguuucaccauguuggccaggcuggucuugaauuccugaccucaagugauugaccugccucagccucucaaaguguugagauuacaggccugagcuucugcucccagcccacaucccauucuugaacauuuagauguucuucuuuuuuccuccuauaaauaacacaaguacacaggaauuuauaauguccucuccccaguugaaaagaaagcccuccuuaauucugcagaucagguuucucaauuaugugcauucauaguucuuuuucucggucacuuacgacaauuggaauucauuuguaugacuauuucucucucuccagucagacaugcggguuccauaagggcagagauugucuauuuuaaucacagcuaucaaagcagcaccaggcacacaguaggccugaaagauuuguuaaaucaguggagaauaauuucaacauaaacaauauauuuuauaaaagaucacuguguugcaacuuacuuugaaagcucuuaaauaacuuguuuguauagcagugcuuauggaaggcuacucuauuggaugaagaauagaaaacccuccacauugcaaacagugggacuuaacagugggagggccugccccucccaacucccucucacaggcaggagagccugcccucucauacucagucucacaaugggguuuagcuuccuuuucagagcuaaagaacccacccagccuuccuauaacacagacucucuuucaucuuuaauggacagaaucaagauuauugcugccagagauagaaaguuggggaaaaguccucgaggguccccuucuuuguuuggagcaauuugaugcagguagcuuguauuucuguuuaucugcuuccuguuucgucuuuuaucuuuuauccaucaccuuaagcauuuaugcuuuuuuuuuuaaucuuaagaaauggggguucacuguguugcccaagcuggucucaaacuccugggcucaaguaauccucccgucuuggcuuaucaaagugcugggauuacaggcuauaagugugagccacugcaucuggccaaucuuuuguuuuuuguaugaggguagcuggagcacuuuuaauuuucuaagguuaaaaacuuaccuuugcuucacuuaaggaaaccaugugagagaucuugaaaaaugcacuuuucauuuucaucacugcccuaccagcaacuacugguguacucugccaagauaagcuucagacaagucacuucucuggggauugggguuggagacugacuuauucuguaaagugggauuuuaacaaacucccacuaagaaauagcuuuaaaaaauuuauuuuuuugagauggagucuugcucuguugcccaggcuggagugcaguggcacaaucucagcucacugcaaccuccgccuccuggguucacgccauucuccugccucagccuccccaguagcugggacuauaggcacccgccaccaugcccggcuaauuuuuuuguuuuuguuuuuguuuuuguauuuuuaguagagaugggguuucaccguguuagccaggauggucucaaucuccugaccuggugauccacccgccucguccucccaaagugcuaggauuacaggcgugagccauugcgcccggccaagaaauagcauuuuuauaaagaacguacauuuuguuaccuacuuggaaggacggauugaugaaauccucaggcagagucucuggcuuggcuuccugugcuguuuuccaccccagagagggagcguucagauguuuacuguaguaaugucuguacccaccagguggcacaauugcuuuacuuaaaugauuuaagcucauuuugauucucagcgaggugugauaacucauuucuuauuuuaauaauaaaagaugccacaauauuuguuacuguauuuuuaaagagaauuuuugcauguucaguugagugaugagagagaaauuggugucauguuuccucugugguaccuaauccuacagcaagaguuucaaaaauauuuuuuuaaaaaagcucuaagaaggcuauaagccuugucaucagcccaccauauggugccagccuauugcuuugcauagaauauccaagaucacacaguguucugaauaucugcaguaucuagggggagggaagggugaguuaagguuacuguggcaauuuucaucugcauuucucccuucuuuugcacuugagacuuacugaggguacuagggcauuucguucauugaauuaaaaugaauauagaaacaauugaaguuuagcguccaucuguuucuuaccccugcuuucugucacuucaucaaccacaguucuauuaacuucauucaagcuagauacaguauguugauuagccuugguucccuguaccaaggaggcuguucuaaucugaagagcccuucugccucuaucuucucuccucaagagauagaacuguguuggcugguccgaaguagugaguuaucucaacugauucuucacaauugcagauggaacuccuuguucuucucucuuccugcuucucacuacuggacccagcuggucuuuuuuaaaagaaggaaaggagggaaggagggaggaauugugcauagagguuguuuguuuuuguuuuuguuuuagauggagucuugcucuguugcccaggcuagagugcaguggugcgaucucggcucacugcaaccucugccucccugguucaagcaauucuccugcuucagccuccugagcagcugagauuacaggcaugagccaccaugcccugcuauuuuuuuuuuuuuuuuuuuaguagagacgggguuucaccauguuggccaggcugguuucgaacuccugaccuugugauccacccaccucagccucccagagugcugggauuauaggugugagccacugcgcccagugcauagaggucuuaaaccuuauaccuuaucugauauuuaccagcugugugacccuagccagacuacuucugugagccucaguuucuuugugaaugagagugauaauggaacuaucagagaagauuaaaaaaaagauuguaaagagcuuaaaacaauggcucauaaauaauaaauucucagacguuagcuguuguuucugcuugucaguauagaugccgaaccuuuaggaagcauuccuucauugaucauuauuaucaucugaugacuuggcauucccauacuguccuacaucuguguuguuauuucguguguuuguucucuucuguugccuguguguugucucaagcuacugugggaaaucgguucauuuuugcuuauuucggcuugcuauuuaauacagugcuuuguucaugguaaguuuaauucaguacaugcuugauuaggcuuuuggaauuuuauaaauuuucuugaagaaugaggauuucacauucugucuuuaagugauauuaugaggaagcccauaacucauucaccuaugcucuccauaaugguaaaacgcaguggauggauucuugugcuucugacugacagauuggaaugucggccagguugcacaggcaggccugcuuugcgcacccuguacacuggggaagggugaugggugcaaaugccugggcccauagaaacgugcuggcauuuucuugagcagcguggacuuugcucauuguccugauuagcguuuacuucaugagucccugcccucaguggcuccucacuuccagauuggugaauuuuuaaucgauaagggacagaauuaagauuguuguugccagaguuggaaaaguccccacggaucccucuuuucuuuaagagcaguuuuuuguagguagcuuguauuucuccugcuccucuuccuuccuguuucaucuuuuauucacugacuuuuaagcaucugcuuaucuuuuuuuuuuuuuuuuuuuuuuuauaaggguagcugggaacacauuuuauuuucuuggguugaaagcuuuuuuuuuuugcuucaguuaaggaaaccacgugggagguuuugaaaagugcacuuuucauuuucauugcuguccuaccagcagcuacugguauaacucuguaaaggaacaggguagguggugggaagggaauagcaucagggauucugaaaaguauggcagcuaugcaugucccuugauuaaagaaaacaaaagcugaggauuauguagagcaggaauacaguaagagacaaggucugucaacagcauugcuugugcagauggcuauauucugaguaaacucuaguccagaacauucugugaggagaggaggaggaguaccuacuguggugucauuuucccaguuaggugauaaccuggcuuuauuggugagaacuaauucuugggaaggucagggcguugcuaaagauaacauagucauacagugcugacugugugccaugcacugcuagacaaacucauuuuauuuugagacagagccagaauuugacccgggucuuucuuacccuguacauaaccugugcugccuuuuaucuugugggacaggaaaccucauauguugacauuguacauaauacagcaccccaggcauucauucagcaaaugucugucugauuuuuguuggacauugggaacaaugaaaagaaugaaaaaguguauauuugcuaguagguauuagaugguaauuccuuuuacagguuagagggcuccugguacauuaacuuacuucaucacaaccuuccgagcaccuaguagacacaccaugugucuucauuuaaguaguuacuacaguagagugcuuucuuccuuuacuuuagauuugagucaucagggugaucuuccaagaauuuuuuuuuuuuuuuuggacagggucucgcucuguugcccagguuggaaugcaguggcacgaucuuggcucacugcaaccucugccuccaggauucaagcgauuguccugccucagccuuccaaguagcugggauuacagacacgcaccaccgugcccagcugauuuuuguauuuuuaguagagaugggguuucaccauguuggccgggcuggucucgaacuccugaccucaagugauccucuugccucagccucccaaagugcugggauuacuggcaugagccaccgcacccggccauccaagaaaauccaaaaguuacaugacuuuaaagguuaccuuaguaagaauaccuuauuguuuacaauauggcagauguccuauauaaccucagcugcagcauucgggaucuacuguuacugucuuguuguuccugucaccagcugauucuuaagauauaaagcaaaagaggaguugaaaauggaguagcauucaacaaaugcuugugugugucuuaaaauuuguagcuaaaucugguugcagacagugggcacaggcauuacaggccuuguuacugauguagcaggagggacucugagcagauaacauaugcccaagaaccacaggcaggacuagccccugugcugggccacuccagggacuccugcaucacuuuuucagccugugcauguguuugcucaaagaucgugcuacuggugaucauacauacauuccuuacucaguuaagguagauaauagugugcucugagacuugagauuuacagcagaagcuuaagguucauuuguuguucauucaccaaguauuuauuaaaggaaggaacccuucaagccaguuuuaaacaagcagaccuucuccagaguugacccucaauuuaccgcagauuguuuucgccuucuguccuuacauauuccugagugcaucucaugaccugguuuuuaaucagcuggccugcugucuguuucuaggucugguaugcugccauuugcaucucaucuccuccaguaugaacccccauauuaccugugucucucugcaggguucuggccagguauacagaaccaccuguucgagcagccucaucugacauuuuuuagaaucugagagcacuuuuauuuggcauaaucuaauguauugugaaggaaaaagcaagggacacacuuuggaguaauucccugcccugccuuuuuuuuuuugagaugaagucuugcucugucaccaaggcuggaguucaguggcacgaucuuggcucacugcaaccucagccucccaaguagcuggaacuacaggcaugcgccaccacgcccagcuaauuuuuguauuuuuaguagagaugggguuucaccauguuggccaggaugauguugaucucuugacuucgugauccaccugcuuuagccuccggaaaugcugggauuacaggcgugagccaccgcgccuggccucugcccugcuuuuuaaaaucaccaguuauacuuuugugacaagcuauggucauuucauuugucauuugcugaccuucaaguaaauugaaauuuuacuguaaucugagugaaguaaccaguuuguaacuauuuuaaauauuaaaucggaaauuaguggcuuaguauuagaauuaauauugagcugcaguauauaauuaguuauuguuugaauuagguugacuuuuucuuuugucaauggaauauuuuuccccaauuuuuagaauacaugcuucuauaagaguuggaauucuuuuucaaaauugauuucuguuuccuaaauugguugacaguucucccagagcugggagcaugcuuuugguauaaucgcauggcaaacuaaguuguagaagcucagacuuuuauuaggacuccucuguuuacucuuugugucauagugggaaaguggaucacucugagccuguuuucucuaaguuuggccauuguaccuagagaguaagauuuaggagccaagagggaauaggggcuagucaggauuuuacugccuacuucauacaguucuaugcuccuugauuuuuuuuuuuuuuagcuuguguuguuguuauuuuuuuaauucauaaaggaaaaucaugcaugaacauauggcagugcuauugacuagugcauuauuuuuucuuguacacuugggaagaaagacuagaauauccucagggaggaaauugauucaucuuuggggguggcagcuucuccuagagguugagucaauucauuuuccuugguauuuuccaugguucuugaaagcuagccaccuuauauuggaguaguacauauuugaaagcaaauaccaagcacugggucacguaaucuaucucuuaagaauuuuuuaaaacauaaagaauaguuuguucauuauucaaccugagcugaaacuaaaaaugacgcccaauuucauauuucuuuuuacugcuagacauguuguuuaaaguaguacuuguuuguuguagaaaguuuuaaguagaacuaaagauuuugucuuccuuuucccuuuuucuuuuuuugagacagagucuugcucugucaccaggcuggagugcaguggugcaaucuugguucacugcaaccucugccucccggguucaagcgauucuccugccucagccucccaaguagcugggauuacaggcaugugccaccacaccuggcuaauuuuuguauuuuuaguagagaugggguuucgccauguuggucagguugcucucgaacuccugaccucaaagugauucgccugcccuagccucccaaaaugcugggauuacaggcaugagcugcagcauccagcccugacuaauuauuuuuaaaaauuauuuguagagacaggauuucacuauguuauccaggcuaaucuagaacuccuggccucaagggauccucccgccucagcuuuccgaaguguuaggauuacaggcaugagccuuuguuuuucucuuuuaaagaagacucauaaucucaucaccaggugauacugcuguuaauauuugagaauauucauucagacguuucucugcaggaucaauaacuauuauaaugguucuguuuuguuacuguguguucuuuauuuuuagucuuguacaggacaaguguauuaguccguuuuuaugcuguugguaaagacauacccgagacugggaagaaaaagagguuuaauggacuuagaguuucacauggcuaggaaggccuuacaaucaugguagaaagcgaggaggagcgaggagcaagucauauuuuacauggauggcggcaggcaaagagagcuugugcagggaaacuccccuuuuuaaaaccaucagaucuugugagacuuacuaacaggagaauagcacaggaaagcccauccuccaugauucaguuaccuccaguugggucccuccuacagcacuugggaauugugggagauacaaaucaaaaugagauuuggguggggacacagccaaaccauaucagcaggccugaaauauacacguauaucaauucuagcagaccauaggguguacucugucccucaguuuguuuaauggcaucucuucuuguuuuucaguggaugaauacauugccauugccaaagaaaagcauggguacaacauggaacagguaauaucaugguuuucuuucuuuugcuguuaaaaaaugaguauuuguaacuaaauaauuauauuuuuuucuucuuuguauugaguagcaguguuucuucauuagcaacuuuuugguaauuacuaguaguguuacacaaacucuggucuucuuuuucuuguucaagaugaauauuagaggacccuuugauuugaaaggcauaucugucaucugcagaucuacagccuuuaggacacugauuacuuagugauuacuaaggagcuggaugcuugagcauaaugcuuucucauuugaauaugugauuuguuugucauucuucugguuguaucaugauguuuuuugacgcauguuuucacauucuuaccuaaaguguuuuaauauucaccauuuugaaucauuuucaguuugagauggagucucgcucuggugaccaggcuggagugcaguggcgcaucucagcucauugcaaccucugccuccgggguucaaguaguucucguaauucucgugccucggccucucaaguagcugagauuacaggugcacaccaccacgccuggcuaauuuuuguauuuuuaguagagaaggggccucccaaaguguugggauuacaggcgugagccacugcgccuggccaagauuuucuuuuaaauauuguuuggaauguacuaauaagaaauccacaagauuuauuuuucugcaaaaguguggugauaccuuauuucagcuuuaaugauuuauuuuaaacacaucaaguuggauuaaugcuuuccauggcauuaaucuagaucuuacaaccuggaaguuacugacauuucuuauuuuucugaaugauggaaguuaccaagaguuuagauuaugugaaauuguacccuuucuuuuggacuuggccuuacauuuaauuacucuauccuggucauugaagcuacuuuugauugcaaaauauaccuguaugaauucuuaaggaugguagucuugaucauuucuccuuuaaaaaugaucauuagcaugaaaauuuccuauauuauaauuccagcauaaaaauuaccauuagcaaaguauugcuggaucucaucuuaccucuuuuguugcuuauucuauuucuacuuuuuuucuuucuaagcugagaagaccuuuauauaucauauauauaacauauaaauauauauaauuuuuaaaauaaaagaauaacagcaauuguucuuucauaaauuacuuuuuucauuuauauauugaggcaguaaagugugauacuugaagagcacagauccuagaacuaugcugguucugugaccagaggcagggaaaggcagugccucagagaagaccuucaguuuauacucaggcugauccucacaauggaggcaagccuacaaccaaaagaaaacaaaacuguaguaaaaacauagcaaacccugaggaagagugugauuaugaguuuacuacauuauuagauucagauguccagguuuuaacagaaaaaucacagagcauacaaagaaaugguaaaguaugcccauucaguagaaaaaaauuaaucaacagaaacugucccugggaaaagaccuuaguggcagaucuacuaggcaaagauuuuaaaacaacuaucuuaaagauguuuuuaaagaacuaauggaagauacagaaaaaaucaagaaaaugauguaugaacaaauggaaauaacaguaaggaaauggaaaaccugaaaggaaaccaaaaugaaauucuagacccuaaacacuugaaaugaaaaauucacuagacgugcucaaaggcagauuggaagagucucaacaaagaacaugaagaaaggacaguggaaaugauuugagucugagcagcaggaugagaaaagauugaagagugaacagagccuaagguacccuagggacacaaucggguggacuaacauaugcauguggaaguugcauaaggaguaagagagauagggacagagagauuacuugaagaaauaauggccaaaaauuucgcaaauuuguugaaagaugugaauauaaacaaacauccaagaaacucagugaacuccaaguagaauaaacucaaagaggcucaccagagcacauaaugaaacuuugaaaagacagagaaucuugauagcagcaagagagaacuaaccuauuacauauaagggauccugaauaagcuuauuaggguauuucuugucaaaaccuuuggaagccagaggcaauggucugauauauucaaagcagcaagagaagaaaacugucaacuaagaauucuauaucugagaaaauucuuucaaaaguaaaggggagaaaugaagauauugucaguuaaaagcugccggagagucucucugaagagaccacaguggagcugaacuugccaacugguaaucccauggucuauaaauuggacaagaacuugaagcccaucaagcccaugaauaaaaaaaguuccuggggaugaagagaccauucauaaagccauggaagcuguggcugcccagggcaaggccaagaagugaaggccagcaggcugacugcucucucaaggagcacucucccugcccaacccauucuucuucaccucccugcugcacaugccacaccgaccacaucugcaggcaucuuacguuggagcugcagaugggaacucauggcucccauuuucauuguaaucaguuuugucuccugcacccacucccuucauauaaucuagucagauagcaccucuggugcagggagaaagcuccucuuauccaagagaguugagagguagugacuagggcuuuugccagggcuuguuuacuaaggaccuuugugggaggaaccaugcugucaugaccaaagaggagaagcaaagagggccugcuugaccccaggacccaauccuguacucuucucuagucaugccacugucaggagagcucugcucauuccaguggaagaugacaguaaccugcacggugaugugaaaaaacaacgauuuccucccugaucccaggguagguggcucuagaagguugagagcaauccuguauuaaguucauguguuggauuuacuuuuacaaaaaauuguauguauaaauaauacaaaacaaaaacccuucugagauuuuuuauuuuauuuuuuugagauggagucucacucugucacccaggcuggagggcaauggugcgaucucagcucacuacaaccuccgccucucggguucaaacaauucuccugccucagccuccugaguagcugggauuacaggugccugccaccaugcccggcuaauuuuuguauuuuuaguagagacaggguuucaccauguuggucaggcuggucucgaacuccugaccucgugauccacucacgucggccuuccgaagugcugggauuauaggcgugagccaccgcgcccagcccccuucuaggauuuuuaguggcaguucaaauagucccacauguggucaucagaaauaagccauuccauccuggacaacauggcaaaauccugucucuacaaaaaauuaaaaucagccaggcaugguggugugugccuguggucccagcuacuugggaggaugagaugggaagauuuguugagcccaggagguugaaaccagccugggcaauauggugacaccucaucucuaaaaaaaaguuuaaaaauuagccaaacaugguagugugugccuguagucucaauuacucuggagguugaggugggaggaucgcgugagccuagaaggcagagguugcagugagccaagaucaugucauugcacucuagaucacaacucuauaucaacaacaacaacaacaacaaaaaaaaagaggggggaaagaagccauuccucacaccaauaugggauaagcuccuugaccucuaagggauaggauugcauccugcuguggguuuucgaaucucuccccuaccuuguuuuguggcugugaaaugccucaugaucauguccaaguaugucuuucacuggcugauuuccgaaucacguucuaauugcuuggcccugccauguggacccaguauucauuuugagcauaacuguacuaaaucuuucuuucuagaucaguguaauaaagguguaaugugcaacuuaaaauaaauaaaagcuugugucuuuuuguuuguuuuguuuugagacaaggucuugcucugucauccaugcuggagugcaguggugugaucauagcucacugcagccucaaaccccugggcucagucaagcaguccuccugccucagccccccaaguagcugcaguuacaggcgcgcaccaccaugccuggcuaacuuguuguuguuuguuuguuuuucguagauucauggucuugcuaaguuccccaggcuggucuccauguucugagcucaagugauccucucaccucggccucccagagugcugggguuacaggugugagccacaacacccagccucagaaaauagcuauagaauauauacacaaggaaauagaaaggaauuuaaaucuuucacuauaaauaaucaacaaaacauaaaaaggaggcuggaugugguggcucacaccuauaaucccagcacuucaggcagaucacuugagcucaggaguuggagaccaaccugggcaacauggcaaaacccugucucuacaaaaaaaaaacuagcugcgcaugguggcacgcaccuguagucccagcugcucaggaggcugaggcaggagaauugauugagccuggaagggagaagguugcagugagccaagaucaugacauugcuccuccagccugggcaaggagagugaaacccugucucaaaaaaaaaaaaaaaaaaaaaaaaaaaaccuaaaaaaacaguaauucaggaaaugaaggacauaaaaaacuuuaaggaauguacaaaacaaauagccaaaugacagaagucccuccuuaucagugauuacuuuaaauauaaauggguuaaacuuuccaaaggacagagauuggcauaauggguaaaaauuacaggaucccaguauauacaagagauuuacauuaguuccaaaaacacaauuuuaaagugaaaggguggaaaaugguaucccaugcaaguaguaaccaaaagaaagcaggagugauuauaauaauaucagucaaaauagacuuuaaauuuaaacagguuguaagagacaaggacauucacuguuggugggaauguaaaaugguacaccugguggggaaaacaggauggcagcuccuuaaaaaauuaaaaauagaauuaccguauuauccacuaauucuacuucuggccaaaguggguagaucacuugagcccaggaguuuaagaccagccugggcaacauggcaaaacccugucucuacagaaaguacaagaaauuagccgggugugguggcaugugccuguaucccagcuacuugggagacugaggugaucaaggaggauugcuugagccugggagguggagguugcagugagugccacugcacuccagccugggugacagauccagacccugucucaaauaauaauaauaauaauaauaauaaauuuuuuaaaauuuauuuuagaagaauuauuuauaguuucucugugaccacuucccugaugauacauauguugccauacuuaacaaauaccaccuucccuuguugcuguaccuaacaaguuaucaccauccugaauuguauacuuaucauuuccaagaaaaauauuuuuauuguauguguaauuuccaauuaaaacauauugcauauuguuugaaaauuaaauaauuuauuuaaauugcuucacucuuucuugauacuuauaccuauauuaaaagacauuauaccuauaauaaaaauuacaucaccugaaaaaaaaguauguguauauuaccacaguuacaaagaauagaaaaaggggccucugacagugucugccacuuagcgcuguagaugaguuaguuugucuaaauaugaagucguuuuuacuuuucuuuugcuggucucauuuccauuuucauuguuuuuuguuugaucuaaaauuuuacugauaucauuuuuguaggcucuugggaugcucuucuggcauaaacauaauaucgaaaagucauuggcugauuugcccaacuuuaccccuuucccagaugaguggacuguggaagauaaagucuuauuugagcaagccuuuaguuuucaugggaaaacuuuucauagaauccaacaaaugguaaguagaugagaccacugaguucuauuuuuuuucuccuaucuaacucucuuuugcagcauacuugagauagggauaucauacucaaacauaaauauucccauuuuugauaaaguuccccuuuagauucagcuuaguacaugcugcucuguggaugggaguuuuccaguuacaggaguaaagcacuucuagcacuucccauccugucgucugugacuggacccuccccacccaccccagucccucuuguugggacucccaaaagauuagacccauacgaaggacuuuuuuuuuuuagacggagucucgcucuaucaccaggcuggagugcaguggcaugaucuuggcucacugcaaccuccgccucccggguucaagcgauucuccugccucagccuccugaguagcuugggacuacaggugcgugccaccacggccggcuaauuuuuuguaucuuuuuuuuuuuuuuuugagauggagucucacugugucgcccaggcuggagugcaguggcgcgaucucggcucacugaaagcuccgccucccggguucacgccauucuccugucucagccucccgaguagcugggacuauaggcgcccgcuaccacgcccggcuaauuuuuuguauuuuuaguaaagacaggauuucaccauguuggccaggauggucucgaucucuugaccucgugauccacccgccucggccucccaaagugcugggauuacaggcgugagucaccacauccggccuaauuuuuuguaucuuuaguagagacgggguuucaccauauuagccaggauggucuccaucuccugaccucgugauccgccugccuuagccacccaaagugcugggauuacaggcgugagccgcugcgcccggccuuaaacauuugauuuuuaaagauuacuuuuuuauuuaaauaaaccaacucauuuuuuauguuuagcuuccagauaaaucuauagcaagucuggugaaauuuuacuauucuuggaagaagacgaggacuaaaacuagugugauggaucgccaugcccggaaacaaaaacgggagcgggaggagaggugagcacauggcugggguguugucuaaccacuuaggggacuaucuaagagccccagauacacaaaggcaaggcagaaugacugguuuucccuccgcgccuuccugguggaaccacauguucaugagauguauuagagcgugucacauuauucagguauuuuuucucaccacucuuucccugcagucagugaacuuccauuuugagucaguuaacuuugacccauuuuuuuuccuucccauuuagaagggguggcuccuuuuaauaaaaaagaaucuuuuauuuuguaguuugagguuuaacgugguauauuuuuacaagauucauuugguguguuuuuauguuugccauguggaaacaaaaauacaacuuagaguugcugcuucuuuuuuugaccaucuguuuuuugugugugaaugagaaagagaaacauuuuauaaucucuuaguaaggauauuaguuuuaaggauagcucaguauggagaauacuucuuaaccaucacuuccucagucuuauauguagcauagagaaguagaaauggccagguacucacacucagaaaugggcucuggucucagcucugaagauuccacuuacaugccacaggcuacacugggauguuuaaggucuuuaauuuauuuuuuaaaauguguaaaauuguacauacucacaggcaggugacuucaacaugcgucuuccccaagcuucuguuuuccuuaacucuaaaaugaagauguuugaaguccagaaggcagcaugcagaccuagugguuuccuuguuaggguggugagauauauagguggguuuuaaaaaauccuauuuuccacauuuccuguaauauuuuuaucaauuaauaauaaaaaaauaaaaugaaggaggaugaaauauaugguccccggugucccaucucaggauggaauuuuaucauuucaaaugaaagaguaacaugugagaacacauugaaaguugaguaucacuuuuggagaauucaaaccucuuggcccaaguauaaauugagagugauguuaagaacaucuccaaagcucuuuuaauuguaagagccuauaaaauuaucgaccaugauacaucugcauauuuuugccucugacuuauauacuaguagguuuauuuauggaugaguacucuuauuaacuuuuaaugaagcuuuuucauuucccuaguuuacugucuauauaguaagucuguuacuauaagcagaugcaguuuacuaagcagcaaucaaaauuaaauaauacagagugggauuggauauccuugagugugaaauaagaauaccugccaacacuuccauucuuacucccuggaggcuuuuuuuuugcauuagucccgauggggccaggaagugcuuugccuccaccucccaugugcaccucaaccacuuuugggaugcggggauggaggugcugcagcagcaccugauaaauuguuggcuuucuaacaggacuugccugugaaagucauggcagggacugggacaaaauucccuuagccgaaggcucuuucuuguuguggacacucuuuccucagcuagagcuuccugcuaccuugguggaggauggggaggagguggcgcguagugggcauggucccgugggauggauuccagaggcagugcgaggugggcaaacuggggcaggcuacuugacuucuguagacuuaguuuucuuuuuuuacaguugcauuccuaccuacaucggggcuuuucuuguuucuuuguuuuaaauuaaaugaaauacuacauucaggauauuacaaaaagcauuuaaagugcuauaccaauguaaguuuucuuuuuaaaauuaaacauaauuuuaaaacaucaguuguccaggacaccagaaaagccucagacuuuguguggccuuggguagaaagacgguacuuggaaaaggauuuuuuuacuguuagcagguuuauucccaaugcaguggaaauuuauucucccauaauuucucaguuuuguuuaguaaucauauccuaguccucaauagauaauuaugagaaaauaacauguaaaugcauuuucauuuugauauuuucaguuuacagauauagagcaauaguguuuuagaucuggauugggaaguuaggaaucuauuuuaguaguuucucaucacuuagacugaaagaacuauggaguugguauucuguuugaauuacaaagauguuuuuaucucagcagccugaaaacauacuaauuuuauauuaaaucaguuuauuauuuauauuugguaaaauuaguacaaaauuuucaguuaaaucaauuuaucguuuguauucggaaaauuaguacaaaauaaucauucaguaacuuguucuugucuuccagcgaggaugaacuggaagaggcaaauggaaacaaucccauugacauugagguugaucaaaacaaggaaagcaaaaaggagguauuuuuucccccuaguauuguuuaggcgaauaaauuuuauuacuaguuucauaaauaaaacauucauguugcuuguucuacuuaauauauuaagugcuauguggaaagcagcaugauaugacuauuuuucaacaauacugucuuugcuuuauagauuguauaauuuuguuugcuaauagauaugaauaaaggaaggcuuaaaggauagaaaauagcacuaaugaguaaugauguucccuagaacagcaguccucacugacuuucuucguaagccauuagcucaguagguuaacaaguggucuagugaauuccaggcagccuuagggucuccauucacgcuauagaugccccagcgucugcccauccuaggcacccaugccgugccuggggugacugcagggagcuggcagggacucggcacagcccuccuguuacucagaagcagcaauuuggucacaccagggggagccaggaccauccucucucacauggugacuguuucaucuuaucauuuuaaaaaaucauuauacaagagauuguaguuucuggauucagggggcucgugaaccucuacaauugcauguaacuuuuacauagguucauagagguauuuuuccaaagacacagucuauaguuucaaaaaaauuucucagagaguucucucucucugcuccaaauuauaagaauaguuauuauuuuaagccuauaaaaacagaagggucuaaauuuaucuaaacuuuaaaaugacaucaguaauauauguuucuuauagacaagguaggaaauacagcuaacugaaagaagaaaauuaaagugauuuauaauauuauccauaaucacugucaaccuuuuggugacuuuuuccugagaacucuuucuguaaaauguauaugccuguauauucauaauucugaaucuagucacuuuuuaaaaauaauauaauggaagcuuuguaauuuuuagaaccuuuuaaauuuacucuaccuugauuuuuuuuuucucuuuuuucuuuuuugagacagggucuccugugucacccagguuggaaugcaguggcaccaugacucacugcagccgccaacuccugggcucaagcaguccuuccacuauggccuugcaaagugcugggauaacaggcaugagccaccuccagcccuugauuuuauuuuuuuuuauuuuguuuuugagacagucucucacucuguugcccaggcuggagugcaguaguaugaccuuggcucacugcaaccucugccucccagauucaagugauucuccugccucagccuaccgaguagcugggauuauaggcacaugccaccacgcccugcuagguuuuuuuuuuuguauuuuuaguagagaugggguuucaucauguuggccaggcuggaccuugaauuuuuuuuuaugucaaauauauuuguauacguagcuauauauuauucugucacaugaauguuucauaauugaguuaccuuauccuauguggauuucccaguuguuuauuccuccuguuuuuugcuuuuauaaacaaugcuggauugauucucacauaacucacuaucugugcucauagauuuuuuucauuagaaccgauuccuggaaguuguauuguugagucaacguguucuagauacauuguuaaggcuuuuuuuuuuuuuuuugguuguauaucaccaaauuggaaauuggucguuuuuuucugcauaauuuauaugaaugcccaaauaagauccugaggguuagcuaaauuagauuguuugggaaaucaaauuguaguuguaguuuuuauuaagcuuuguguugauguauugcuauuuacuagguuuuucaguggcacauuuuaaaugagagaaaacacuugauuucauacauuuuuauaauucuuauuuauauaauuucugauucagaaagaaaauggcuaaaucauuguuuuuuuuuuuuuuuuuuuuuuuuggagauggagucuugcucuguugcccaggcuggagugcagugguccgaucucagcucacugcagccucugccucccagguucaagcaguucucugcuucagccucccaaguagcugggauuacaggggcccgcaaccaugccuggcuaauuuuuguauuuuuacuagagacggaguuucaccaucuuggccaggcugguuuugaacuccugaccucaagugauccacccaccucggccuccuaaagugcugagauuacagccgugagccaccacaccuggcccguaguuucuuuuuuuuuuuuuugagacggagccucacugugucgcccaggcuggagugcaguggugcaaucucggcucacugcaagcugcgccucccagguucaugccauucuccugccucagccucccgccauucuccugcuucagccucccaaguagcuggggcuacaggcgcccgccaccgcaccuggcuaauuuuuuguaguuuuaguagagaugggguuucacuguguuagccaggguggucucaaucuccugacuucgugauccgcccgccucagccucccaaagugcugggauuacaggcaugagccaccaugcccagccaccuggcccguaguuuuuuuaaguauuaaaaugauacuagaacagacguagucaguuggugaucuuuauuaaacaucguagucccauacacagcaguuuauugccuacuaauauuuuuguauuacccacuuguugaagaaauuaucacuaccauuauaguuuugcagugucuuuagcucagucuuuuaaaauaugaagcagaaagucauauuuucagcuuuaucagugaaugcuaaugcacuaacaagauggaauuaugagcaauuauaaaaacuucuuguucuuaaaaugguuaccaguaaguuauauucuuuaacuugacaagauuuuacuguguuucauuucugaaaguuuugguuuuacagaaauuaauagccgucaugcauuuuaaaaugauaagguauauuauuuuagaguaaguuauauaaguugccguaaaaauuguguuauccaaaaauguguauaaaaagcuguaauuucauguagcuaaauacagauguguguguggccacaaaacucauuagcagagaauacagauuuuuuucuuucuauauuacuagaggaagcugagaauucuuauuuucauuggcuugaaacgauagaguaaggaaguauuuguacaagaaggaguggaacacaguuucauuguguuuagucaaaacucaguagcccaaauucugucugugaacugccuguuagaauuuauagaucucauuugguucugauagggcaugguauuugucuuagauuguuuuggugccauguuaaggaaauaaauauguuuauuacugaucauuugacuuuuuuuaaguuucauucaucaccuguguauaucaugcagguucccccuacugagacaguuccucaggucaaaaaagaaaaacauagcacacaagcuaaaaauagagcaaaaaggaaaccuccaaaaggaauguuucuuucucaagaagauguggaggcuguuucugccaaugccacugcugcuaccacggugcugagacaacuagacauggaauugguuucagucaaacgacagguacucauaagccuggucuuggauguaaaagaauuaauuagcacuuuagagguguuucuguuauucauauaugugaauguucucuuuccgcaaaucucaaaggagcauuuuguuucgaaggaauuggacagaucuuaaguaccagcccauuguuuuucuuuuuaaugaacauauaaauugaaguguauggauauagugugaucugaaaguauuucugaaguauauagcaaagcauaugaauaucauauuuauauuauauaugugucugugucuccaugauuucucacaauaugaacauacccuaguaaccugcaucuggaucaaaaaauggaauguugcccccaggcccaugcauuuucccuccuggucacuauuccauggaauguugcauucccucagcaacuccaccccucuuuuauuaccugacuccuccuuguagguggccacuauucugauuuuuuuuuuuuuugagacggugucucgcucugucgcccaggcuggagugcaguggcgcgaucccggcucacugcaagcucugccuccccaguucaugccauuuuccugccucagccucccgaguagcugggacuacaggcacccaccaccacgcccagcuaauuguuuuuuguauguuuaguagagacgggguuuuaccauguuagccaggauggucucgaucuccugaucucaugauccacccgccucggccucccaaagugcuggaauuacaggcgugagccaccgcgcccggcccugauuuuuuuuaauuuuauuuuguuuuugagacagugucuuguccuguugcccaggcuggagugcagcggugcgaucuuggcucacuguaaccuuugcuuccggggcucaaaugauccucccaucucagccucccaaguaguugggaguacaggcgcuugucaucacaccuggcuaauuuuuuguguuuuugguagagacgggguuuugccauauuccccaggcuggucuugaacuccugagcucaagugaucugcccgccucagccucccaaaguguacugagauuacaggugugagcuaccacacucggcccuguucugauuuuuaaaaccauaaguuguuuuuguccauuuuugaauuuuauauaaaugaaagucaugugguacuguuuauuuuaugucuggcuuucuuucaaccugagagcuaaacaguuuuucaaagugguccugucauuuuaugugcguuuuguuugcacaucagcguuucccagcuguagcacuauccucaugaugggccguucugugcacuguaagauguugagcagcaucccuggucuugacccaguagaugcuaguagcacccuccccuaccaguugugacaacagaaauaucccuaggcaucaccagauuaccucacaggggcaaaauuguccccauuugagaaccacugcucuacaucauugccauauuuugguagucuuaaauuuuagcccuucugauggguuauaaugaugccucauuguacuuuuuauuuggcaguucccugaugacuaaugagguugcucaccuuuucauccauuuguuggucauuuggauauccucuuuugugacaugucuacucaagucucaucuguuuuuuuucugucagguugcguauuuucuuauugguuuauagguguucuuuaggcucugaguuguuuucuacaacuuguauuuuaaaugcuguaaauauguuuugcauucugugacucucaaugguaucuuuugaugaacaguaauucuucauuuuaagguaguuuaguuucuuagucuucugagguuaguguuuuugaguucuguucaccuuucucaaggucaugacgauauucucucauguuagucuuagaaguguuguuuuaccuuuuacauuuugaucuagaaauguuuuucuguauuuguuguuacaugucggauuaauagucacuguuuuguuuucauaugaguaucaauuuggucaaguauuuauugaagaaacuguccuuuauccuuugcaacgcagcaggaccuuuguuuuacauccagugucuguaugcauaugggucugguuugagguucucuguuccuuuaaucucuuuguccauccuucaccaauacauacuguccuaacuuuauguacuuuauuaauuuaguuaucugguguaauauaaguucuccaagauugucuugguuaucccuggccuuuuacuuuccauauaaaauuuagaauuacuuuaucaauuuucagaaaaauaauucuauuagaguuuugauugggauuguauugcaucuauagauaaaaauggagaauuaacaucuuuauugaguuuucugaucagugaaccugauauaccccucuacuucuauagguuuguaauuucucucaauguuguauuguuuucuguguaagaacuuaacgcaucuuuuguuagucauuccaugauauuugguacuuuuuuggugcucuuguaaaggauauuguuuuuuaaauuacuuuuuauaauuauuuuugccugcuauguagcuuauuauuuuaaucugauugcauaguacauuuaaacugaaaauucaaccuaguaguuggguccuguccuuucauucucucucuggaauucaguuuccagaaauccaucagcaaguuguugacugacuauuuuugguuuuugcugcuuuugauuuaucuugaugguucccuuggaaggucaaacaguagaccaacugucaucucauagacgcgaagagcagggcgugcugcugucuuucuugugguuuagggaggcagcccagaccaggacccaagcacacucugugugcucagaggagcggcuucuucuuguggcugcuggcacagcugcacucuaaucuuaggagaaucacuuaaucuuucuaggccucuuuucaaaugagauuaauccuggccugccugaucucacagaauaugucugggcuacugugugagagagcauuugaaguucuguuugcacuggaagaacugucucgggcugugagcucuuguugacauugucaucuuccuuuacaaggaugcuccuuucucccucugcugagugagcuccuggugguugcuguuuaauauauugagaaaagaaaaagaggccuuccucuugcaccgagguguuauugacuccauagggugagagagaaaagauucuuuaguuuucagagcagggucaagagcaagaauuuuuaaaauuugaaggucgcucacaauuaugaagagggaggacucagccucacucagagaggaggugggugauuuccuuuccacagccuuuuagcgccacagugcagcaguguguucauugccaaaugugcuucuagacucaaaaugggcagucaguccacuugggccacuuguucuggaggccgccauguuugguauaucaaggauauauucugaaaauaacagcaaacucgacuaacaacagcuuaaacaauuuaggguuuauuuuucucaaauggcaagaagugccaacaucaguggcuacugguguuaguucauguguucagucaugcucucagggacccagguacuuuucaggucuucuacugugccauucucagcuguuggcuuuucaucuugcuuguugccucauguuggaagcuacuggagccauuuugcaacccucacaucugcauucagggcaguaugaagaggagguggggguggagguaaccugucugucccuuuuagcaggacaagcaaaagccuuaccggaagcuccuuagcugaauucugugugcccgugcguugcguacugcucuuccuccuucccaagacaucaucaaccucuaccagcgagaagggggcugggcaugucucuuaaauuagccagugaacagugcugguugcaucaggucuuucucugaguggagaauaaagugaucugauguuaaaagaggaaucacugugcccacaguaaaguagaaaacagaaaguucuguaugacugaggguugggugggaggguggugucuagguagggcgucaggacaaguggauggcuuuucuuuuucaucuuguuuuuucuuuaagugugauuaccuuugcauccuauuucuuaccuauuucauugccacucacuuuccaguuagcaugaugguggcaguaaucucuguuuuuuuccugcuuaauaaacacuagauguuuggcggggggaagggggcguauuuuguuuuuuggagacaggaucuugcucuguuguccauccugggacuguagugauacagucauggaucacaguagccucaaaggccugggcucaagcaguugcccaccucagcccccuaaguagguaggacugcaggugagcaccaccacaccuggcuaauuuuaaaauuuuuuugguagagacagggucuugcugugucacccaggcuguucuugaacuccugggcucaaaugauccuuccugccuuggccucccaaagggcugugauuacaggugugagccacugcacuagcauaauuuuuuuuuggcagggucuggcacugucacccaggcugaagugcaguggugcgaucucggcucacugcaaccccugccucccagacucaagcuauccucccaccucagccucgcaaguaguugggacuacacagccuagauauuucuucuucuucuucuucuuuuuuuaaaauuauacuuuaaguucuaggguacaugugcacaacgugcagguuuauuacauauguaugcaugugccauguuggugugcugcacccacuucgucauuuacauuagguauaucuccuaaugcuaucccuccccacucccccaaccccacgacaggccccggugugugauguuuccccauccuguguccaaguguucucauuguucaauucccaccuaugagugagaacaugcgguguuugguuuucuguccuugcgauaguuugcucagaaugaugguuuccagcuucauccauguccuuacaaaggacauaaacucauccuuuuuuauggcugcauaguauuccaugguauauaugcagccuagauauuucugauacggaaaaugcaucaggaagagggguauaggcuacugagcauuuagagcuagcuuuuaguucagaauuuuagauguuuugcauuuacucucucugcuucuuuuauaacguuacuuaaucacagugcaauauauacccaguuuuguacuaucuaugaacaaccagcuagagugacaagaguggucuguuucacuggaaugcgaagaggacauguaauauucuaaaccuugacuuuuuccugccaaaaguugcuauguugcauuuuuagccaaaaaggaauccagugaacauaaucugaguacuuugcaauuuuccuggguuuucgguaacugaaagaccacugagcaagauccuaagagauuguaaugucuagcauggcagccagcagccccaugugugguuguuuaaauuuagauuaauuacaagugaaaaaaauuuaaaaauuuucggguagcaucuucuacucaugaaugucuuuuacauuuuacuugagaaaaucaagcuccucuuccguuggcuuucuuaguugcuugugugauuauucaaagaugaaaaaugcuggaguucagaguucccuggugcuugacacggauaugcccucuacuuggaguagagagaaaauagcauacuuccgugaccugucucauucaaggguccaugggaaaauuaaggagcagccauagccugggagguugguauuguuuguggucuuucuuucgacuggguaaggacagugaaagauuaccuugagccaaggcaguaauguggaaaaagauaauuuguaggaaagugaagacgugacaguuaaucaaaguuagacuucuggaaaucucacugacauuguguuuuccucgcccccccaucauuaaagaaaucuaugcuugugcacuucugcccuguguagaagcgguggacagcacagugaucuuggggcgcugugaggcugcacccgcaguucuguuguaaagacugggccuuuuugguccuuacuguggcugcucuguuacuucaguucaauccuaugugguaguaagcccagggauuucuucugucuuuuauguaagacuccagguagguguuuugcugcucagguaucaccuguuaggaagcuguggauccaggacuguguacgugagagcccuccguccccuccuccuuggguuguaccuuaucuguugcucugaacaagcaaauaauaaaccuaguuagaugcuucaaaggauaccauagggaucucagaauucagcuacaacagauguuaguaacgucuuuacucuuggguuuuuguuucuuuagguuuuuaaguucuguuuucauaccuuuauauaguuuuuauuuuuaaaaugaaaauuauuuuuuccuuccuagauccagaauauuaaacagacaaacagugcucucaaagaaaaacuugaugguggaauagaaccauaucgacuuccagagguaggauuauguuaacaucaucuuagaagucauauucaaguuuuacauguuuaagaauuuaauaucggugugauacauccccaguauacaucucuuggaagaguauauggacauaauuuuaugaacccaguugauguuaaaauuccgauaagagaaaaugaaagguucguuaagcucauaaggacauacucaucucuaaauguaaugugcuaaaaugacucauuuggauauccaggucauucagaaauguaaugcacguuggacuacagaagagcagcuucucgccguacaagguagggggaaguucuucuaaagaguuuaggaggccggcugugguggcucacaccuguaaucccaacauuuuggaagguugacgcauuugcuugagcccaggagcucaaggcugcauugauccaugaucacaccacugcauuccagccuggacaacagagggagacccugacuuuaaaaaaaaaaaauuuuuuuuuuaauggaaaaaaaagagcuuaggagcauugguagauuuuagggaaaaguuacguccugcccuacucccagcaccuagauucuuggacaauuauguccuaguggauaucauuuuagccaaauuacuguauuccuuugggcuuuuuucuuuuccuuucccacuucucacaaguuguaaaaacuuaaccgggaacccugagucuucuaaagguguauuucauuuuacuaguuacucaucgagcucugacuagccaggaaguacaaaaccccaaaagaagcagacagaguguucagcuuuaaagguugggggugcucuggaccugcgauaccaaaagaugaaugcagaauguccccaacccuagggcaauugcugggugacuucagcuguuaugugacauguaaugggaagacagauaucaaaaugacagggucggucaucuccagaaugugucuagaauuggcugguacuuuuuccuacucuaauaauacacgaaauuauugccugcuguuaaaagccuguauguuuucuuaucuggauaaagagguaagugucacuugugguuuuaaaaaaauguuuuucucuuguauuuuaaaaaaugcuuucuuacauccuuagccaucaggaaauauggccgagauuuucaggcaaucucagacgugauugggaacaaaucagugguacaagugaaaaacuuuuuuguaaauuaucgacgccgcuucaacauagaugaaguuuuacaagaaugggaggcagaacaugguaaagaagagaccaaugggcccaguaaccagaagccugugaaguccccagauaauuccauuaagaugcccgaagaggaagacgagguaaaucugaaacaaaacagucacuucucuugucagguucacgcuugauacuccaguuucuaaagugaugaauuuuuucagcuauagagauuuuuagguaucagcuguauuaguaacuucacucuuaccuguaaauagccggaauguguaugcauugacuccaguucuuggugccuguauauuauucacauguuaauuucugggcaaauccugaauuacauccugauuuccuccagcuacaaaauacucugcauuaucaguuuuuccuuaaauacaguaaaaucuugagugacaaagacaggggagugggggcauaaacaaaaaguaaaaaugcagugaaagcuguccugucugugagggaugucgaugaagcuccgucaucugcaaugugcagucacaucaucaugacgcagcacagcgagccagccaggagcuccugaggccucucccugcuguccagaucuuucagccuuugaugcucuuuggggcugauuggcuuaaguauugauggggacaguucuguggcuggcuggaacuucugugaugguggcuaauuucuggaaugauaacccuggucucaucugucaccucccugcuuccugugucaggggcaccugccauuuccccaucuagccuggccugccuugcuguuacauuugucccucuauucccagagcagaugagccuggggcugggcauaagaaagaguuacuugccaaucacuuugcaucugaauuuguucacaggcaugguaauuuaagaauuaauuuagcuuuguaaggaaagucacuuucacaucaaagccuuuucaaaccauacuggaauguuuugagauuaccuauuuuguauugcgugugcuaccauuuugcuccaagggccuggcucuggaaacagcccagaaggccccuccugaccugagcauggaaguaccucgugagguauuggcauccccugggagcguggugccgccacuccaugcagggccucuuugcugacuggagaaaggaccucaaggcacagccaucuguaagaacaccauugaaacauauuaaauuuguuagaauuagauucuuuagagccuuuugccagaaaaucuuuauaauaaguguaccacgucuauaauauugccaaggucaguaccccugaaucacccccaugcauagcucugccugaaaagagcaugugaauuaaaugaugguguuuuuaucuuucagcagugauuuuuuucuuuauuauuauuucuuuuuauuuucagugauuuuuguaccagcacuaauugccccuguuagcacucaguuucggaagcauugaaaagcuggagacugcuggggaagaaccauuagaauuugcaggaaugaaagcuugcuucuuguguguguguuuuccggcuucggucccaggaugacuggaagcagaaacaguugggaacgcuggcucuauucccucuucgcauuugaucaaagccaguguuggcugggcuggcauaacaaaucucauaguaaauuuaggaccaagagucccuaccaacaggaugucaguuguugugcauauguuuuuuucuucauucucuuauucuuggaucauugguugacugacuuaagugagucaaguauuuuuuuuuuaaccuuguuauuagcccagaagguucuuccguaaugauccacuuaccguguggauugcauuaucaaaguaccgucuuucuuuucacagucuaguuauggcuccuccaagcagcagaucauaguuuuuccuuggugauugaucuuccaugucucuauuuacccagccuucucugcaaaacaaaaugaagaaugguauuaucuaacucguguuuaguuucauaguccuuauaucccuuuacaaacuuuuucacuccgcuagucauuuaaaauguacccccucauaccuuucuuuucuuuuuuuuuugagacagagucucccucugucacccaggcuggagugcaguggcucaaucucggcucacugcaaccuccaucucccagguucaagugcuucuccugccucagcccucagccucccuaguagcugggauuaugggugugcaccaccaugcuuggcuaauuuuuguauuuuuaguagagaugggguuucggcauguugaccaggcugguuucaaaacugcugaucucaagugauccgcucgccucugccucccaaagugcugggauuacaggcaugagccaccgugcccggccuauuucuugaguuucuuucuuuuucugcuucuuguagugccaccccugcccugccaccuaguuuuauguucuccauauguuaguuugcagaaggaaauuaaucuagugaccagcugcuucucuguguccaagggccuaagggaacuuguuagaaugcuggcuuacuugucugucuggugaguccacagaacuugggguguguguaauuucaccuuuuuauuuguccuguagaguccaacagcugagaaagaugucugcuggugucuugccugucccuucugcccucagguuuuauguauuaugcagaagccacagggagaacaugagaauuccuagaaguucuaguaacagaauggucugucaguuauagauuauuuccuucagggcuuagaggcagguagguagcccaaggcauuuugagcuuuugaaauucauaguuauuugacguggacaaggguggguugggaacagugucauauccaaccuuacacugaagaaaggaugccauggauuggacagaaagaugucacuuaaaauuaugaaaugauuaagucuguuaccagugaggagaaaucuccuccuguaucuaagaacaguucuuguacaugguaugguuuuuagcugaaggaacaaucacuuugcgauuuuggaugcauggcccaguuguuucuccagcaaugagaugccaugagcauggcagagagcaguaagacgcuaugcagccuuuagguuugggucugggaguccuuuuuaaaaaaugggagaggggaguuaggaaaugccucauagcuuuuaaagaagauccugggaucguaugggcuccuguaucccagcuagaaccagugacugggugcugaacgggcugggugccacagcaugcccucaagccagugagaggaguuagggcugccacugugcuuauaugcccuuuucagguuuuuuuguucauuuguguuuuugagacggagucuuguucuguugcccagagcaaguggagugcagugguacgaucuuagcucacugcagccuccaucucccgagcucuugauucucgugccucagccucccaaguagcugggacuacaggugugcgccaccacgcacggccaauauuucuuuucaguagauagguuuugccuuuuuggccaggcuggucucgaauuccugacaucaagugauccaccugccucagccucccaaagugcugggauuacaggcgugagccacugugccgggccguuuucaggcacuuaaauuuaauccuggugaaguagguauuaucacuaugugucuucugcacaugaagaaacugaaacucaaaaacacugauaacuucuuugcacauauugggguuugaggccaagacgucuggcuggagaggccacacgcuugcccugcccuuaagaacauggugggcugggcgugggggcccacacauguaaucccagcacuuugggaggccgaggcaggcagaucacgaggucaggaguucgagaccagcccggccaacauggugaaaccccgucucuacugaagguacaaaaauuagcugggcguggaggcaggugccuguaguugcggcuacuugagaggcugaggcagaggaaucgcuugacccaggaggcggagguugcagcgagccgagauagcgccacugcacuccagccugggagacagagugagaccugucuccccuccaaaaaaaaaaaaaagaacucgguguuugcucugcagguuugcuggcuaccuucucuuuucaguacacuggaaauagcagcuuguguuguuuaccuacucuuugauccuuuuuuuuuuuuuuuuccucuuggccucaggcuccuguucuggaugucagauaugcaucugccuccugagaaacugguggcuuugaacacuugguguggacuacuguguuauccgggauaucagguauuaugagacaucaccuagccaucugcaucacaucucucuggacaagcagcuauuaccaaaaaaggcauauacuuccaguccugugcuccaucugccuuaauucuuugcucguuccuccauguuggcgccacuucccagagagcuccacugcaucucacacucugcccacgugcuggggaagucucacggccugcacaucucuugugacucugggaaccgccucucccgccggagcccccgagccccaccaauggcagcucuucccagucagcagcuucagagcaggcagucuccuuggaaggcccgacucuguuccugcauggccugcaguuucuacuuugugcauagagucauuuucagagucaccgcgacccuguuggccuucuagaaaguuucuuuuguucuuuucugagacaaccaccuaagugauaauacgcuuuuuuggaaacuaauauauauugccagacugcaucauaaccuuuaucaugccaagcauccugaugcaacucacauuucccuaaacaugggguacaguuaugauuuauaaauugaguuggcuuaaaucucccucuucucccuucccaaguguuacaaagaucauuuacugcaacugucguuggacacuguagcuuaaagggaacguggaccucaaugcuuucugccuucaacuuuucagcauugugaccccagggugguugccaccccaucuuuuccugaccccccccacccccccaccuccaagagguucggcccacaucacuguaccuggugcuuguaaauuuggaauuggugccuucuccuuuuggcaaccaugguuaucaauccuuuuucuguuuuagugucuuauuucuucuuucaaguuauuugcuagccaaagaugacaucacugagauuaggagacaggggagagcuugcugcagauucugacagugcagauuuuaaaugucaggauauuagaauagcuggcgcugguuuaugaaagcugcgcguuguuccgcguucucucggugugccuggccuuuuauguggcacucuguaugucaguuuguguccuucaugugcugaugugauuacacaaacaccaugcacucucuuuucauaucagaguacaggacagagaagugaucaauguauuggucuagugagacugagaugaaaagaaauaaccuacagaguggucuguaaugccuuuugguuggacugggaacaaguaaaaauuucuaauaaacauuuugagacuuccagaaucacuuuuguuaucuuaucagaccaugggccugcugaggguugagcagacagccugcauucuaacauacccuguucccaccccacggccauucagacugcacucaauacgcugaagucgcuuuuguuguuguuguuguuguuugcaucauuuggauuuuuuuccugcuuucaauaccaaaaaaaugcagaugcuuuaaggccuaaacagaauucugaagaauuuaaaauaugcaauuaaaguuugauauguuuugucucccaagcaccuuguuuuuuguuguuguuguuguuguugaagucagcugauuuucucuuuagaaagagggucagcuagaaaccuagguuuuuuggaauuguaaauuuuuuuuuaguauagucuggagagaaaggucauucaaaaggaaaguacaaugggacuugcugcccuucaucaucucguucccgugccagguguguguuggucacguaaaagccugggaagcaucagaggagucccggauugcugcugcuaccuggagacaggguuagcaaaauaacacuagugaugagggagaggcuucuuuucaccauaagccugcuguguacaccgagggcggcaggagaagcaugggaaggagucagccuaaguuugcacauugcauaaaggguacacuaagguaugagcugaagcuuuagguucuccgugcuucccucaagaccuccuucuugcuaacagaagcaguaggcaauugcugcagugcguuucucacccugccaauaggucugucuguaucucuguuaaggaaaauagccuggucccuccuggcagugcuuggaagcuugaugcuaauuuuuauauagcguggcaaacugaccagcagugccaggccuugaucuguauucugcacuaucccuuuacuugguuccuggcacugaauggucuccagcccugaagaaucacgugugaucacagcagcugaccugggcuuucuccccgagaggaaggggcaugucauuuuuauuugacagagggaaaaugggagcuguccuugacugccuuuguugugcuuucccgcguaagauagcacuguguuuuaaacuguugcauuacacugucuuugcaaugauguaaauguaagaaaucacuuagcuuuaaaagcgcagugguuugaucuuauuuauaugaagacuuuuuaacauaucaagaauuaggugcauuggcagguaggguuuggggugugauaacugcuucagauggaauguucacuuaagcuuugucuucuuaaaaauuaucaaugugaaugucauaauuauauauauuuuuguggaaaauuuucuccuaaguauaaguuauugugcaaaauauagugucauugaugcaaauaauaguuuaacuuuuaguuuagaacuccuaaaagauauaaauuguauugcauaugcauuaaaaguuuguuuuauuuaauuuuauguagaugugugaaguguuagguaaaauuuuuuucacuuauccauuuaaacaccuuguuacuugaauauuguguugacuggucugcaacagugauccauucuguaauauagcucuuuuaacugggaaggaaccacaccccaguugugccgauuacauuaguguuggcacacagucgggugcuaguguaacacaaaugccgcguugucuggguguacaguguuuguggagacgccacuuccucaaaaugguuuuugauuguuuuuaaccuauaagacguucugaugcucacaaaccucuauucaacacacaaaacaaacaugaaaagguaguuaguuggguuguaacagcuuacugggguggacucauaaaacaguggcuuucuguucaucuaaaguuuccucagauaccacagaccacuguuaagugugcucauugucacuuuaaauuucaacgauacccuauuuuugucauucuaaauaucagauguacuauugguauaauugcacaccaaaaauaagccaaacagugcauuacgcuaacuggaucccugcuuuuaugugagcuaaggaaagauggagccaacuccaacgagggccucuuuuucucucuugucuagccuguuucuaaaccgaaugauccaggauucaagcuucuauugucaagugaaacuuuccucagauggacuccagguagccaggucaccuaaaccuagugguccugugcgaugcucuuucugccagucccugaaucucugcagcuucucuuaccugucuuaccuguaguaaagcacaauugcaguggcgucgcauucagaagaagggaaggucagcagaggcuaugcauguugugugaugaugaguguuuacagccaccuucuccuaaaacgaaauuuauaccgggguggauaguauuccauuagguagacuuaucgacuuugcuaagugcuuuuuagacagcuuaaaaaauuuucaagauuuuaaaagauguauaagguuaaguuugcaaauauaauggaaaugcuguauaucuuuugaagugaugaaauccacguuggaauuuuaaagaaaauauguuguaauaaugcuguuguaaguaauauuuuaaugucucuuugccuguuuucuauuucagcacauucauuguggugaauguucauagcauuauaacugcuuagccauugaaugauaacauuuguuaguggaaauuggaaaauuuauuugugaaauucugcagaauucauuuuucuauuuccaauauuugcugagguuaaauaaaaauuuucaagccauugauguaauaaaauaugaaaugaaagca

SEQ ID NO: 192394 - RNA, 17870 nt, Homo sapiens
cuauuggaggagaaggccgagaggagcaggacggcgggaagaggagugcggaacccgcgggaggugaggcccgccgagccgggcugcgagccgggcugcgagccgggcggcagcggggucggaggucgugggcggcagcgggcgugaggggugaggcagggucaaggggcgggggcggccgcgggucuccauugcccgagccugugggagcaggcgggccuggggcugcagcacucaccccgggagccccgccgcagcucggguagcguucaggcaccucgccggggccgggccgcgugcguucggagcggggaaggcggucuccggggcccccggugcgcgcggggaggcguccgcucaggggaggccgaggugggcccgcggcugcgcccccggccuucgaugccuucgcucguccgccugggaccgcgcuggcuucgcaucgaagugggagaggucugaacaguuauuuuaauacuuugauuuggaaagaaaauccuuuaggccgggcgcgguggcucacgccuguaauccgagcacuuugggaggccgaggcgggcggaucacgaggucaggaguucaagaccagccuggccaacauggugaaaccccgucucuacuaaaaauacaaaaauuagcugggugugguggcacgugccuguaaucccagcugcuugggaggcugaggcaggagaauuguuugaaccaggacccgggaggcggagguugcagugagccgagaucacauuacugcacuccagccugggcuacagaaaaagacuccaucucagaaagcacacaaaaaaaagaagaaaauguuuguucauccugccuuuaauuccuuauuacaaggcgugaauuuuuauuguuuuuuuugagacagucuggcucugucauccgggguggagugcaguggcgucuucacagcuaggcacaaccucgaccucccaggcucucaaguagcugggaccgcaagcgccacuacacuggccagcuauuuuucuuuuuuuuuuuuuuuuucgguagagaguaggucuugcuguguugcccaggcuggucuugaacuccugggcucaggcgaccuuggccgccuuggccucccacggugcugggaugacaggcaucagcaguguugaagccugugagguggggucccuguggcugacucugcccucuccuggggccauuggcagugcagggguccuuguguguggaggaaauaaggagaugaucaaaguaugauuccacgaaucacacgguuuauugucaaagaagauuuguucucggguucacagugcucagaggggaggagaggggaggaggugaagacaccuggcagggaagcagggccuccauggauggggugcauucacggcagggaggugaguggcagaacggccaggguccgguugcucugcugggauggagcgggccccuggagagugagaucuggugagaguucgagguuugccuugguagcaguggagagcgugagagcgggagcucucugagaagcugggaccgagguccagcucccaggccagcagcguauagcuugccucaaagcaucugcacaaccuucaagcugaugucuguuuuugcaguccagcagucagggucaguaacucacauaagggagugucugacaagguuuaaguggcauucccaagguugcggaguucacucaaguccucacauauguggucugauaagacaucacacucuugcaggggggucaggucaccccaaaacaucagacuauguaagugcugugaaucacuucaaagcuacacagcaggucccagggcccaaggcagaggagugaguccaccucggaaggcucagagcagcuccaggcaguaaccacggcauuuccagagucuggugugugagccuaacagcucuggugugaccguccguacucaccuagcagcacgugacaucagcucucccccugaagucauugcucagcucgggugcugcaggaagacauacaggucugucuugggccagccccuugccugcugugggcugcucccuguguguggccuucaccccgguguagagagaugggcuggucacaccccugccccucacagcggcgagaggacagaggcaugugccgggcugucuguggagcucccaggccagugucugggaugcggcaggugcuugguguuaaagggaaaauauuccaggauaucugugaaagcacguuaggcagagaccaggcuuucauucagaaccuuugagagaugugggaaccaccacacugcggucuugcagugggagagaggcugggcucagcucugaacaggccaugggcugguggcggcuuacagcuccagagcugggcaggggcagaggauggaagguugcuaagaggaacccccaggggcgaaggggaugcagguucaacugaccugccagaucaggccgcccgggggacaguggaagaugaggcgccuaaucagcugucaagggugaugggacacgggaggaggucgucacuaaacagacuuugagccaggccuguuaaaccaaguucucagcaggaugugcacagagggcccaggaggagccucaggagccggacugccguuggccaaccggugagucuguuauccgucaguggacacucugcuuccaggugccuuggccucggcccgcguccugaaggcgggagacguugcagccacgugcuggccuucccggugcuccugccagcgucccgcugcuugacacaguccaaguuuuguauccagacccagccugggacagcagccucccgacagcccccaggcccagccugucugugacagucacgccugcucagggaaccaucccuccgugcagaucugggcuguguuuugggugguaccucgggugugggguccccuaccaggugcgagguucauacuccccaggcugccuccuguccucagggcuuggagagucccauguucugaaaaugaccucuuuucgagccgggcaaggccgcaucuccuuuggcaguguagugucuucccuggagguggcauuccuuuuugauuugccuucugugcuugggaaccucacuuccucacucuggccagcucugccagcaguuuggagcugguucagcgccccaccgcccugccuuggccugcgcccggcccuccaggguggcuucucgccaguuccugucaggccugccugggcaaccaggccugggcaccucccugucccuugcucagaaaacccacaggcugugggggcccgggagccaagccuggugcgcgggcaggaaacgcauccuggagcaccagcuucccugcccugcccgccucacggggugccugggggcgugccucagccugcugcuccuguagucuguuccugucucccugagcaggcugaacaugggcauacgagugaccagcgugaucguguccaggccagugccgcauucugugugguccaagggaaaaccuucuccaaguccacggcccgcccuuuccucugcuggguuacggccaagggcgccaggccucacuggaggacauggauccuggacccggcccucgaggcugcugccuuccaguuuccccauguccuggacacucuuggucucaccauuugggaggccgacaggggaugcagaguggccuguuggaaaggccuuaugugaccccaggcugagucccugagcagccugcugaggccggaggggagaagagcugagcuucucccuugcugggccaggcucgggcuguggaauggcugccagcucccuuccugggagaggcugggugggguccacagcaccuuccucccgucccacaggaagcugucuucugcuguuggcugcugggggcgacugauguuuggaucccugagcacccugccaaucccagacucaccuucccacucuuuccagaguccccagggagacacuuaagggaaauuaaacugcagagugcaagagaugccucagucaagucagccaaaaacacgcgggucauccccaagccccagagaggugagucgggcagggcacucaacugcugcaggaggauggucuuauuucuagcacuuuccacaggagguaaaugugguggguuugggggguuuuucaaaugcaucagugucuggaauggguucuaagcugcuaaauaauucuuagagguaaaugacagacauguugcccuagauguagcuagacagccuucccucuacagugaagucuccuccacccucagugacagagccccgaugacacggacaccucggcugcugucacuucccugguucgggccucccacaggcuuugaauugaaggcgagugccucagaauuugcauccauuguucugucuuuccugggaaguuauucauccugguggccagcccaccgacaaaauggauuuggaucuacuggaccugaaucccagaauuauugcugcaauuaagaaagguacauuuauuucuauuuacauaaagggugugggugggugugugcaguuuauauaaggcagguuaacaaaacgcuggcuggcuaagccuuccuuccuuugccuacccugauuauuaaaccgagggcgggauguacuaugggauuuucagguguguguguguguguguguguguguguguucuuaacuacauggauuucuuucaguuacuuuuauuuuuaucaaaguaauacaugcauauugucuaaaagguaaaauggagccacauaaagucuuuuaguuuuuuuuuuuuggagacggggucucgcucugucacccaggcuugagugcaguggugcgaucucagcucagugcaagcuccgccucccgggguucacaccauucuccugccucagccucccgaguagcugggacuacaggcgccagucaccacgcccggcuaauuuuuuuguaaauuuaguagagacaggguuucacuguuuuagccaggauggucuugaucuccugaccucgugauccgcccgccucagccucccaaagugcugggauuacaggcaugagccaccgcacccggccgucuuuuaguuauuuuuuuaaaaaauauuuacaucugggcuccuaaacguguuuauguuguaauguuugauuugucaguguuacugauuauccauggacuucucuugggggcugugaggacugagcgugccuacaccuguguaccccaacuuccucuccccccagcucccugcccauacuuagaaccuaguuugggugacaucagcugucaggguugugacugggugcauacuggccauuguugaaccuggugugguggugcaggggaugguuuucuuucuuacagcaucuuuuuucgcccgaguuaguaaaugcucaaaacucaggccccacgugcagccccugcccccugcuccccaugccagccgccuggcugucauccggggacccuccugccagcuuccauccucccccgucuccccgggccucagcuacgugaaccucagcacgcugucuguggcgagaagccggagugcucauggagcugccgcagcagccuggugacagggcagggccucgcuguccugacccuccauccuuggcuguugguuuuuauccuccuguugguggccuugugaucacagcugcugccacagcugcagacacgacgcuugcagaccagggacagagaagggcucagccagggaguuccuuucucaccugugucucuuauccaaaaaccaauguuuccagaagucccugcagacuucacggcugugaagggggcuggggcugugaggcuuaccagggggagcgcccugccacagccccgaucccggugaguccucagggcccacagagccuucuggagcagccugucugcgggaagcccccuccgcuggaucuggugaaacccaggggcgcuuucuucauucccacccuuccaucuccuuguguuuucuguguggcuuuucugaagaucacaccagugcuuacuguuuuccagccgcacaaugguugucuuuucacugcagcguucagcgcacccguguugaggggguuucugaugugguggguguaaguccccguggccggguggggcgcuucguccaccacugcucccucucgugugcgcuuccucgcacuucccugaucggcugaucagucugcagcauuugucgucuuucuacaaguuugaaauuagaaagugaugcacuuaucugaguccaaaauuaacuuccuugcccuccuccccagauggcagguccuggggaucugcaccccuguaacugcugccaccgccguucugauucgcacaugcucugcccccugcccugacugcccugcgcagcuggcguuuggaccugggcucugcuacccucccagcgcuccccuccccagggcacauguccucucccgcggcucagcccagauccaugccuggugggcgggugguggaaagcucggugcugguuuuuuccugcccccuucuggagcacugucuccagcuggcauggaacugggugccugucguuucuucucaguaccggaaccugcucucagcaccgggaccugcccagcccugucuucuggcuucugccccagcucacgaggcugguaucuguccgagugccaggacucagggcgcaguguccagcagcccuuuccucgugccugugcaucggccacacuguguccaggguuuccagggagcaggggauccggucccuacccaccuuguccccagaaucggaagcacggugcucucacagugcucuuaacaaagcaccuuuugucacuguguugcccugcguugugacagucugacauuuuccuguaauuuaucuguguuauuucagccaaacugaaaucgguaaaggagguuuuacacuuuucuggaccagacuugaagagacugaccaaccucuccagccccgaggucuggcacuugcugagaacggccuccuuacacuugcggggaagcagcauccuuacagguaggugggcccuggcaucucugccaggggugacauguggcuccagcaucauggucccaguggugcagggcaggggcugugcagacuucacccagggaccagccucagggcguguggcagcugcuccagccccagaguucccaucuugcuuguccuacacccauggggcuguggucacagcaucgggucagaagaugcgugagguggacacgggcugugggaccuccuggggaccuugcuccauggaccagaggagggggugcaggaagcagggguggauuuggcagucagcacccagagcccuucaggcucuggcagggugggaacggugugagauggggcccuggccacggucccaccaccacgugugggaaaccaggucucagcaggggaaggagguacccagggaaccccaugcgccuggacggacaagguuuccaucccugcaucucagcaggcccuaguaggcagcgggguccuggcaugagcagggcccucucuccccugcagguggcucaguggcccaggccccgaggaacgugcugaacuuggggcugccguggugggcaggugccacggccacacacacggugcugugggcagggcucugggcaggccucacagucaggguggccugcuccaccuggacggggugcccaaggcagugugcagacuccaagggaggggcugcuccucccggcccaggccccaggccaagagcgcagccugcaccgcaugucccaccuugagccuugcccugaggggcuucggugucguggaggaggcugugucaaauggcucauccaaggcccuuuagccaagaggcugagaccagcauugcuccagaaugguaucugucacagagaacugacggcauguggugugcaugugugcgcgccugcgggagcccauuaaagccgcuugagaacuguucagcaccccagggcaucccagcuggacagagcugugccuuuuucuucacauggaggcuguuagggagcgccucggggcucucuggaagcuuuggcugaaggcgucuggugcugcaauugccccauagggggaucccugcgggcaugugaugguggcccuggggcucccccugacucugcaucucaggugcacccgcccuucccggcugggccccccucccugcccucagcaccuugcucacccccaugaccgcaggcaccugugcuccagccacacugcaccuggcacaggcaggcugaccaugccucccgcaguccccagcccugcccgcaggcccaggagagucaggccugacacuaucccugcccuuuagcacugcagcugcaccagcagaaggagcgguuccccacgcagcaccagcgccugagccugggcugcccggugcuggacgcgcugcuccgcgguggccugccccuggacggcaucacugagcuggccggacgcagcucggcagggaagacccagcuggcgcugcagcucugccuggcugugcaguucccgcggcagcacggaggccuggaggcuggugaguggccaccccuuccguggggucugggcaggugggcggccccugcuuugugugggacagcuuuccguugagguggggcaguggccgccucuugcgcuguuccuaccauugcgucucccuccuucucacccugauugcccucgcuccuuccagaacagggagggggaagugaggcugggcucagcugacagcaggaggggugggaggguacgaaccccaccaccaggcagccggcccucagcagagcuaggcccccaggggucgcuggcugagcacagcgaugccggcccacguuccgcacagcugccaagcccagaguccacagagccagcaacgcagggagggcagcacagccuuuccccgggugccccgccgccaggccagguaugcuccuggcgcggccccgugagccuguacgcucugucugugaaacgaggguucccugcauuggacuaaagcguucagagcaugccugccugggucucucagguguuaaaaguucacguaguuuuaaacugugagcugugaggaggagagauguuucucaguagcuccuuaacuuuuaaacuaauucccuggugucaacaugcgauucccacguugucuuaaacuccacgugaacagaguggcaguauuuuuucaucgguggcaccuccgagcacaucugcuaggcucacuucccacacagggccggaccccaggcccuggacccacaggcccagccagccaccuccucacgggccugaccugccagcagcgguguggcugggaaccucaccucugccacccucaggucagcgucauccccaggacccagggugugcugugccugccugagcuucagugcuggguggagggugaggggucuccugagccuccgugucggguggagggugaggggucuccugagagcccagcuggggucugcucacgccacaggcauuuuugucccugcagcccaggggagggcacccucuugucaggugccugagucccugcggcuggucuuggggaugagccuggagacagccagaagccgggaggacaggaguuggccuugaaaaugggagucucccgcuuaccgcacggaagagcugcugugagguggaggcgggacucgagcgugcucaggaacgggacgggagccgcccucauucuccagcguccuccgugccaggcuucgugcaaaucugauuugugcaaugacucccccucagcuuccaccccguuggccuuuucagugaagcccacacuccccgauacccagggacacagaagccuuaggacacccucccugaaucccccagcugugcccagcccagugacugcugcgggaugacagcacaguccagccuugcgggccaggggaagggagggggccccacggccaccgugaccacaugcaagguuaggggucagaugugcuuuccuggggaaaugacuuccuuuccuggauccaaucuaaaggcccgaauuuugaaaagaaagcggcaggcgggcucugaagugauuccgacucccgugcuuaagccgcgugaggcucucccaggccugcuggggccccgcccaccgcugggcuguccacagccacccuccugccagcuucacgauguccccaugacugugcagccccuacauaacgucaccccaacaaaaacacgcugcuugaccgguuccaccugcuuccgagccuuccagcccagccucucuccagccaacaggacggaggaagcccagggccccgaccuuccuguggcuccugacuaggggcacagucacugcuggggacacugguggggaagggaaccagccacaaaagggauguggccucccaaggcaguauuuauacguuccuggccucaagcgggccagaugcuucucagaagcuuaguucugacacagaauggggcgggggguuccugacccauuuuugcaacucuucuuuacguuugaaauucugucaaagcaaaaucagcucagaauuaaagguuacgcggacacucacaaacaggcugcaugacacggcgugggggcacuggcucucccacaacugcaugugccacugcaggaacaggacgacgccccgugggccacgggguccuggcugggcagccuuccuggcauagucagugcuuagagagcucgccggccuugucuuuuuguuuuuguuuugcaggaaacuggaguuuuauuauuacucaaaucagucccccuaagccuuccuguuuuuuaaauugagauguaauuuacaugccauaaaauucccucuaaaaguguacaguucggccugauaggcgcaguaccucaugccuguaaucccagcacuuugggaggccgaggcugaggcaggcggaucaugaagucaggaguucgagagcagccugaccaacauggugaaacccagucucuacuaaaaauacaaaaauuagcugggcgugguagcgcacgccuuguaaucccagcuacucagaaggcugaggcaggagaaucacuugaacccgggaggcagagguugcagugagccgagaucgcaccacugcacuccagccugggcgacagagugagucucuugucucucaaaaauuaaaauaaaauaaauaaauucaguggcuuuuaauagaagcacaaaguucugugcccgucaccacuauccaauuccagaacaguucccucaccccaaaaggaaacccuacccaugagcagucagcccccacccccagcagccugccuccccuuucccuaccugugacucuuccuguccugggagcuccaugcaagugcagccggacagcacguggucucgugacaggcuuccugcauuggcauuguguuuucgagguucauccgugcuggagcaggugucagaacugccuucccuuuuaagauucgaucaucccacuguaaggaugggccgcacuucauucguccacuccucaguugauggccuuugggccgucuccccccgggcugucaugaaacgugcuacgguggacguucuuucucuuggguaucuaccuaggaguggggcugcugagucaugugauuuguuuaacuuuuuaaggaaguaccgauuguuuuccgagcugcaccauuuuacauuccuagcggcagugcacaggggucaggggucugccuccuacacauccucaccaacacgugucuuuucaagcuggcuuuuugaauuucaccauggagcccagauugcaggagcuuugaagagaggaaacgcuugcucagugggggccuugaggguggccaugugucggggcucaggggccauuuccagaaggcguugcccugaugcugccacuugcucccugcccugcaguggggaacggagguucacagggggaaggaggggcaggguggagcaggagaggccucccaucuguggccauuccagcccagggcccaggacaggggaaguccuugccugggugucagaaguggagacccagcccauauuccuccugaggggucaccuggccccggagguggcugccagugggagggugagaaaaagcaccagccuccucccuccccaggcgaggggcaaagaaccugugaggggcagagaguuagaaauggcgggagacaucugcacuugauuuguguggcagucacaggcccgucuggaguccccugggcacaucaggcacucuugcuucccaggagccgucuacaucugcacggaagacgccuucccgcacaagcgccugcagcagcucauggcccagcagccgcggcugcgcacugacguuccaggagagcugcuucagaagcuccgauuuggcagccagaucuucaucgagcacguggccgauguggugagugugggagaagccccaugacacccccaaggcaagcuauucaggaccauuggggcagguguagccaccacggcaauggggucucacagcagggcagggagaguuggggcucagcucugaacacagcaugggucauggggguuuacgcccgaggagcagguggggucagaggauggagagugacugagaggaacuggcaggggagggaauucuggcuaaagcauccugccaggacccuugcugaaggugugccuuggggaucagacggccucuggggacuguggaggauggaccagucagcuacugagggcgacuggauacggagagcagggguccugcuacaaucucagcagggauugccaaaacuggauuucaugaggacgugcacagaugggccuaggaggaggcucaggagccugacggcaguuuggccaaacagaauccuggccaggaguggcugugggccaggcaggcagggcggcaggcugcgacacccaguuacaucugaaucucaggcagcuuugaagcguguucuagaaugaggaugcccauauucagaucaacuuucuucaugaucugaaacucagauguaacugggcgccuguacaccaucugucaaccuugcccaugaagacggaguggggaagagaagccccaggcggguggcaaggaccuccucugggcugugggccccugaccagcugccccaggagaccaccgcccugagaaggaugcgaccugcucuccaggcugcugcccuggugagauagcuguguugguuuccccuugccccugaggggaagacggcccucacuaggggcacaggggcuccaccuggccaaggccugcugggcacccagcucagacaggugaccucagauccuugaccacugccuggcugcuggcuucccugcagacacuggcugggcuuggaggagggaccuauggcagggccuugcagagagcaggggccacucaccgggggccaguggaguccguccuguagccaagaagcaggcaagagaggcugggacccaucccugcagcuggggcagcagugcugugagcugucagugcuuaguuuauagacaucauccugggagggagaagugaugaaguagaaaagacgcagaagaaaagaugggacguuugggaguaaaccccugaccaaaggcaaguaaggaaauuccacccugugcagggggagcggcugccauguccagcccacccuagacauggcuguggccuggcagagcagcuccugggugggccuucccccacuucucuuuuuuuuuuuuaagacagucucgcucugucgcccaggcuggaguacaguggugcaaucucagcucacugcaagcuccaccucccggguucacgccauucucuugccuuagccuccagaguaggugggacuacaggcgcccaccaacacgcccagcuaauucuuuguaucuuuaauagagacgggguuucaccauguuagccaggauggucucgaucuccugaccuggugauccgcccaccucggccucccaaagugcugggauuacaggcgugagccaccgcgcccgccagccuucccccacuucuaagaggucuuauaaaaacuuucaaguaaagcauaaggcauauaaacuuuuaauuuaaaaaaauguacaauaaaauacguuaucgcacacaacgugaggaaguuacacaugggaagggagccgugggcccagcucaugccccaggucuccugggagagaccacgccgcaccagggcaccagcuuaggcccagccccagccccaaggucacgccagccgugugguuauuaguaucauguccuaugcacacagacgcaggagaaaugagugagcgcugcggcucccggccaggggcccucccugccgcccuggcugucccgggccagcuccgggccacacucggcagucccauccuggagcggggccaggucggggucacugcaagagaagauagaaggucagggcugggccgccaaaaccugacaguguuacuaaguucuguucuggaaacagcucucuggggaacccccaccccaagucugccuagagaagaggguguugcugguugugagccucccuggggccgaggggucaugggggacuggugcgucuuuggucucugcucccuggagcaccaaaggccugcgucuggcacgggggaagccagggguguggacacagagccuucucuugcauaagcagagccuggugccauucccacccccccacucuguggcccuugggcuugcaugaggauggggacccugagccaagccccucuuggaggcccagccuggcagcuagcagcagucaccacuugcccauccccagcuccccccagucccugcaugugcaaagucccucccuggcccagcugccugcuuccuggggcugcaggccgugggacucacguuagcgguggcgucuuccaggccacugcugcugcugucguuuuccacaaaaagaggcucggccagagacgcccuggagaugaagcacagacgaguuucacucagggcgugcaggcggcccucaggcgucuucagagcuccgggcgugacaccagcguguggcugcagaccuuggacuugagggacagccuaggggccccuuagcagccuccaucuggccagagcugcuggcaaggcccguggggccugaacuacacugcuuggugccaggagcagcugugucacccucccccaucaccauggcucaccaagcugugcggucagaggccaggccagccaugccaauggcucuggcacccacaggccacggcagcacccagagggaggccgaggacaccugccuucacuggggggguccuccccuggaagcucuccugggagcuggugggcacagggcuguuuccaccccuuggccaggccaggccagcucagagcacagggcuaaggccuggaugcacgggaggcacuggccuugagggugucucaaccuacagccccauccugacccccagguggucucccagagugccccacgccuuggcagaggcaggccaggccugacucgccugaguaacgccugaagggcaucaggccccugccuugcugagcgucugaagaggucauggccaccacgggcuggcuuugguggcacuguggccagguuuggguggucugaguaccuggugcggggccacugaaggagggggcugguugcugcugaccugugagggggagagggugaaaccauggcagaaggagagcagacccccgcaaggacucaggagccugcgcaaaggacaccucuacagaggacgguguuggcacagccaaggggugacugccugggggggccagaggaaggacauggggccaagggaaccaguugugugagccugaagcuucuauaguuggggccucuuugagaaaaauacagaauugggcucagaguauggggacuacagaguaugggcacugugagccccagguggguaggaagguuuucagacggucgagugacaguccaaacggggucuggucaccuggggcggggacuugcugaccagcauagacaaugacagcuguccccacaggacaccuuguuggagugugugaauaagaagguccccguacugcugucucggggcauggcucgccugguggucaucgacucgguggcagccccauuccgcugugaauuugacagccaggccuccgcccccagggccaggcaucugcagucccugggggccacgcugcgugagcugagcagugccuuccagagcccugugcugugcaucaaccaggugagcaccaaggcaggguugcaccccugagcucguauuuuuagccaggaugcggaagcagagccggucuggagguggggcggguggcagugagguggccuccggcuccugcggguagcagccugugccuaaccaucgagaagacccucagccguugcagcugaccuggacugugcucuuccaggugacagaggccauggaggagcagggcgcagcacacgggccgcuggggugagugcagccauguggugugugcaccucugugcaggugccaggggcacagcugggccgaagugggcggggccaccaagccugagcgccagcuugccugcuuccuguuucucagguucugggacgaacguguuuccccagcccuuggcauaaccugggcuaaccagcuccuggugagacugcuggcugaccggcuccgcgaggaagaggcugcccucggcugcccagcccggacccugcgggugcucucugccccccaccugccccccuccuccuguuccuacacgaucagugccgaaggggugcgagggacaccugggacccagucccacugacacgguggcggcugcacaacagcccugccugagaagccccgacacacggggcucgggccuuuaaaacgcgucugccugggccguggcacagcugggagccugguucagacacagcucuuccagggcagcggcuccacuuucucauccgaagaugguggccacagacugacccccaucugagcuggggggauguucugccucucccugggucuggggacaggcccgcuugcuggguaccugguccccacugcugagcuggcccuuggggagaggugauucucagggcuggagccugggguguccuacagugacucccugggagccgccugcuucuucucuccacauggaagcccaacugggguugcgucugaggccugcccccugggcuggggccucagacccccucagccuugggaccgugcccacgagggucuccccuccugcacacagggcaguccuuacucccccaccacucaggccacaguggggcugcaggcaggcggcuccuccucacccaccucuggguccuuggcucccgggggccccaccucggcacacacugugccccacaaaacuucagugugguacaagguggagaaagcauaucccaccaaccuccagugucaggguccaggagagccuggggguggggggacugccuugucucuaguaguguggccugugccagcaccacagccggucagaggagcgcaggcagcgcagggcuggcacgugacaggcucgucagccaccugggaacacaguucugggcaaagaggauccgagguugagaggaaggagggucccgguguauccuggcccugggggucugggcguccagcucagcccuggccuggcugggugguauucugguagggauauggcaggacuccuggcagggccaccugcaggacccuguccugcagucccacacugugcagacccagucccacacuguggccaggccuuacaucuggcuggaaagcagagccuccugggaacacaucuggcugcacaggcugaaauauccacccagcaggcagaguggcguggccuccccaugggcacaguggugacccccuugauucccaccguacaacccccuccaccccccacucagugccuccacaugcugccuggcacagaccaggccuuugacaaauaaauguucaauggaugca

SEQ ID NO: 192395 - RNA, 6527 nt, Homo sapiens
ugugacgucacggcgucguugguaaggggcuggcggccggggagcugcguagcucccggccccgcggccaugcccaagcggagcugccccuucgcggacguggccccgcuacagcucaagguccgcgugagccagagggaguugagccgcggcgugugcgccgagcgcuacucgcaggaggucuucggugagugucgggcgggcugccgaggguccgcugcgucggggccuggaacgggccgggccucagcguccccucugaggccugagcggggggcuggagggcccugcuuucuggccccgcguucccggaagcugggaggccgcggggacacaagcuggccacgcccagggcuggggucagugagggggaugugaggaccccagcguucgcccacccuguccaacagccugaaagaaaagggucccugccccuagcccccgcgcccucuuccacgaucccgguuagucgccgcccugcagugagcggcacccgccuggugcuuucucaggacugucccgugcaggauguccugggagagguuggggagcggggcguccugcauggagucaacccgaagagugccccuccugucccaagagguauucauggagcgcgcggcccugccaggcacggcggcuuucucgggagaccaaaggcaggcaagacagaugugccccgucucccgggagcuccccagccuaguuggggagaccagcaggaggagucgccacagguggucggggcaggcacagguuugugcaggcgcaccugcagggauggcacggaaggcuucuuggaagaacagucugagcggaauccugugggggcgaguaggaguuagccaggcagaggaagggaaggaagagggcgaggcagaagccaggcagcaggagagcgaaauaggacuccguguggcugcaguguccaguucugggugggaugugagggcagugagcucccaggccuucucuggcuuucuccuguggauuucaggcguguugaucuuauugaucaucacucugacuggggugauuaauacccuggggcagguaaaaaguggagcuuaccuugccuagugauugggacacaaagucugcaccuguagagcaguuagaggaugacccggggugugugauuuaccuggugccgcuugugccuugggaaugagggaaagacucugccucccgagguuccucugugcggugucuccagugugcuagggcugugaaagcgagugcuauucugggccauggggagguaaggggaaugaugccgugggaacuguggcaggaccgcaaucgugugcccucucaggacaguugaaaaauucaaacacugugcaggcaagaagaggaagauggaaauggggccuggcucaguauggcccuuuauucuucccgaguguccugaccugggcguuggcaggugugugccacucaccgggucaggucagggaggucugcugggugcagugggccuuccaugguaaaugcaggacaccuacuuugaacugugugacaguuuccaaauuccaggccacagcuguuacccugaucucuuaaccucgaauuguccacaaggccuugaggacaaggauuagccucaccacgugucugucccauuccuuuccccuuauagaugggggaagguguggggggccaggaggaaggugcaggguguugugggcuggcaucagcuacuccaugugaguuacccugucacuauuauugcugcccacuucauguagagccacauagaguuucugggaucucugccuuuacuguguuauggugaggugcaaaacaaaaaacaaagcauuucugggucuggcccugggcaucugauuuuucaaagcuccccaggugacugaacuguggccugauggaaaaccacugcucccagggauggguggguguucuagaacaagaggucuggaagguucugggaugcuugucuugccagcaacucuguagcaggugaagggggugugcucuggccagaggcuguaggcccagcuccaagccucuggcugcuuccuuggcaggggacgaguuuugugaauuagugcuccacagugcagagcucccucugugcauuccacagagccugguuuccagguggggagugcuggggaagcagaaaagggagaaaggggacaagcuuagugaggcgaggccagccgugaauugcagaaaaugagccgagugauaggagagggaacccuugcaucagacacagguggggcugcagggccagagccuuccuggaggagaugacagcuaagccagguaaggaaaggacgcacaagcauucucagcauagaggcagagcaggacccagcucgccagggcacaacacaggcugggguuacugggagacagagggcacacaggaggacgaugggguucaugugaggcuagaaagacucaauggccaugcaggggcuucguugguacacagugaaggacgugagaaugauuuaucuucccccagagaagaccaagcgacuccuguuccucggggcccaggccuaccuggaccacgugugggaugaaggcugugccgucguucaccugccagaguccccaaagccuggcccuacaggggccccgagggcugcacgugggcagaugcugauuggaccagacggccgccugaucaggagccuugggcaggccuccgaagcuggugaguggcaccagcagcccuuuguggcuguggcacugagggcaggugguggcacgagcauuuuucuugauuugcaaggucaggcuuuuccucccuggguaagcaggacucugacccagagcuuggccuucuggcucagaaggcuccuguuaucaggaggucucacauucaagacuggaaguuguuaaacagcuucuaaguacugggccaaaaaagcagcagagacuccccggguaucccgucugcuuuccgccugcagcccccucagauagucccacaaggcuggaaacaugccagucccaucccuaugcaguguggggucucagagcaucaccuguguugcugguuagaaaugcaauccccgacucuaccucaagucugguuggugugucuaggaggagcccaggcaccucuuuguuaaccaguaaggcagugggccacacugagacccagaugggacacauggaguucugacaagcaacaggggaagaaugguccuuccagcacuagccuccagguagcagagggaccugguaagggaaagagcacugaacuuggagucaacuacaggcauaucucaccuuggaucucuguaguaaaacggggguccugugcacuguaccaggcucacggguugucagaaggauccaguguagguggggaugggguaggcaggucagagcccucugcccucagguaugcauggaggcagguagcccggcagucccggaaacuccagucuccuugcagccugacggcuuggcguuucuuccucacagacccaucugggguagcguccauugccuguuccucaugcgugcgagccguggaugggaaggcggucugcggucagugugagcgagcccugugcgggcagugugugcgcaccugcuggggcugcggcuccguggccuguacccuguguggccucguggaguaaguacuucagucccuggagcugcugagaucccauagccccagcaagccgugaugggggacgggugggucacccaugugggcccagaacacacacguguggccccugaugcagugccaucuggcauugccuaacgggacaugguggcaauagaugcuuggcccaacuuuagugguuaguaauccucucuaagggaaagcugaaccucacagaugaccugcucuguauccggcucuagucccugucuucagccacuuccuguucugaucuuugagcacccccaccuccuccuccucuggucuuugagcccccccuccccccguccgaggagccccugguuggugacacaggugcacaccgcagcuucaccacagucaugcgugccguuugguuguagacccucucaggcaggaaguggaguguuuguguagucucccauuuguggguggguuugcugcagcuggcuggaucccguccuuacuccuaagguggggaggggcguucucacccuaggggcuacucaccugguggaugggaguggacaguguggagccuguuugcccugccccgugagaaagaugacuucauccagacacauguggaacuggcuccauagacccaaagcaagcuuaguccaaacaaugucugaaauuguccaucuaaaauagaaaccacauguuacaucucgaguccuuucucucgagccuuucuucagucggggcagaggcccagacucauuggagacggagagcccugggcagggggggcagcaccagggagaagcgccgcgugccagugaucggcucccauggcuucagcaugggcaggagugggguaacgcaccccauccagguugggaaucaucugcagggcuagcuaugaaugugggauacucugucuuugcuuuucacccgcugaguucaucuucuuuccuagaaguaaacugaaaagggcaggguuuucucauugucugguggcccucucaccaaagcagaagugaacauagccaugggcagguucagcggagaggugggucccagagcgcugcguggcuggccucccacuccugcccugcacaccauccuugagggacucccuugcgcccauuuccuccuggccucuaccuacuuucugcugcugcuuccucccauacccacagaguucacguugagcugagugggccacuguccccacuguggacacacucuuuuaucgcagcuacagcacaggaggugggcucugcccucuuucacaaauaaaugacuuguuccaggucacaagccagaaguggcauucccaggccaggcagcccagcugguggcacccgcagucuccuacccccuccccugccauuuccuacuucaggaccaggcgucgcaggagugggggaaaacagggaucuguccacacggcucugguuuaacacagaugcagcccagcagccuuuggcguccugcugauggccugcacuggcccacgccuggcccguccucugcagggcucuccagcuggcugccgguggcggugaggggcugucuucgcggcucacccacaauacuacuggcaaacucugcaaaccaaguggcaagcaguucuggcugccuuguugacuccacggcccugucguguuugggguagccauugccagucccguuuccucgcaacaucucucuuaaucacuuucucccuguguuuugccggguucccuagccuuuaccuuuagagcuuucuuuuuuuuuuuuuuuugagacggagucucgcucugucacccaggcuggagugcaguggugcgaucuuggcucacugcaacuuccaccuccuguguucaagcaauuuuccugucucagccucccaaguagcuggaguuacaggcgugcgcuagcacgcccagcuaauuuuuguauucuuaguagagacagaguuucaccauguuggccaggcuggucucgaacuccugaccucaggugauccuccggccucagccucccaaagugcugagguaagccacaccauacgcgugagccaccaugcccggcccuacccuuagucuugauauaucagaaaagcacuguuugaugugcuucaguguaaaccauugugguucggugaauucuggcaggucaucuggagguuucuuuggagagcuucuauccuacuggaaacccagguugggccccauguggauugaucggcagugggaaucagcuagggcugcuguaacugaguucgcagacccaguggcauagacagcaaagagguacugccacguggcuuuggagaccagaagucugagaggaaggugcuggcagggcugguuccuucugaggcugcaauggaaaaccuguccuggccucucuccuggcaucugcugguuaucuuugguguucccuguagacagcugcccccucccuguaucuucaugucgucuuccuucucuguguccuucucuucacguagucuuuuuaggacgcuggucguguugccuuagggcccccaugucagugccgucaucuagacugaugaugcccgcagugauccugucuccagauaaggucauguccugagguguucuggguuaggacuuugacguuugaaugguggggggugguggacacaauucagccccugacagcagcuuuucucuccccucccugacgcugucgcagcugcagugacauguacgagaaagugcugugcaccagcugugccauguucgagaccugaggcuggcucaagccggcugccuucaccgggagccacgccgugcauggcagccuucccuggacgagcgcucgguguucacacugaacuguggggucgacgggaggggugccuuuuacauguucuauuuuguauccuaaugacagaaugaauaaaccucuuuauauuugcacaaga

SEQ ID NO: 192396 - RNA, 6527 nt, Homo sapiens
ucuugugcaaauauaaagagguuuauucauucugucauuaggauacaaaauagaacauguaaaaggcaccccucccgucgaccccacaguucagugugaacaccgagcgcucguccagggaaggcugccaugcacggcguggcucccggugaaggcagccggcuugagccagccucaggucucgaacauggcacagcuggugcacagcacuuucucguacaugucacugcagcugcgacagcgucagggaggggagagaaaagcugcugucaggggcugaauuguguccaccaccccccaccauucaaacgucaaaguccuaacccagaacaccucaggacaugaccuuaucuggagacaggaucacugcgggcaucaucagucuagaugacggcacugacaugggggcccuaaggcaacacgaccagcguccuaaaaagacuacgugaagagaaggacacagagaaggaagacgacaugaagauacagggagggggcagcugucuacagggaacaccaaagauaaccagcagaugccaggagagaggccaggacagguuuuccauugcagccucagaaggaaccagcccugccagcaccuuccucucagacuucuggucuccaaagccacguggcaguaccucuuugcugucuaugccacugggucugcgaacucaguuacagcagcccuagcugauucccacugccgaucaauccacauggggcccaaccuggguuuccaguaggauagaagcucuccaaagaaaccuccagaugaccugccagaauucaccgaaccacaaugguuuacacugaagcacaucaaacagugcuuuucugauauaucaagacuaaggguagggccgggcaugguggcucacgcguaugguguggcuuaccucagcacuuugggaggcugaggccggaggaucaccugaggucaggaguucgagaccagccuggccaacauggugaaacucugucucuacuaagaauacaaaaauuagcugggcgugcuagcgcacgccuguaacuccagcuacuugggaggcugagacaggaaaauugcuugaacacaggagguggaaguugcagugagccaagaucgcaccacugcacuccagccugggugacagagcgagacuccgucucaaaaaaaaaaaaaaaagaaagcucuaaagguaaaggcuagggaacccggcaaaacacagggagaaagugauuaagagagauguugcgaggaaacgggacuggcaauggcuaccccaaacacgacagggccguggagucaacaaggcagccagaacugcuugccacuugguuugcagaguuugccaguaguauugugggugagccgcgaagacagccccucaccgccaccggcagccagcuggagagcccugcagaggacgggccaggcgugggccagugcaggccaucagcaggacgccaaaggcugcugggcugcaucuguguuaaaccagagccguguggacagaucccuguuuucccccacuccugcgacgccugguccugaaguaggaaauggcaggggaggggguaggagacugcgggugccaccagcugggcugccuggccugggaaugccacuucuggcuugugaccuggaacaagucauuuauuugugaaagagggcagagcccaccuccugugcuguagcugcgauaaaagaguguguccacaguggggacaguggcccacucagcucaacgugaacucuguggguaugggaggaagcagcagcagaaaguagguagaggccaggaggaaaugggcgcaagggagucccucaaggauggugugcagggcaggagugggaggccagccacgcagcgcucugggacccaccucuccgcugaaccugcccauggcuauguucacuucugcuuuggugagagggccaccagacaaugagaaaacccugcccuuuucaguuuacuucuaggaaagaagaugaacucagcgggugaaaagcaaagacagaguaucccacauucauagcuagcccugcagaugauucccaaccuggauggggugcguuaccccacuccugcccaugcugaagccaugggagccgaucacuggcacgcggcgcuucucccuggugcugcccccccugcccagggcucuccgucuccaaugagucugggccucugccccgacugaagaaaggcucgagagaaaggacucgagauguaacaugugguuucuauuuuagauggacaauuucagacauuguuuggacuaagcuugcuuugggucuauggagccaguuccacaugugucuggaugaagucaucuuucucacggggcagggcaaacaggcuccacacuguccacucccauccaccaggugaguagccccuagggugagaacgccccuccccaccuuaggaguaaggacgggauccagccagcugcagcaaacccacccacaaaugggagacuacacaaacacuccacuuccugccugagagggucuacaaccaaacggcacgcaugacuguggugaagcugcggugugcaccugugucaccaaccaggggcuccucggacggggggagggggggcucaaagaccagaggaggaggaggugggggugcucaaagaucagaacaggaaguggcugaagacagggacuagagccggauacagagcaggucaucugugagguucagcuuucccuuagagaggauuacuaaccacuaaaguugggccaagcaucuauugccaccaugucccguuaggcaaugccagauggcacugcaucaggggccacacguguguguucugggcccacaugggugacccacccgucccccaucacggcuugcuggggcuaugggaucucagcagcuccagggacugaaguacuuacuccacgaggccacacaggguacaggccacggagccgcagccccagcaggugcgcacacacugcccgcacagggcucgcucacacugaccgcagaccgccuucccauccacggcucgcacgcaugaggaacaggcaauggacgcuaccccagaugggucugugaggaagaaacgccaagccgucaggcugcaaggagacuggaguuuccgggacugccgggcuaccugccuccaugcauaccugagggcagagggcucugaccugccuaccccauccccaccuacacuggauccuucugacaacccgugagccugguacagugcacaggacccccguuuuacuacagagauccaaggugagauaugccuguaguugacuccaaguucagugcucuuucccuuaccaggucccucugcuaccuggaggcuagugcuggaaggaccauucuuccccuguugcuugucagaacuccaugugucccaucugggucucaguguggcccacugccuuacugguuaacaaagaggugccugggcuccuccuagacacaccaaccagacuugagguagagucggggauugcauuucuaaccagcaacacaggugaugcucugagaccccacacugcauagggaugggacuggcauguuuccagccuugugggacuaucugagggggcugcaggcggaaagcagacgggauacccggggagucucugcugcuuuuuuggcccaguacuuagaagcuguuuaacaacuuccagucuugaaugugagaccuccugauaacaggagccuucugagccagaaggccaagcucugggucagaguccugcuuacccagggaggaaaagccugaccuugcaaaucaagaaaaaugcucgugccaccaccugcccucagugccacagccacaaagggcugcuggugccacucaccagcuucggaggccugcccaaggcuccugaucaggcggccgucugguccaaucagcaucugcccacgugcagcccucggggccccuguagggccaggcuuuggggacucuggcaggugaacgacggcacagccuucaucccacacgugguccagguaggccugggccccgaggaacaggagucgcuuggucuucucugggggaagauaaaucauucucacguccuucacuguguaccaacgaagccccugcauggccauugagucuuucuagccucacaugaaccccaucguccuccugugugcccucugucucccaguaaccccagccuguguugugcccuggcgagcuggguccugcucugccucuaugcugagaaugcuugugcguccuuuccuuaccuggcuuagcugucaucuccuccaggaaggcucuggcccugcagccccaccugugucugaugcaaggguucccucuccuaucacucggcucauuuucugcaauucacggcuggccucgccucacuaagcuuguccccuuucucccuuuucugcuuccccagcacuccccaccuggaaaccaggcucuguggaaugcacagagggagcucugcacuguggagcacuaauucacaaaacucguccccugccaaggaagcagccagaggcuuggagcugggccuacagccucuggccagagcacacccccuucaccugcuacagaguugcuggcaagacaagcaucccagaaccuuccagaccucuuguucuagaacacccacccaucccugggagcagugguuuuccaucaggccacaguucagucaccuggggagcuuugaaaaaucagaugcccagggccagacccagaaaugcuuuguuuuuuguuuugcaccucaccauaacacaguaaaggcagagaucccagaaacucuauguggcucuacaugaagugggcagcaauaauagugacaggguaacucacauggaguagcugaugccagcccacaacacccugcaccuuccuccuggccccccacaccuucccccaucuauaaggggaaaggaaugggacagacacguggugaggcuaauccuuguccucaaggccuuguggacaauucgagguuaagagaucaggguaacagcuguggccuggaauuuggaaacugucacacaguucaaaguagguguccugcauuuaccauggaaggcccacugcacccagcagaccucccugaccugacccggugaguggcacacaccugccaacgcccaggucaggacacucgggaagaauaaagggccauacugagccaggccccauuuccaucuuccucuucuugccugcacaguguuugaauuuuucaacuguccugagagggcacacgauugcgguccugccacaguucccacggcaucauuccccuuaccuccccauggcccagaauagcacucgcuuucacagcccuagcacacuggagacaccgcacagaggaaccucgggaggcagagucuuucccucauucccaaggcacaagcggcaccagguaaaucacacaccccgggucauccucuaacugcucuacaggugcagacuuugugucccaaucacuaggcaagguaagcuccacuuuuuaccugccccaggguauuaaucaccccagucagagugaugaucaauaagaucaacacgccugaaauccacaggagaaagccagagaaggccugggagcucacugcccucacaucccacccagaacuggacacugcagccacacggaguccuauuucgcucuccugcugccuggcuucugccucgcccucuuccuucccuuccucugccuggcuaacuccuacucgcccccacaggauuccgcucagacuguucuuccaagaagccuuccgugccaucccugcaggugcgccugcacaaaccugugccugccccgaccaccuguggcgacuccuccugcuggucuccccaacuaggcuggggagcucccgggagacggggcacaucugucuugccugccuuuggucucccgagaaagccgccgugccuggcagggccgcgcgcuccaugaauaccucuugggacaggaggggcacucuucggguugacuccaugcaggacgccccgcuccccaaccucucccaggacauccugcacgggacaguccugagaaagcaccaggcgggugccgcucacugcagggcggcgacuaaccgggaucguggaagagggcgcgggggcuaggggcagggacccuuuucuuucaggcuguuggacagggugggcgaacgcugggguccucacaucccccucacugaccccagcccugggcguggccagcuuguguccccgcggccucccagcuuccgggaacgcggggccagaaagcagggcccuccagccccccgcucaggccucagaggggacgcugaggcccggcccguuccaggccccgacgcagcggacccucggcagcccgcccgacacucaccgaagaccuccugcgaguagcgcucggcgcacacgccgcggcucaacucccucuggcucacgcggaccuugagcuguagcggggccacguccgcgaaggggcagcuccgcuugggcauggccgcggggccgggagcuacgcagcuccccggccgccagccccuuaccaacgacgccgugacgucaca

SEQ ID NO: 192397 - RNA, 89615 nt, Homo sapiens
cugggcagugcuucugggcccucugcugcuccugcuugucgguugcuaggcgcugggacgcgccucccgaagggugcggggcacagguggccucuucgggguggaccgcgccuggccggggccgaggacaccgcggccgcccgggccugcgggaagcgauggagcccgggaaggucggugcggcgcugggucugggcgagggguggucgagcuucgcggacuccuucgggcgccgcuagcagcgccgccgccgcccucccuuugcgcagcgguucucucggccgggccggggcuucccggaggagccgcggugccuccgaggcaggaagggaaacggaggcgcggcuggccgucggcgcgagggauggcaggacgccgggcucccggcggucgggagaggcggucugugcagccucaggccuggggucgccgccgcggcccgucuccucgcgcccggccuggaggcggccucggccccugcugcggggccgggguggcugaggagacauauuuaaaaguuuauuaaauuuuagcugacuuaaguuuaaauaugacuugucacaguuuaagagguugagagagugcagccugggugcuugaguuugaauucaggauuuuguauuuacuuguaugaccuuggcaaacucacuuaacaugucuuguuuccuaauucauucaaugggcacaauaauaauagcaacauuauaggguguuuaagaagguuaagugagauauuauguguaaaagugcauagaccagugccugcuuucauuaacacucaauaaauguuagauauuacuguauuauucuuaucuauugauuccccacugaaagaugaggaauuuaauuugcauacauuuucuucuaccuucacuccuauuauuuuuuccccaucacuuaccuuuauguguugaauaauacuccuuaauuuguauuuuauguuauauaaaccuuagguuuuuguuuuuuuuuuuuuuuugagauggagucucacucugucaccaggcuggaaugcaauggcacgaacuuggcuuacugcaaccuccgacuccaggguucaagagauucuccugccucagucucccgaguaggugggauuacagauguccgccaccaagcccagcugauuuuuguauuuuuaguagagaugagguuucaccguguuggccaggauggucuugaucuccugacuucgugagccacugcacccggccuuuuuuuuuuuuuuuuuuuaaagauaauuccccuugucgcccaggcuggaguacaguggcacgaucucuacucaccgcaaccuccaacuccuggguuccagcgauucuccugccucagccucccgaguagcugggauuacaggcaggugccacuaugccuggcuaauuuuuguauuuuuaguagggaugggguuucuccauguuggucaggcuggucucgaacuccugaccuccggugauccgcccgccuuggccucccaaagugcugggauuacaggcgugagccaccgcgcuaggccaaccuuagauaguauuuuuuaacuuuccccuaguuaagauuaagaagcuacugcccugcacuccccauuucucccuaaacccacuaauuuccugacccugucaucuucuaugcuauucucuuuacauuucuuuaaguuacucuguaacuuacauuguccgugauuuguuuauagguugauuuuaaaaaugaaaaccaauaaacacuauaacaucaugguuauauacguuuucauugcagaaccaaauagucagauuggaccaauagauacaauggaguccuguauucuaagcucacucuacucagggaacaauguuucuggugucagggucaaaggggucaucuuuuguuacauucaguuaauguaccacaaugaaguuugcuuaucauuuggaccaugucuuucauaaauggcccuauuugcccuguuuuuuuaguuuuggcaaaaaagaacauaagcuguuuuaaauuuuuaaaccuuaugaugucuucuagcuuauuagugucauauuaccuguuuaaugaaauucucuuaaauucuucccagagcucacugacuuuauguucucaucaggacaaauuguuuucuagacaugcacagagcuaugaucugggaauucuuucucauugugcuucuggguuaggccuacuguuucuuggaucaagugucucccucuuuuuugaaaucuccaugcuuuuuccaguggaguauccccuccccccacuuuccucuccccuccccccuccccuuuccccucccuuccucuccccuccccuuuccccugcccuccccuuuccccucccuucuccuccucuccccuccccucuccccuccccccuccccuuuccuuuccuccccuccccuccccuuuccuccccuccccuuuccuccccucccccccuuuccuuuccucuccuuuccuuucuucagagucuugcucuuucacccaaguuggagugcagugacacgcucacagcucacugcagccuaaaccucccaggcucaagcaacgcucuugccuuggcuucccaaagugcugggacuacaggugcgagcuaccaugccuggccugucgcauaccuuuuuagacaagaguauaugugggaagaaaacuguaugcccuaagaauauccuuauuauacugauagauuguuuaagaguuuggcuuagcauagaauucuaggagcaaaauaauuucccagaacuuugaagaugguuuacuuuugucuucuagcaguguguuuggcugaugagauaucuuugugaguaacauuuucuuucucuccagaagauuuaggaucuuuaucugugauguuuugaauauggauguaguuuguuauagaucuuuuuucauucguuauuuuugacauuugacugucccuugggguuuuauucugauacauauuuaauacauaaaauucauuuuuuuugagacagagucucgcucugucgcccaggcuggagugcaauggcgugaucucagcucacugcaaccgccaccucccagguuaaagcgguccuccugucucaggcuccugaguagcugggauuacagaugugugucaucacgcccagcuaauuuuuguauuuuuagcagagacgggauuucaucguguuguccaggcuggucuugauccgcccaccucggccucccaaagugcugggauuauaggcaugagccacugugccaggccaguaaauaaacauuuuuaaaguagcaaaagcaacagaucucagagcuggauauuuccuggcaacuaaugaauuccuguaacagguucucaauugcaagucggucuuuaacuuuuuaggaaguuaacccaugggucauuagaaucuaauuauguaacuauuaggcugugauauagaauuaauuaguauagucuauuucauaagguaaggggaaggauaaaguuuucaugagauuacuggaauaaaauuguauuggauuauuuugguauuagaguuuuuuuuuuuuuuuggagacgaagucucacucuuguccccuaggcuggagugcagugguaugaucucagcucacuccauucucugccucccggguucaagcaguucuccugccucagccucgcaaguagcugagauuacaggcaugcaccacuaugcugggcuaauuuuuuuuauauuuuuaguagagacacgguuucaccauguuggccaggcuggucuggaacuccugaccucaggugauucaccagccucagucucccaaagugcugggauuacaggcgugagccaucucaccccgcugguauuauagcuuuuaguauacaccaagcauuucuuucaguuuguuucauuguacuuaguugcucacauaauuaaucugaugaauauaaauaguuuuauguucuuuauuuguacugagaucauaccaaguuucaguaugucguagcuauuggaaaaaacuuaaugguaccuuugcaggcuuuacaccugccugcauggugacaauuuucuuuaauauuagcucuuucaaaacucuuuaauuuaucuuguuuacaauguguaugacuauuaauuuuuauggucaaugaaaauuuuagaaauuucuaaguuuuuuuguuacauaccaaacaauugauagguaaugugugaguuuauuguuaugaaauuuauuaaucauagcuugaaaaauguagacauguuuuuuagguuauucuuaguuuaaaauaaauuucuacccuuuuuauuuucaugugagauauguacuagugaugugaacuguuuagguacagugcaaugccguuucauucuguuuuuagaaaggcugaauguuuuagaguagcuacaguggggucuccaagguugguccucaccaauccgcuugugggguuccuccagagaacugcagaaacucuggcaugaacucuccauucaaagcccugugcugauucuugacgaaaguuuaacacugcuccucgcgguguaaggccaccucugggacaacccagcucaguguugucugaaagagcucagggcugucagaauaauuuacuguuuguuuuagccaacaccuggggauaggucccugacauccuuucugaagagaguuuaaaagggcuuaaauuaugaauccuucucuguccuuuugagaugucucuaaaucugcaauucaggagugucuuugaaaagauaucagaaaggacaggauggccucuguucuggucucucugggaagguagaauccuaacuacuguaauuaucagcuagcagacacagcgagcuuaaucucacacugaccagccuuuguaauuuuucacuugagcuccccuagcccggguucuccccuaaaacacucccucaccucagugcaaacagaaauggagcucagcuguuucccgucccgccugcaguuacugaaugaaaucuauuucaccacucgaaagucuggcaucccccuccccacacuucucaucugucagccaagucuagaaaggaaucagccugaggucagcucugucuacaaaauagacucagcgcagcagcauuuuaggcaucugccgcuuugacguagcuuugacguagcagcucacagauaggacucucaucugcaaauacaugcauaccgaaaacacaggugcucccugcagccacguuugucacauggaguacagaguguuagaagcagccuguguggucaccagccagggccuaggugagugaauuacggugacuguagggaauaaccuuggauucagugauggaaacugaucauccuaguuuucuucguuaccguuuucuucagagcacuuuuccuaccagggagcgucaguuacacagucaaguaauagaaugaagaccuggauaggcugcauuucauaauuuggcccuaaguaauuugauaacuuaaaaauucuaguguaaggaauuuuggaaaaaaaaugaggacagcaaaggauaaauuaugucccaguccuaaaggcgggagccagccuugcccucugggucucuuagcgugcgcccuaguuugguguguugccaugcaggguuagugaagcacaccacucuggccguuagugcuccugcucauuccacucuguaauucugagaauuaauguuggugucgucaaccuaaagaaaauccaggcaaaauuaauuauagagacuaucagggccacagccugggaaacacugggaggcgcuccagagaacaaaggagaggcuugaguguuuaaagagaaaaggacgaaucaggggacgauuacaaaauacuuugucaaguacugguuuacagaaauaacauugauuauugauugguuauacaucacugaacugcagguuacgaauucugguguccaguguaugacauugguagguuaauuuauggcuauuggccaggugugguggcucaugcuuguaauccuggcacuuugggagggaggauuguuugaggaugggaguucgaggccagccugggcaacauagcaagacccuaucucuuaaaaaaaaaaaaaaaaaaaagccugggcaugguggugcauuucuguagccccagcuacucaggaggcugaggugggaggauuucuugagcacaggaggucaaggcuguagugagcuaugauagcacuguguccggaguugguuccuucugguggguucuuggucucgcugacuucaagaaugaagccacagacccucgcggcgaguguuacaauucuuaaagaugguguguccggaguuuguuccuucacauguucagaugugucuggaguuucuuccuucugguggguuuguggucuugcugacuucaggagugaagcgacagaccuucgcagugagcguuacagcucuuaaagauggcgcaucuggaguuguuuguuccucccgguggguucauggucucgcugacuucaggagugaagccccagaccuuugcagugaguguuacagcucauaaagguagcguggacccaaagagugagcagcagcaagauuuauugugaagaacaaagcacaaagcuuccacaguguggaaggggacccaagcagguugccacugcuggcuggggguggggggaggggggccagcuuuuauucccuuauuuggcccugcccacaucguggugcguuuacaaaccuuuagcuagacacagagugcugauuagugcauuuuuacagagugccgauuggugcguuuacaaaccuuuagcuagacgcagagcgcugauugguccguuuuuacagagugcugauuggugcguuuacaaaccuucagcaagacagaguccugauugguguguuuacaguccuuuagcuggacagaaaaguucuccaaguccccacccacccagaagcccaggaggcuucaccucugggcaccacugaacucuagccugggugacagaaugagacucuuuaaauaauaauaauauggcuguugguggugaugcugagucaagaggucauaaagcaggcugcuuacuuagcucugggugugggaggagcgggacuuccuuagcuccaggugugugugaggggggcggugagccggacguccuuagcuccggguguguuuggggggggcggugagcgggacguccuuagcuggggggggguguggggagagcgggacguccuuagcuccugguguguguggggggggcggugagcgggacguccuuagcuccggguguguggggggaagggggacguccuuagcucccggugugggggcgggggggagcgggacguccuuagcucuggguguuugguggggagccggacguccuuagcuccggguguuggaggguguuggaggggggagcgggacguccuuagcuccguguguggggguggggagcgggacguccuuagcuccguguguggggguggggagcgggacguccuuagcuccugguguugcggggagcaggacguccuuagcugcggaugugggggagagcgggacguccuuagcucuggguguggcgggguggggagcgggaaguccuuagcucccggugugugugugugguguggggggagagggacguccuuagcuccgggugugggggggggagcagacguucuuagcucuggguguggcggggaaugagacgugaccacugucacauuucaguggcucugggccuaaacauuuaaaggagcucacauuccucagauuaguuucuuuucuuucucagugucaugcagggaacaggaugacgauguggacgucagcgcuauaccacuggguccauguagaugaaugucacaggguugggccgcggugucucugucauguggggacucaggcuggagagugccuuugcugcuuugcacagagcuaguggucauccugaagguccagaauggauuuauggcagugucccuggaaggaagaguggauuuagaaacauguuauaagcagaaauaguaguaucuggugacgcuuuccucuguuuauuuuuuaauagagaugggguuucgcuguguugccugggcuggagugcaguggcaguuaucacagcucacugcagccucgaccuccugggcucaagugagccuccugucuuagccuccugaguagcugggacugcgguugaaucaccaugcuuggcugauuuuuuuuuuugauggagauggggucuugcuguguugcccuggcuggucuugaacuccugggcucaaguaaucuuccuaccucagccuagcaaaguguuaggauuacaggugugagccaccaugccuggcucaaaauaacuucuuuuaaacauuucuuaauguucaauuaacuaguucaaaucaguauuuaacuuuaaccucugaugaguguuuucuaaaagaggaggcuggguuagaaagcaaggggagaagcccacugcccacagguggcugcagaugccaguggcaccuucucgcuggagucugcccagcugucggagguuauguggcaggaacaaugagcgucagguccaggggcuucugcuguuuggcuuacagagcgcggaagcccucacacccacucguagugggggucggacaagauggcacaggggugggguuugcuuuccaucugggcugugaguguccucccugaagugagguuuuggcuucaccaccucugauggugcaccuuggaggugauaccaccuuggaagugauuucagcccagguuuacuucuccuuggauuucaggaugagaugagaguggggaaaagaauucccuugaagcccugcauugaggggaaggggaguuaaaucaguuucaucuguuuuauucgggaggcaaaucaaagggauguaaacauuguucaggguucuuacuguacaguucucaauagaauuuuguuaugaaaagguucuagaugauuuaguugauguaaaucgagcauaaaucgagggacagaggcccuggggagcuggugcugggcagccgcucaucuccuguuugcuugccaugugcaugaaggaugcuggcccaggacaggugcuugcagaugcugaagaccgcaggcuccaguucucauccacuagugcgugggcugaaucaugcugaugguuuugcugcuuagcucuccugagucuccucaccccaguccccaggcugggguuuguuccacuccugggagugcuggggaacuuugcccuuugguuccauacuuggagaguugauuuuaagcguggauugcugggcugcuccauagggcagagucugagggcaggucaaguuggucuuuaaaaggccuuggcagaagcaugugguuuacauguggcaaguggggaccgacagcaccggggcagggaagucguaaaucacuguugaacaguuugaaacucuagagggagacagcauggauagaaaacuugaggguaaacaguccauauuagcugaguuuuaagcgcuccaaaguagucaguauucugugcauuuaagaaaauggcuguuacuuuucauacugaaaaguagagaggccgaagaaaaauccugugaucucugucagagaccucuugucuucaggguuuuuaacuuugucaguaucaguaauguuaaccauuaagaaaccccacuggauggguuuugugacauacuuacuuuucacauucugagcuaguggccuugugccuucccaguguccccugaauguccucagcguccccugugugcagcgcccacgucuccugguugaacuguccccuaauguucuagguguccccucucuguggugcccaugucuccugguuggacuguccauugguguccugggcaucccuucuuuguggugcccaugucuccugguuggacugucccugaguguccuggguguccccucucuguggugcccacguuuccugguuggacugccccuugguguccugggcguccccucucugugguacccuggucuccugggucuccugguuggacuguccccgaguauccugggcguccccucucuggucacucguguccuggguuccauucagcccuuuuuuuauagcagguccuauauuaaaccucucuguaggaguuaacuuuaaacaaauaguuggccgggcgugguggcucacaacugcaauuccagcacuuugggaggccgagguggggggcucaccugagguugggaguucgagaccagccugaccaacaugggguaaccccaucucuacuaaaauuacgaaacuuagccgggcgugguggcgggcgccuguaaucccagcuacucaggaggcugagccacgagaauugcuugaaccuaggaaguggagguugcagugagcugagaucgcaccacugcacuccagccugggcgacagagcaaggcuccgucucaaaaaaaaaaaaaauuguuuaauauauuuaugagguauuacagcuuuuuuuguuugcccuaauuuucacauuccaggaagaguuuuaguggcuuguccaugaaaaguuuccauuuuucauuuggacuaaaucuguuuuuuuuuuuuuuuuuugaaacaaacccccaaaugcuuccuuuauuuauaccuuuaaggaaguguuucucaaagggaaaaauugaauaauuaugguauauucucugcaggaaaucauccuugauugaguuugcuuagcugagguuagguuuaucauuaagcucuguuguaccaggguugugggguuguaggguugugggguuguacccuguguuguuggaguguguuacuauggcguggugauacgcgguuagguuaagcaugaagcucuguuguaccgggguuguagggcuguacccuguguuguuggaguguguuacuguggcauggugauaagcaccugcguguucugcacugagguucugcugaggccucagugcagcuguggagcaggagcggcacagaagaaggagcuguggcugcacuggcaaagcucaugcuccccucggggagaccagcgcggaucuuguaggaaucacuaucgcgaggguugccaggaggcaguggugcagugugacaggaggcgcuccagguggcggcgagggugcagaaggggagucccaaccuugccuuagagcacagucaaccuuuacuguccucaugguuccuguagguuaggguuuggggguggcguggggggacguuagggugcaguccucacgcucucugaagguugcguugggcugaggggcccuucugacgugugggcuggugccggccucuccugggccuccccgggagugcuugggcauccuugugcuauggcgucucccagggugcgcggugagagcaagcgggcaccacagccagguggaagcucuggaagggacccugagcaggaaggcgcacagcugggccuccaccccguccuccucaucagaaguguggcagggcgggcggcuugagcugaggaguuugggcaacauggcggaacuccaucucuacaaaauacaaauauuagccaggugucaucccagcuacucaggaggcugaggugggaggaugacuugagccgagguugcgccacugcacuccagccugggugacagaaccagacccugucaaaaaaacaaaaagacgaugaugaagaagagugugacauagaaucuggcccacguucgaggaaggggaaucagcuugacuuguaaaggaaggguuguugaagagucaguggaaaugguuuaagaccacggcaccuuguuauuuuaauaguccccucagaugcuuagaacaguuggauaccuggugagcuggcuguccggaugccgccuuucccggcacgcacaguguggauucucuaauggcugguggucgugaggcgcugcgacaugcuaagcagugcugggugacacagaggacuaagauaggccuuccuuuccggaaggugagggcuuagcuggagagaugucaucacacuugaaagguggauuauccaacgaggaacaaacacuuucgcaguagaaacaacaaacaucagaggagcuggacgguguuuuugggccuggaaccuuucuuggguuuuaucugcgcagccccagcucugcagcagugcucggugugugcgaggagcuugguguguauuugcugaauacaaguacagggcccuggagggccagagacacgggugagcuugugggcccaccaguugcccaguguagcagacgggugugauaggguguccucagggacaggcaggcuuucucugccgauccuugagcauucaguccacaggugucguuucuguuccugauuuguuccuuggcaggacucuagagcugaaagcugcugagccuugugaugccucacuguccucauuagaaaaacugagcugauagccuucuuaguaggguuaugagauuuaaauauuggugcuugaacaggauagcaucugguaugcaccagaugcuaaacucauuucugucugucauacaucccagcugcuguugcuguguaagaggcuguggugugagacaacagcagccuucuaauuuucucacauacucuguggaucaggagagcucacagcagcaggcuuaguucuguugcugguaccuggggccucggcuggggagacuugagguucaggagguggugacucaugaggggcugcgggagccgugccucucacgcaccugcccuggugcuggcugugagggaccccucugggcccguggcuguggcaucugcugugagggaccccucugggcccguggcuguggcaucugcugugagggacccucugggcccguggcuguggcaucugcugugagggacccucugggcuguggcaucugcaggggccucuccccagggcugcuucucuuccucacagggaaguaucuggagcugcagcccaggaggaccaggcagaaacccauuguccugggaggcccaugauaccuucuguccuggguugagcccagcggccgcagaaggagcacagacucccucugugugcacagcauuugggacgugagucuguuguggcuguuuuuggaaaauacagucugacacaagauauuuuaaacccacagaauauuuguccuuccucuguuguucaacugcuguuauaacuuguuuucacuuuuauuuuauaauauuuaaguuuugaaguagccaaaggaacacauuuuauaauaaugugucauuuuagacuagugaauaauuuuuaaaaaucuguauuucuguuaccuuuuauuccaggagguagagaaguauuuucuggcaugucaagaauuaacugccauugauuuaaauggcauaaugaaaaagcagcucacuacaacacugaaaauaaauuauuuuaaacauucuaacuuuauacuuuucuauuuagagaagaaccaaagaugauaccuggaaagcagaugaccucagaaaacaucucuggguaauuauuguaaagauuuggauugggaucugugcaggacucgugugguuuucuuggaccugcuuuaccugguacacaacacuguauaacuuugguuaugugugccucauuucagaaguacuuugaacucagaggugaagguguacggcuaacaaucccucuggaacguugguuaagccagcuggacacucccacugcucguggggcucugccauggcucaggggccuccgcacugcuuuagggcagggagugcucacuucaggggccgcagcgguggguggggagaggggcuuugggauugagagagaguccugagaguuuuagaacgaggguccuuguuuguauggggcccaggcgguuugugucuuagcgacuuuaaaacacagcuucaguaucucucuuuuaacacauguaguauuuuauuuauuuauuuuuaguuaauuaauuuuacucuuuuuuuuagagacagggucuuaccguuuugccuaggccggagugcaguggcgaaaucauagcccacugcagccuugaccuucugggccugagcuguccucccaccucagucucuugaguagcuaggacuacaggcaugaaccaccaggcuugcuaauuuuuuaauuuuuuaauuuuuuaauuuuuugcgggagagauggggaucuugcuauguugcuugggcuagucuugaacuccuggccucaggugauccuccugccuuagccucccaaagugcugggauaauaggugugagauaccaugccugguccuacuuauuuuuuuugaauuuuacuuuauuuuccauauuuuggggguacaggugcagguuucuuacaugcauaucuuguggaguggugaagucugggccguuagugcuccugacacccgaauaguaccugucacccgaauagugaacauuguacccaauggguaauuuuucacccucuaauacacguaguauuuuagauuugauuugccgaucagugugaauguccaugauauuggggcgcuggugggcaguuguagaaaucuaagcuugacuccauguccuuuaguguucuaagaacauccaugcaggcuuuggcccgucugggauuggaaacugggauuggaaagcaguugaaugcaaauauguuuuaaggcccuucagcugugugugcuucucacauucagguauuaaaagucuaauggaaaucugccuuccuggucacggaggacccuuuguucucuuguuucaggccauacagucaggugguuccaaggaagaaagaaagcacagagagaagaagcugcguaaggagucugagauggaccuuccugaacauaaggagccgaggugcagggaucccgaccaggaugccaggagcagagacaggguggccgaaguccacaccgcuaaggagaguccucguggggagagggacagagacagacagagggagaggagaagagacgcaaaagaccgggagaaagaaaagcugaaggagaaacaucgagaggcagaaaagucucacagcagaggaaaggacagggaaaaagaaaaagacagaagggcccggaaggaagagcuccggcagaccguggcccaccacaaccugcugggccaggagacacgcgaccggcagcuccuggagcgggcggagaggaaaggccgcucagguggguccccgcuugccuuccugugguuccacccgaggugccgcgucgcugcuggugacagguugauagcucgcugccuccccucccucucucccccgcuucccuccuuccccuuuccuuuuuuuucuggacagggucuugcucugcccccaggcuagagagcaguggugccaucacagcucacggcagccucaacuuccugggcucaagggauccucccaccgcagccucccaaaggacuggcauuacagacaugccacugugcccagcuggcucuauuucuuuuaaaaguucuugcuguuugggacauuuuccucuuuugaaauguucauuuguuauuuuuguuuucucucauaguuuucacaaauguuuuaucuuugaaguuagagguuccuguucucucuguugcgggguguguguguguguacuuuuuaucauuguuuuucuuuugguauuuuaaaaacuuguucaggccagguguggugggucauaccuguaaucccagcacuuugggaggcugaggugggaggaucacuccagcccaggauuuugagaccagcuuggggaacacagggagacuccaucacuacaaaaaauaaaaaaauuagcugugugugguggcgcuugccuguaguucuagcuauuugguaggccgaggugggaggaucccuugagcccaggaggucgaggcugcaauaagcuaugauugugccacugcacugcagccugggcaacagagugagacccugucucaaaagaaaaacaaaagcucuaaaaaccauuuagccagcugggcgcgguggcucacgccuguaaucccagcacuuugggaggccaagguggguggaucaccugaggucaggaguucgaaaccagucuggccaacauggugagacccugucucuacuaaaaauacaaaaaauuaagccaggcaugguggcgugugccuguaaucccagcuacucaguaggcugaggcaggggaauugcuugaaccagggagguggagguuauagugagcugagauugugccacuguacuccagacagagcgagacucugucucuaaaagaaaaaaaaaaccauucagccaaugaaaggaauaacaauuuucucauuauuagcuagaguuuuacuauuaaaacauauuuuagggccaggcacagugccucaugccuguaauccuagcacuuugggaggccgaggugggcagaucacuugaggccaggaguucaagaccagucuggccaacauggcgaaaccccaucucuacugaaaaaaaagaaaagcaaaaauuagcuggaugugguggcacagcugcuugggaggcugaggcaugagaaucacuugaacccgggaggaggagguugcaaugagcugagaucacgccacuacacuccagccugggugacagagcgagacucugucuaaaaaaaaaaacccaaaaaacacaaccauauuuuagacuuauuaucucaauaaggcuuauuaucuccguaaaucugaauccucaucguaaauaaacaaaaauaaaccucuuugauaaaaaauauuuucuaaaaguguguuuuauuuuauuuagcuaaauuccuaggaacuguaagguaaagguacauacuuuuuuuccuccccaaauggaaauuucuucaguauuuuuugguuauauagguaguauaugcuucuuacaaaaauguaaacuagcgcauauaaaugcagaaggaaucuguuagaagaacagguagucacucuuagaaucagcagaaggguuagaaggccuggcugugaaaaggauggaaacgaagggccuuuacucauugccaccauuagaugucucuuauagacacggugaucuguuuauccccuucacugcugguggccauuugagucguuugaagauuuagacuauuaggaauaaggcugcuaagaauguuaucauguguauuuuuugguguucauauaugugcguuucuguugggguggaauauacaugagguggaauggauggguuaguuggguuaccacuaauuuuguuuucuuuaaaaauauauuuuauuuguugauuuauuacuuaaagaaauaaaguagagucagggucuugcccugucgcccagguuguagugcaguggugugaucacagcccaccacagccuugaacugaguagcagagucuccaggcucgcaccacugcaccuggguaauuuauuauucuuuuuggagauagagucucacucuguugcccaggcuggagugaagaggcgcgaucucggcccacugcagccuccgccucccugguucaagugauucccgugccucagccucccgaguagcugggacuauaagcacacgccaccacaccuggcuaauuuuuuguauuuuuagcagcgacggggguuucaccauguuggccaggcuagucuugaacuccugagcucagacaauccacccaccuugaccucccagaguacuaggauuauaggcgucagccacagcgcccggccagcaccuggauaauuaaaaaaaauuguuuguagagauggggcuccacauguugcccaggcuggucuugaacuggucucuagcaguccauuuaucuugaccucccaaagugcuaggauuauaaguaggagcuacugcacuuggccuaauuaauuuuuuuuuuuuuuuugagauggacucucacucuguuccccaggcuggagugcaguggugugaucuuggcucacugcagccuccgcuucccagguucaagugauccucaugccucagcccccugaguagcugggguuauaggcacgugucaccacgcccugcuauuggccuaauuaauuuuaacaguagcuguccuacuauuuaaugcucuuuucaaaauuauuguuuuugauguuuuugguauuuauuugcaaucaaaucuuuuguucucagaucacccuuuuuuggcugccugcucauuuuuucagugugguguugaaaggaauuguacuggaaagacuuuugaaaacugaucguagacuagacucucuaguucuuuccucuguacaucucuucucaucuccuuucuuuccacaaagcccaucugugcaguguggccuuuauccagggcuggguccccaggccuccucuccagcaaccccuugcccuugcuggcuggaucuagucucaugguuuuaaauacuguuugucuguguccuuauuuccaaguuuuuacccccagcugggcaucaucccugaauuccaggcuuguguauccccugugcuuugaagucuaauggguaauacaaacgcaguguaccccacaugaagcuuccgguagccccuccacacuggcuguccugcaggcuugccugucucaguuaauagcaccugcauccucgcguccugaggucacaagaccugggauauauccugaugcccugcuuucucuuccagucucuuggagaguccugggguuucagccuugaaaaucuaccuguucuggggcccucccucuguaacccagacuccuagaagagugcucagugcuugguaaaugccuuuuuuuuuuuuuuuuuuuucugagaaggagucucgcucuauuguccaggcuggagugcaguguugcagucuuggcucacugcauucucugucuucuggguucaagcaauucucuuccuuagccuccugaguaccugggauuacaggcgcacgccacgacgcccggcuaauuuuuguauuuuuaguaaaggugggguuucaccauguuggccaggcuaaucuugaacuccugacuucgugauccaccugccucggccucccaaagugcugggauuacaagugugagcuaccgugcccagccugguaaaugcuuuuugaaugaaugcacuuugccucagugaucuuugaaaguuuaacuuugcccugaucuuuuaaaguguccacucucugaauuuuacaucugaugccuuuuuugugugcagauucagaagugaaaguccagcuuuccuuguuggaugaugcuuuggugucaucgguaccugccuggcucuguuugcccccggucucucuugcaggucauacugggccuuggugcuucagccuccccagcccaggauggaugccguagucuggugcccuggggagucagcugcaccuggcuuccuuguugauucaggggccucuggcuuccuugguccccucagcagugggggugccaggagguuugggggcugcucuggguccucagugcauccaggagggcaggcauuucccuggagcucacauuuggcuaaaguguuggccgacugggcugguucuccuguucagacuaagcccugcuucugcgugauaugcagaaacccugaaggcuguaugaguuuggucuggugcccucuugaauuuccaaggguuacucagacauuugccugguugcuucagcagcaaacugagugaggcaagaaaucucucuguuccuuaguguacgagucuguccucauacugcuguaaagaaacaccuggggcuggagaauuuauaaagaaaagagguuuaauugacucaccauugugcgggcuguacaggaagcauggcuggagaggccucaggagacuuacagucuuaggagaaggugaagggaagcagucacgucuuacagggccagagcaggaggaagggagagaguggggaggugccauacgcuuugaaacaaccagaucuugugagaacucacucaguaucacaagaacagcacccagggggaaauucacccccaugauccagucaccucccaccaggucccaccuucagcauuggggacuacauuucagcgugagauuuggguggggacacagauccaaaccauaucacuuagauugccauguucaucuccuucuucauuuuaaauuugauacuagaacucuucauucuugaguuggaggcauguguuuuaguugaagaauauuuucaaauacauauuaacgaauauaaaaugugcaauaccauccauagcaagauguuaaaagaguuuuuugaugugcuaacauuugggaguauuaaaaauauguuuuacuucuuguaguaaguaaaguaagaagugaagagaaagaugaagacucugaaagaggagaugaagauagagaaagaagauaccgagaaagaaagguauacgaagcaaggccuggggaaaaguuuuccaaauguugccaaguaaaggauguuuuaagcauuauuguuggaagcauuuuuagaaaauguccuaagccaggauuucaguccuggaaaaggccuccagcacuguguauagucaguuucuuucuccucauagucaagugcguuuuucugauuccaaagguaguaugugaugauauuagaaaauuuagaagauacaaauaaguaguaagaaaacaaaaacugucuaauccucacccacagguaaguauugauagcauuuagguauguauuuuuccagguuuauauauuuguguauguauaacauuguuuucuuuagauuuuuacuguuuuauaaguuguuuaaacggaacacauuuugagccuuuuccugagugauccugucucuccccguguuucagugagcgugcaacuugguguuucgcggugcggguguguuggugcucuccaggcaccugcgguuccggauugguguuccgcggugcggguguguuggugcucucgaggcaccugcgguuccggauugguguuccgcggcgcggguguguuggugcucuccaggcaccugcgguuccggauugguguuuugcggugcggguguguuggugcucuccaggcaccugcgguucuggacacuuagguuguuucuguguguuuguguuuuuucuuuaaauuauaaagacauccagaugguaugcuuuuugguucguucauaauuauuuccuuaugauuaauuucugaaaaugaacuugcuggaucaaaguaaauguaaacuuaacucauuagcuuuacauaaaaguuguaauuauuuauaucaucagagcauaauuccuuauguccuaagcaggagcugggcaucaucuucguuuaaaaguuuugcucauuugauucagaagaaaauggcauuucugggcauuuuuaaaagcagguuuacugucuuuuguuauuuaccacuuguguacuuuugcuuauuuuuuuucucucuuuuuuuuauuuuuuagagacagggucuugcucugucacccagguuugaguguuuuagucacagagaugguuaaacucuggucccauuuucaagacucuccaucugcgugggacuaauuaggagagaaagagugaugugacauguccauaugagagauguggcagccuugugcugucauacucaccggagaaggcaucucucagagaagucagagcuugcucaggagggaccccagggcuggcggagcuuaggcugagggccaccagcaugagggaugaggcuguggaggccaggagggcugacugugagugccgggugccauguggaggggccaggagggccgacugugagugccaggugccauguggagaggccaggagggccgacagugagugcugggcaucauguggggaggcgaggaggggaggccaggagggcugacugugagugcugggcaucauguggggaggcgaggaggggaagccaggagggccgacugugagugccgggugcuguguggggaggccaggagggccgacugugagugcugggugccauguggagaggccaggagggccgacugugagugcugggcaccauguggggaugccaggagggccgacugugagugccgggcaccauguggggaggcgaggaggggaggccaggagggccgacugugaaugccgggugccauguggggaggccaggagggccgacugugagugccgggcgccaugugggguggccaggagggccgacagugagugccgggugccauguggaggggccaggagggccgacugugagugccgggcgccauguggggaugccaggagggccgacugugagugucgggcgccauguggggaggcgaggaggggaggccaggagggccgacugugaaugccgggugccauguggggaggccaggagggccgacucugagugccaggugccaugugggguggccaggaggguugacugugagugcugggcaccauguggggaggcgaggagggcagacugugagugccgggugccauguggggaggcgaggaggggaggccaggagggccgacucugagugccaggugccauguggggaggccaggagggccgacugugagugccgggcgccaugugggguggccaggagggccgacugugagugccgggcaccauguggggaggccaggagggccgacugugagugcugggugccauguggggaggcgaggaggggaggccaggaggacugacugugagugccgggugccauguggggaggccaggagggccgacugugagugcugggugccauguggagaggccaggagggccgaccgugagugucgggcaccauguggggaggcauugcuuucucugugggagcgagguggcugggcugcagaguuacuguguggcguuggggugacagcagugucugaccauggaccaugacaugaauaggguuuuuccuuacacaaggguaacagauuaaguuuucaggaauauaucugacaguggaauugaggagugaagggggcagugguaguucuguaaguuuuccuccuuuuauuguaacauuuauaaagacagcacagucgucccuugguauccaugggagaagggcuccaggacccccucagauaccaaaauccaugaauacucaagucccccauauaaaaugguguagugucugcauauaaccuacgcccuuccaccgggaugcuuuaaaucgucucuauauuacuuaaaaucccuaaugcaauauaaaugagaugcaaauaguuguuauuguuuaggguguaaugacaaggaaaaagucuguacauguuuacuacagacacgauuuucuucaaauguuuuugauccgugguugguuggauccgucguugcagaacccacagagagggagggcuggcugcacuccuauuugaugugcuccuguguuucucagcuugucguguuuuacagcugcaguacggagacagcaaggacaacccucucaaguacuggcuuuauaaagaagaaggcgagaggagacacaggaagcccagagagccagaucgagacaacaaacaccgagaaaaaagcagcacaagggaaaaaagagagaaauauuccaaagagaaaaguaauucauucucugacaaaggggaagaaagacauaaagaaaagcgacacaaagaagguuuucauuuugaugaugagaggcaccaaagcaacguggauagaaaagagaaaucggcaaaagaugagcccaggaaaagggaaucccagguaccccuucugaugcuucguugccuuagcagccgccccgaggccggcgcuuucagaggaggcuuaccgggcggugucgccagacaagguugagauuuguggccuaguaguaguaauuuaggaaaaacgcaacucaagucuugauuacgugguuaguauagacagauuacugaucuccuaaggaaugugcugucacauauuuugauuauaucgugaauguacuuuuaacagauauuuggaaaucuaucauaaaacuuugaaauuuggccaggcgcgguggcucaugccugucaucccagcacuuugggaggccgagguggguggaucaccugaggucaggaguucgagaccagccugaccaacauggugaaaccccgucucuacuaaaaauacaaaaauuaguggggcauggugguaggugccuauaguccuagcuaccugggaggcugagguaggagaaucgcuggaaucugggaaggagaauugcuggaacccaggaggcauagguugcagugagcugagaucgcaccacugcacuccaaccugggugacggagugagacucugucucucaaaaaaaaauuuuuuuugaaauuuaacauugaaaaggaagcugguacguuuuaaaguggaaauuaagugaauaauuagcaaacguuucaaccagaauugguauaaguuugcaaaaaaagcaaaacaagacagaacaaaaauguaaaagcauugauugcagagggucuaauuucccucccaggucugugguuucaucccuguacuuaggauuuuccuagagguguuuuagcaccuuuuguucucaugagugugcuuuuugcugcuguuuuuacagaauccgaagcuaauaugaucuuauuuaccuauuucuuggugaugcuuccuuuaagauggaagcaaaaucuuugcaagagucaggugguaucugaggcuaggggagagucacaccuucagggaugagacuggaggccucagcagaagcgcaggacccggaucuccugaucugaacugacacagcugaggaaauggacguagagcugguggccacugcaguguuuacuguaaaacgcgaaugccaguggguuagaacugggagcacuuaggccgagaagcagucguguuaggagcagaagcugccuggcucccggccaucucagccgcucuuggcgcuguccugcauggggucagaguccuuuaaccucccucgccuuugcccuggggccuuuccucacugagaccccacugucuuccgcagcccacgcccucuguuugcaucagggcguuggccguguuucuuagcagguuugaggcagugccgguucugcuacccgcgucuacgguguggaaagccuggacuccccucuagucagccacacggaagguuaguugaggcggucacugagaagcagcuccuugaggacagauacucauuuuuuuuguuuuuauuuauuuuuauuuauuuauuuauuuugagacagagucucgcucugucgcccaggcuggagugcaguggugcgaucucggcucacugcaaccuuggccucccagguucacgccauucuccugccucagccucccgaguagcugggacuacaggcaugugccaccacucccggcuaauuuuuuguauauuuaguagagacgggguuucaccguguuagccaggauggucucaaucuccugaccucaugauccgcccgccuuggccucccaaagugcugggauuacaggcaugagcuaccgcgcccggccauuuuuuuuguuucuaaaucucuuucccuagaucaaaacuucaucauuuucucccaacguuguguuacgaacauuuucaaacauacagcaaagucgacguaauuuuccaaagaacacucuuguacccauaacuuagacuccgcuacuugccuuuuauugaacuuggcuauucuccauucccuagaucauguuuaauuacuggaagugacuuagguuacaugugcuuaguuccacccagaaaugccuuucuggacauagauuuggcuuuuauuaaaggugaaugugaaaaauggucgaugaagaacauuauccuguaucuuuguaaaaccacugccuucaaauuagucccagaagaaagauuauucagacgacugacauuuucuuuuuaagacaagcuguuccuaucugaguggcuuguaugcugggcacuguucuaggugcugaggauacagcugugaacaaaacaaaaauuacuguucuuauggugcuuauguuguguuggagaagccauaggauaaagaacuaccaaaaaaaaaccaccuaaaucucagauaggugugguggcuuacaccuggaguccuagcuacucaggaggcugagguuggaggaucuguugagcccaggaguucaagaccagccugagaaauauagugagaccccaucucuaccaaaaaaaaaaauuuagccaggcaugguggcacacagcuguagucccagcuacuacagaagcugaggugggaggaucacuugagccgaggaggucaagccugcagugagcugugaucauaucacugcaguccaaccugcgugguacaguaagaccuugucuuaaaaaagagaccaggcaugguggcucacaccuauaauccuagcacuuugggaggccgagacagguggaucacuugaggucaggaguucgagaccagccuggcuaacauagugaaacccugucucuacuaaaaaauacacaaaaauuagccaaguaugguggcacgugccuguaaucccagcuacuugggaggcugaggcaggagaauugcuugaaccugggaggaagagguuacggugaacugagaucgugccacugcacuccagacuggaggacagagugagccuuugucucaaaaaaaaaaaaaaaaggaaaagaaaugaacagauacacgauacaauaucaggaauggggaucgagcauuguauaauuaaagauuuuuuccuuugcguugacuuucagaaauucaaaacuuuugaguacuuuugauacucaaaauuaguaucaauuuuagauauucuucaacugaguacucugaaccuacugcuugauguaauuauccugugguuaccguaaagugcaaggugcacugcuaauaauuacgccaggacaacagauagaaacugggacuguucccggggauggauguucucugugauucucucucacuuucucuauaugauauuuuuucuucuucuuuuuuuuuuuuuuuuugagauugagucucacuguaucgcccaggccagagagcaguggugugaucuuggcucacugcagccuccgccuccuggguucaagugauucuccugccucagccucccgaguggcugggauuacaggugugcaucuggcuuauuauuauuuuuuuuuuuuuuguauuuuuaguagaguuucgccauguuggccaggcuggccucgagcuccugaccucaggugauccuccugccuuggccuaccaaggccaaguguuacaggugugagucauggugccuggccucuauaugauuuuugauccaugauuuuaauuagaaugauauaacuuuuauuguaagcuuccuccaguuaucaauuugagauagaguaugaguaaguacaauaaauauacaaaauguucuaagcuuccugaccagugacuucuuuuuuuuuuuuuuuuuuuuuuugagacggagucuugcucuguugcccaggcuggagugcauuggcgcaaucucggcucacugcaagcuccgccucccggguucacgccauucuccugccucagccucccgaguagcugggacuacaggcgcccgccaccacacccggcuaauuuuuuuguauuuuuaguagagacggaguuucaccguguuagccaggauggucucgaucuccugaccucgugauccgcccgccucggccucccaaagugcugggauuacaagcgugagccaccgcgcccggcccagugacuucuuuaauagaagaauccaguggccucaucucguuguuauccuaucugccacaccuuuauccuuuuaaaaaacaauuuuuuuuuuuuuuuugagauggagucucgcucugucgcccaggcuggagugcaguggcgcaaucucugcucauugcaagcuccgccucccggguucacgccauucuccugccucagccucccgaguagcugggacuacaggcgcccgccaccacgcccggcuaauuuuuguauuuuuaguagagacgggguuucuccguguuggucaggcucgucuauaacucccgaccucaggugaugcgcccgccuuggccucccaaagugcugggaucacaggcgugagccaccgugcccagcauaaucacccuuuuauauauacuuuuauccauuuucuuuacauuuaauuaucuaauuuacuaaaaauaacugguaaaaauaguuauuuuaaaagguacuugugauguacaugcuguuguuaaauuuugaaucugugcuuguuuugugggguuuacuaauuaugcuuacuucauuccgauaugcuaauaaaugguuaugggauuauauuuuuguuugauagaauggugaacacagaaaucgaggugcaagcucaaaaagagaugggaccagcagccaguaaggauugcaugcccuguggucgaccuuuacgugugccgcucucauggaaugcuucagggaauuuucuuauuggcuccgaugacggccaguccauggcaaucaguuauagauauacuucauuuucucuagauuuuaccccuuagccccuccaaauggguugguagguuuuuggaauacuggaggagcuuggaaacuuaauauauuauuagcuuucuuuggccuuuuaaauuaauuauauuuuaauuuuuucauuuuaauauuauuguuuguauuuauugccucaggaucuacuuuuguccuuuuuaacauuugcucaugcaaaauuagaaaauugguacucacuuuggggagaauaauucacuugggagucacuuaaugugcaagagggaguccucccugccugaagcuaaagcaaauccgcaggugggcaguuuugcaccuuuacgcaccugagcaaaccauucugguucacagccacuaaaaacaggacgugccggcgagucccccucugcccacuguuuaucacuugugaacacacgggauaacauuccgcccucaggccuuggcagagacccccagagcugggggugggggucagccuugguuggaauuuccugucuaccucuuaguugcaguguuggguggcuuuucgcuaaagcagugaugauaauuccugucucguguggguuuugcaauacauaauuggaguuuauguauaaacucuuuuuuuuuuuuuugagacagagucucacuuuguugccgagccuggagugcaguggcgcaaucucggcucacugcaaccuccgccucccagguucaagcuauucuucugccucagccucccaaguagcuggaacuacaggcacauaccaccacacccagcuaauuuuuguauuuuugguagagauggaguuucaccauguuggccaggcuggucuugaacuccuggccucaagucauccaccugccuuggccucccaaagugcugggauuacaggcgugagccacugugccuggccuaaacucucauauguaagcccuagacuuuaauuuguucuuucugacaaucauauuuuguaaucguuuuucaaagauuagaaaacccagguuaaauaucuuacccaaauuuuuacaaguuugggcaaagcuaacacuuaaaccuagggugucaauuccuggauuuuauacugcauguccacuagaaggcacaauaagacuuuuuuugcucaauucuguauuuuuguuaaaccgcaugguauauugauaugaaugaaaguuuaaaaauugagaaucaguuugauauuuugcaaaucuuuauuuuagguccuaacaugaaaugugauuaaaauauaaaacauuucaagauaaaucuuucuuuuagaaagauuuuauauuuuuauuuuauauuacauauuauauaacauauuuauauuuuauauauaucuuuuauauuuaauauaaaauaguauuucagauagaccaauaaaauuauagaaaauuucuacaacucuuuuuauuuuuuguuuugugauggagucuugcucugucgccaggcugaagugcaguggcaugaucucggcccacuguaaccucuaccucccugguucaagcaaauuccccugccucagccuccugaguagcugggauuacaggcacacgccaccacgccuggcuaauuuuuuuguauuuuuaguagagaugggguuucuccauguuggccagacuggucucgaacuccugaccucaggcagucugcccaccuuggccucccaaagugcugggauuacaggugugagccacugcgcccggccgagaacuuguaaaggauguagauuugcacucacaaguuuguuaaaacacauaauuucuucucuggaagauauuuucugucuugaauuauugcuaaaauaguaagaaugcuaggaagacuuuaacauuuauugcucuaauaaaacaugcuuugcuaaccugaaacaguuuuuuaaaaaaauuauuuuuugagaaagggucuuucucugucgcccaggcuguagugcaguggcacaaucauggcucacugcagcuucaaacuccugggcucaagcaaaccuccugccucagccucccaaguagcugagacuacaggcaugugccaccaugccaggcuaauuuuuuauuuuuguagagauggggucuacucuguugcccaggcuggucccgaacuccuggccucaagugguccuccugccucaaucucccaaauagcugggauuacaggugcaagucaucgcuccugguuguaguaguucuuaaucauaucaaaauauuguuaagagcuuucacugauauggaaaauguuuuauuuuuuaaaagcucucauuuaaaguaaguuuugauuuugauuauguuugcuuuccaggcaugcugagaauuuaguaaggaaucauggaaaagauaaagauucaagacggaagguaaggcagucuccacugagaauacauugauuuuaugguacauugagauuaaccauaaucuuacuuugggcuuccccuugaaaccagaggccgagacagggcucauuugcagaugguuuauucgaguggugaucccagaaggcacacuggagacucacuuuagguuagaagaugcaaauugauugaaaguaaaaagguggacaaagagaaucuaucagacagcagcuaugagagggcuggauuggcuacacuaguaucagauaaaacagauuuugagacagaaaguguuacuagagagagacaauucagaaugagcaaauaauugguucagcagaaggcgauaaaacaauuguaaauggauauuuaccuaacaagagggucccaaaacacaagcagcaaaaacugacagaauugaagggagaaagagacaauuaauaauaauaguaacuuuagcaccccacuuucaguaacagguaggacaauauuuuaugguaacaaauuagguaauuuagaugaaaggacaaauuccuagagacuaucaguuacuaaaacugcuggaagcaguagccugaauagaccuauagugagucaagacauugcguuuguguuacagaucuccccacaaagucgcucaggcucugauggcuucucuggcaaauucuaccaagcacauguuauuaauagacacuuguuacuaacacacaaucaucaucccucuccuugcauaauuguuuccauguguuaagcuaccuugugacauguauuuaugcacagggagaauuguacccugugcugagcuugucaauuaguacaucagcguuucuccacagucuucauuaucuucacugucuccauuaggaucauaagaguaggcuuuguaaugauuacuuagugacucuaaaauagcacacuguggaguuaggguuauuaucaaaccauuguccuuuuuuuuuuuuuuuuuuuuuuuugagacaggucucacucuguugcccaggcuggagugcaguggcacgaucucggcucacugcaaccuccgccucccggguucaagcgauucuccugccucagccuccugaguagcugggacuauaggcaugcgccaccaugcccggcuaauuuuuguauuuauaguagagaugggguuucaccauauuggccagucuggucuggaacuccugaccacaugaucugccgaccucggccucccaaagugcugggauuacaggcgugagccaccgcacccagccuuuuuguuuuguuauuacagauaauguggcaagcauauuuuggauucuaugaauuauuucuggagaauaauuuuuucuucuuugaucguuaucugaaacccaugauucugagguaaucauauuuaacaauuuugugccauacauacauauauauauauauauacguugagauggagucucacucuguugcccaggcuggagugcaguggcgugaucucagcucaccucaaccucugccuccuggguucaagcgauucgugccucagccuccugaauagcugggaucacaggcaugcgccaccacacccagcuaauuuuuguauuuuuaguagagacaggguuucaccauguuggccaggcugaucuugaacuccugaccuuaggugauccaccugcuuuggccucccaaagugcugggauuacaggcgugagccacugcgcuuggccuuugugcaguauuuuuaugaauugcuuuauucuauguccguacacaaacauaauuuuacauaaauuaggucauacagcaccuguuguuuugacguggauguuuuauuucuuuaauuuuggugguggugguuggauugcuuauuaucuggcuauagccacacauuuaccacagaaaaaaauaccuacaaauauuucuucucauauaaucuuuuauaaucauauauugguauguauauuuaggaguuuggaagccaguuuuaaacauuuacacacacacacacacacacacacacacaccccuccuguuuuucuuuuuuuuuuuuuuuuuugacauggggucucgcuuugucacccaggcuggagcgcaguggcgcgaucuuggcucacugcaagcucugccucccggguucacgccauucuccugccucagccuccugaguagcugggacuacaggcgccugucaccacaccuggcuaauuuuuuguauuuuuaguggagacagggauucaccauguuagccaggguggucucgaucuccugaccucaugauccaccugucucggcuucccaaagugcugggauuacaggugugagccaccacgucuggccaccccuccuguuuuuccuaguucauaguggaaaucccuccaguuuggacgauauagaucuaccgcauuuuuuuuguggauacauuucuugaaguggaauuguggaaauacuggaugaaaacguauagauuucuuuuccuauuuucuucauguuucccaauuuugucucuaagcuccagguuggcauuguuaacuagaauuauaaugugagccacauuuauaauuuuaaauuuuauuuuguauuuuuauugaaaaaaauaggccagauguucgagaccagccugggcaacauaggaaguccucaucuauauaaaaacaacaacaacaacaaaauuaacaaaaaggccaggcaugguagcucaggccuguaaccccaacacuuugggaggccgaggcagggggaucaucugaggucaggaguuugagaucagccugaccaacauggugaaacucccgucucuacucaaaauacaaaaauuagccggguguggugguggccuccuguaaucccaagcuacuugggaggcugaggcaggaaaaucgcuugaacccgggagguggagguugcagugagccgagaucgugucacugcacuccaaccugggccacggagugagacuccuucucaaaaaaaaaaaaaaaaaaaaaaaauagagguagggucuugcucuguugcccaggcuggucucgaacuucugggcucaagugauccucuugccucagccuccuaaaguacugggauuacaggugcgagccaccacaacuggccuauaauuuuaaguuuucuuauagucacauuaaaaacauacagaagaaacaugaaauuaauuucauaacaucuuauauaauccaauaaaucuaaaauaguauccgugcaaccuguaaucaguauaaaaauuaucagugagguaaccaaugggauauuuuacauucuuuuuuuuucuuuuccagaggaguaaaauauaugauguguuuuuuucuagaaaaauuucaguugauugugaauguaucuaacagcuuguuuuggcucugauuagauccugauuuuacagcagcaacacugaauuuaucuugguucaauucuucagcauuuauggagugccugcuaugugccagaauaguuuucuggacacaugggaaguucuuuuucuauuuucuucaugaauaauacuuuauacugucaccaguuuuagacacugccuaguuuuggguagugacuucuuuuuuuuuuucuuugagacugaguuucgcucuugucgcacaggcuggagugcaaccucugccuccugaguucaagagauuuuccugccucagccucccaaguaacugggauuauaggcacccgccaccaugccuggcuaauuuuuuuauuuuuaguagagacgggauuucaccauguuggcuaggcuggucuugaacuccugaccucaggugauccgcccgccucggccucccagagugcuaguauuagaggcgugaaccacugugcccagccuggguagugacuucuaagugcauagaucuuccuagugucauugacaaaggugacauuugcaaggcuuuuucuucaucagaugcagggaucuggacuucauguguauccuuuuauccacuccucucacugcuacugugaagcagaugccauaauucugauuuuucagaagggaaagccgaggcacagaggguugaagauacuugcucuaagucacacaguuugucagccaccaggcugggaccugcaucccagagcguuaguuucguagucugugcaccuguuugcugagggcuggcgggcuccgcagugguggggugggggggagcugcguggcgugugcccuggagucccaccuguguccuggcugauggggcuguucucucuccauuagcauggccacgaggaaggcucuucugugugguggaagcuggaccagaggccgggaggcgaggaaaccgugguaaggagaguacgucuucuuauaguuugcaauccugucccagcacagacccacucacauuugcuugcuuuccugucagcauuuugcuagugcaauuauugucccuuucagacagcagaacaugagcaugaagggacagaugagauuuucauaugaaauucauacuugcccuuguuugaaguccucggucauguugaaagcugucuggguugugggggucaaggaauguaacuggguugugugcacaccgucagguacuugagccucuuucuuccuggaagaggagaggauuuugcaaagaaauuggagggaagagguuuagggugaaugaacagacagccuucccauuguugcucuguguguaaguugaagaaagugaggagauuugaagacaccuaauagagaaaucacaaaagacacgauccaggccaugguugcugagaauuacacaaaguuauaaauaauuuucagaauauauaugcaaaacuggauagaucaaggaaaugcagguauccucauauaagggaagaauugcggacggggccucugaaggacguagcgcggagcuugaugcagagcacggccucgugugagggaagaauugcggacggggccucugaaggaccuggagcggagcuugauggagagcacuuggggcucuccucggggcaggugaacuccuggugauggggguuucuuguuccuucucaggggugcgugccccagugugguucuagcucugcacagaagugacggugucugcugcguacuccacugucuccucaccuggcugagugccuggcccacacuagguguguuugcagaguaaaugaacuguaguuucaaaauccuggccagacauaggacuugacuaaaagccacugggucugcugaguuguacgagaauaagaaaugugaugguguuaguuuucguugaaaauuccuguuuucuucuugucagucagcaggcguuguauuuacugauacaauaaauguaguauauguuauuuaauauaauguaccaugacuuuauaugauaaugugcaaugacuuuauaugauaaugugccaagaggaccuuauuuauuuuuauaagacuuuauuauuuuuuauuuuauauuuauuuugagucaggggcucgcucuguugcccaggcuggagugcaguggcacgaucauagcucagagcagccuuagacucuugggaucaagcgauucuccugccucagccuuuugaguaguugggaucauaggcaugagacacuacuccuggcuaagacuuuauuuuuuuuuuagagcaguuuuaaguuuccaucaaaauugagaggaaggggccaggugugauggcucaccccuguaaucccagcaccuugggaggccgagguggguggaucaccccaggaguucgagaccagccuggccaacauggugaaaccccaucgcuacuaaaaauacaaaaauuagcugggugugguggcgcgugccuguaaucccagcugcucaggaggcugaggcagaauugcuugaacccaggaggcggagguugcagugagcugagauugagccauuguacucuggccugggcaacaagagcaaaacuccaucucaaaaaaaaaaaaaaaaaauugagaggaagauacaaagauuucccauauacccccucgcccccacacaugaauagccuccccuauuaucaauguacccuaccagaguggugcauuuguuacaguugaugagccuacguugaugugucauuaucauccgaaguccaagauuuauguuaggguucacucuuggucuuaaacauucuguggguuuggacaaaugggucaugacguggauccaccacagggcaucaugcagagugguuucacugcccuaaaaccccugugcuccggcuguucaucccucccuucccccuuauucaugguaaucacugaucuugucugugucuguauagcuuugcccuuuccagagugucuuauacagcugcuccucaacuugugacaggguuacaucccaguaaacccauagugaguugaaaguaucgugauuugaaaaugcguuuaauaugccuaacuacugaagcuuagcccagccuaccuuaaaugugcuccaaacaguuacguuauccuacaguuggcaaaaucauuugacacaaaaccuauuuuguaauaagguguuuaauaucucauauaauuuauugacugcagcacacuguagaguauugguuguucagccucuuggucacguggcugccugggagguguggcugcugcuguugccagcaucauaacaguauuguaccacauaucguacugcaugucacaccgcauaucauaccauauaucauagugcauauccuacugcauaucguaccacauaucguacugcaugucacaccgcauaucauaccauauaucauagugcauauccuacugcauaucguaccacauauuguaaugcaugucacaccgcauaucauaccguauaucauaccguaugucauagugcauauccuaccacauauuguaccacauaucauaucguaacacaugucacacuacauaucauaccgcauauuauaccaucuaucauagugcuuauucuacugcacaucuuacugcauaucauacugcauauuguaaugcaugucacaccacauaucauaccguauaucauagugcauauccuaccacauaucauaccacauauuguaacacaugucacaccacauaucauaccacauauuauaccguauagcaaagugcauauccuacugcauauccuaccgcauaucauaccgcauauccuaccacauaucguacaucauaaugcaugucacacuacguaucauacuacauaucauaccguauaucauagugcauauccuaccacauaucguacugcaugucacaccauauaucauggcgcauauccuaccacauguccuacugcauaucauacugcaugucacuaguccaggaaaaaaacaaaauccaaaguaguuuccacucagugcguuuugcuuucucagcauuguaaaguaaaaaaaaauaauaauacauugaaucauuguaaguugcagauugucuguaguuagaaucauacuguuuguagccuuuuccagauuggcuucuuucauuuagugauaugcauuuuaaggucccccugugucucuucaaggcuuuuaauaacucauuucuucuagugcugaauaauauccauuguagggauguacuguagucuauccacucacuaacugaaggacaucuugguugcuuccaaguuuuggcaaguaugaauaaaugugcuauaaacaucugugugcagguuuuugugugaacaaguuuccagcucuacuggguaacuaccaaggagugugauugcuggaucauaugaugagaguauguuuaguuuuguugauaaauugcgaagccaucuuccacaguggccauaggguuuugccuuccccagcaaugaaugugaguuccugugccuccacauccucaccugcauucgguguuguugguguucuggauauaaaaggaucaccguccuuuuaauuugcauuuuccuggugacaugugauguggagcaucuuuuuguauguuuguuugccaucuguauaucuuguuuaguggaguggggugucuguuaagaucuuuggcccauuuuuuuauuguugaguuuuaagaguucucuguguguuuuggauaacacugcuuugucaguugucuuuugcaaauauuuucucucagucugugacuugucuuccuguugacauugucucuuacagaacagaaguuuuuaauuuuuaugaaguccagcuuaucaauuuuuucuuucauggauuaugcuuuugguguuguaucuaaaaagucaucuccauaccuaaagucaucuagauuuguccugugcuauuuccuaagaguuuaugguuucgcauuuuacacuuaggucugugaucuguuucgaguguguuuucuugagggguguaaggucugucuagaucauagugugaauguuuauuuguuccagcaccauuuuuuguggagacuaucauucauucauuguaccguauugccauugcucccuuuucaaagaucaguugauguauuuaugugggucuauuucugggcucuuuguucuguugcauucaucuauuuguccacucuuuucgccaguacacacugucuugauugcuauagcuuuguagugggucuugacaucaggucaugucaguucuccaacuuuguucuccuucaauguuguguugacuauucuggaucuucugccucuacaucugacuuuagagucgguuugccaauauucauacaauucugaaauuucuauugcgauugcauggaaucuauaggucaaguugggaaaaacugacaucuugacagauuugagucucauuugugaacauggaauaucuguccauuuauuuaguucuuuguuuuugcuuagcagagcuuuauaauuuuucucauagagaucuuguacauauuuuguuagauuaauaccuguuugauuuuugagggugcuaauauaaguaauaaucuguuuuuaauuucagauuauacucguuccuugcugguauauaggaaagcgacugacuuuuguauacucacucuguguucugugaccuugcuguaauugcuuauuauuuccagucagguuuuuuuuguucaauucuuucauauuuucugcgaagaaaguuuaauuucuuccuucccaaucaguauacuuuuuauuuccuuuucuuauuucauuaguuagaacuuccagcaugaugcugacacggaguggugagaugauauagucuuuguuuucaaucuuagugggaaaacugaguuucucacuuagguaugauauuagcuguauguuuuuuuguagauguucuuuaucaaguggaggaaauuucucucuauuccuaguuuacuaagaguuuuaucauuaaugguuguuggauuuugucaaauguuuuuucuccauuuacugauaugaucuuaugauuuuucucuuuuagccuguugauuugauggauuacauuaauugauccuucaauguugaaccaggcuugcauaccugggauaaaugccaguugguugugguguaugauucuuuuuauuuuuuaucuuuuguuuuuuugaggcaggguguuaacucugucgcucagacuugagugcaguggggugaucauggcucauuguagccucaaccugucaugcucaagcaaucuuaaccaccuuagccuccugaguagcugggacuacaggcaugugccaccaugcccagcuaguuuuuaaauuuuuuguagagacagggucuuaagaucucaccuaggcuggucuugaacuccugggcucaagugaucuuacugccuuggccucccagagugcugggauuacaggugugagccacugugccuggcccuaugugauucuuuguauacauuguuggcuuugauuugguacaauuguguugcagauuuuugcaucuguauucgugaaugauauuggucuguaguuuuuuuuuuuuuucuuguaauaucuuugucuggaucaugcuggccucauagaaugauuuaggaaguauucuuucugccucugugcccuggaagagaguguaaagaauuguauaauuucuuuuuuuuuuuuuuuugagacagagucucucucugucucccaggcuaaagugcaguggcacggucucagaucgcugcagccuccaccuccuggguucaagcaguucuccugccucagccucccgaguagcugggauuacaggugccugccgccaugcccagcuaauuuuuguauuuuuaguagagguggaguuucagcauguuggccaggcuagucucaaacucuugaccucagguaauucacccaucucagaucuuacugccuuggccucccaaagugcugguauuacaggugugagcuaccgugcccagguaagaauuauauaauuucuuuauuaaauguuugguagaauucaccaguauuagugcuuucuagcacuagcugggccuuguguuuucuuuuuuagaagguuauuaauuauugacuugaugucuuaauagguauaggccuauucaaauugucuguuucuucuagugugaguuuuagcaacugugucuuugaugaaauuggcccauuuuacuaaguuaucaaauuuaugggcauagagcuguucaugguauuacuugauuauccuuuuaaugucaugggaucugcagugauguccucuuuuaccuuucugacgcuaguaauuuggauccacuuucuuuuuuuuccuuaguuagcuuggccuagaaguguacugauuuauugguauuuucaaaaaagacagcuuuugauuucauugauuuuucucuguugauuuccuauuuuuaauuuugauuucugcucuaauuauuauuauuucuuuuuucugcuuacuucagauuuaauuugcucuuauuuuucuaguuaauccaagcuagaaacuuagaugauugauuuuagaucuuucuucuuuucuaauauaugcauucaacauuguaaauugcccucuaagcacugcuuuuguuugcauuccacaaauucugauaaguuuucauuucuauuuaguucaaaaugcuuuuacauuucucuugagauuuguuuuuuagccucuguguuauuuagaaauauguuguuuaaucuucauauauugugggauuuuccaguuauuuuucuguuacugauuucuagugugauuccauugugaccugagagcagauguauaauuuccauucuuuaauauuuguuaagguauguuuuauggcccagaauaugggcuaucauggugaauuauaugccagcuugauaagaauguguauucugcuguuguugggugaagcagucuaacgcugcccauuauacccgguucacugauggugccguggaguucagcuauauccuuacucauguucugccuguuggauuuguccauuucugauagagggauguugaagucuccagcuguaauaguggauucaucuauuucuucuugcacuucuauuaguuuuugacuuaaauaauuugacccucacacauauuaaggauuguuaugucuuucauuaaagacauaaaauuggcaucuuuaucauuguguaaugcccuucuuuauucauguugacucucuuuacuuugaagugugcugcgucagaaauuaauauaaugacuuuugcuuucuuuugauuagugugagcaugguauauuuuucuucauuuggguuuccugaagacaauaaguagauggaucuuguuuuuugauccucucugacaaucucugucuugugauugguacauuuagaucauugauguucaaaguaauuauugauauauuggauuaguaucugccauauuuguuacuauuuuuuauuuguugcccuuguuauuuguuccuguuuuugucuuucauucuuuuuuugccuucugugguuuuaauagaacaucuuaugauucuauuuucucuccuuucuuagcauaucaguuaaagguuguuuuuuuuuuuuaacuuuuuaaagugguuuaaauacauuuacaaccaauacaaguccacuuuugaauaagacuguaucacucccauuccuuguauccuugcugucauucauuuuacuuguguauaagcagacauaagcauguuaucccuugguauuggaacaggauugguuccuggacccccuguggauacuaaaaucugcaaacgcucaaguuccuuaaguaaaauggcauaggauuugcauauaaccuaugcauguucucccauguauuuuaagucaucucuagauugcuuauaaaaccuaauacaauguaaaugcuauguaaauaguuguuauacuguauuuuaaaauuuguauuauuuuuuauuuuuauuuuuccaaauauuuuuggucugugguugguugaauccauggauguggaacccacagauaaggagggcuaacuaugcauauguguacacaaacacacauacacacacacggauaaauaccuaagcauacguaauugaauacauuuuugcuacuauuauucugaacaaacuguuaucuguuagaucaauuaaggaaaagaaaaggaagaguuauuucccuuuacuuauuucuucuuccaucuuuucuuuuuuuuauauagacccaaguuucugaccuauauuauuuuccuucugauaacgguuuggcuguguccccacccaaaucucaacuugaguuuaucucccagaauucccacauguugugggagggacccagggggagguaauugaaucauggggccuggucuuucccaugcuauucucgugauagugaauacaucucaugagaucugauggguuuaucagggguuucugcuuuugccucuuccucauuuucucuuccugccaccacguucaagaagugccuuuugccuccugccaugauucugaggccuccccagccauguggaacuguaaguccaaugaaaccucuuuuucuucccagucucgguuaugucuuuaucagcagugugaaaacggacuaauacaccuucuuucugaagaacuucuuuuuauguugcuugcaagacaggucuacuggcaacaaauucccucaauuuuguuugaaagucuuuauuucuccuucacuuuggaagcauaauuuuauagaguauauguguaauuuugggcugcugaauauuuuucucucaguacuuuaaacauuucucuaugcugucuucuugcuugcaugguaucugagaaacugaauguaauucuuuuuuuuuuuuuuuucuuuuugagacagaguuuugcugucauugcccaggcuggagugcaauggugcgaucucagcucgcugcaaccucugccucccagguucaagugauucuccugcuucagccucccaaguagcugggguuacaggcaagugccaccacgcccagcuaauuuuuauguuuuuaguagagaugggguuucaccauguuagucaggcuggucuugaacuccugaccucagaugauccaccugccucggccucccaaagugcugggauuauaggugugagccaccgcgcccagccuguaauucuuaucuauguuccucaguagauaaaguguuuuuuccccaucuggcuucuuucaggauuuuguccuuaucugugauuuuucuguaguuugaauauaagaugccuagguguagauguuuugauauugaucuugguguucuaugagcuuccuggaugcgugguuuggugucugacaucaguuuggagaaauucucagucauuauuguaucaaguauucuguuccuuucucucuucuucugccauccccauuauacaugugaauaccuuuugcaguugucccacaguucuuggauauuuuguucuguuuuuuuuuuuuuuuuuuccuucccgcuuuuuguucucuuugcuuuucaguuuuggggguuucuauugagguaucaucaagcacagagacuuuucuucagcucuguccaguuuacuaaugagcccaucaaaguuguucuucacuucuguuucuguuguuuuguuguuuuugaccucgaacuuuccuuucugguucuuucuuagacuuuccaucucucugcuugccugcuaucaacuuugucuauuagagcucuuaggauguccucauaguuguuuuaaguuccuguucugauaauuccaacaucccugccaugucuggaacuggugcuugcucugucucuucaaacuguauuuucugcuuucuaguaugcuuuguaauaucuucuugauugugcaguggcgcgaucuuggcucacugcaacgucugccucccaggcucaagcaguccucucaccucagccucuggaguagcugggaacacaggugcacaccaccaugcccagcuaauuuuuuguauuuuugguagagaugcgguuucgccauguugcccacgcuggucuucagcuccugaguucaaguaaucugccugccuugaccucccaaagugcugggauuaaaggugugagccacagugcucacuacagcuacacugucuuuaaugguguagauaagcugagcaccauucagcggggaauauauucauggauaagaaauggauugcugcacauuugaaguuuauuuguaaaacacuuaaaaaauuuuuagccaccagaauuauagagguuucccaaaaaggauguuuacuguuuucucuuuuugguccuaccuguaaguuagcaaggguauuucuuaaaggaauuuaacauuauauuaguuuuacaaauaccuagaguuuaaaauuagcaacaucaaaggaaugucagaaaacauauauguuuucccaaucuauuugcaauauucaauuuuaugauugaauuuuuugguuuuguguuugauuuuuaccucuaggaaauugaaaaggaagaaacugauuuagaaaaugcuagagcugaugcauauacagccaguugugaagaugauuuugaaguauguauaaaaguuaaaacuuuccuuagcuuaaaaaucauuuauucuuaaaaaucagcuuauauauaguaauuugauguccuuuuuauucuuuuuauuaauccuaauacucaauaucuggcuagguugauuuaggucaagcuguuaccuguaaaaugcuugcuauacuucuacuaauacuuaccaauaugauguaauuaaaugauuuuauaauuuaacucauauuuaagugcagugcauaaaaagauguauacauagguaucuauaaaaauacauacacuuucacauucucagcacaaauguuugcacgugaugauaguugauaggucuucuguauaugguucuguauugugugauuuauuuuuagagaaauaaagguagcaguuuauauaaauuuaccuucaaaaacauuaaaaucagggaacuauaaauaucuuucuuagcuguaauaaggacauugucuguuuuaaguuauaaagugucauguuuuguucaguaugagggauaauugaaagucaguuugucuuaaaggguuccaaaagauuauuauuguuugcaggacuaugaagaugacuuugagguuugugauggugaugaugaugaaagcaguaaugaaccugagucaagagaaaaacuggaagaacuuccucuagcucaaaaaaaggaaauacaagaaauucaaagagcuauuaaugcagaaaaugaaaggauuggcgaguuaucuuugaaacuguuucagaagcgagguagaacagaauuugaaaaggagcccaggacagguaaacaaaucaaugcuacuaaugguguccgugcucuuagggcucuguguacugagcccucacagaugcugucacacacaggccuacucuaauaagguggguggagcaguaacaucuuccacaugcugguggugccaugcccuugcagcuaccacauaggaggccccugaagacuugagcacgagcccauccagaauucucuuacacagagaaguugcacgucacuuucugcucagcacccaggccuuagguuagcugagggugccguggccccacucagugagcacugaugcuccuguucuccagagggagcugaggaugcuguggcccuccucagugggagcugaggaugcuguggcccuccucagugggaagccugacucauguuuucuuugcaaccagcguuuuauccgucugugagcacaugcucuuauuuuuccugaugaugugcuccuugaguuuccacagaggaaucaucaugguuuucccuggaggcguggcaguguccacugaugagugccuucaugaggcacguggggacugagggguugaggugccugucaagucuugggacacagcuggacugagccugacacgaagcaugcucuugauccauucuuuuuuuccuacaaggaccuuuuuaaauuaaauuuagaaauguauuuuuucuccaaauucuuggcaucaggauauaauguuacuugugagaguaggaauuaauguuucaaauugcuuuaaaggaaaacugacauucugauaaaacaugggcacugaggauaaaauaggauaauauuaaaauacuauuugaugacguacuacuuuaaauuaucuaguaaaauauucaguaauugaugcaguuaauuauaguuaguaauuaauaugaugcacuaauacaaaugaagguuuugcagaaugauucuuugucucacauuuugugccugcuacagagguggcagaacucagcugggcagugcugauagagcguucuuuaaacuuauagcuaaagggcaccuguccugguagagguaaggaucugccccuucuucagcccuaucgccuggcugaggcucagggacuguuucccucaguuccccgugggguagcgcugcacacagggagggucuuugugccaccagcacacaggauuuccugacagcauuaaagcuugucugcucuggaguugcugagacgcgagcaggauuuuauucuuaacguuacugguuuucuuagcagaucuuugaauaaccuuuuuuuguuacucauuuucaacauuuaugcuuaguguuauaucuuuauuagccugauuuacaagauuagaauuuacaacucucaauaugagauuauuuuuggcauauuucuuauuugaaggaguuauucacugucauacacauugcuccagguaaagcuggagcugcuuucuuggcccuguuuaauguugagcuggcacagguggacggucguaaagacuagcacaguguugacaucacagucugugcugaagcaggaaucacggagccaugcugacuccgggguuucagauaacugacuagcugugugaucuugggcaguuacuuaaccugucugugccucauuuuccuuaacugugaaaugagugucagacuuucuuuaggguuguugugaagauuaauuaagcaagcuaaacauggaaggugcuuaaaggagugccaggcacguucugagugcuaagcaccgguuuguuuucuguguccuccuuggcuguacucugccacacccuguggugcuuggacuacuugguuauaaacugcacgccuuauccuuuuuuagggcaguaagaaaccguuugguaaauaacuuuuucccgugcacuaaaguuacaccauggcguuugaaagccuuuguacacuuccaaaagguaaaugguccacuuggucagugaaggagucuuugcugagcgccaaugacuugcacagaggugugcgcucugcuccagggaugucuuuauucaagucuuaauucuguaacuuuaaacguuuucucauuuuuaaaaacagucacaucuuauaaugucuguguggugcuuucuaauugcucauaaauguggccuccuguggucugguccuuaucacaguccuguacggcagauguccagcaauaagggaacugagaugcagagaugagguaaccucccauggucaugaagcaaguagcggacagugcugggacuugagcucaggccccugacccagacaggcauccuccagagccacacccucugcauugcuggccguaaagcuuuguugugaagaucagaugagauaaugugugggaaagggcucugaguuucauaaaaccguaagacgggagggcaagugcaaaccaauauccaaaaggaaugaaaagacgauaagaugcaguagaaauaaauauacaaacaaauaaauacacagguaaguauguacaagaagccaccgaaauccuuagggggaagagguggauugaggaaugacuuguguccauuacaaaggauuggggauggaguuguuuguucuugucuuucuuuuucuuuuuuuuuuuuuuuuuugagacagagucucacuaugucucccgugcuggaguacaguggcaugaucucggcucacugcaaccuucauuuccuggauucaagcgauucuucugcuucagccucccgaguagcugggacuacaggugcucgucaccaugccugucuaauuuuuguauuuuuaguagagacgggguuuugccauguuggcccggcuggucuggagcuccagcccucaagugauccgccugccucggccucccagagggcugggauuacaggcaugagccaucguaucuggccaaguuguucauucuuauauaauaugaaccuuuuccaucagccugacaauucaauaaucuaaucacaucuucagaaauuuuagagcuucugaggaagcucaugccuucauucucuuuuguuucgugcccuuugacauauuaaguaauugauucaauauuaauuugcacuuguuucuguuuuuuagcaauuuuguauguccuuguuccacuucccuuacuaaaagauaaucuuuguuuuuuuugcagaaugggcgggaugggggcuuagaacugcaucuuuugugcauucuuaaguauuucuaaaacucuuuaauagugugaguggcacauacaauagaugaucaguaaauuuugcuuuguugccugaaaguuuuagaugaaauaaucaagagaggucucucaaaugcuuaugaaagauguuugucauuaguugaaggguuuauugacuauaauuguuauauaugccuauaauuguuuuacuccagauauuuuuuugcuuggaagacauauuuccguguuggaaaaauaguguuuuucucccucacacagauacaaacaguuccccuuccagagccucuguuuguggaauuuuuguggauuuugccucagcuucacaccgucaaaagagucggacucaggcccuuaagcaaaaguagguguauugggaaagcagccaaagguguucaggguuuuagcuuaacuuuucuuucacauacuuuuaaaaaaucgaguuuuaaaaugcauuuuuacuacuguuuuuugggguguaugacuuaauuuguacuacacuuuuguguugagaucuuauguuaguagagcaggugugugagccgcuacguaccaugugcugauguuggauguuuguucuuagauuuguggcggacaguuggagcuacccugggaguaaaucgagaaauuuguaaaauuuagaaaucuauaaaagauauauuuuaaagucaagggucuauuauacuaagcccaaauaugacugaggaguaaaugaaaaaaauaaauauuuuuauuuauuuauuuuuuugagacagaguuucacucuuguugcccaggcuggagugcaauggcacgaucuuggcucacugcaaccucugccucccggguucaagugauucuucugucucagucucuugaguagcugggauuacagguggccgccaccacgccuggcuaauuuuguauuuuuaguagagacaggguuucuccauguuagucaggcuggucucgaacucccgaccucaggugauccaccugccuuggccucccaaagugcugggauuacaggcaugagccagcaugccuggccaaaaaauaaagauuuuuaaaaguggauuuaaaaucucuuaucaccuagcucaguauauggccuuccuuagucaguacucaauaaauauuuacuaaaugaaaaaaucaaucauuaauaauaaaagugguugggcauggugguauaugccuauaaucccagcacuuugagcacaggaguucaagagccugagcaaggaggaguucaagggccugagcagcauagcgagacgcaccuguggucccagcuccuggggagugcuuaggugggagauggcuugagccugagaggucgaggccgcacugagccgugacugcaccauugcacuccagccuugaggcugcacugagcuguggcugcaccacugcacuccagccuggguggcagagcgagacccugucucaaaaaagaaaaaaaaaaaaacuaauaaaggugacaguuuucacagcaguuuugcugccuuuauauuuugguucuccuguggagguagcaaaacugguuucuggccccauggccuucuuuuuuuuuuuuuuuuuuuuuuuuuaaaccugauucaaguucucagaaaacuacauaugguuuaaugcaauuuuuauaaacucagaaauaaagcuacacaguauguuguuuagacucauauaaauaugagauaaaauuauauuuugaaaaacaagaaacugauaaccacaaaauucagucuagugauuguugugggcagugggggaucuuggaaugugucagggaggagccacuaaguagaugggggucauugguugccuucccucccuuuccauuucccuuucccuuuuccuuucccuuucccuuuccguucccuuuccuuucccuuuucuuucuuuuacgucuucugcuuuugagacagggucucacucuggcacccaggcuggaaugcaguggcaugaucuugguuugcugcagcccuaaccuucugggcucaggugacccuccaccucagccuccugaguagcugggauuacaggugugcaccaccacacccagcuaauuuuuauuuuuuuuuuauguagaggcagugucuugccauguugcccaggcuggucuugaacuucugggcucaagcaauccacccaccucagccucccaaaguauugggauuacaggugugagcugcugugcccggcugguaaucuaguaauugguaguuuucuaguuagguccuaggauguuaacuagauugauauauaauguacaaguagauuauauggauuauuuuggaucaaaaauuuuauuaaauauuuuaaaagaaaaauuuaagaaaugaaaggccgaaacauaaagggauugaugauaaauaaaaaaguuuuugagaaaaauguaggaguccacacuuuauacgcguguggggugaguucuggcauuuguguguuguaaggaaauaguauagaggcacuuuuacuacuagauauacauuuaguaaaucaacuugaaauuugagggaaaauagauaccugcuucauaguauacccaagauaaauuccaaauggauuuaaaaaaaaaaugaaaaagagagcauagcuaguguaaaugguuauuucagugauaagaaaggacuuucuaagaauaaaaagaauaaaaauuaaaaauuacuggaauguaccucaaaaauugaauuucugcaagguacaauugucuguaaaucugacaaaauuuaaagguaauugaccaauugggaaaauauauuuguaaaauauaugauagagacuuauuaucccuaaugcauaaaauguuuuuauaauuuaauaagcaaaguuaaauaacccuaguuaaaaaugggcacagaucauacaagacuugagauccagucaggaaaacaaaaacuaauuuggguauuaaacagaaggaugugacacagggagugaauuccuuagguguuggaagagcugagcuucagcagggcccaggagcagcucagagauuugccgcagcaggagccaccccuuccccugagccggagaggcugggcggucgggagcuggagccauggccggccugcuggggccacaggaaauaccugucgguggcucaagguagagagguagaaaaguaauguguuugcuuguuuucucuuacauuauuccccagucucucaccagauggccccagggugguaaaggacacagagagaauucacaacagaaaaaaauuaggcugucaguaaauguaugaaaauauguccugucagagaaauguauauugaaacaaugggaugaauuuuucuuuuauggaauaggcaagguauuaaaaaaugauaauacuuaggccaggcauaguggcucaugccuguaaucccagcacuuuggaagacugaggcgggcggaucaccugaggucaggaguucgagaccagccuggccaacauggugaaaccccgugccuaccaaaaauacagaaauuagccaggcaugguggcacaugccuguaaucccagccacucgggaggcugaggcaggagaauugcuugaaccugggagguggagguugcagcgagcugagaucgcaccacugcacuacagccugggcgacagagcaagacucugucucaaaaaaaaaaaaaaaaaaaaaaaaagauaauacuucaguacugaugagaauguagagaaaaagcuugcuugaaacaaauugguacaaugucugcauaggcagcauucuaucagguaugaaauauagguaucaaaacgauggauacucugaggauauaaugucaugaaaaacgcuccagugauacgagaaaagcaucuuacaaaagaauauguacagaguccuacuuucuugauggaauggcuuguaucagagaaauccuccagcuaaaacaaggguaaaaguuggauuuaaaacaacaaaaacacuccagcugauugaauauaccggagcaaccaaggccgcugggcccugaagagccgagguccuggaaagaagggaaacauggaggcgaucccuguuuccauucagguuugcaucuugauuucucaagacaguagagugaaacagaaagaucugauggccuagggcauuugacguucgcacagggucgaggggaugaaaauggaaguugagagccuuccggugggagaauuucugauaaaacauccuagguuuuggucgagccuccugcaggccugugcucuaggaagcagggcagaccuggaggagugugaggugaaggaucgggggaggaggaggagcagagagcagacccgguggccgaggcaccuggauguugggcgggucguucacucggucauucacugugcauucauugagcaccggcuguguggcgauaacaguaaagaaacaaaaaucucugcccuugcgaguuuauaucccagugaggaguaacaaacaaauaucuuaaggauuugaccccgggcacacuaauguuagggugaaacuuaggaaaggaaaacccagcacaggcgauggaaaaggaacuguuugugaagcaagaggaagccacgugggugcggcguuucggggccugugggcagagggccaucggccgugucaggccugugggugcagggccauuggcugugucaggucuguggguggagcaugaugggcugugucaggccugugggcugagggcgauuggagggcgaucagcugugucagaccugugggagcgcgauuggcugugucaggccugugggccgagggcaauuggcuaugucaggccugugggccgagugcgauuggcugugucaggccuguggguggagggccauuggcugugucaggcuugugggcggagcacgauuggcugugucaggccugugggcugagggugauuggagggccaucagcugugucaggccugugggccgagggcacuuggcugugucaggccugugggccgagggcaauuggagggcaauuggcugugucaggcucgugggccgaucacuauuugcugugucagaccugugggcggaggacgauuagagggcaguuggcugugucagaccuguggguggagggccauuggcugugucaggccugugugcgcagggcgauuggcugugucagccugugggccaagggugauuggcugugucaggccugugggcggagggcgauuggcugugucaggccugugagcgaggagcguuggcugugucaggccugugggaggagugcgauuggcugugucaggcuugugggccaagggcgauuggcuguuucaggccugugggaggagcgcgaauggcuguuucaggcccgugggccgagggcgauuggcugugucaggccugugggcggagggcgauuggagcgugaaaggcaggucaaguccugggggaagcacagagguuggcuguggccuggaaaagagcguggcccaaaacacuuacuggcugcgugguccgaccauggugcaggugauugcauagucaguaugucagcuccugaagucaaaugaauuaguccuuaggaacaucccaggcauauauguugugugacuugauuuuguguuagcucaggcauacgcauuagaacggucacacaugagguucgugacacacacacgaggcagucggggagcagaaucaccaaaugccaaggucacacaccagguucccacgacugucuacuacucaguuauuuuuaacagcuguuaaauaucucagacucaccccagccugaagcuagguuucugacaauaacaugcauuuaacucuaaguuuacuucuguucucccuacacuuccccacguauauuauucgaguuaauuuuugucuuguuuccaauuuauuucaaaggaugcgaaguacaaaacugcuucggcucauugacuuagauuuuucauuuacuuucucucucuuggaucuaccaccaguaaaugaauaugacauguauaucagaaacuuugggaaaaaaaauaccaagcagguaaguaugagauguguuaacuaagugauaaaaugcaaguaaagucuaguaggauaacuuugugucuuccugaauaauguucugcaauauuagaacuuggggauggucugugaaggauacaagcuuagggaaaauggggacccaucuucacauggggcccauucacccgagaggccgggcacaggcaaagccggaggcacuccagagccuucaggagcucuggugggugaucugcucggaauggggacagaauggcugcuguccugaccuuggagugaagcuuuaugcugugcaaauguuuuauuuauuuauuuagagacagucucacucugucgcccaggccagagugcaguggagugaucuuggcucacugcaaacuccaccuccuggguucaagugauucucgugccucagccugccuuaccugccugucuguuccucaguguccaaggccuguuuucugggugaacccuuccuagugacuuacaaugaauucuuucuccuauuccagaguuccuacaauuuacuauuucaugcaauuuuguacuucccuguaguauuuccaaucauuaauucauuaugugauggucucacuucacaacaagguucuaaagauuuugaagucagacgucuuaucuaacauuuuucuuacauuccuguuacugguaccaccaaucuuaacauugucuaguugguacacucaauaaaauccuuuuaaaaggaggaaggucacgggaugaagcugaagaagcugauggcuuuuacaauuuuuaaauuuuuaaauuuuuuuuaagagacagggucuugcucugccacccaggcuggauggagugcaguagcaagaucauaucucacuguagccuugaacuccucggacacugacaauauuaauccugguuuugcagcugauucacucugaccuuaaguagauuauuuaucuuuggugguuuuccucaucauaaagcuguuaguaacaaaacugauuucacugaagcauguaccuuuugaaauauauauguaguuuugcaaaaccagcauguccuaagaaaauagggugugggcaggugagguggcaguauuuucagacuaaagggaaaucguuuggugagacuuuuugaacacacuuuugaaaauuagaccuguauauaucuauaucgaacguuuaagcacagguugucuuugcaugauuguucuuuaugcuuugauacuuacuuuugacacagugacucucauuauuauuucaguaaugacagauugcuccgaaauugaaaccaauguuaauuuuggcauauuuuuguuuuuaaggcauauguucaguguaacgaagauaauguugaaagagacauucaaacggaggaaauagagaccagggaaguguggacccagcacccgggagaaaguacuguuguaucuggagguaacaucuugcucuugaguguugaccauugacucucuuuacauucuuuuuuguuuuauuuuuacuuauucccuuucugguucacuuucauuuugucuuucucuucuguaugguuguuagcaugugacaauagcaguacccaauuuucuuuuaaagaaacgcuaaccagcagccacagagcugcugaacuacaagugggaggaaaccugcucucgaggcccagucugugccauugccaggauuuaugacagauuuuauuccuguguagagggagagauuccacauuccaaacaaccacugugucgcuggaccuuugaagcacacuguguuuuuaacuuaggggaagccuauucucaugaauauagaauuuuuauguuucaagugcaguuugcaaaaauguuccaucaauuuauaucgaaggucccuagaauauaugguuucugcuaaguacucuggagcgauuuacauguugaauacuuuacugguuuuucucaaggaauugccucuguauggcagggauguauauuacucccuuuucucagguaagccucaccuuaagaaaguaauauaccuaaacuuaagacuuacaugauaauuaaauugaugccuuugaaaaaaaauuuuuuuuuugagauggagccuugcucugucacccaggcuggagugcaguggcaugaucucagcucacuguaaccuccgccucuuggguucaagugauucuccugccucagccucccgaguagcugggacuacaagcgccugcuaucaugccuggcuaauuuuuguauuuuuuaguagagaugggguuucgccauguuggccaggcuggucuugaacuccugaccucagaugauccaccugccucggccacccaaagugcugggauuacaggcgugagccaccaugccuggccugaauguuuuucuaaaugcauuuacagacuucuauaaaacaauaugcaguuguuuuggggaguuaacaguaguaaaucuagagaguauagcuugaaguuuucugucuuuuccuucugggacucuuaauguugauuuguuaggccuguuugaacucuuaagauguguaaugcaugauuauuuuagagucgacuucguugauuuuauauaaacuguuuuuuuuaggcagugaacaaagagauaccucugaugcuguaguuaugccaaagauugauacuccaagguuauguagcuuucugcgggcugcuugucagguauacucaaccuauauauguuguguucucuguguaagugcuuaaaguuucauucuacauagaaacauaggagcuuuuaagaucuuaaagucuuuguagcuuggauaaaucagaaucaguuauucauuuucaaguauuauuuucuuacaaauuaucagugguacauucauuaagcccuugugggcagaaugacccuggguaaauguauaucacugaaguacuauguguguauuuggauugugaauuuuauuauuaauuucuuacauuuuaaaacaacuauagacuagcagacacgaaguuggcaaggcaagcauaaaucuaggguauuugaaaauauuaaacuucugauuuuacaagcugauuuauaaacugaaaaauuuuaaaaauccauacaaagagacauggaacaguccugugaagcuacagguacuuuagugguuaucaccucauggcugugggucucgucugaccccccugcccacuccaccacccaccccaucaguuauuuugaaacaaaucccaaucaucuaacuuugccuccaaauacaguucaguaugaaucucaaaaagcagagaaugucuaaaagaguaauuaguaauaacuuauaaugcagucagauaugaaguuggcauucacauuucgccagcugucucaucacuuucuuguauguaagcucagcacuugagucuacugcagcacugaagaguggaacguugugaaaccucaacacgcuaguugagauuaaggaugauugugaaaccucgacaugcugguugacauuaaggaugauuguaaaaccuugacacgcugguugagauuaaggaugauugugaaaugucaacacgcugguugacaggaugauugugaaaccucgacacgcugguugacauuaaggaugacugugaaacaucgacaugcugguugacauuaagaaugauugugaaaccucgacacggugguugagauuaaggaugauugugaaaccuggacacgcugguugacauuaaggaugauugugaaacgucgacacgcugguugacauuaaggaugauugugaaacgucgacaugcugguugacauuaaggaugauugugaaacgucgacacgcugguugagauuaaggaugauugugaaacgucgacacgcugguugacauuaaggaugauugugaaaccucgacacggugguugagauaaaggaugauggugaaaccucgacacggugguugagauuaaggaugauugugaaaccucgacacgcugguugagauuaaggaugauugugaaacaucgacacgcugguugacaggaugauugugaaaccucgacacggugguugacauuaaggaugauugugaaacgucgacacgcugguugacauuaaggaugauugugaaacgucgacacgcugguugacauuaaggaugauugugaaacgucuacacgcugguugagauuaaggaugauugugaaacgucgacacgcugguugacauuaaggaugauugugaaacgucaacacgcugguugacauuaaggaugauugugaaacgucgacacgcugguugagauuaaggaugauugugaaacgucgacacgcugguugacauuaaggaugauugugaaacguugacacagugguugacauuaaggaugauugugaaacgucgacacgcugguugacauuaaggaugauugugaaacgucuacacgcugguugagauuaaggaugauugugaaacguugacacgcugguugagauuaaggauugugaaacgucgacacgcugguugacauuaaggaugauugugaaacgucgacauggugguugacauuaaggaugauugugaaacgucgacacgcugguugacauuaaggaugauugugaaacgucuacacgcugguugacauuaaggaugauugugaaacgucuacacgcugguugacauuuaggaugauugugaaaccucgacacggugguugagauuaaggaugauugugaaacgucuacacgcugguugacauuaaggaugauugugaaacgucgacacgcugguugacauuaaggaugauugugaaacgucgacacgcugguugacauuaaggaugauugugaaacgucgacacgcugguugacauuuaggaugauugugaaacgucuacaugcugguugacauuaaggaugauugugaaacgucuacacgcugguugacauuaaggaugauugugaaacgucgacacgcugguugacauuaaggaugauugugaaacgucgacacgcugguugacauuaaggaugauugugaaacgucuacacgcugguugacauuuagggugauugugaaaccucgacacggugguugagauuaaggaugauugugaaacgucugcacgcugguugacauuaaggaugauugugaaacgucuacacgcugguugacauuaaggaugauugugaaacgucgacacgcugguugacauuaaggaugauugugaaacgucgacacgcugguugacauuaaggaugauugugaaacgucuacacgcugguugacauuuaggaugauugugaaaccucgacacggugguugagauuaaggaugauugugaaacgucuacacgcugguugacauuaaggaugauugugaaacgucuacacgcugguugacauuaaggaugauugugaaacgucgacacgcugguugacauuaaggaugauugugaaacgucgacacgcugguugacauuaaggaugauugugaaacgucuacacgcugguugacauuaaggaugauugugaaaccucgacacgcugguugagauuaaggaugauugugaaauguugacacgugguugacauuaaggaugauugugaaacgucgacacgcugguugagauuaaggaugauugugaaauguugacacgcucguugacauuaaggaugauugugaaacgucgacaugcugguugaaauuaaggaugauugugagacgucacuaaacacccccugcccuccacacuccacccuccaccucucacuaaacaccuccuguccuccacacuccacccucugccucucacuaaacaccuccuguccuccacacuccacccuccgccucucgcuaaacaccuccuguccuccacacuccacccuccaccucucacuaaacaccuccuguccuccacacuccacccucugccucucacuaaacaccuccuguccuccacacuccacccuccgccucucgcuaaacacccccugcccuccacacuccacccuccaccucucacuaaacaccuccuguccuccacacuccacccuccgccucucgcuaaacacccccugcccuccacacuccacccuccaccucucacuaaacacccccugcccuccacacuccacccucugccucucacuaaacacuccuuuucuugcccguucccauccugucauuucucacuucaaaucuccugccuuccacacucucuuccugucaguucucauuaacauuuucuuccuucuucacacccauccugucaguccucacuacacauucccuuucucacacgaauccuaucaauucucacucaacauuuccugucucucacucucccguucugucaguucacaugaaacauucucugccuuccucacucccauacgguuggcuuucacugucuguuucugccuuccucacucucacacagucagcucucacucaacauuuccugccucccgcccucccauauucugucacuucucacucaguauucccggccguccugacccugaguguucccgggucaugucaguucccaaugaacacuuccuggccuccauucucacuacgcagcucccucuuccucgcacaaauccuguugcuucucauucaacacucucugccuuccucacuuuccuuguguuaguucucaggaacauuuccaguucuuuuuccaucaauccuguuuugucucccaaucuucucuuucugcccugucaaauccuaaggaugacccuccuggaacaaugacaguguuuuaccacucacucuggcuuuuuaccaaaacccagugagagagacucgguggguucaugacugcucuuuacacugcuuuguucauuuaugaaugcuggauacccagcccccuuucucccacugugauuuuuagcaguguauguggugugaaaaacaacauucagggcaaaugaugauucuccuguggaguuuuaguuaaucuuacuguauuaguuuucaguauugagcagaaaggaccguaucguuuuucuuguaguuaugauagcgucauggaucuaagcaguuauuugcagauauggauaagaugaaaagguaauuuuuuuuuggaaaagauaauccauugugaaguuuuuauuaaagacuacucacuuaugucugacaggugauggccguuuugcuggaagaggaucgcuuggcagcugaacccagcuggaaucuuagggcucaagacagggcccuguauuuuagugacagcucaucucagcugaacaccagucuaccauuccuucaaaguaagaggcuguucucaaauaugauuuuaaauccagugacuaaacauucauguugaaauaauacucuguaguauaauauuuuauuuuaaugugaugggguuuaauguacauaaaacugagaaagacugaguuucugcagaauucaaaagugagugguuuuucccucuuaagugugcauguuaaauuugugauuaaggauuuuaguaagaugaauagaagagggauccacaguaauuuaaacaugugagauuguuugaaugaaugggaacugagauuuucuauguguuugaaauccuguuuucuuuucucuuccaguuauucaguuucuuuucuugagauagaguaguagaaauaguuggacgagcaugagagaguguucagaucaaaguuguguuaauaguuuagauauaguuacaagcaagacgcuuaacauuuaguguagauagacuuagauuuuuaggucaauccgugguuauggaacauaaaacgggaagcaaagcccaggaucucaaacagaaaguacaguugcauguaacuguuuaaucaguucagacaaacugcauuugcaagaccaaacugaaauuucuugagcuaguaaccucuuugucucugaaaaaguggcugucggguaccggagggcagccauggucccgguuuuuguggagaaccagcagaggugguccguguggccgucugcuugguagcaggugcgggugugcugcaggguaaacgugcuucggggcacgugugagaccagagcaguuggugccacuguuccaggcauuucuuccguccugccugcuauuuagagauuucaguuuauuuacauuucucugucuuuuaacguuaacaaaaauggcauuguuaauuuaacaagucuucacauucuuugagaggguuuugucuuuuccuguuagaaaaauaauaaaucucuguaccuguaucauucaacacauuggcauccacacucccacacccagcagacaccaagaagggaaccgagugugcgccgcccccagggagccgacacugagcagugacagcagaugcaugagagcggcaguggugccauggccuccgucggagaacacgugaaguguguguguguacugcagcgcuguggccuccgucggagaacacgugaaguguguguguguaccacagcguguggccuccaacggggaacacgugaaguguguguguguauggcagcgccgggccuccgucggggaacacgugaaguguguguguguaccacagcguguggccuccgucagagaacaugugaaguguguguguguaccacagcauguggccuccgucggggaacacgugaagugugugcgcauacugcagcgccgggccuccaucagggaacacaugaaguguguguguguaccacagcguguggccuccaucggggaacacgugaagugugugugcauacugcagcgccgggccuccaucagggaacacaugaaguguguguguguaccacagcguguggccuccgucggggaacacgugaagugcguguguguaccacaguguguggccuccaucugggaacacgugaaguaugugugcauacugcagcgccaggccuccaucagggaacacaugaaguguguguguguacugaaguguguggccucuguuggggaacucgugaaguguauguguguacuucagugcguggccucugucggggaacacgugaagugcauguguguacugcaguguguggccuccguuggggaacucgugaaguguguguguguugcacuucccacauguucaaggaguggagggucuuguuugcuuaguuuuguguucugguaaaaugaauauugagauagcagaaggaauaugagacugcaagagaggcaugagacggaguguguggguugucucacccugcgaauccagaauuugacucacauuagauucugaucugugaucagauguagagauacuucagccuuccuaggguccacccaguacccucaucacuauuaaaacacgcggcagaaugacacagccagcgggucguccucaucucuauuaaaacacgcggcagaaugacgcagccagcaggucguucaucuugacaaauguucuguagcgggugcuaugcccugggcacugucggggagcugcaguucagcagugaguaggacgacagcaacucugcccuccugaacuuguguuucgcugggucaaguaggcucugcacuggcuaaacaggucaacacacagucuaucagagagggguaaguucuaaggagaaaaauaaagacaguucugauagaggaggccucacugugagugaaaaccggacggagaugagagacgggccacagggagaugggagcuucuggaggaggcgcugcacgcacacaggucugagcggugggcacaccugugucuuggguagaagcgaggagaccacgguggacagugggaggugaggucggggcagcgaugggucaggcguugguugccauaucauaguuccgcuguaacaggagguacacguuccuaaaaaucgcuacaccguggaagacugccaauaaaaaccacagggcuuaggagaaaacggggucaggucacagcacucgagaaccucaucccacuaaaaacaacuauuaaauacggcagcuggaagaagaccugacgcuugcugguggaaguggccccagaaggcugcagcuaugagcgauugugacgagguggaaggaggguucccuggaauuggaggggacguugugacccaagcauggaugguguggguagcaggaugugaacugaggggcugauagguguuugugguguguguguggcugggguuggccgggugcugcuuuccacauugacuuggcgccugccagcggugcgguccaguucuuugacugaaguucucgccagucauggacuuccuauccuccuguuucacgagcuccaucuccaucuucugcugaugugugagagcugccggcacggccagcaguggcaacaguaacgccuuggagugcagucccucgccggguggagcagugucuggaacggcgcucagccgcucgcagccuuugaggagagcagugugccacgugguguuccagugcugaagccccugcagcugguguauuagcaauguucuaaagcagaggggcagccaggcgcacugcauuaccucccagcucugagaucccgacucccggcuucuggugggcagcugguuucugugggagucgcucguggagccacaggugucuugggcugcaugugaccacauuuuagccagacucugaggucagcuuggacagaguguuggggcauaggcuguggccguucaucaaaaccuacguuucauguauguugguuucgaaaggaccacguuuguuucuucaugaagcugaauuuuuuuuugaguauucggaaguguguuaaauuuaacuuggauucuggcaggucguugaaaugugaacauauuuuucuucucccuagaucgaaaaguauccuccuugcacaccucccgaguucagaggcagaugguggucuccguucacgacuuacccgagaagagcuuugugccccugcuggacagcaaauacguccucugugugugggauauuuggcagccuucagggccacagaaaguucugauaugugagucccagguacagcucaggaugagagucgcacguuugaugggaggaugggcaguggacagagcgugaaggugcagguggggagagucacggagagaggugcagggacaggagguggguagggacuuaugggccauucucugucucucacagcuggccucagcugugcugugggugcagcgagacacaugggugugcuuguaguucagaaugagcaaacgagaauuuucacagagcagcccuuugggucagcugagaauuaggaaauggaggugguuguaggcugaaugaaaauacucaccaugcuggguguagcucuggggcccuagaugccuguguuuuugccuugcacuguuuugguccugaguguuuuagagguuucuuagacugcguggagguuucuuagacugcauggagguuucuucaacugcacugagguuucuuagacuguguugaagugugcugucgcucacagcccuucuggaggccucccauucaccgcccaggaggcuggcaccgaggcuugaggacugugcggugaggggucagggcugccucucuuauguuugggaaaaugugcauuuguauuuuccuaguuauguauucccuggccucaaacccauugauuuccacaaaagcuguagagaagaauaacuugaaauuguaacuuuuguaauacaagauguaaauaaaauggcgcaggauggaacugcuacuucugagguucagccgauugagcugaguggacaggcucccggcaggcuuugugugaccagaugagugucagcaccuugcguuugugaucauaacaagccuacgggguggguuucucaucccuauucuccauuucaggaaccugacaagccaccuuuuauuucugugcaggagucuacguucugcuuacugggcccugcaggugacucccgugcaaagugaaacauggucagacaccccacucaguaaaugcagcuuguguuagcaugcuucucauauucuucugucauuggcuuucugugccuuugucuuuuaggucacguguugcugcuugagcccuuugaaagcauuuuuacuguuugccggaacagcgcacggcucaguugucgucugggauuugagagaagacucaaggcugcauuacucugugacgcugagcgauggcuucuggacguuccggaccgccacguuuuccaccggucagugucaucugccugccaauugugugucugcuagaaaagccacacggauuugaggaacaaagcuuuacauggauuugcauuuauuuauucacauuaucccagaggacggggucugacccaugggcaaaagaggcauuugauaaauacaaaaaacagaaaucaauuccaaucaugauuauccagugaccaagaaugacuugaauuuccuuucuuaauaaauuuguggauucuaaaaaauccucaaugaaauuaccuuuaguuuuaaaguagcuugaggcaucuuggcauggguguucuucagggcaaagauagcucacacucacgugagcaaagccagucacccugagggcugccaggaaccagcacaauugggccucccugagccuuggcuugacucggguggacauucauacuaugccgugcccagccaccacaguaggcaccuggcauaaguguucccuguguucugggacucgcccuaguguguaguguacauugucucauuuaauuccccugauagcccuguauccuagcuccacaggaagaugccgcguuuauccaaggucacgcugacgacauggucgggccugcacugggaccccaugccacgcccugcaccgccccuucccguagggguuggggcgcuguggacugaaggugcaggccgaggucaucacucaccccucuguguggcuuuauuaucauagauauguugcgugucugucuguguuugacauguguaucuguacauuguacauaagagggccacuuuuuaaauuccccaaccaugaauugugccccucuguguggggcaauacuacuacuuacuguuaaggcuguuugaauuuaucgcaacuuauggguugcgaugcuauuuuaaaagauaucuuuuaaauaaauaaucuuugccuuuucuaacugcugcugcuauuacuaaaaaauuuuugaauucagcaccguuuucaaaaacaguaaaucucuagacuguacauacaaauaaauuauuccauuaaaauacauccuucuuuuuuuuuuugagauguggucuggcucuguagcccaggcuggaguacaguggcacgaucuuagcucacuggaauuucugccuccuggauucaagugauucuccugcuucagacuccugaguaucugggauuacaggugcccaccaccagugcucggcuaauuucuguauuuuuaguagagacgggguuucuccauguuggucaggcuggucuugaacuccugacuucaggugaucugcccuccuuggccucccaaagcgcugggauuacaggcauaagccaccgcacccggccuugucuuugaaauauuaucaauaaaaccuacaaaguuuuaaauaaacucccaguagugaggagcuguggaacuucugauucagaccaugagucagaggaaccaaauucucacccgggagaccagcccuuuccucagucgagccaucagugcuucaucuggguccucucacuuagacacccuguaauuuauucuuaauuucugagaugguuuugucuuuuucuucaguuucuuuccugaguucaaucccaguucucauuucauuucuugcuuuuuugggucuaauucuguucuugauuucugauucccgguguuuuuucuugcuuguuguuuugauauguuuccagaugcccuuugaggagaugugauuccauuuggaacguugaguuuugugucuucugccuuuugcuuguuuuuaggagggauaauuuucaucagcugaaaugcuuucauuuacauuuuuucuguuuucuucuuauaguagcuuucuauggaguuuggcguuuuucuacuuguagacauucuguagguguauauuuuaggucagugagcuuugcuuuauugauuggcgacagguaucuuuucagugggcauugugccucgaggugguaggugggguggguuugccuuuccuuugguuuugcaaaugccuggauuuugcucuugcuggcaguugugaggugugugcggaggucucccccauuuccuguucacgucccccuucccaucggccgugcugcuccgaccuccucugccucccagcuccuuccccucaguuguuugaguggcccccaggauuuggccucgcagagacuuucucugucugaguuuucuuucgggcuguguggcaugcucuguuuggauggugggcuuuagcuuucuuccugccuuccagacuggagagcaggggcuggggcccguguguccuaggaaucugaaagucgugguccugugucaguugugugugucagucgugugugguccauguugguuuugggguguuuugggaagauguguggagagaguuggaucugugagacccagaagcaccucguguuugucccugugugaugcgaacugcauuucuucaacuuacuacuuacacguggaugcugugggcuuuugaacuccagauggaauccuuaccucaguaaaccaccgaagcccucuucaagcaguagaaccuaucucaacguccguccacaaaaagcagagcuuugugcuuucacccuuuucuacucaagaagguacgugauucuucacuuucuuaaaauccuucaucaaugguugugaaauaugguuuccuuauuuaaagccauuucuuucuuuuuguuucugucuucaucagaaaugucagguuuguccuuccacaucgcuuccuuggaugagagugggguucucaauguaugggugaguaguggcccaggccgggcacaugcggggccugagugagguggucuggguggagguggcgccugaauggcgcagggggcgggacccaguuagcuguggugggaaacggagagcaagacugggcuucuugguccugagcagaagggaugcagaaggccacacauggcagguuuggggcccuuucgugacagugaaauagggacucucacacagggcuuugggaacgcggaaugaaagugagaagggaacaaaauguuagggcugaggugaugcuggauuggcuuguccuggaggaugcgccaagacuguugauuaagucaccaagugaagagaacacgaggagaucaaagcaaaggagucaacuuguagaguguuaguucugaggcuaaagaucagucucuuuuucuggagcaguuauguuuuaguaccuaaauagcacuccaucuuaauuagagcuaugcuuugcuuagguuguuucauaauuauaaaauguaucaauauucauuuucaauauucuguuuuuaggugguuguugaauuaccaaaggcagacaucgcagguucaauaagugauuuagguaacuauuaaguaaaaaaauuaauuuuaguguuuucuaaaaugaaucgagauuaaaaguacugauaacugcggucaggugcaguggcucacaccugcugggagccucagcacguugggaggcugaggaaggaggauugcuugagcccaggaguuccagaccagccuggacaacauagcaagaccccgucucuacaaaaaaauucaaaaauuggcugggcgugguggcacacaccuguagucccaacugcuugggaggcuaaggugggaggauugcuugagccuaggaguuugaggcugcagugagccgugaucaugccacuacacuccagccugggugauggaaugagaccuugucucucuguuaaaaaaaaaaaaaagauaccaauaacugcuuugaaaaauauaaauuacuaccugaaaaaugaaaauuaaagguguaugucauauaaccuuauaaacuguugaacgggcaucucaauuaacuagaauaaucaaaugauauucugaaugaauuuuuuuuuuuuuugagacagagucccgcucuguugcccaggcugcugcaguggugugaucuuggcucacugcaaccucugccuccuggguucaagcaauucucuugccucaaccucccaaguagcugggauuacaggugcuugccaacacgcccggcuaauuuuuguauuuuuaguagagacaggguuucaccauguuggucaggcuggucuugaacuccugacuugaggucauccacccaccucagccucccauagugcugggauuacaggcaugagccaccguccagccugagugaauguuuugaucuuaguaggguuuaaugaguucuguuuacagcugaguaccauucaguucugucagacaagucaaggacagcuguguucuguagcuguucccuauguauuucagguguccgagucuuucagugcgcauucauuuuggggcuucuuccucucaguuuuggauuuacaaccccaggguguaucaggaacacuggaugcugccccgagggcccuuagacuggaucccaggguggcaaagguccccggguuugggcagagcagaagugacuugaagcaaagcuaauagcaccucucacagguggcugcucuugaugcuauggaguacgauuuucaguuccagaaagggcucagaagugacggaguaauucaguccuguuguguucugugguugagauuagcccauguuuugaucucaacuucuuucucaccucauuggccucccacaacccaguuuguaaugacaaaccccccuuucaccuugcuugaaucagggguguuuucccauguagaucuggcaaaaaauaauaugagugagaccggcuuuguuccuaaccucuugagaugagggaagaggccacuuuggcccuuggagcaaaugcucugugccccguagucacacgucugugguggcccuuacaaguuuacuguugauucugacuucaguaaaaauaagacagucguggugcucauuucacugcuaaaugcuuuugagguggagucaccauguuucucaauguauucuuuaugcggcacccucucugcucauggagccguucugcucuguguuguccacuccaggcugccccuagaauccuggagugucagagcuagggagccugggcagggguccuggugccuccuucucaacguacacaggucacgggauggguuagugauggggcgagacccacauagucagucucagcaccaaccccccuucacacccaggauuccgccccaaaugcccagaacucuugugaccuuaagagugcgccuugaggcugguugugccguuaacuuguuacaugaucaagguauuugucaagcaauuacggaugguacugagaucauuucuguccauagucaggugauaauccggcuauggagacaaaaucauuuugcauaaaaaguauuugcauacaaauguuuuguaguacaugauggucauauaaaggauauccugggguggugaguauuucauuuuaaaauauugauguauaaaaacacccuuucuucacugaaccacuuacccaaauugcaaccauguuccagccuugccuuuaggaagggaggacguuccgaccagcccguuguucaggguggcugccagcucuuuguguaggcauuggaugaguugcuguuggagagcugaagucucagaaggagucagccaccaucuuuuuaugaaauguucucugcauaagcgagguccaguccuaggugccaggagaccugggcgaagaccccagcccgggagagggcgaguggugguggacuuacuggagcggaggcgcagugggaaggccuggccagaaaggcugcccgugggcgguggcguguaggggcccagucggaaagggccuggccagaaaggcugccugugggcuauggcguguaggggccagugggaggacccggccagaaaagcugcccacaggcgguggcgugggagccgagacgccagguggggggcaugccgggaagcuucacauuugugaauaguggcguugacccuucuucacugugguugugacuggcaggagauacgcagcagcuacagggacccugcccagcugcagguugggcuuauuucuaucuccuuuuaauucaccugcccccagaguuuuaggcaaugccuugcccagaauuuggguuuuaauauccauagauuucuaguuuuuccccuuguaguaguuuuagagggaaagugauauugggagcagacacaggaggcaaaaccaguggguggccgaggagccagcgcuguagccaugaacgcuuucaggaaggaaaggaagagcagucaggccucagagccguggcucuguguuguuugagaaggaagcuggagaagcugcuggaacagagagugaggccagacgcacucggcugaggagccacucugccuccugugcauucugcccggagaccagcagauuucugagucucugggaugguggagagagagguccugcaaguuuccuguaggcguuggagccucgguggacauucacaggacagcguuugcugcugugaucuaaggcuuauuuaguguauguacacucguacacauguaugguuugcuuaccccccuuauuuuaucagaucuaaugauauaaaggcucccagaucaugguucuacaaucuuucuucccauaagacuuugaacugugaauucucgauucuucuccuaaggcaggauacgugaaccucacccagaggaagggagggaugcuguguauugauuugcauuugauguuauuuccuaacacagauauuuaagcaaugaaaaaugauuccaggcaacuauaacuagauuuugauuuagcuucuauugaaaggugcauugauuuugguucaucucuuuuuaggucugaugccuggagggagggucaagcugguacauagugcucugauccaguugggugacagguaagaugugagggaaaaugcuucacuaucucacaaagaccuagaaggaaaauaacauuggggaauugcauauacgguaaauggugagcuuuugcgaugaagaaguccauuuucucacauuguuuuuuuacuguuuuguuagucuauuauuuuuauuuuuuuauuuuuuugagacggaguuucacucuuguugccccggcuggagugcaguggugcaaucuuggcuugcugcaaacucugccucccugguucaagcgauucuccuguucagccuucugaguagcugggauuacaggcgccugccaccgugcccggcuaauuuuuguauuuuuaguagagaugggguuucaucauauugaucaggcuggucucgaacaccugaucucaggugauccacccaccucagccucccaaagugcugggauuacaggugugagcccccacgcccggccuuguuagucuguuauuaaugagugaauguaauaaaugcagcuuccagguguagagcuaacauuuugucauuaaguagagguuauuuucuuuuaaauuggucuuacuuaacuauucuucaguucucaugcaacccugagguuaaacuuaaaguuucaggaaccagaaacauugauaaaaaguuuuauucagagauuuagauuuaugcuuuuacucauauaacuuaauaugacauaaaaagucuucacaaauguacaaauauuauuugugguauuuauauguuuuauguuaauuuauuuccuaaaguaucuuuucuugucauuuacugcacucaggggucaaaauuuuggggucugguucuuccuaaucagaaaaccuguggguuguguuaaugaauucaugcaugcuuggagacuuuaaaucaacuacaguuguaauuaguaauuacaacuaauuaugaaagagaaucaauuauauuuuaaaaagucauuuacuguauugcagagccaaacauacaugguuccugggcaagccccugaccccuccagccucuacaguucccccacugaguuucuuuacgacuuuuuaucucugcuagggcccuuauugcuuuauauggugcauuguauuuaucuuuaacuaucagcuucuccuguacuuaacuacacacacacucuuugaaggaaagugucuaaucuguccgcuguuuggguuuuuucuuacccaaaaacuccuagcagugucuuccugagauccaugcauaauaaauguucccucagacucugcucaaccaaccauguugagcuuauucuacgugcuaggcuuuguagcacuaguggggagcauccuccgucaaggugcuccgagaaggaggcggaugaguaaacauuacgugauugcagggggcgcucccugcuuucccaggaagaaggcucugcaguggaguucagagugaggauguuucuuaaggaguuccuugggcuuacugccugggaaagggccgggaggaggcagaauggggccgagaggaggagcugagcugugaggcaggucccacggccaacuccccagggcccaggaguugugagcuggaauggccucccagaaucacguggcugggacuuuguaccccgcaucccaucagucacugagcaugaguguccccaggaggacauugccugcagggaagcagguccugcagcucugucugcaccgccccugcagcgaggccccgucccucaggguugucgugcagaggacgaagugugcugucaggaugugcacaaggcuugugggagcucaaaggaugggggcagcuugggggauggagugcaguggggacaucuugaggaggcaaagacugagccaggccuuugagguggaguuagauggucagagggagcagaaccugggggugcccagaggcacauuuggagcugucaguggguccgauguugagggaggcaggugagccaggcccuaacgagucugucugccgugcuaaaggguguggacauuagcauaaagguggucacgagcugucagugggucugauggugagggaggcaggugagucaggcccuaacgagucugucugccgugcuaaaggguguggacauuagcauaaagguggucaggagccauugcagcacguugagccgaggagcagcacaucuugucugugauguagaugggucaguguggcaguggcguaaguugggaacagaggaagggaggcuggagucagggagagcaguuaggaggcuucuggagugacugacaugaacaaccaggaucugaacaaaggcagcaauuacagguacagagggcuggacacaggcuaaagggguagaacuuaaaaaacccaggagcucaucaauuauaggagcagugggagggaggagccuagguuggccucugccuccaccagcaugucugguuggugacugggcaccacuugccaggcgaggauaggagcagggaggguugggagcagcccaguguguuccagugaggacaggcugagcuuguggugccuguggagaugcccaggagcuaggggccuccauagcagaaaccccagauggagguaaggauuugggagucgucaaccaagagguggcauuugcaguccugaauguggacagaaagagaaaauuggaaaggaggcugauagcauggccacaugcugacuuugaugauguggguguggcagauggagcaacugugggcaucucucuguuacaaauacauaggccauauaaaggaaaaaauaaaacuaaguauaguuuuuaaaaggaaaggaaaaucucuaaaugccauaaacaggagagagcuuaaaguuagugucauaagcuuuugagcugcuaugugauggcuuggaggcugggugugaagcccaggcugucucagaccuucugagcugucucuggggcuugagccccaugcagaaccaggcgacgcauuggguuugccugaggcaaggagguagaacugagaccccugcacaggacucuggaacucacugcuccugcagugauagggaaauucagaaagccgcaccacagccaagggaagacagaggagcuuggaagagcuugaaauccuaagcugagugggugugugggaacccacaagcugagauguuagcaucacaguucuagaccaguggccucaguggguucauaguuaaaguagacgcaaaacccccugguggguaaagauauguuugcaaauuggggcucacagguuucuuaugagaagcagucugcugcagaugagcucacaacuacaagcaugaagaaauagucuaccuuggugcaaaaaguaggagucacacacuaagaacuugagacaguuguacaaucuaaaagaaauuucuagaaaugaaacuguuaucucugaaauuuacaaccaagugaaugguuacauagcagauuagauauagcugaagaaagaauuagggaacagaaggauaacucugaaaaaauuaucaagaguguaguagcagaagaaaauagaaacagaguggcuaaacccacagaggaaugugacauggccuguuauacaucgauguauuguagugcaaaucaguguuaauaccaucauuauucuuaagguuggaaacaguccaucuguucauuuuguuacuuuauuuuuucagucuuucccauaaagguaaugaauuuuggggcacuacacaaacacugaauguuaaauuucugccuucagauccuaaucacuuuauuauuggcacagacauggugaguaguauuuuaaauuuaauccuauuacucauucuccuuguuuuccugacuuaccugauaaauaucuugauuuaggauuaacuuacucuuuucuuuauaaaguuuaaauuguuugaggaacaguagcuguauccaaucucguguguaaugcacucguucagucacucuugggcuucuucuucacagggucucauaagccauggcacaagacaagauuugagaguggcucccaaacuauucaaaccucagcaacaugguauaagaccagugaaaguuaaugucauugauuuuucaccauuuggagaaccaauauuuuugguaagaaaguuuguuuuucagagcuccaauucuucuuuuuuuguuuuuugagacagggucuugcucugucacccaagcuggagugcagugauguggucauagcucacugcagccuugaacuccugggcucaaaugacccucccaccucagccucccgaguagcugggaccuguacaggugcaugccacuaugccuggcuaauuuaaaaaauguauuuuuuuguagagacgaggucucccuguguugccuaggcuugccaguucuuuuuagugauacucuuugccuguuugggcagcauaacacuugcagugauccauuggaaaauuuuaaaaguuaaucauuuacuagagcacaaauuggucauuuauggggcgucagugguuuaaaaaggagaaacaugaaauuaauaacaaauuuuaaaaacaaaaccuauguagaaauuaaacucucgaguaauacuugguucaauuacaaacuaguuagaauuuaacagaagaauaugaaauaccaaaaccuaugauacagccaaaaaugugaagaaauucuuagugugaggauuuuugccuguguucuuuuacuguuuaacacaauagaaauuaauguucagagucuugaaccugaaaguccagggauggccgucgggcaggcagcagucccugcgcugcacucaugcugcaggaaaugugugugugggugcgagcugcuugcugucuuccccuccagggccuggugucagcccagcucacccuagucacaguuguccuguagacuccaaggucaguuuauggguugguuuggguaagauaggacagaaggcaaaauauuaaacaacuuuauacgugauuaaaugugauaguuaacaagaauuauaugacagucaaggcauuaaguuauaacucagauauccccuucucucacuaguguuuacaaauuuccguguacuugagauugaggggaaagauuguuauuuauucacacuacucuuauaguacuuaaaacauuauaaauuauguuuauaugucagucacauaaacuaagguugcugagggcagagaugguauuucauguaucuuuguauuuccaaagacugcauuugagcugcugaguaaugucccccuguggcuguugggagccuggaauguggucaggcaaggcugggaugugcuggaggugugaaauacacaccaaauuuugaagaauuagugugaauaaaagaauguaaaaugucucuuuaggcugggugcuguggcucacgccuguaaucccagcacuuugggaggcugaggugggcagaucaccugaggucgggaguucaagaccagccugaccaacauggagaagccccaucucuacuaaaaauacaaaguuaucugggcacgguggcccaaaucccagcacuucgggcaucccaggcaggugggucaccugagguagggguucaaaaccaugcuggccaacauggcaaaacuccgucucuacuaaaaacauaaaauuagccuggcguggugacacaugccuguaaucccagcuacuugggaggcugaggcaagagaaucgcuuuaacccaggagucagagguugugaugagccgagauagugccauugcacucagccugggcaacaaaagcaaaacuccgucucaaaacaaaaacaaaaaaagucucauuaauaauuuuguuguuggugauuuccaguguggagcucuugagcuuuuuuuggcuucucuccccacaaaaaaccaaaaccaaauacauagcaccaagaucuucaccaauaagaacuuagaacucaauugugaagauaagacaguuccuggggccacagagaguagaaaagcuccaagcagaugggaggagaacugggcuuccauauccacaaugucccuucccccuuauuuggccuggcaccaagugcauggaaaaucuccccuuaacucaugguuugugaaaguaaaauugagguggacaaccaguuuuucuacuuucuugggugcccugucccugccucagcccauggggagcaucccgagugccugaaggaagaaauaccccugaggacacccagaaacaaagcugggaggcaggacuacugucugcagcccugaaaauucugcaccucagccaaaggaggcacucaaucagaguggccgcucauagcaccaugcuccaggagguuuauuccacaggucuucugaacacaaacccugacacaggcagggagacuucccuuugagacuucccucauuugggacaggccucccucaaucacuaaauacagccaaagugaaccucgucuuaaggugacaccuauagcugaaaaggaggcagcaaccuagcagagaagauuugcuaaguaaauauauucaauaaaaaccaaaacaagcuggacagagaaaacuggaauaaauaacuaauccugcaaugcaaagacacagacauacacccacaagaaacagcagcaaacagggaaucaugaccuccccagaaggacaaagcaaaaauccagugacugaccuaaugaggcagugauuugugagcucucugaccaagaguucagaagagcaauuuuaaggaaacucugugaucuccaagacaacacagaaaagcaauucagaaauuuaucagagaaauuuaacaaagagauugaaauaauuuaaaaaaucaaacaaaucuuggaacugagaaacauauuugcuggacugcagaaauucauuauaggcugucagcagcagaguggaucaaguagaggaaugaauaggugagaucaaaacaggcuauuagaaaauacacaaucaaugcugggcgcgguggcucacgccuauaaucccagcacuuugggaggccgaggcggguggaucacgaggucaggagaucgagagcauccuggcugacacggugaaaccccaucuguacuaaaaauacaaaaaauuagccuggcgugguggcgggcgccuguagucccagcuacuugggaggcuaaggcaggagaauggugugaaccugggaggcagagcuugcagugagcugagauugugggcacuccagccugggugacagggugagacugucucaagaaaaaaaaaaaaagacacaaggcugggugcaguggcccaugccuguaaucccagcauuugggaggccaaggcaggaggaucucuugagccagcuugagcaacauagggagacccuaucucuacaaaaaaaauuaaaaaauuugccaagaaugguggcauguggaggcaaauggaggcugaggcaguaggaucacuugagccuggaaggccaaggcugcagugagcccugauugugccauuguccuccagccugggugacagagugaauacuguuucuaaaaagaaaaaagaaaggaaauauauaaucagaggagaaaaaagaacaaaaaggaauaaagacuaccuacaagacagaaaauaaccacaaaagaccaaaucuaagaauuauugguauucaagagggagcuaacaaggguuagaaaauguauucaaagaaaugauaacagaaaacuuuccaaaacuucauaaggagaucaauauccagguauaggaaggucagagaacaucaaacagauucaacccaaauaagauuaccccaaggcauuuaauaaucagacucucaaaggugaaggagaaagagaagauccuaaaagcagugagagauaagaagcaaauaacauauaaaggaguuccaguucaucuggcaacagacaucucaguggaaaccauacaggccaggagggaguagagugacauuuucaaagugcuaaaugaagaacauugccauccaagaauaccguauccagcaaaacugucauucaaauaugagggaggguuaaagucuuucccagauauacaaaagcugagagaauucaccauccucagacccaucuugcaagaaaugcuaaagggaggcugggcaugguggcucacgccuguaaucgcagcacuuugaagguugaagcggguggaucaguugaggucaggaguucgagaccagccuggccaacaugaugaaauaugucucuacuaaaaauauaaaaauuagccagaugugguggcgggcaccuguaaucccagcuacuaaggaagcuaagacaggagaaucgcuuuaacaugggaggcaaagguugcagugagcugagauugcaccaccgcacuccagucugggugacagagugaaacuccaucucaacaacaacaacaacaacaaaagaaaugcuaaagggaguucuucaaccugaaagaaaaaaaaauacacgcaaaaacaaaaaacuuaucaagguauaaaacccauucauguaauuaaauacauggacaaacccagaauacuguguuacuguauuuguacaauaugcucauaacucuacuaugaagccaaaaagaccuauuaaaaacaauaauagcuauagcaacuucuuaagauauaaguaauuuaaaaauauauaaauugagacaacuaaaagucaaaaugugagaggguuaaaguguagaauuuuuuguuugguguuuucuuuccuuuguuuuuauuuccuuauuuguauucuaagguaaguuguuaucucuuuaaaauaacuuguuuuagggcugggugcuggggcuuaugccuauaaucccagcacuuugggaggcugaggugggaagauugcuugagucugggaguuugagaccaguuugagcaacauagaccucaucucuacaaaaaaaaacccaaacaaaaccaaucagcuggguacaguggugcccaugcccaccuguagucccagcuagcuacuugggaggcugaugagggaagguugauugagccuaggaggucgaagcugcagugagcugugaucuugccacuguacuucagucuaggucacagaaugagaucccgucucaauaaauaaguaaauaaucacaauacaaaaaccuauaauagcuucauucaaaacaaaaagcaacaaauuagaacauacuagcagagagaaggaagacaggcagaaaggaacaaaggaagagaggagucuuaagcagaaaucaagcaacaaaauggcaguagaauguucucacuuagccauaauaucacugaauguaaauggucucaauucuccaauuaaaaggcauagaauggcugaaugguuaaagaaacaagacccaacuguaggcugcucucaagaaauucacuucaccuauaaagacacacucauacuaaaaggguggaaaaagguauucuauacaacuagaaaccaaagaagagcaagaguggcuauacucauggcagauaaauuagacuacaaaucaaagacuguaaaaaaugacaaaaaggggucuauauauaaugauaaugggugaauuuacuauauaaugauacaggggucaauucagcaagaggauauaacaguuacaaguaucuauguacccaacaccagagcucccaaguauagaaagcaaagauuaauagaucuaaaacagaaauagacuguaaugcaauaauaguaggguacuucagcaccccacucucaguaauggacagauuacccagacagaaagucaacaaagaagcaucagaguuaaacuacacacuagaccagugguccccaaccuuuuuggcaccagagacugguuuuuguggaagacauuuuuucccagaacuggggauuugggggacaguuucaggaugaaauuguuccaccucagaucaucaggcauuagauucucaugaggagacugcagccuagaucccucgcauacacaguucacaauaggguucaugcuucugugagaaucuagugcugccgcugaucugacaggaggugggguucaggugguaaugcucacucgccugcugcucaccuguugcuguguggcccaguucguaauaggccguggucugguacugguccauggcccagaggcuggggaccccugcacuagaccaaauaggccuaacauuuacagaauauuucucucaacugcugcagaauacccauucuuuacacuagcacaugagacaucauccagaauacaccauaucuuaggccccagacaagucguacaaauucagaagaauagaaaucauauugaguaucuuaugauuaucauggaauagaacuagagaucaauaacaggaggaaccuuggaaaauacacaaacacauggaaauuaaacaucuuccugaauguccagugggucaauuaagaaauuaagaaggacauuuaaaaauuuauugaaacaaaugaaaauggaaauguggcauaucaaaaucuaugggauauggcaaaagcaauacuaagagagaaguugauaguaauaaaugccuacaucuaaaaaaguagaaagacuucaaauaaacaauguaacaaugcaccucaaggaaggagaaaagcaagaacaaaccaaacucaaaauuaguggaaggaaagaaauaguaaaguucagagcagaaauaaauaaauugagacaaagaaauuacagaagaucaaugaaaugaaagguuagguuuugaaagauaagcaaaaucgacaaacuuuuagcuagaauaacuaagaaaaaagaagacccaaauaaaauaaaaucagaaaccaaagaggagauacaacaacugagcccucagaaauacaaauaaucauuagagacuauuaugaacaucuauaagccaacaaauuggaaaacaaauuugauuuuaugaaaauuucaauccaagagaaguauauaaccauauuauugacacaaauguauguaguuuuuuaaaaggugccauauuuucauggagccaaucuuaauggcccauauuugaaucacugauauucaacuuuguuaaauuuguguuuauauauacgcugaaucuguugauuauuggccauuuuggaagagaaaguguaucagagucaggugagugcucaccuuuguaauuugugaggagagauucaauguuacaauuuuauguuaggaaaacaacaaauuaauguuuuugcaguacaaacuaaagcaagcucauccuccaaaaaauuucucuggcugcugagaucaaguuacgaaaaaaacaaaaaagaggcugggcaugauggcucacaccuguacucccagcacuuugggaggccaagguaggaggaucacuugaggccaggaguucgagaccagcuugggcaacauagugagaccucaucucuacgaacgauauaaaagguggguguaguggugccugcguguagucucagcuacucaggaggccgaggcaggaggauugauugagcccgggaggucaagcugccaugagcugugauugcaccacugcacuccaggcugggugacagagugagacccugucucaaaaagaaaaaggccaugcucagcaguguucuuucuuccuggucauaggccggcuguucggacggaagcaucaggcugcaccagcugagcuccgcguuuccgcuccugcagugggacagcagcacggacagccaugcggucaccggccugcagugguccccaaccaggccugccguguuccuggugcaggacgacacauccaacaucuacaucugggaccuccuccagagcgaucuggguccugucgccaaacagcaggucucccccaacaggcaaguggggaagcucuggaccagcugcugguugugggggggcuucggccacgggugccacuuacggucuuucuucauuaauuuuugcaugaggcugcuacauuuuaagauguggccauauguaaauuuaaauaauauguucaguuaaaaauuaaaaaguauuguuuuugagagcgguguuagguucacagaaauuugaguggaaggcagagauuucuagcacccugucccacaucccggccggaggcacgugcggugcaaucacgggccuguucccacaccaccaccaccgagucgacggcuuaccugaggguucacucuuggguugugcauuuaaauaauauuuuuaaaaucacuuuaaagugugauuauuuuauauuuagcccaagcuagucuauuggauuaacagauucaucaugcgguauuuccccaucauuaguguucugugaguaagaaaugauaguuugugagagcuucuuaguuauguuccuuugccaaucuuaugagcuauaaguuuguaaugucugaacgagguacuugguguuccccuagugucuaaagggggaaaggaggaugguguguggaauuaaugguccacaugacgccacacuaaagccauuccagcccaggccccucgaggggcucccagcucacaggcagaccaguauggcuggggcgugcaugucaguucacgugaugucacugauggaauuaagacggcugcacucccaucaacaccacuguuagguaguucuucguugcuuuguuuguuucacagcagaaguguucacgaaagcuuucgucaugaggugcucugccuuggcccugcuugucuguucaccuguguuuuuuuucuugagauuuuuacauuucuuuuuaauaaauucuccuacugugaggguucauguugaccuggggagagaaaucccacagcccuuuuguaaaggaaagauaagaguuuaauagaauguuggggguaucccagugagaucugaaugaaauuaagaauugcauuuauuuaguuugauuccuagguuuacuuacguuauucugauuauuaaaaaauacauuaaaauccagacugugauuugcagauaaccacacaacacaccugcaguuuauuauuccagaaagcauguccaugccugcguuacaggauaaacacauuuacccagcaccgacugugugccuggcggccggggcuccacacccugagaucucucccucccuggugggcaagaaagacaaugagcagagugaacgagggggucccgaaaugugcuggaaaacgugcuguggaggcagaugaugaggaagaggucacgagcgugggucagggccgagggggcaggaaggaugguccuguuguggggacguuugggcagaaaccuaggagaugaggucugggugaaggcagcagggccugggcaggggcggguagcacaccccaaggugggcugugcugcuguggcggggaccggagggucugagcacaggagccccagcucugugugugauggacuccaaacguggcucauaguggagagcauguuuguugucauuagcagguuacgcacccuucgguucuggagccuugucuuaggggcaucauggcuuuccaugaaggagaacgugcuagggaccucagcuucaaucuccagcugagaccccgaugacuggcugcccuggagcuccccuaaccccucagcagugccggacgccgggucaacccuguccaucugucaggaaggaggcggcagcccggcccacguuccucuacuucuacuucccacacgggaaaaggcucuggaaggagguggcgcucucuccuccuguugagcagccagagggaccugacacagaaagugcccaguuacuuuucucugguuagacagagaaacagaacaagaagaaacggauguuuggaaggaaggaguuuagauacaagcaaggauuuaacacuuuuagaguuacguuacaaucucugacaaugacuuacccguugcaugugguugagaagcagguuggcuguggggaacaggcagggcccucagggccagcacgggagguggcaggagccuugugguggcucaguguugggcccaacuuuugcuuuuguccucugcccucuuugcuuggauucugucuaccuuaacaaauaugaaggauguguaaaagagcugacgggugcuaguacuguguuugcacaucugccguagguguaguuuuaaagcaucuagacauaguuuaccaagggacuguuuuauuugcccggugucagggaagccuuugguguccaccgucuguuacugauguuuucaagucugcagcuaaacauugcccaugcuuuacacacgcaauugaauagcaguuuuaaaguauccgcuggugaaaauccgaguggcuuguaguuccucauggucugccccuuuuggggugucacgaggcuucauucccacacucugccgccccacguccuguggagugagcagggagggggugcacucagguagcugucagguuggaugugauuuucaccccuguagugacaagggcagggacccuacccccaucaucaggcacagccaggauccuggcaggugauggcaccaaguuggaucucaaaggacaagugggagugaagcaaagacgggcagggagucugcaagaggcacggggagacgggguccccagccacgccuggaguugcaggugccaggagugugagccguaggcccagggccacaaggagacugggcguguuucuaccagccacaggaggggguuugaaugggggccagguggacagcagaggugugucuuugagagucucugucagccucaggagaggauuagagcuggggccuggucagggagcguguggucaucagagugagggaaggggccccugggagugagaucggggagacaggguggccacaggucucguguugggcacuggguggaugauggaggugcuggucccauggaggccaggaguggagggguccggggcuccagggugaguccgggcuggagacgcagacuugugaguccugacacucagcugugggugagauccagggaggcuggagaccaaggacgaggcucugauagaugggccugccugugcugcugauggcccccaccuucuccagggaccugcugggggcuacugacucccggccugaggagacagcagcacguccucaucacuuaccucugcgaaguuccaucuggcaggccucugacaugcggaaaugcauuuucacacauuuauuucuggucuagcuuucauuuuggcuauugguauuuuuagaauuucucauccguuucacucuucccauggaagguagacauuuugaagacucagacagaaccgaaugucccuuugugugcacugacccucugcuucugccccucucccugcaggcugguggccauggcugcggugggugagccugagaaggcugguggcagcuuccuggcccuggugcuggccagggcgucuggcuccaucgacauccagcaccugaagaggcggugggcggccccggagguggacgagugcaacaggcugcgucugcuuuugcaggaagcccuguggccagagggaaaacugcacaaguagcggguguggcugagaggaccgcguuucuguaaugacccagauuuaaaagacauaagguggauaauucuacauuugugugcaaguauauuuauguauauagacuauguauauucuguauauaauuuauuuuacaugaauaugucuuugguauucccaguaaauagaugacuacuuuugaguggaaacaaagaacauucuagcauuuacaaaacuuccaggggaauguagagccacguccagggugcucuuuucugagaguauuucgaguuauuuuuagaacaguuuaaauauugucacauuacugcuagauuuuaaacagccuaccaugaaaauguaucuuaaugaacuauuuucuuaugcauaaaguaugugaacacaugucuaaauuaaaaggaauuacuccaccgaaauga

SEQ ID NO: 192398 - RNA, 68179 nt, Homo sapiens
cuguuggagucauaggcaaauguuuaauuaauucugcucauaugcacaucugaaagcaugagacacacuccacagacagcacgcacuggagcagguggggcagaugggcacucgccgauuagguauuaaugucaauaauacgugcauaaagugcugauaaaauaacuuaaguguuacaaaaacagacaguccacgguggcugcaggcacaugcaggcgggacugggucagacacuccagggcugcacauguuccagcuggccugaguccgacacgucauagcuggccuuguacuuggccaggauuuucaugaggggccguagcuugagccaccacuguucuuugggaauccugugccuguggagguaagaggagacagcagugaggccugcagucacuggcgggagaugccuccgccuggccagcacagcgagcggucuugccagaaacacaggguuuguagggucggcugaaucaacuagaugauaaagccaauuucaggaucaaaugaaaccauuguuuaaaauuauucccgaagacccagugguggagucucgcucugucgccaggcuugaguacaguggugcaaucucagcucacugcaaccucugccucccggguucaagcgauuucuccugccucagccuccugaguagcugggacuacaggugugcaucaccaugccuggcucauuuuuguauuuuuaguagagaugggguuucaccauaugagccagguuggucucgaucucuugaccuugugauccaccugucucggccucccacagugcugggauuauaggcaugagccaccgcgcccagccaagaccuaguauuuuuuuaacugagcuucagaaaagccaguuccucaaaccccugaaugaguugccgacagcaacagcaauggccauuccccugucccguacucacauuggggucuuauugccucagggaacccagccaacuuacucaaaauccguuugcuucuucagcucugccacagguugaaaaauaacguuucuuuugcuuauucccagcacacaaauggaaucaucggugguaaauuuuuuuccuauaaaagauuuuaaaaaagauuaauaacacccugucaacaugggcaggugggggagcagaaucacggggcgagaugagaacugagauuccucagaaccaugcugaacccggccuggaagcccagugagacugagaacagccgcgcaguggggccagcaccuggccucgugcagcucugcuccugugggacugccccgagggcuuccuggaaagcagcuuuuguuuuuuccucccaguggagagaauuuuucacuaaauaguggaauagggaaauuagcuuaaauuacaggacacuaauuuaugcucacacauacacacacugagaggcaaaaagcauccauagcuaaauuagcaaaagaaaaucgcuguagaaagaaucaaagccaaagucaguucuucaaaaagacaaacccauugaaacuauucacaucacugguuuuuauagacugucauuuuucuaaguuggacacuggcagugauagugguuugccggaauaaaagcacacaucugcuaugacugauuaagaaagcugaggggggugggggugagaaagaugcuggcacaaagagccacucaggaaugaguggggaacagccauguuggagccauuaacaagaguauuauaaaaaagucauguuucuugaaacuucaguuuaaagauuucuuagaauauguaacuuacagaacugauuuaaggaagaacaugcacaguucuacgaacaugcaguucuacaaacaugaacaauucauucagcagucagaucuuccucaaaacuggaaguuuugauggauagucacaaggagguuguccuagcaaacauucaaaaaauagaaggccccacuuaaacugugaggggaaauugcuggccaacguucaggaucucuagagcaaaaagccugcacaaaagaacugcagacugcaucuagcagugauaaaagagaacaugucauacccaagcugaucuuaucccaggaauccaagguugguuaaauagcaacacucagagaucaggaguaaaacaucacgugcagcucaguacugaacugaagaaggaaccagcacccuacuucuccccgauaggacagcauuuucaccaaggcaggacggccugcaucacgaggcuguggccucccuccccagaccccuuaccucugccccgggccuccuugaguuuugcagugauccacuccauagcucuggcagagauuuugguuccaaaguuucuaucaaauggagagggugccccacccuguuggugguuagaguuauaugaaauaccaguuauacaguaacacuuugcuguuaaauagaaaugacaauuucuauuuugcagaauucauguuuuuauuucuagguccuuauaguuggaacagaacaaaaccugugauucccguagccugaacuuggccuguuaagaaaaaguaucaaguguuccccccgcucaguaagaugaggauuuuaauaaaccgaacaagucaacuaacaaucuucauuauuuuaaaaucuuaaaucaggauuucaugaacucaucugagcuggggaugggucacagcuuuaaucugauaaccguuguggauucuuuaagaagaucacacauaugccuacuauuucaucaucauugcaggggauucaugggcucuggcuuaaaaguauaagaauaggagguggugaggaaggagugugugcaaguuaggaggccuggacccugugucccaggcucagcucauaacacgugugugccugugugcagcucauuccaggucauucugacuuggggugucaaguauacuacaugucugauaauccauuuuaaaucuuagggaagcuccaguuuuuaacuugaugaaguguuuaauuugaauaagcauuuccaaguaauggggguaucacuguuuucaugaaagcugacaguucccuuaaaauccccauuacucaaaccucaccaacaaaagaauccuaaagcuggugauguuuggcaucacuuaaaaguucagauguuuuggcugggcacaguggcucaggccuguauucccaccacuuugggaggcugaggugggugaaucaucugaggucaggaguuugagaccagccuggccaacguggugaaaccccaucucuacuaaaaauacaaaaauuagcugggugugguggugggugccuauacugccaucuccucgggaggcugaugcaggagaaucacuugaaccuggaagguggagguugcagugagccaagcuuguaccacugcacuccagccugggcaacagagcaagacucugucucaaaaaguucagauguuuuuuaucaucuuggaauuuacuuauacauuuuuccccacaauggcuaaaauaagacacuaaucuuuuaaaagucacaugacaggggcuuuguggccccucaugcagucucgggccuaccugcugcaugugacccagcacguucuuccugcagucaaacacgccuuugcccucuucugaauacagcugguaaaugaagucggugguguaguuuucacugcagcucucauuucugaaacgagcgagaaggagucacuuuguuuagcgugcagugggcacguggcucccugcuuggggagauggcccugggaggcuggacucccgcaucccccaacccuauggugauucuacaucaacaccagucccuccaguucacgguuuugcuuucugcaguuuguuacccaugguccaguggucaacugaggcccacaaauauuaaauggaaaauuccagaaauaaauauguaaguuuuaaauugcacaccauucugaguagcgugaugaaaucucgugcucucuugcugucccacccagaacgucaaucaucccugugcccugcaucuccaugcugucugugccuccugcccgagucacucaguagccaccuugguuaucagauggaagcaaccucguguauacagggggcggguacuauccccagguucagacacccacugcagucuugggacacagucccugaggcuaagagggaugacuguauuuccuucuuucuucauaaacaucaggugcuaauuagggaaaugauugcaagauaucaaagaauaagagacuauaaagcaaaaauauuaguugucuaaaugcaggcaagccuuuagagcaaugcaccacagcugucuucugcaccugcucaguguguguagugcacucuagcggcaaagaaaugaccacucauccagcccaagucacagacuagaaucuaagaaccaggguguggcggugaggguaagaucagccccuggucucucucucucaccugagcacaaggccucucuggaugguggucuucauuuucuccgucaggugcuccacguuggacuggaagagaguauuuuguuaaucagacaauaaacuucuacuaaguaccuacugugugccaggcacugcaggcugggaagugccaaccaaguguggcagugagcguggccaaggaggcugcagcucucgcggcuugggucuuggggagccuccucccagauagggaggacacgucugcagcgaugaacgcugaggacagggcacggugagcagcccucacggcggccacuagcaacaccuuccagagucaacagggucccucugaaaaugguaauuccgugcuuugccuagugaucauucauggcucuauugcuccuuguuuauuugcaugacgauguucucggugcucucagaggaaagagugaccuguggccuuucuauggaaucucaugugacggccugaugagcagugucugaccaaagaauuuuguagacucacauucauacacagauuucuuaaggaaaagauggucuuagaguaagaacauccccauuucagaucauguuaggaggauuacaagagggagguaauucucuaaugauucauccuaagaaaauggagguuuuuacaucuaaucaaaucugucacugggcgcaauggcagaauuucacaaaguaggaggccaggcaugguggcucaugccuguagucccagcacuuugggaggccaaggcggauagauugccugaggucaggaguuugagagcagccuggccaacauggugaaacccccgucucuacuaaaaauacaaaaaauuagccaggcgugguggcaggugccuguagucccaccuacuugggaggcugaggcaggagaauugcuuaaacccaggaggcggaaguugcagugagccgagauugugccacuacacuccagccugggugacagagcgagacuccaucucaaaaauuaaagcaaaaaauaaaaaucugucauaauuucucuuaagcccuugccaugcugagcgcuggugaggcaggaucuuuggauagauuucugaaauacggucaugagucauguaacagggggauauguuccuugagaaaugcauugcuaggugacuuaagccuugcgcaaacauccuacagugaacucacacaaacccaggaggcagagccugcugcacaccuguuguuccuggcuacaaaccugaaugucugggacuguugaauacugcaggcaauuguguaucuaaacaugucuagauguagaaaagcacaguaagagauacauauuuuuugauaaaaaacaucuuuuuauaaaauauauauuauaaaaauauauguaaaaagauauguuuuuauaaaagauaaaaaacugcaccuguuuggggcagcuccauuauaaucuuaugggacccacuguugacagaaacaucaugaugcagugaaugacuccacaaauauuugacaugguaaagaaauucgugauucacaugucacauaauuagugccaaggcccuuuuuacuugaucuauuuggcucagaaacaaguaacauccuaacuuuuuaaaagacaauggugcugggcgcgguggcucaugccuguaaucccagcacuuugggaggccgaggugggcagaucacgaggucagaaguuugagaccagccugaccaacauggugaaaccucaucucuacuaaaaauacaaaauuagcugggcgugguggcacgugccuguaaucccagcuacuugggaggcuaaggcaggugaaucgcuugaaccugggaguuggagguugcaguaagccgagaccacgccacugcacuccagccugggugacagcaagacucccucucuaaauaaagacaauuguucaaguugcauuuuaucugccaaggccugucaucuugcaugaaguuuagcaacuuugaauguugcaggguccaggccuggauucugcugugucguccaagcaggggcagaccgcggggucagcgacacccuucccuaaaagagccacagaugccgagaaaccacggucaugucuguguccguuuagaggcagacgcagcaucaggggccucaggauuuaaaagaagcugcagcaaccuucagagccugucgcagacguggguggugacugucagcggagguucucaaaucauuggugacauaagugagacaacauuaacuacacaacagacuaugucaaacaaacaagcuuguguuucacacaugagacuagaagguguccucaaccaggcacacccaccgucaccugacacgcaguaggggcaccugggcgaugcgaaguguaucaagcguggcauguucuguagcaucuccaucuccaugccccuuggaaagcaaaccacccuagacacgaugauucacuccgcagcacccaguggaucccaaggggacgggcccugaggccagccccgucacauaccugcagaucccugaugucgaagggcucuucgaaaauguaugcggcaucagcuccggccgcgagcccccccauguuggccagguagccacaguagccgcccauggucucgaugaugaacacgcgccgcuugguuccgcuggcggacugcuugaugcggucgcaggucuggucacagagaagcgaucagucacuccagcccaggcccggggcgcgcccaccaucccagagcucccccaagagugagugcagcaaggcccccccaccgcgcccaaacaugcggucccagcaucccgcagaggugaagggugugcagcagccaggaugugcccucggagugggugugaacguggucccccgcaaccccaccauggcagccaccuggaggugaccucgaugucccguuuugggggccuggccaucugccgcucccuucucccaggccccauagaaggggacggaaaagacgaccccacaagccagcucacuccacgcugcucugugacugucccugcugaagccgcuuucaccggacacagacaccguuagguguuagcugagauguuaggggacuguccccugccagcuuaguccgugagaaccgcugugcuauucuauuuucuucugaaaagcucccugugauuuuagaggugcggccaucuuccauccauuggcgaauguuacauuuauggaaacucuacucaaaggcagauggugguucuuagacccaggcaccuggggaagucuuccagaugcacaggcaucggaucccagagugaaaugucugccauccgcccuccaugaggacccaagcucggcggggagaaaaauggcaaagaaaugcaucggccgccuucccacccauacaucaguccggcugcaacgcccucuuccugggccucagcucccaccccgggacccuccaauccguucacacagaaaggaccccaucuauaaaaaacauaaaucugauccaguucuugguuuauucaaaacccuuugcucacuucaaguacacaucaagccuuugucgggaauccccggccccgccugcucccggcaccagguccuguuccagccaccccagguccuccuggggccuuuggauaugcuggccgcugugugcaucacauuccggcacaguggugggcgggagagcagcccccaaaggaaucccaguccuaucccuaaucccuggaaccugggaaugcucccucaugcggugauaaaggugaauccuaggaguacccaggugggccuuaaaugccaucaccugcaucagcagaugaggggcgcagaggcugaaggcccuggagcgggaugcugcacacccacauggaaggaggaggcgccagggaacaaggcguacaaggcgugcaaggcccgcaacucugggcaccugaacgggccacgagggacgcuccuggagcaaacauucuggccucagcccauggcuccugcgcuccagagcugugggagagaguauuauuuuccagccccagguguguggucagugucacagcggccacgggacacacagaggcaccuuccucagcucugauccagaggaaaaugucauuuccucaggaaaacaccaccugguuucuaggaccacaaaguucccucugucaggggcucucggagccaccccauguccucucuucacagaaauuaucccggugucucucccugcaguuaccuugugguuauuugacuugggaggaucuuccucacuaggcugcaaauuccaugaggacaggaacugugggcugggcuuacaccagugcaccaucagcagcacccggccgagcccccacagcaggcgcucaagaaaugcuugucucugaaugacauaagcaugguauuccccagccagccguccguccguccuggucaacggcugauccugcaggauucccuaaugggccuccaugggacucagccaagaguaagagcaugaaguggggguguggacuugagacuaggagccacgugagagucugugcacccaaguuuaacacccauugggaaauguucacuugagcacuucggaugaaaucuaaaagugcacuuugauuaauaaaugcaggcuugauuaaaugauuccaaacuguauuuccaguuucuuuggcagauucuuuucuucccaaaauaauugguugauguauucaaaacugaacacggacucuaguuagcgggccacuuugcauuguguagaagccgagauggggagagaaacaggcaaugggaagaauucccaucuuugugcuuaggaggacagaggacagauccccgucaaggguccaaagagcccacaacugccuucuugaagggccagugcagaauucugaggguugcacuguuccaccuguaccgggucucucuaaaugugaucuaagacuuaagacgcuguaaggcuuuaagacuucuccuuugucuuagagaaucccaggcacggguggggccucaggacccccagaggcacaaaaccucauggguuacuuuuccaacugaaucucccccgcagcccacccugagguggggaauuacugucacucauucaaagaaugacaucaaccgcuuaauggcaaaagaauucugcgggcaaagcagcucucccaagaggcugauuugugcccaggcgugucugaguucuggucccgccaggcugccccagggggcuguggaacagcgcagcccugacaccugagccacgcccccgacugugugcucgucucaguguaaacgcagcgacagcugguacggaagaggccgccuuugcuggagcuuagauacagcuuuccugaacucucuccucauuaccuagauggcaucugaagccugaauuagcuucuaaaaauagcaagucacuccggccgugccucaggcaauuagucaaagcagcacugacaagaaggcggcagaucccaagcgcggcccugccugccugcaguguggcacggaggugccucccuggccuccgaguggguggaaggauggcagagggcugugucccagggcuggcacguggacagcagcugugaguggcacuugucaggcaaagccugugaccucagccguucccccugcacgaugggaugugcccccagcagacgccacccccugcaaggacgcagaggcgauccugcugcugagaaauuccccgaggagucccaugggagcgagagccccaggcuacaguucaaacaucaccacacuuugcuccauggguguuaagaaauauaaauugguggugaaagaaaagguggcguuugcuacagcauuaacguagaaaaaagccacugacuucucugugagaaccaccuugcucugugaaucugcagggaggccaguuuucccaugacugguaucccucacggcagccgagccucugcugaagucgguggccagacgggacaggggguggggguccugucccugcuacagcauggaacccgcagcaaagcacagcugcuggccaggguagggcugcgucgcguguggggcgcgaggguggaagugugcauggacaucuacaaggugcuaaaggagagugaagccagcgauggccggacccuaauggcauucacccaacaggggucaagugcggggcccaaggaaguccugggaaugagccagggccagccucugcaagaccaccacagcacuggggaacacagggagaagccuaggagagagauggccaggacacgccccucagcucgagugggaggcugaggcucggacucacaggaagcugcagccgaccucauggcuccucugcucccuucccugcacuguaacucagcucugaaggaaguacccggaauagaacugcugucuuccgagguucugugcuaagcugaacuaaggagucuccagcaggacugggaguuuucacugcaaacuccggagcuggcuuggacgucaagauguaagguaaaggccaguggcugcuguccccgcacgcgaugcaggccuaccccggccagcaguucugcuuugcugugggucccucgcaccagguggccaagucacggacgugaccccacaugucacgguggccaccguccugucugcagcugagugaggaccgucucugcagcaaaggccuguggaacuaccauaggucuucauguccagcuuaugaccauagagguaggucagaguaucagggaccggaggggccaccaugugggugucagcaccacacccacgacuggcagaauccaccccucccaaggcacauguuggugaaaccgccugcccaggagggcgugauuucggcucucuaaagagccucuugucucaccaggaaggcuguuuuccaggcagcggcccccaguggguacggcucuguccuggagcucguacuuaccgggcauuuacaccccuuccugcaggcucccacagcuggcccugcagccucacuacucagcgugggcaggagaggcagccuccagagcaaugguaccugcggcuccccuagucuaggugggauagaaacacgaucccaaggacuggauauaucaucucacuuuuaaucaauaaagacaggcucucccuaaggcagagaagcuaaaaaaauuuuacccuguucuggccagugugacauaaagccaagcuaacaaaggggagaaaagaagaagaauaaauccggcucauccuuagcacagaagaaacaaguugcuaaaauaaaugacggaaaagcaaugagaggaaacgggguucucuuaccucaacaacagcauucaggccagugucggagcccaggcuuauuucugugccugggacauuguugcuaaucguggccggcaccacacacagggggaugcaaagcuccugguggcggccucgugccucggccaugucgcacgcacucuuguaagccugaagcagcagggccaagcgguuagcgggggugccgggugcucaccugccagccccagggccugugcugagguccaggaagggacgggaggggacugagucaccaggggaagccgguucaugcgggucaaggggccgagggaggcucuggaggccgugcgagagcagcacaggccccagcaacacagggggccgccugggcacagcccagguccucaugaaagggggugccugcaggcagcacagcgggguggugugaggcaggcaacggagcagguugcaggcaacggcgaguuagucacgagugggacagcucagcucucggcgugucaugguagguaagggaggccagggcagucaggacacuuaaaggcaaagccaauccuguagcuuucugcaggcaggcaaggaucagugggauggggcacacggcuguaaggaccacaccaaaugcccgccuucaucgugcagaggcggcgcccaggugcaggcagggaagggggcaugcagcuggauuaccggugggccacacucagccccacgccacaucucugcucuccgggcggaagcugccguuucugcccucggcaagccgcacacaaagccgcacaggcgagcaagaaccugaguugcugcucugggguuccacugggaaaugcgcuccgguaucagaaaggggagcgguucuugagcccguguacaccgggguuuuucagacuccaccucaggguguuaaccaaagucacagcaggacagguccacacgcccacuguucccaccuccaaguggccccacacagcaagguguuuuugacauccacgugguggcaaaaccaacuauuuauggucuuggacguguccgucuuacugugaauauccccacaucugcugcagaaaugcuacuggugggacacagggcggcgcccacaccucccugggagagucggacagugagcgaucugggcucugcagcccuggugcaacgcaaagcaucccaaggccuggagcccgugugggccgagggcuucggacaguggguguagacccguggcaggugaguucacagcacgguggauaggaggguggggcgggugggucagugcugggugaccacaaggcgagcugugaacggggucagugcugggugaccacaaggugagcugugagcagggucccccgcaccccauggcacagccuccaccuccacccaggcccagcacgugcccagcucuugggccgcucugugcaggcucugccuggcaggcucuggccauggcaguuuuugcaggacuucaauccaaaugccagcugcuucccagccagcaacacucaugucggggcacuggcuggccuggugcccaggauguggccccucagcaccgccacgugggagucuccuuaugcuuuucagacaggugaugucgcucacuuuacuguggaauacccgagcucaggacugaccaagacuggcuguggggagccggcuguuucuccgagaagcgcucgcuggaagccagacggugugggugaccugggaccaggaggggccugaggcacacaggagggcaggugggggucucggcagcuuaacuccacauugaaaucuguggggacagccacaaugcugcaaauccucucuccccucuucccuaucacuccucuuuuccuuccuucagucuccaaaaaagggaagggaagcuucaauacgggggagacccugcccagcaaaacauaaaauucucaagaccaagcgcagccaggcugugaaucagucacgaggcuguggucacugccaccuucgcggcagcugacggcagcguggcagcagcuuacugugcuucugaugugaccuuaucgagcuuacaggacggaguaaugggccagugcuaaggaaugaaagggucggacugaaacucccugcagccguauccugagaacgugucacaccggcucugagguaucucauuccuucugcucugcccggaggaccacucaccagcaccgcauagauucugaggggcuaagcaucaaugcuggcaagaaggaaaucaugagagaggacgaggacgcacguguccagagaagaugaggcuucaccacaucagccccgcccagggcuuccgaagcacaacacggcgacauccugagccagacuccuauuauggagcccacccugugcucugagggacguuccgcagcgucccuugucuccagccccagaugcugggagcaucccuuuucccacuucuaaccagaaaccucccuggacguugcaaacauccccuggggcaaaaucaccaccccugcccccaugagaaucaccaaauuuucugaacaauagaagccaguauacuggagccaucuacagaccucaaaccuaaaugcugcccagggccaugccaugagucaccagucacagaggguguggccggacagggaagagacgcucacucccaugcguccucagccuccggcggcuucaggacaguggccggggggacccggagccauccacguccaguugccucacacccugauuuccugaggacgccaccagcucauguucuucuauggccagacgagcccaguucagacccaaauccaaaccuucucaggauucacacuguucggccgucaguaaacagggcucuggagaaaacagcugccauguucacauaucggucccucucccuucaggguccacagagggacccucagcggcuuucucuucucugucccagcuccccagcagccacagcauucgccagggugaccucggucagacggcgccacucacccaucacgagacuagaaccaccgcacucccaagacagccuuguuccuuggagcucaggaucagaagggcaacaaggacacacacaugcacuuaccaagguggcugugccuggccaacgggaggcucaacuaacuacacgcuccaguucuuucucagacauuguaaucaguuaacuucaggcccggcgcgguggcucaucccuguaaccccugugcuuugagagcccaagacagggggauugcuugagcccagacguuuugagaccagccugggcaacacagggagaccccgucucuauggaaauacaaaaaauuagcugggcacgguggcacccaccuguagucccagcuacucaggaggcugaggugggaggaucaccuaagccugggaggucgaggcugcagugaauagcgauugcagcacugcauuccagccugggaaacagagugaggcccugucuccaaaaaaagaaaaaaaaaaaaaaaaaaaaaaaaaaagaaaaaaaaagaaauuguuuaaccuagcuucgagaaacucgaaugaaugaaaaacugcauuuaaaacaaucgcauaauaaaucacacaaucccuccaagggaaguaaaagcagguggaaaugaucauuugugggguguuuuugccccacguauuuugguuuucauaaauuugacccuaugcauuuguuacauauuuacaaucugaaaaaaaaaaaaaaaaaacaguuauuuauagcagaggacccuggaauuaaaaagaaacucagcuaacugcagcgaccgcucucaaauucuccacccguucccucugggcgaguuccaauuagguaacaauuagggaaaaaagaagcuucagucccucccauugcacacccaacuuucacagacccaaaaaucuagcuaaagcaggcgaaagagcagugaaagcaaugacggaauccagucugugaaagaggcucaucuucacauucacagugcgaagguagguccagagccgggccagccccgcagcagcaaagccgugacacccaccaccaggagaacagaagcaacgucuaggucagagauuagcaacugccaaaaauaaggugaaaguugcccccaaagccagugaacacaggaaaaccugggcagguuuccuucgcaaagaaagugaagaaaguuuaaaacgcucagaaaagcaagaaacgagugcuaagcauuacuuaccauaugagcuguauguuaaaagcuuguuuuuuuauuuaccagugcuagaaauaaguuucaugccaagguuuuacaagaaaaaauaucuuugaaaaauauucaugagaaccaagucucacaagaaaaauuaaaacuugagaauuacuacaaacuuuuagacaucaaauuuuaaaaaaaugaaaugcuuucuguguuagguacggaucuucaaacucccacaucaauuaccaagcgugacacacaaacaugggaauagguguauauuucuuuuagccgggaaugguggcacaugccuguggucccagguacucgggaggcugaggugagaggaucaccugagcccgggaggucgaggcugcagugagcugagaucacaccaccgcacucaagccugggugacagaguaagaccccgucccacaaagaaaaaaagaagaauauauuucuauguuuuauuauugucucuuggcaaaaaaacuaaaguagcaccaauuauugccuuagagguaauuuaacauccccaguuuacaaaggggaaaaugaggucaacagccaagaccagagagauaacaaaugcaauggugcauucagggcaaugaauaaaauuauaaaauauucaguucaauuucuacccucagcaucaaggcagggguucaucauaauggguauuggaggcucaaagaaaauuuaggcucagcacacacacacacacacacacacacacacagcgauuuuuaaugcugguacaaucacaggagacugcgacccagcccuccucagcgccucgggugcucacgggcaccccuggagucucggccacacuacgucccccugguggccacacagaagaagaggugguaaaacucucugggagugagaucaaaaauuuucagagucuuaaaacauacuuuucugggggaaaaaaagaacgagaagcucucauucaggguauuuguaaaaggcuauuucuagcgcacugguagauaaaaagggccggggccccgggguuagcgucagccggcgcccgccuggcagggcgcacacggacuuacgucggugauaguguucagggcggugucugccccgaugcugaaaucggaacccggcacauuguuggacacaguagcgggaaccaugaccauggggacacagaacuccucgugcuucucccgggcggcugacagcuccaggagucccagguaggccugucagacaagcgugggaguuguggggcgagagggaagcuggggaggagagggucucgcugggagaggcugggagcgccaccuccaccacagcacgcagggagcacacuggggcaucacgaaaacacuccgagaucaacacacaguugccuuaagaccacagacaaggaucggcagguuguaagcacaaagggcgcaggacagacaugaucgguuagaugacuaaaccucucauggguaagagucucauuucugagguucuuacuuuguuuuuguuuuuguuuuuugagacggagucucgcuuuguggcccaggcuggagugagguggugcaaucucgucucacugcaaccuccgccucccggguucaagcgauucuccugccucagccucccggguagcugggacuacaggcaccugccaccacacccggcuaauuuuuauauuuuaguagagacgggguuucaccauguuggucaggcuggucuugaacuccugaccucaggugaucugcccgccucggccucccaaagugcugagauuacaggcgugagccaccgcgcccggccaguuuuuacuuuuucuaaaaguaaauggaaagguuaccaugggacuaaucuucaugaauagaaaaaauauuagggucuacaguccaauaugugauuuuaaacaaaauucuagguauaacuaccuuagucucuaaguagccacuggacucuggacucaagagauagaauuacuuccacaggccugaaauacauuaagagcucacugaauagaugaggcccggguuaaggagucaagcuuuugcuucucgguuaaguugcuuuacuggaacugggccacucguaggccacgucuuaccaccugcuauccugcuguucuacaauucuccaguggccgcugggucugggaaccuaucaucucggaucguggccaguagccaacaaguagcuuaauguuuagccaacacagggcgcggcucacaccugcaagaccggcaagagagaaacgguaacguaccucgaauccaccgaugaucagcagcgcguugaugcugugcgugcgcaucuguguggcgaucucuuccaaguacuuccccgggagaacgcugaaaauagccacguggagaacgaugucagacaccccaaacuccacgcgguccgcaggacgccacgccgguccccacccggccgccuuccccagucugugguuuuaauuaaggagcgguaaacgucugccuuuucacucaugccguuguggcuggcagauggcagaaugaccaggaaucucaucucaaaacaguguuuucaugagaaaauggaauaaagcauuucagcucauaccuugaccuaaaaagaacucuacugccccauuagaaaaaauaaaauuaagaaguuauaauuaauaacaauuuuuuuuuuccaagauggagucucacuuuguuaccaggcuggaguguaguggcguaaucucagcucacugcaagcuccgccucccggguucaagugauucucgugccucagccucccgaguagcugggacuacaggcgcccgccaccacgcccggcuaauuuuuugcauuuuuaguagagacaggguuucaccauguuggccaggauggucuccaucucuugaccuccugauccaccugccucagccucccagagugcugggguuacaggugugagccgccgugcccaauaauuguuuaaauggaaauuuccaguuuccaaauaacuuacauaugcauuauccacuauugaucucauuuaaaaucccaucugcucauaccugcucucccucccccaugcucucaccaaugucacaugacagggcuaacaagugcaacaccagacugugccccucccuggaucccaucccaagcccauccaaagguuucauguugauuggaagaagugaaguacuuguacucuugguagauuuauaagacaccguagggcaaaaacguucaggccaggcaaucagagcagacaagugaaugcagcuaagugcaaaccugugcuggccccuaaggugagguuucuuaagccucuucaggacgagcccacaacagccagcgaguccucucuacguucgagagcaacgcccuggcccuaucaagcaccugugcccggggugucagcagccaguccucagccccagaacgcacaccgagggaugcaucugccucuaccuagagcuuuaccguccagggcacccacacacagagcucaugagaacagccgggaggcagcuguagagcuaacccagcuccgaggcucccaccaucccaccaguggcugggaguaccaggguccuggcuguaaagcaaagcaaagggugcagcuaacucccuuggaacaauaagccggaauuacauggaauccaucauuuauuauauuugccaaaaacuaccuuccuuccaugugaaauuguaauguguagugaugacagagauuaauauucgcaccucugacaugaucaaaggugagaauuacucaggcuucaucuacauuaggaaaucccauuguccccagggaugcagggacgccaggcuuacuguaggucugaaaaagagauuuuuagacuagaauuccuuggguccuuuccucggcuguggaaaucugagccucgagucacagcugcucagggcuaugcuucccaccaaugcuaccugcuauccaggcugcuuuaggguuugcuuagagugccaucuccacggcuccgugacaccacucaucuuuaugaccuccaaguggaggcuuuaggcucgccagcuggcuuuucaaaugaauggaaauaugaauuagaggaaggcauucacaaguuaccuccucuucucucuuacgcccugggacacauccccagcucccuggaacacgggcaguuccacuggagggaggaccgguaacugccugcaccccucccuuagggacgccuuuccaggaauccaacuggcgucggcacccagcgauucucucccagaacacggcucuuccuucuuccuuaaaagcaggucauagaguugagauuuggaaguuaccguuuugucccaagaauggagccuccuuggccgguccagcccccgacaucuguccagccgauuucuuugaucuaaugugcaaacacagaacgaaacagcuaaagugaacaaugaaaggcaaguugcaaagugcuaaaaauagcuuucuguacuuuucaacaagcugcauuccgguaaagauuugagaggcguaugagacagcauuuaucacgaugcccggaugaaucaaggugagaagcagaaguccaagguuaacaacucaugaagagcagcagaggggcugcguucucccugccugucggggccucugugucucauccugagccacgugugagauacaucagcucaccguaucccgccaccggcaacuaaaagaaaaguaacaugaugguuucuaaguugguaaaagauuaagggaaaauuucuuuucuuacaaacuagggagaaaaaaggaaaacagauuacuaagcaaacuaagguaaucgcagaaagaggaugccacugcgaggacggcaggacugcaggaggagaacccguggggcucgaaccccagcuccgcagcuuccggucacgagauucuggguaaguucacggaugugguggacacacugccaugcugcagggggaucuccagguaaauuacauuagaaaaaagaucauucuacaucaaaagguaaauacuguacaagguguguauguauauauauauauauuugacagaaccauauaaaucaggcuuuuuuuucccacauaaaucaguuuugaaggcaauauuuuuuaaauaaagcaaauaccaguuuuaagccaauuaaucuucacaagucugaacaagaaagacggggaaagcaagauccacccaggacagaacgguuccucauccgguuccugcugcugagaugcggguggaugggccaacacagaagggcgggcaguggugguggaagguggaucaucuguguucccagggaugccacagggcaucuccaccccaccucucugccacuccucagucuccugggcugggguuuccucuucccacccuacucuuaacaauggcgcccugaggaaucaguccuggaccuucucucucuccugccugcacucaggcccucagggaagcucugugaguucugcaucuuuaacuacguggagacgcugaagauuccuaaacccaugagcucagccaaacccuccugaagaugcugggacacagcggcuuacugcacauucuuggccacgggacacacaccuucacccuggcauccccaguccuguccucagcugagggacacacaccuucacccuggcauccccaauccuauccucagcugugggacacacaccuucaccccagcauccccaguccuguccuccauggcgggacacacaccuucaccccggcauccccaguccuguccuccauggcgggacacacaccuucaccccggcauccccaguccuguucucagcugcgggacacacaccuucacuccagcauccccaguccuguccuccgccgugggacacacacuuucaccccagcauccccaguccuguccuccgccgugggacacacacuuucaccccagcauccccaguccuguccucggccgugggacacacacuuucacccuggccucaugagucuccgcuccucauccuaccugcaagaagugugucucagggcuuccuaguccucauaaauugcaacucuacccuuuccaugugcucaggccaggaauggagugauccuugccuccucuguuuaugccugcguguacuuagcaagcaaaccccaucugcccuccgugcccuccauaccuccagacccuugaagguuucucgccaucugcacaguagccagucuggacccaccaucucuugcuaggugacugcaaagccccggcugggagcccugccuccugccucagugaacagcagcgggucccuuuagaaagcucuuggugugggccagucccugcucaggaccuucgaaucucacauaacauaaaagccaaccuccucaggcugcccacaaagaagccggcccugccccugcaguucccauccucacugcccugugcgggcuuggagcccccgccccugugagcaucagcuccagagcauccuuucccuccaccugggaugaguguccccugagggccccaugagccaccagcagccugggagcaccuuccccagcauugcugucugggggaucuccagcaggcccuccucggcaugccucugagcacugcucaccauccagagagcaggaggauccucagccacuguccucucuccccaucuauaaacgcagucuccacggaaccagagaguugugucugcuuugcucacucauuuaauuccucagcauaagaauuccacaaaguaggaggcugggcacggugggucaugccuguaaucccagcacuuugggaggccaaggugggugggucaccugaggucaggaggucaagaccagccuggccaacaugaugaaaccccaucucuacuaaaaauacaaaaaugagcugggcgugguggcgcgugccuguaauuucagcuacucaggaggcugaggcaggagaaucgcuugaacccaggaggcagaggcugcagugggccaagaucacgccauugcacuccaguuugggcaacagagcgagacuucgucucaaaaaaaaaaaagaauuucacaaaguagguauuuguuggcuaaucagauaaacaaauagccacaaguucagccccuggucaggagcucagaauccuguuuccaguccucccucgugcacccagcccuaugccucgguuuucuugugaggaaaauggggauaacaucuuagauuuagugugaggcuuaaaugggugaacacaugucaaucccacagaacaacuggauacagcacacaucaagggguguuaccuguguucacuaagguuuguauuucagugggugcuugugcacaccagacacugccugcuuucccuccagugcccgguuuaaacaaaccacagccuccgagacaacgccaccuuccuucucaccuaaugucagggccaucagaccccagaggcacugccaucccccagcaccuuuucagaaaauucaaaagcacaucauacccugggcuccaucugagggccugaaaccuaccuuagggugagauuuuacuccagaagcaaugcuucagucacaauaucacaggaucccggacugaggcaugaaaagguaugagggccauggagggcacccccccgccgccacguccacugugcucacagccagggugucugccugccuacggcauccugggugacucaccuggcccuuggcgaagccgucaaagccaucauagauggcgagcauccuguggccgucggcaaugcccacgcgcacagcugagcguacggcugcguucaucccagccgcgggugcccccacguugaugacagcuacguugcaauuggucugcaaaacagaaggcaggugagugcugggucacgggcacacgugagcuccauuugcugcacacuuuggcaguggcucaugccgugccaggccugaaaacagguggccucauucacugaggcagaggccaugaggggaggcccgcaggagaggucggggcaucgcgggaggccggccaccuaccuuugggaucugaucauccggcagcuugauggcaagucgcuuguagguguucagguugcccgcaaagcuccuaaaggaaaagggugucguuggaccggagucgagaauaccggacacaacucagggcucauguggagaaaagguggcuuaucugccagcacucaaugugucugcccgacuaucugggcagaaggaggaggccccaggguuccaugugcauggcagagcccuuagccgcgacccgcggugcuguccgugucugguggaaauggacuaagagaaaagggcacgcuucuacacuucauaacuuucucuugcaagacaugcgugcgguggcucaagccuguaaucccagcacuuugggaggcugaggcgggugaaucauuugaggucaggaauuugagaccagccuggccaacauguugaaaccccgucuguacuaaaaauacaaaaauuagcuggauguggugacaugcacugguacgagcugguagucgcagcuacuugggaggcugagacaugagaauugcuugaacaugggaggcagagauugcagggagcugagauggcaccacugcacuuuagccuaggcaacagaaggagacuccuuuuuuuguuuugguuuguuguuaaagggccacaagucaccuugugccuuaaucucauuagcuccuaaacaaccaucaccuuaccaaaaaggaccaauggcaaauuuagaaaaugauuucucucuaaccagucaccagggccugcuacugcaagagcggugcugugaguacugccugacuuucugauuuuucacagugacauggaauaagcacaaccccuaagcacguuugcaguggcugggccugagggguguguguuccugacagggcagagcuuucuccaaagcaccucaccucccucggagucgaaccgcaucuugaaaucuccucucguccaucgccuucugcacauccugagucuuuuaaaacaaugaugaaaagaagaaagaaugugucaggaccuggugcaucauggaugggguagguagagacuggcucgguccuucccaccagcccccuccagucugacccgggcagccagcagccccaggguuaauggucuagacgaccggccgccaaguguguccuaaugcugguuggcagccagccccacacggcccggcugugaggucagagcccugggacugcuuagcucaggaggcuucugaggaaaaagagaaggugucaccugcuguuuguggacacaacacugugaagauuuaacuccaagagaacaaagccagaggaaaugaaaucucucaggcaugguucuaaggaauucucaauuugauuaugguggggaaaaacaaaacagaacacaccagcucacugggggaugugggaugggagcgaggucacagcgggcgggggagcagaggggcccggauggaggcccugggacacggggcugggacugaugcacgccaggcagcccugggcaacgucaggaucuuggucaaguucuuucucgcucugaacuucaauuuccucaucuguaagaugagaaaaauacuccuacuuccagcuaucucuaagguuauucaagcaugucagacccucaggaagacgccugacaaacagcaggugcacaguaguggucccucagcuuuaaaaacaaagccacacaagggugguuucaaggucagggcaagugacaccuaccacggucgucucuagacaagcagagacaugagacacaggcucaaaauacacguaccgcaugucguucagugcucugagccuuuuaagccuacugccucucacaugcacacaggcacacacuaacgugcagacacacacuaccucacacuccaacauacacacauaugcacauaagcauaccugcacacacaaacaugcagacacacgcuaccucacacucaugccaacaugcacacaucugcauagaaacauaccugcacacacacacaaacaugcaggcacauacuaccucucacaaacauacacacacauccauauaaacacaugcacacacagacaugcacacacuaucucaaacaugcucacacaugcauauaagcauacaugcacacacaugcagaugcauuaccucacacacauauauacacaugcauauaaacauacaugcacacacuaacaugcagaaacauacuaccucacacucaaauguacacaugcauauacacacaugcacacacacuaacaugcacacacacuaccucacaaaaacaugcacacacguacaaacaugcaugcacacaaacaugcacacacauacaugcagacauacuaccacaaacaugcauacucaugcauauaaacauacacauacaugcagacccaaacuaccucacaaacaugcacacacaugcauaaauauaugcauaaaccugcauguauaugcauauacagagauacacaugcacacacauauacauacauacacacagagacacaagccugcgcacacacucacacacauacacacaaauacuauuuucucccuugggcuuuuggaaauuauguuuacaaggugacuuucaacaagucccugacuugauugcuucacgacuucuuuguguguguuaagaggcaacaaaacaggagucacgaaucaugaaugaacucugaaaaauaaaacaacagcugggcgugguggcucaugccuguaaucccagcacuuugggaggccgagguggauggaucacaaggucaggagauccagaccauccuggcuaacacggugaaaccccaccucuacuaaaaauacaaaaaaaaaaaaaaaaaaaaaaaauuagccaggcgugguggugggcaccuguagucccagcuacucggaaggcugaggcaggagaauggcgugaacccaggaggcggagcuugcagugagccaagaucacgccacugcacucuagccugggcaacagugagacuccgucucuaaauaaauaaauuaauuaauuaaauaacuucaaaugcagcuaacuccacagccaccuccacuacugaaccaaugccugaaaagcuggaacugcuuuucccuuuguucauuugcaggcagacaguucccuggcccaagaaggguggguguaucuucgggugaccagagcuuucccugugucccaucacagaccugaauguccuuggggauaggaggacaggaaauggcugaaacuggagaaguuugggaaggucccaccuuccccuacaaaauaccacccuguagaucucucucacgcccgccucccugccucccugcccccucugccccaugggucucucucacgcccgccucccugcagucuguccacggaucucucucucucggcugccucccugcacucuguccuucugcagcaccuggugcacuggggccaccuggauccucgacuguugaggaucccgaugcucuagacccccacucaggggagguuacgacuaugugccacacagauggaugguaacuuagaaaaccaaagagcgaagacggcgcaggcucugcaggugugggagagaacauaagccuucucccuccccacgggcagcucaccuccuucucagaaaggccguguaaugcaucgugcaccgacgagacacccaaggugcccaggcuggccugacaagcagcuucugucccagccgucuccgcccugcccuuggccaugggcugcccacucaccaucugcacgcacuccaucagcggcaggcgcacggcgugguucccguucagugacacgacgcaagcugggguguccgggguggccucuagcaaggcgaugacugccuccacucccaugcggcuggccuggaaaccagguccaugugggucaggggcagccucccguccugcccugucccugucaccuccuaucuuuccaugacguccaaugaccucagucaggugcucacagccccucccgcuuccagcccaacucuuuagagcaaagcgauuuccacuccuuuagaacuggcaagacgggaacagagaggaggucagggcacauggagagcaggaguguuaagaacugaggguuuguacuugggauuccugcugcccugagucaguuuccagaaacucacuagaaacacagccuuucugcccugggauugugcccucugggguccacgucgugccaacaccaagcacugccuucccacauuagggagcucuccccgcaucugaauggcugcaggccuagagacuggucuacaccaaaggucucaaggaucguuaagaugagggccgggccgcgggcaucucucggggagcaccuugccagccucuguggccggcuggugccugugccucuccagaaacgcuuccuccuagagaccuugugaagaugcccaacccuucccaacucaccaagauccugucgaaugccgaaggggucccuccucucugcacgugcccgaggauggucacacgugugucauagcccagcugcgugacgacaagcugcaaggaaacaucucguuaggaugcggaacugugaugcggacacagcagcccagaucuggaaggagguacugggcacuggaaaagguuuuucgcucuuucuucagaucuaaaugggaaaaguuauuucuaaauuuuguuuccuagcagaacguuuaguguauauaacaggcagcugaaaauugguuuuaaaaauaauacuguuguuaccagacaagaucuuggcucgcaccuagaaaaugaauacaaguaauauguucguugcuuuaaaaaagaaaaauaaaaaaguaacguuucaguagcuugcauuuaaacuauuacuuauauuuuacaaaaaauguaaacaucuuccuugaaccagcuuuaauuuguucagcugugauuugaacagcacaagccagcccaaucaaggcguuccccucgccccagcccaugggcacaccggcccggugaucuggagaggccacugacugucucuggaacucagcuuauuccucuguaaggacaguggggcugggcuacguaaauuccuugguuccuucucgguccauuguccuauaauuuaauuacaguuaagcgggaaauaaaaucuuugccuggacuuuauggaugaccacuuauaaauauuggcagaugucuuucccagguguccaucacuguuuucauauccagagauaugcuuugcuccuuaacugaccauaacaaagcacaauaaagaagccgacuugcaaagccagguggggacgucuucugccccguggcugcuggagccacagcccauccccagccccggcagccugcagccccgucuacagcaggggcacagcccaugguaucagaguccucuccagacaggcaggcacuggccugagcaagucccagggcacgaagccugccaaagccugccaaagccuguucccaggcagggccacgaggacacaguggcuuuguaagaaugugcucagcugaugcucuggguuaugggagggcacagggaauagcaagacgccgccuuuucccacuguggcaaacagaagcccgggucggcugccaaguggucaguccucauucucagagcagcucauguuuaagagccggaacauucuaauccaaagaacacgcguggccacucgagcugacccccucugucugcuggggagucccggaaccucuacgggcucggcaagaggugacguaagcggaaugggcucccaggagcgggagcugcguguuuccccugccguccaacuucugagucauuaugaaaauguuuuaaauaucaaggauaaaaaguuaauaauucaauguucuaaaccaagccugcccaugacgcuagccuccccugcuuccaggcagaaaccgagagaaagugagcagcuacacacacucaccucuuugauuuucucagaggugauggguuuauuuuggguaucaauugcuccuucagccacaauaauaauauucagccuuuuuuuccgggcacgguucuguggagacagaaaauuaaagcucucaaauuccuaauccuguucuuagcaacaaaugcaacaaaaccacagaagucugucucaaacugaacuggccucuuucugggcaggaaucuuugccuaacuuccuaagagcugcuucccaaugacaucagaagguggugaaaggugugcugggugacagcagggagggacaggggugagaggaggggcaggggcgaggagaggggcaggggugaaggggcaggggcagggugaggagaggggcaggggugaaggggcagugcaggggagaggagaggggcaggggcgaaggggcaggggcgaggagggggcaggggugaaggggcagggcaggggcgaggagaggggcaggggugaaggggcaggggcgaggagaggggcaggggugaaggggcaggggcgaggagaggggcaggggugaaggggcaggggcgaggagaggggcaggggugaaggggcaggggcaggggugaggagaggggcaggggugaggacagggguaggggugaggacaggggcaggggugaggagaggggcaggggugaggagaggggcaggggugaaggggcaguggcaggggugaggagaggggcaggggugaaggagcagggcggcuguggcucacuggaagagagcucuuugggacugggagcucacaucaccaccgcagauagaaauguggcccccagucagccccagguggagggugcuggugugauugacagggguucccauggggaaggacacacagguggacgccccacaggcgccccgugcacgccaugcuuucugccucccauggggaaggacacacagguggacgccccacaggcgccccgugcacgccaugcuuucugccucccauggggaaggacacacagguggacgccccacaggcgccccgugcacgccaugcuuucugccucccauggggaaggacacacagguggacgccccacaggcgccccgugcacgccaugcuuucugccucccuccagaguuuccugccaucucccugugaaccacuccuccccggcccucccaggggaggccccgaagccuggccacugggaugagguuguauugcacacaggcuccagcagcagagagucgggagagagaaaacggcgugagcggacacagggcccagacaguggguuucuggcagcugcagcugcacccgaaaggccucacacugcugggccaccguggcugcuguccccgucguccuuccuaugcucacggcagucacgugagccuaaagaggucaugaaaggaacauagcgaccacuccaugauguggauuaacucauccucaauggacucgcuuucuauuaagccccaaauuaaagacccacccauagaaaaugauagggguggcuguguggagccuggagccaacagugccugaagucugccugccggaguuaggcacgcauggggcauucuaaccaggcucacucugucucagccucaggucuuaaaugaaaccucuucugccuugagucucagccuucauagaggaaaacaugccccacgcucacaguccauagagugaaauacaaagugugacaaacuggagacagagaaauuuuuucacuugcuuaaaaugccgucccacuugggauccugauuaaagcaaugcagccagcaucgcccgcuaucaacggccacgggacccgcauuaccuccgagaguuugacacacaucugcuccucccagccuuccucugguggagauucuggaaggaacacccaguccgcaccgcaggccaaggcacucaccagggccagguaccuauguggacaaggcaacagcaucaacaccccagaaggauccuucccacgagggcagcccaggcaccccgcucagcgacagacgugcagaccuaacgccagguaugaagcgggaugccggccccuucaggacuuuccacgggagcauucaggauguggggugcagccucagggagaugaugcugagggucccccaccugaaccgcguccaccggacccaccgcagguacguacccacagugucgucccaucaccuccagaacgaagguccucugguggcuggaagagaaacagagggagccccggacacagcucagaaagcagagaaacagagggagcacccacucaguccuggaaacagcucagaaagcagagaaaaggggcuuugacagccgaguuagccaggaggccugcagggaccuaggcuucaaaaaugguccauuuucuacuaaggcaaacgcuaugcaguagccuuccagacuccugcgaggaaggggacuugagccaccucugcgcucuccaguugcacguuggacaccuucugccugccugugccaggacacacucacacuccccggccccgugcugggcucuuucccagauaccuucucuauugggcacagucggcagcugcugucgacagccacggcuggaucucucccacggaaacaagugagugccagacucacuaagugcuuaaugcccagagacugugggucuucccagggaauggaaaaauccaacugcuccgagcagccuuccaacucggugauuuuccaccaacugugggguucacgcccacgcacugagaauguccagugaggcgucacugggaacaggacacgcacacagaggacugggaggcgccaugcuggggacuggauucgggcacucucccagucucgagcaccucguccuuaaaggggagacacuuauucuauuuaccauuccacaugguuuucaugcaaauugcuucagaaauuguacggugcgccccacagucuuuagugauaaccugcugagccuagagcaccucggaucaaacgcuguggcccccacgacacuucgugaauccguagguuacacagggcaggacaucgcuggcugcguuucuaaugaguaguguggaaaauccacacaacaguuuccugcuugccacuccuucuggagauguuuggguaggacauuuagaggauaauuacuuuguuucuuccuuccaaauucuaauaaacuguuuucuaucaucagguuaaaaacaaggaauguuuuaaaauuaaaaaugaaaaguagaccagagaacaauguucuggcaauagcuccuaaaagucaaguuacgagaccagcaccaggacacccaaucugcagaauguucuagagcccgugguaacgucugagcugggcacacgucgggccccacuggccucccgccgguuccucugagcgcuuuaccucugggccguggucaugauggcgucgacgaccucgaugauccugugcagggcggaguccgugccgauggucaugucggugccgcagaaaucauugucgauggagcccaccaugcccaccacguugagguaggcguacuucugcacggccuccuuaucgaucuggccugcgcggggagcaaacagcacgucucaucgccguaaccauggcgcguucggggggugccccacuaggggugaggcagaauggccauggguagagaaaucaaccauucuaaacucuuuguuauugguaucauuucuuuauuaucauuuuucugagacagggucucacuguugaccaggcuggagugcaguggcaccaucauagcccacugcagccuugaacuccugggcucaggcgauccuucugccucagucuccugagaagcuagaacuaugccuggcugauuucuuaauuuuuuuuguagacccacacucuauguugcccaggcgggucuuaaauuccugggcucaagugguccuucugccuuggccuuccaaagugcugggauuauaggugugagccacugcccuggccgauucuuuauuuucuccgaacucaaggcaaccggauucugcauaguuaaggaaagagaagccagacaaagcuggcagcaguuacacacaauggacucugucaccuggcacuuagacaagagcaguggauuagaaaaauaaaagaaaggauccacauuugcaaucgguaaacaaacaucucaguacuuccuggcaacagcuucagagaaugacacggcuuugaacaggauacguuacaauuacggaauuaagaaucuaagacacuaggccaucuucacacugauuucucaugcaucugugggaagcuggaucgugggugagcaucugccucgcacucaggacagaccugggcugggcaguucugcauaaagggaaucggaaccacugaagggccaggggcaagcuugggcccggacuuguggccacugucccggucugugcacucacugugcugugccagacgggaugagguggacaagcgggaaccgugaggccuggcugcuuccaacgggcagccuucuccauccccuacgaggauguucacaaaccuggggacagcugcuuugccucaaugccgccucucaucgaguugcuguuaaacaauaugcuucccuggucauauuuaauauugcacugaaauuacauaaccgcuucaagggagaaaaacuacacuuugggaggccgaagcggguggaugaccugaggucaggaguucgagaccagccuggccaacauggcgaaacccuaucucuacuaaaaauaaaaaauaaauaaaaaaauuuuaaaaaagcugggugugguggcgcaugccuguaaucccagcugcuugggaggcugaggcaggagaauugcuugaacccaggaggcagauguugcagugagccgagaucgugccacugcacuccagccugggcaauggagaaagacucugucucaaaacaaacaaaaucaaacaaucaaacaaaacaaaaauaaaccacauacacacagggcucucagaaacgcuuuccuaaguagugccaaaguugguacuggaugauguauuggcagagauuuaucgucuaaauaaauuaaaguccuguggcaacuucaguuuuuuuuuuuuuuuuuuuuuuugagacagagucucgcucugucgcccaggcuggagugcaguggcgggaccucggcucacugcaagcuccgccucccggguucacgccauucuccugccucagccucccaaguagcugggacuacaggcgcccgccacuacgcccggcuaauuuuuuguauuuuuaguagagacgggguuucaccguuuuagccgggauggucucgaucuccugaccucgugauccgcccgccucggccucccaaagugcugggauuacaggcgugagccaccgcgcccggcccaacuucaguuuuaaaggaccccagcgagcuggagggacacagugugagggcugaaaggcggaugcuagugucccaggcugcuggggacccggcucgccccacggcugaguggccguuugauuccucaucuguaaaugggaugaucuaaaaccuggcuuagauggcugucgugaggauuccauaaagcuaucugugugaaaggucgaagggugccuggcacaugguaagguuaaauuacuagcauucuuacgaucauugcuguuguuuuuugagauccuaaaaaguccugagauggugaccuguaagaucugugagaagagguacuucugccacagugaagagggaaaccugucgguuccaaagcucugaaacagggcgaaaacccgcaggacagaggagcagguguccacucaccguuccuggccagcuccuccagcagcccacuccacuccuuccggaagagguuggccccggugaggcucccguccccgccgaucacacacagguuggugaugccucgcugcagcagguugcaagcagccuucaggcggccuucccgcgugcggaaggccuggcaccgcgcacugccaaugaucgucccgcccugggaaagacaccagcuaauuuaucuccucucagucugagagagcgccagguggauggcacacacaggccgacuauaaacauggggugcuagaauuuacauuuuucucauuuucaucuugugaguuaguaacuagcuaugaaagacugugauuuuccuguuuuuagucccagaccagcauuccauggacaaagacaggcgcgugacacccaggaggagccagggagggugcagagccagacacacggcagccagcaguuaaauacauggagcaggaaccagccugcggugucacagcagccgccucagcaccggccaacgagcucaaccaggugcacguggaaccaaagacaagcccacugaccaccagagcaugccggccaggacaagggaagcggugugaccagcagccaggcuucucccuccagucaccccuuacagcaccugcaaguaaaaccagcaggaaccuggggccagggggauuuuuuuuuuuuuuuuuuuugcaccacauacucgcugccccuuuuaaagagcuauaucuucaggaucuuaaauucuuucauccaaacuuccaggggacauagaucaugauucgucacacuugguuuuccaaaaacuaagaauuguuggugggauccacaaaugcaagauuucuuuaaauaaaaccaugaaugcaccaaaaaacuccauccguacgggaucccuaagcgcgugcugacuuugucaagcaaggugcucauaagcacagcagggguugucucugcacuggaggcgaagcucucccugccuucggucugcaggcagcucccaggagaccccugcagugacgugagugcguguuucgauacaccaauggugcacgcacacagcucauuuucacacacagagacucacuaauauuccaaaucccagaaaagcuccuauuuuuacaugaaaccuaccaccauuuaauuuaucaaaacauuaugaaaagguuacaaaaacugaaauucacuccacacgauccuacgucacuggcaccaagugugaccgagaccauuuacaacccaacccccaaggcaagugagggugggggcgcagagcagggcaggggugcucucuggacucugccuggacaaaaaccuggggggcagcacgagagccagcacaaugggagcuagagccagcaacccagaaacuccaaccaaagagacgagguggccgcaacucaggaacgaaaccaggauaacugggcugcagaggagugggugccauucccauucucucacucacucucuuucacacacacacacacacacacacacacaccacacaccuacacauacaaggacaccacauauacacacaccccacacacagauacacauucgcuagccagaaauucacacaguuaacacauacacacgggcacaccacacauacacacucagacucacacaccuacauacagacacacaccagacucacacaguuacacacacaccgagauucacacaccacauacaccacacacagaaacacagacucacugauacacauacgcacuucaacucuccguucacaucuuaucuuccuccgucaaucacgaccgcagaauggaaacgcuccccugugugaauucagcccacacucuccugauguuuugcaaacguugcuccaccuaacuuccgugguugucaaaauucccuccaccucucuucugaugugucggagcucaggaggcgcccaaugcagagagagccuggaccagcacgaaggugugggccccaugagcgucuucagcggggaggcaccgauuuggauuauuucuauuaacaaguacucaaagugacucacagauuaacacaugcauuucuaaaaaucaaaccacaaguaaagagcugcucacaaagucuguucuguccacauaaucucuauuucgcaacugaucugagcucaaguguucugggaauuuacuagacauaaaagagucucuaacucagagaacccuguggacgcagcccaguaccuaccacuugcaggaugcuggagacacucucccagucggccucugcgauguuugagccuccguccaccaugcccugguagcccuaggggagaaagggagaaucuuuuaaaaaugagauaaacuucacuaaaugggaagugauccuuaaauuauauaaaacgggaaaaaugacagugaaugucaguuccucagcauccacuggucagaagacagggcaguuccagcacuggauaaaagcagugaauugugggaaaguccucaccuugagucccuaguaaugggaacgucugccuagacucagccucacagugcaaugaggaaucaagccauucuccuauggcccagcguuucccgagagguugaaagggucguguuucgcuagagguugaaaggggucacuuucacccaacguguuuaucauacuucagcacaaacucacaggcacacagcacugucgagcacgggacauacaugggagcauuuugucaggggcuccgccugccaaggcacccugcgccacuugggauguauguugaauauuauuaaacagcacagcugaauaauaauugucugccuuacccuccauuaaugacacggugcugcauuagggaaucagauaucaauaugugaggacacauugauagaagaagcccaaggacaauuaccuuuuuuuuuuuuuuuuuugagacggagucucacucugucacccaggcuggagugcaguggcgcgaucucggcucacugcaaccugccucccggguugaagugauucuccugccucagccuccugagcagcugggauuacaggugccugccacugcaccuggcuaauuuuuguagcuuuuaguagagacggggcuucaccuuguuggccaugcuggucucaaacuccugaccucaugauccgccugccucagccucccaaagugcuggaauuacaggcgugagccaccgcgccuggccaacaauuaccuuucaaugcuaaaugcauccccaucuuuuucuccacggaauauacaagaucaggaaaugcagcaaugcccacggguaacuucaucuacauaacucacuuuccacagcauuuaaucuuaagaaggaauaacuauuaaggauuuagaaaaguucaugauagauuauuguuggauccauaagcccaccuuagugaagguccggaggacagaaaaaagaaagguuuuuaaaauugaaaugacucauagauuauggaguucuauauauaaauuaaucaauagugcaggcaccuugauagcuggccaauuuguauacuuauauuuauaaauuucuaccagaaauauuauauauauauguguguuuauuuuauuuuauuuuugagacagagucuugcucuguugcccaggcuggagugcaguggcacgaucucggcucacugcaacuuacaucucccagguucaagcaauucuccugccucagccuccagaguacuugggauuacaggaacacacuaccacaucuggcuaauuuuguuuuuguuuuaaaguagugacaggguuucaccauguuggccaggcugguuuccaacucuugaccucaagugaucugccugccugggccucccaaagugcugggauuacaggcgugagccaccaugccuggccacauguguguuuauaauuuagugucauacauguaauaaacaagaaaggagaaaacagucuggaauggaacagaacccaaaacagagcugguucauuucagcgcuggcagccccgucugcaccucccgagaccccccaggcacccaggcccuggcucacaggcugguacagggacugcccaucaccaggcccccuaccuccauggcaaaacagcagaacaucuucuaaacacagcccagucucacucuagggauuauuauuauuauuauugucuccccuugcucugaaaacagauuucccuugcagugcagaugagcccaguguagccgucccccggagggcgagggugagcaagugugaggucggaugcagaccucgccucugcacagggcacccugggaggcaccguuuauguucuguccugcugcggaugcucuguccacacaaggacucacugguaacagacggucaugugcaaagccaugaaugacucuuggaggccauaauccucagaauauuguaaguacaauagguagguaggcggguggguggauacauaaauaaagagauaaccuagccuugggguugcaguuucagugaucucuaccaccccaaacucccagguuuuuuuguuuuuuguuuuuuugagacggagucucgcugugucacccaggcuggagugcaguggcgugaucuuggcucauugcaagcuccgccucccggguuccugccauucucccaccucagccuccuuaguagcugggacuacaggcacccgccaccacgcccggcuaauuuuuuguauuuuuaguagagacgggguuucaccguguuagccaggauggucucgaucuccugaccucgugauccgcccgccucggacucccaaagugcugggauuacaggcaugagccgccgcacccggccucccagguuucugcuaagaauuaugcuucauucugcaagcacaacagagcgcuccauucuucaggucugggagcaacacugaacaaacugccaucugcagugauccugacuuuccagauugacuuccaugaagcucgggggggcaaggaaacaaggaagcaggcauguagccugggccaccgugaaacggacccuucuuagaggcacgaccucccauccuccaagcccacaucucaggaggagagaaaagaugacccaugauggggccugaacugcagcagaaaccgggaccucccugagaggacugggauguagagcggccguaaaccuggggcuccggcaaaacugaaacagacaguuccuacauucccacacccagagcuguugcggucauuucugugcaugcaguuuuuugguaaauaaagagaccggggggaaggugccaguuccggccgccacccugcugaagaggaugccaaggccgcugcagcauccugaggccgucucaggcccaggagucaaccaugcaccccuaacggcaucagcuuucagaguauuccuggagcacgcgcuaucccggacgcugcuuccaagucaaccgccacccagcauuuuacuaguuaauaugccauagugggaaccauacaauuuccuuucccugcaugaguucacagaauuuaaauacggauuuaaucaaacauguuaacgaauccucuugcuucuggaguaguaagaaaacugcucugcaaaccacaacauuuugaaaaguaaaauguucucugaaaguaauuucauuauuuuguguugcauagaugcauguggcaaagaaagccauuaaaaaauagaaagggagggcuuucugagugccaccuccaaugcucccugucuagugcaugcgugagcuaaguugcuaggaaaugacucauucuuuaauuugcaaagucacgacgcccauggaacaugugaaaagcaacuaccagccgcaguucuaagccgucuuucaccaacaaggaagauauuacuaaauuaggaagacucauuuugcccaaacguacuacaacguagaaauucagaugaguuuucucuuuugaagucuucuuagaaggcugaauauuuaucuuacuacagccaaagcccagacguuuccuaaaacacccuuuuggaauuugccuuccaagccaguuuuaugacucacauaggaaaaacagagcauaaaaccuuuaaccuuaucucaguuuuuuggccaaaguaacauucucugucuuguugacucugacucacaagaugaaccuuagagcuccucguuggcuguaucggauccaucgucggacagaauuuuuuacguugagucauucgaucacaucuaagaacaugccacaggcucugaagucauuucaacuuauucgaaauuguuuugagcugugucaaaauaaccagccuucuaaccauguaggagaucauucuauauguagaggugguuuugacuagaauuuuuaggcaaucgccgaauccaucauaaauggaguaagcuaguucaccuaugcgcguaguucaccuauggguggcuuucucggacgucucauauguaaguuuuuuuuuuuaaaguuacagacaaagggaaauuauaccguuguguugcagcaguaggcuuuuucuuucagaaugcuuguugcauggguccaugugucuucucaacuggauaaugcuuuuuuccaaucugauuuccugaauucuucacucaacuaacuccaaauggugaacauuccaacuaccagaauaaaacaagcuccuagagauaacagacuuuaaaagugccuuccagauaguguuaucaccagcuuccugcagacauaguuacugcauccagagauguaggggcuuugcugcuucugaguaaauacuauuuuuuuuguuuccuacagaaucaagcuuucccuaguuuaauccuuuucccucccccacagaaccuaaagcuacaacauuccuuaauaaauuaaagcauuucacuuuuagaauucagagcaugcaugcagaggucagcucugaacggcucucuaggcuuagacuugggaaacaccagcguuccaaacuaggugugcgagaaagagaggcggcaggaauuucacuaugucaaugguuuucaaaggccaggaaucguggcuuuauccugucucuaggaaauucagaggcagagccugagauuaaacagccccacaccaacacacaucccaagcccugcucaccuccccaccaacacucugaaggaacgcucuuguccagagacccuaccaaucaccccagcaaagcacccucacugauuucauuacuugauagaaaauuucuauagagcagccucaggauuucuucuugggagacucagucaacuguaaaauucuaaaauagguuagcacacgacacaccaucaugugguccugcacuugcuucuuuggaagaccaauaaugcaacagcaugauguauuuagcccucuggcaucacagauuucuuuaagccaaagcuaagagugcacaauuccgguaaguuguacaaccaacagccccagcaggagcgaggccggucgcccuuccuccccuguagagagagggucccaagcacuggccuggcagugaccuuacagcaaaccccaccuugaggcucauucagcugaccacagugguggggaggugguggugaagggagauggugcucuucugcaguuugaaauguucacugaaacuagauugucugaagccacaggcaaugguguaaaugguggugggaugaaggcagaucauacaugaagaauucagcaugggaccuggcuggcauauaaacauguaauaaaagauaaugcuacgacagaugcgguggcucacgccuguaaucccagcacuuugggaggccaaggcgggcggaucacaaggucaggagauggagaccauccuggcuaacacggugaaaccccaccucuacuaaaaauacaaaaaauuagccgggugugguggcgggagccuguagucccagcugcucgggaggcugaggcgggagaauggcgugaaccugggaggcggagcuugcagugagcugagauugcgccacugcacuccagccugggugacagagcaagacucugucucaaaaaaaaaaaaaaaaaaaaaaagauaaugcuuguuccugugguuaucgucacccuggaugugucaauuuuguuggacaauguuccaacgauaggcagggagugcagagcagaaccaggccaccucaacuggucuucuaggagucagccagcucggugagcacgcacgcguguuaguggaaggcaugggcucugguaaagacccuguagagucaggucgggaacagcuacacguaagaaacugcacagugcugugcucaagcaucacuuauuuuuagacagaaguggagugguugaguaguuuucacuucaaggaaguuaaugggcagaaauaguuauguuuaaaacaucaaagagaugugacugaacgggauguggacaaccuugcuuggucuuucaacacuguugggggaaggugggggugacagucagggaugggaggggugagacagagauuuaaaaaaaaaaaaaucagacacagucccagaagucagggccaaugcugucaccugcucuuugucuugccaacuaguuuccacggccagccccuuccacacaucccaggagcgggagcucaggcuuccguggucacccccauccacacaucccaggaguucaggcuucuguggccacccccuuccacacaucccaggagcaggagcucaggcuuccauggccaccccccuacccccauccacacaucccaggagcucaggcuuccguggccacccccaucuacacaucccagcagcucaggcauccuccagauuaggagaggucccccacaccccuuuccucagacaggggagcaccagcacuucuggggaaaagguguuuauuuugggucacaagugugagauuucucacuuuaaaaauuguaaaagcaggagcuucauuuuaacccaaaagaaauauuuccuauggcuaaugaagaaugaaggguuucuaucaggaagggaaagguuuuuuucccccauauuuuuucaauuuuauugacacauauaauuuuacauauuugugggguacaugugaguaucuguugcaugcacagaaccuguaaugaccaaauuaggguacuggggugucugucacccuggguauuuuuaacuucaacccauucagaacauuuccaguccucucccccagcugcucugaaauacauuaauauaauacgcuguugcuaacacagccagccuacuccgcuaucaacacuggaaccuacuccuaucuaagcauauguuugcacccauccaccucucugcauccccuccuguccacacccccuucccagccucugcuaucuacauccuccucucuaccuccacgagaccaacuaaagaagggaagcaugaugccaaucaauucauugauaaguuaaugguuuguuuauugguauaguaagucaagcuguaaugcucagggcugaaacaagggaagcuaagaucacaugcugauauuucaagcucagaaggguuggccagucugggugcagggacagggcugcugaccgggggccauggggagauggagacccucgggcaccugagcuaagcuugggggccgguggcgggggucagguggcacaggcuccauggcagcacaucugggaagaccagaggcuggaugcugaugcuguaccaacacccuuuauccuuucaacauaaaaaggcaucacuuaucugacaccuuuugaauguguuauuuuuaaucauggaaaaaacuagcgauaaaaugaucagaauuauuccuagccuuucuuuaggguguggacuaugacaaagacagcucugauauuguuuacaaacagcugucuagagcagaaccaaacuuuaaaacaaacaaaaaauuaagauaaaagacuuuuuucuuuuucuuuuuugacacagucucgcucugucacccaggcuggaaugcaguggcgcaaucuagguucacugcaaccuccaccuccugaguucaagccucagccuuccaaggauuacaccacgcccagcuaccuguuguguucuuaguagagacggaguuucgucauguuggccgcgcuggucuuuaacuccugaccucaaaggauccauccgccucagccucccaaaguacugggacuacaaguaugagccacggugcucggcaagaaucuuaagugagucauauuugaagagcuauaauaauaugaacaauuucugaaaucugcagaagaauauucaacaacaggauaugaaauucaugaaugaaaccaaaugcaaggagccgacuguuuccugcagacacaguggcagcccuggauuaaccaacugacucgccccagcuugguuuggacccaccagagccaggguaguuuacccugggcauggccuuugggucaaagcaucugauauacuuaguaucaucaucuccaagaagcuaaagccauuuguaggcuucuaaggaaaaaccuuagcuuaagagaaaaaagaaagaagcaacaauugguucaccagguagaaaggaauggguuaacuggcaaacccuccccgagucucccuggaaugcagcccaaggcuuggcaugcuucacacguaggcuuggcccagguuuauaggagcucaagcagcggccagacagcagaggucccucgaugaaggccaggcuuucagcagaaacgccacuguucccagguuaauacuuucuucacacaugcacuacugaaggaaaaaacaaaccccuuuaauuaauaguaaccuguuuaacuguccuggucuguugguaacccagagagcucuagguuagaaacuagaguauaggugaaaaaaaucuguuggauaaauuacugagucauccuuaaaaaaauaaaacauaauauccccucaauuugagcccaaauaggucuagaacagcggucccccaaaagagugauuuuccccccauaggacguucgccgauguuggagauacuguaaggacaucuuugacugucaugacuaugggguagguggacacaggggugcugcuccgcauccugagagucaaaggaccgcccaccaagaauugcccaccccagaugccaucgcccugacacucagagagaagcccagccuguggguaugacgcagagaccaggccggggagggggcugagccucuucagugcagagccaucugugaauagauguguucaggugcagaccccguuucccuaccuggccacacacccauggagucaaaggcaugcgcgucucaucccugaaaagcagucaaacagcuccucugccccguuagucucagacuuuuccaaguccuuucuaccagggagacaggagggcaaacaccauuucuacugcacagaugagcacacagaaaugaaagguugauuuaugcauccacagucacugcaguacguccugcaggcccacgauggcucacccaaaacccaggucugagaggcaggccaggacucagaagacuugggauuuuaaaaagcagguuuucuaauggcuuaaaaauauuccauugcguauauacgccacauuuuauccacgcacccacugauggccacuuagacugauuccacaucuugauacacaauggaauauuauucagccaauaaaaaagaaugaauccugucauucugagcaacauggauggaacaggcagaaauuaggugaaauaagccaggcacagaaagacaaauacugcaaucucuuacucauacauuuaagcuuaaauaaaaaauugaucucaugaagacagaguuaggauugaucucguggagacagagaacagaaugaugguuaccagaggcugggaaaaguagaaggaagcagggguguaaagaaggaugguuaauggguaaaaaacaguuugagauagaaggaauaaaauccagggaugagugauacuauggagcgacuacaguuaauaauguauaauaauguuuaauaauauauaauaauguuauacauaauguauaacauuguauacgauauguauaauacauauauaauucauauuauacauaauguauaauaauauauacauaauauauauucaaaauaauauuucaaaauaacuaaaagaguaaaauuggaguguuccuaacacaaagagaugauuguucuugaggugauggauaugcuacuuacccugauuuuaucaugaugcauugcaugcuuguaugagacuaugacaugcauagaacucccccacaagccagcagccccacugcugggcauauaccccgagaaagggaaucggcagaaagagaccuccgcacuccuacauucacuccccaucacaacagcccaguguggaaucagcgcccgucagcggauaaauggacaaagaaaacguggugcacgcccacaacacaacaccguucacccauaaaggagaaaaccccaucauuuguggcaauggggaugaaagugcuuuacuguuaagugaaauaagccaggcauaugggcguggugguucaugcuuguaaucccggcacuuugggaggcccaggagggcaggaucaccugaggucaggaguuugagaccagccuggccaacauggugaaaccccaucucuacuaaaaauaaaaaaauuuagccaggcgugguggugggugccuguaaucccagcuacucaggaggcugaggcaggagaaucgcuugaacccgggaggcagagguugcagugagcgaagacugggccauugcacuccagccugggcaacagagcaaaacucuguauggaaaaagaaauaagaaauaagccaggcauaaaaagagaaacauugccuguucucacucauacgugggagcuaacagaguugaucucauagagacgagaacugcaauuaucagagguauggaaggggagggguggggaaaagcaaggauaaaagggaagaagacuauauuucugaacucuaugcccacaaauaguaaagaugguaaaugauauaugcauauuuuacuucaauaaaauaaauuuuaaaaaaaucacauguaccccauaaauagguacaacuauuauguauccauaauaauuaaaaauaaaaaauguuuuaaaaagcagugaguguuacugcacccauacucugggcccuugggagugcacggcaucaaacccaccccugcaaagagaggugggagccgucaccucggcugggugacgggaucacccccaggcaacgcgcuccaggucagccggggcuuugcugcccaguuaggaaaacacucacagauuuuaguguguuuucuaucuuagaauuaaagacuuggaaccaccccaaaugcccaucagugauagacuggauuaagaaaauguggcacauauacaccauggaauaccaugcagccauuaaaaaaggaugaguucauguccuuuguagggacauggaugaagcuggaaaccauuauucucagcaaacuaucgcaaggacaaaaaaccaaacaccacauguucucacucauaggugggaauugaacaaugagaacacauggacacaggaaggggaacaucacacaccggggccuguugugggguggggggaggggggagggauagcauuaggagauauaccuaauguaaaugacgaguuaaugggugcagcaaaccaacauggcacauguauacauagguaacaaaccugcacguugugcacauguacccuagaacuuaaaguauaauguaaaaaaaaaaaaaaaaaaaaaagaaugaaagauacaggauuuuuauaucuguaacagcaaaaugaugauaccauaaauggauucaacauuuauugcuacagcugguuauagaacccaccacucauacaaaguccuggcggucugaggguccaugagaauuuauguucccaagacgcccagagguaggugccugggcuacacuggaggaaggugaagaaauggacccguucacuaggauuucccaccuucuggggcagguggggagggugccagagaggaaauuugggcucaaaugagcugauccccaggcugcuccuaucuuccucaguaagauaauuccaaaagccugaucauucuuugugccaaaauucauaaacaguccauucagcucugcuccuagacagcuucgaaggugccacuuacuauaaaaguuaucauaaaaauuagaauucccccaaaacaccauuugcacacaaggauuuauuuuggccacaucucagcagaagaauugcagaaauuccgugaauuucccuaaaggaaaugagaucucagagucagaaccccuccuuccccaccgagggcaggggcaggaagaggcgcuguccccgccagacaagguuguccagaccucguccagacagcaccugcggccauggagucacauggaugggccucagagccccagcccucccagcugagacagagagaacauauggguuuuaccucccaagaaagcccagggccucugagccaggugaggugccucacaccuguaaucccagcacuuugggaggccaaggcaggugaaucacuugaggucagcaguucaagaccagccuggccaacauguugaaaccccgucucuaccaaaaauacaaaaauuagccaggcacguaaucccagcuacucaggaggcugaggcaggagaaucgcuugaaccugggagguggagguugcagugagcugagaucacaccacugcacuccagccugggcgacacagggcaagacucugucucaaaaacaaacaaacaucagagaaagcccagggccucugggguaggccucccaguguguuccauaccaacuccuuaauucugguacauaccacacagacagcaggcacaggucugaggacaucugaaucccaccaggaaacagacgggcgacuacagcacacagugaccaauaaaaaucagacacccgacaaucgccacaaaaacacaacccuuacaucaagagagauuaaagugggccagggacugcauccaagauuaggcccucacacuccccucggccucacuccccaccccuccccagcuaacaacauucaaaccaaacacagugugcgcuugguuuagugcagggucccucggccuuguuucuaccaacauuugggucuggaccauucuuuguggggugugguccuguccaucguaggaugugcgguagcaucacuggccucuccccaguacauuccaggggcaauccuuucaauaauggcacaaucaaaaaaugccuccaaacacugguaaacguccuaaggggguaaaucacucccuacucccggcuagaggccaggggucggggaccgaacucuguuccuggcccugaacaugcugaguggugacgcggagaaagugaacuaagguaagucaguuuaucugugaaauaagagaagugauuuccuuccuuuccucugcacccagagucccugugaguguucaggccgccacuucugugagggaacuaacuuccacucaacacacaacagcgucagggccgcgggaacaggagcagccgugaaaaucacaaggcauccugggaaacauucugugaacuacaagucuucaugaauuuaaaaacauuuugcgaauuauaacagaaaaaccuccucccaggauacuccauccccaaacagcuuuuaaaaccacauuucuguacuaagagcagcucucaggacgggugugguacugucucccaaaguccaaggcagaucacacccacccucucccccgcccacccaaaaaaaggcagagggaacaaauucaguaugcacauguauaugcuccagcagcagcggaaacuaagcuggucuucgucaggugcaggugaccgccacuucuggaagucugugugcaaauuccagcgcugggggcaggguggaggacaaugcuggggagggggcggaggacugugcuggggaguggagugggggacugugcugaggaggggguggaggacugugcuggagaguggagugggggacugugcuggagaguggagugggggacugugcuggagaguggagugggggacugugcuggggaaggggugggggacugugcuggggaaggggugggggacugugcuggggaaggggugggggacugugcuggggaaggggugggggacugugcuggggaaggggugggggacugugcuggggagggagugggggacugugcuggggagggagugggggacugugcuggagaguggagugggggacugugcuggggagggguugggggacugugcuggggagggguugggggacugugcuggggagggguugggggacugugcuggggagggguugggggacugugcuggagaguggagugggggacugugcuggagaguggagugggggacugugcuggagaguggagugggggacugugcuggagaguggagugggggacugugcuggagaguggagugggggacugugcuggggagggggugggggacugugcuggggagggggugggggacugugcuggggagggggugagggacugugcuggugagcgggugagggacugugcuggagaguggagugggggacugugcuggggagggagugggggacugugcuggagaguggaguggcggaccgugcuggggagggagugggggaccgugcuggggagggagugggggaccgugcuggggagggagugggggaccgugcuggggagggagugggggaccgugcuggggagggagugggggaccgugcuggggagggagugggggaccgugcuggggagggaaugggggaccgugcuggggagggaaugggggaccgugcuggagaguggagugggggaccgugcuggagaguggagugggggaccgugcuggggaggggguggaggacugugcuugggacgagguggaagacuguacuggggaggagauggaggacucuccuggggaggggguggaggacucuccuggggaggggcuggaggacucuccuggggaggggcuggaggacucuccuggggaggggcuggaggacugugcuggagaccgcgucuacugugcucauuccacaucccugagcaaggggcagcugccaccagggccaggguccaggcagggaaacucaggagggcaaucugaccuuaaaaacacccaaauauaaaaugauaaaaacaacagccugggaaugcuacagcuagacccuccguuaaaauugcccaaaucgcauaaauacaaacaauaaccacguaaccaguuuaauugaauaaaagcaaacaacaaugacacgaacaaaaaaaccucuuuccagcaaaugauaaacaaauggauacacagauaaaugagcaaagaauaauaguagcaaccauuucaccaaagggaaacauggcuuagaaagcagacaggggaaaccugccagugcucagaaggccgccgcacacagcggcacacagcaucaucaugggagcuagagcaccgccuucccugcgcggggcugggacgaggcuggacagguuucaggaauuacuuaggcaagaggcaucccaagccaucaugaugacugucccuuuuagcucagucggugccugauauuaggaccaagguauuaaauaauacaaaacaucaaaucgcuuugaauauuaacauagaucuugcaguguuacaauagcuuaaaaaacggggagaaagcuaaauagugcaauaccacaggaaugguggaauacaggguccaucauaaaugaugagacaucaauucaacaagacaguauguugacauuuaaagcaacaguuggcugggcgcggcggcucacaccuguaaucccagcauuuugggaggccaaggcaggcagaucaccugaggucaggaguucgagaccagccuggccaacauggugaaaccccaucucuacuaaaaaacacaaaaauuagcugggcaugguggcaggcaccuuaaucccagcuaugugggaggcagaugcaggagaaucauuugaaucugggaggcggagguugcagugagccaaaaucaagccauugcacucaagccugggggacaaaagugagauuuuucucaaaaaaaauaaaauaaaauaaguuaaagcaacagucgugaaaccuacguagugaaaagucaugacauaaucguaaacaaaaaacacaguauacagaacguguuugcuguacuuuuccuaauguguguguuucuuuccgguguuuuacauacgucauacugaaggaaaucagacuaaaacacuaauagccauuuuggaggcauuaagugauuuacaaaaauaccuucuucucauuuuuaaagcuauguuuuauaaauuuaaacauuaaauauuuuuccuaauaauuucugaaauuaauacugugauccaaacucuauuggugccuuccuuucaaauacuuuuuagucuuaaguugccaggacuucaaaaguggcagacagggagucacuccugcuauuuaacacaucagcagacacuaggcaucguuuccaccuuacaugaaugaugaaaagcucaaaguggcuguuuuccucauuucccuaaauguguauucaaauucagccuacauuggaaauuaauaaaucacuucuacagcaguaagagccucagacaaauacaaccaaccaaccaauacaaccaauuagagaucauugguugauuucuaauccuauaaaucaacaccaggaaguugauaucaacauggccuuuuguggcugggcacaguggcucacaccuguaauaccaaaacuuugggaggccaaggcggguggauagcuugaggacaggacucagaccagccuggccaacauggugagaccccuucucuacuaaaaauacaaaaaauuagcugggugugguggugggcaccuguaauuccaucuacucaugagacugaggcagaaaauugcuugaacccagcagguugcagugagccaagaucgugccucugcacuccagccuggacaacagagcaagacugucuaaaaaagaaaaaaaagaaaaaagaaaauggcuuuuugggcucccucucaucuccuuucuccucuugccuaacaaaaaacuugcagaccaggcaucugucccugcagaccaggggcuucugugggcugaggaacggcccuggcuggcaggaucuugcuccccugcccaccucuucggcugugcucagcaugggggaggcaggggugagcgagcgccggugacugcagggcucugggcagguggaagaagggcgacagggggugaggggcagacacugaccucguagaugaaguacaccuuggcccccacguagauacccaugcgcaccacggcacggacggcagcguucauaccugcaguggaaacaggagcaagagucacugaagagcccgggguaauucuggcucugccacuaacuacccaugaccauggguccguuuccuaaccucucaaugccucauuuccuaauaugagaaauggguacacacacuccucugggauuaggguaaggacuaaaagaaacagccaacguaacgcaagguacccccaugcccaggcuacuuucuguucaaaacaucacugccuggacuugguacgaauuuguaggccacuccauucaacugcaaaacgaaguacagaauagggguuuauuugcagcuagccaaauucugugugugugugauuugagaaggagaugaaaaauggaguaucacaucaccaacuaccacuguaaaaaaaaaaaaaaaaaaaaaaaaaaaaaaaaggcaaugggcuucaacagaaaacaagucaugcaauuuuauuaucaguaaaguuaaaauaaaccagcauauuacaaauaaccauaccucaugaagauaaagggaggccccccuugagaagaacaguguuauacaauguaucaucauauaagucuguuuacaauguaucaucauguaggucuguuuacaauguaucaugucuauuuacaauguaucauauaagucugcuuacaauguaucaucauauaagucugcuuacaauguaucauaagucuguuagccuccaccuagcucuccacugccgcuggauuugggggagcugaagccacuagugucucggaaccaccucugggccuggagggucugucuugcugucguggcuaacaagcucaggcccaucgggagaggagugaaaaggcacgagggccgcacccacagccaugcagcgcugcugcuuaaggaugaggaacaccugagccuucagugccuuugcucccaaacacaccugagagcaccaagcuuccuccucugcaaaguuaaguuucagaaacagcugucagaacuaaagaugcugcaguucgugggccaugaagccagugauguuuccagucaauaaaccacaaaugaaaggacugugguccugcaggggcaucugugacagaggcaggcuaugugcacuuggacggugaccggcucagaagaugcuuagaaaaaucuucaauuacauugggccaggucagcgaugcuggagucaccauugccucugaaaguugacaauucugaaugagaguaucuauuuggcugaaaaaccuuggggauacauauuuuagagguaaaugcauguuuacuauguaucuaacauguauguauauguauguguguauauauauauuacauagucuuauuuacuuuauauucaaaccuagcuuauaacacaaagaauucgaaugaccuacugauuaacuaguggccaucucucaagaacaucaaacucagcauuucaaaaugcaggucaucucacccugaucauuuccuccucccgcuguaaccucucucuugccgaacagcacaacuuucuucucugucucuggcgcugaaugcugcuaacacccuugcuggcuccugcccauacaaccaacaccugcucccaacauuacccccgacucccugacucccucugacaugagccacacuguggccagaaggauuacaacagcuuuuucucuuucauuugcuuuuaugcaaauaauuuaugaauauauucuucuuguuuagaaaaaaaacaaaugaaguaacagccacaagagccccaccccguuggagagcuggguauggggacggugccuugcuguugggcugugcgaguuucacacuuguuauuucuuucuacacuuugacacuacguccgagauguuuuccauaccaguuucaauauucucuuuuuuuuuuuuuuuuuuuuuuuugagacggagucucgcucugucucccaggcuggagugcaguggugcaaucucggcucacugcaagcuccgccucccagguucacgccauucuccugccucagccuccugagcagcugggacuacaggcgcccgccaccacgccuggcuaauuuuuuguauuuuuaguagagacgggguuucaccguguuagccaggauggucuccaucuccugaccuugugauccauccgccucagccucccaaagugcugagauuacaggcuugagccacugcacccggcaauguucucuucuaaagcacgaauaugaccgcguuccuccagguucccagggcuacuggaagaaaacccaaguuccccugagcucccggccaugccccagggaccucccaccugucuggcagcacucggaggcuccuguuccugaaccuugguagcagucccaccagugcucuugcucggacgcucuuccuccuccaacuccuccucggcucuggcaccucccaggaaaagggccuggcuugccucccaccugauuccauuuauucguggcaggacagagccucccaccugauuccauuuauuccuggcaggacagagccucccgcccccuuggccucacaccuguggaagguccucgcucaucucucccauggcugggcucagcagugccuggacucuucaacucgaaggguggacgcacagcucugguuccaggaccuuacgcuauggucacucuaauggaugaauuacccaucaaacacagcccgugccaacacuaggaagcaggugaugcaggagcacaacuaagacccaauggcggccccucaccccugcuccucuuccccccccccccaccccgcucucugaagaccucguucccaccggucuuucauaaaggaaugaugaagaacucggggauuuuaggaaauguuaaguggaaagacauagaagaaggaauaaaauucuuaaaagcuggacaugaggcugggcacgguggcucacgccuguaaucccagugcuuugggaggccuaggugggcagaucacgaggucaggagaucgagaccauccuggcuaacauggugaaaccccgucucuacuaaaaauacaaaaaauuagccaggcgugguggcgggcaccuguagucccagcuacucgggaggcugaggcaggagaauggcgugaacccgggagguggagcuugcagugagcugagaucaugccacugcacuccagccugggcgacagagcgagacucugucucagaaaaaaaaagcuggacaugauacacaaggugaccccaggagacuccugugcagaguaaaaaugcaccccagcacuaaacucaaucgcugaagucccugcuggauucuccccacccccacuccggguucaccugcacccaccuggaaagaacagugacaccaccccacagcaggagcucaccaucagcggccgcagcacccccauguagcugggcugcccccggguuucacagguggagagggagccugggaacuugcauuucuagcaauuuccaggugaugggggcaccacacuuuuaaagagacacaauucuagguccugaaaggacuucuauuaauuuaugcauugguaggauggagccaugcauugcaaagggcuuuuauucauguguccuccuugagcucagggacuggcagcacucgguggggcccaguaggacgucccuugcugacugcagacccacagccagagcccuggccuggauguuucucacaggaagccugcagagcuccugacaccucccuggagggaugagaaagcugaggcucuuagggggauaaacugauuacuggaagguaacaacauuaguaagcggugaagcuguaguguaaacccuagucuuauuucauuuuaacuuucaagccuuccuaauuuccucuauuacaaugccugugccucagagucaccaaugggaacuugaaggaaaauaauaccugcugaggccagaugcucauuuaauugccugggaguggagacuguuuaguucuaagcccucccucugaacuucugaacagugaggacugcaagucagcugccuccugcugggcccugcaagaugaaaccugaggaagccccaggaacauucagugagggguuuggagggagaagaacacugguggaugaaaagcaagggggaaauauaccagcauuuacuggcgggcugucacccacaggacagggacgaagacgugcacaccugcaaugcaggcagacgugcacaccugcaaugagggcuuucacagcccgcaacgugggcuuuuggcgucacagguaaaagucaccuguuucaccauuuccuuagggcuguccgugggcccuggcacacagccauuaagggacaaagggcaguuucagagucuuucacucaacacucaagccacagauuguccaaauagcucaggcauccuggggcuaauccaucugguuuuguuuugguuuugggagcccaacccaaggauuuccaggagaaaauaacaucuuccuaccaaagaagaaccuuaacauuuggaaaaacaccgcuucguaauuugcaaaaaucccaguuuucagggaagugaauaucuugucaugagaaccaaaaauaaaguuggagauaaugagggagcgguuucauaggaaagaucuggucauuacucugaccaauuauuaaaucgcuuucuucauaugccguacuuuuuaacagcuucuuacuaaaccacaaugcagguaagagagucacaggacgguuucuuccuugagucagagucauccuuggccuacaccagggccuagcaagcaugacuuaagucacccuuauuuccuggcuacuuggaggagcuggauuucccaguuuacaaaucucaguuuccugggauucugcucugauaaaaucuaaauugcauuuuuuuuuuaaaaaguaaggaauaggccaggcacgaugccucaugccuguaaucccagcacuuugggaggccaaggugggcggaucacgaggucaggagaucgagaccauccuggcuaacagggugaaaccccaucucuacuaaaaauacaaaaaaaaaaauuagccgggcaugguggugagcgccugcagucccagcuacuugggaggcugaggcaggagaaucgcuugaacccgggagguggagguugcagugagccgagauugcgccacuacacuccagccuggugacagagugagauuccaucucaaaaaaaaaaaaaaaaaaagaaaaaaaaaaaguaaagaauagaugaacucuaaugaaauaaucugggucuaucuuuuaccuccuccauugucuggaguaauaaagcucccugccucgcccucucucacagcacugagccacuuuuccugaauuuucccacacuccugaucacucacuuguuaauuucaaugcauaaauucuuuuugagaaauaaagucaguuugccgacuccucccgcugcuuuguuagaaaaugagcuuacaccgcgcugaucucacuacugcugccaaaguuccuucuaggggucuuuccuuugauaauguagggauuauguaggcauggggaggugggaugccaaaggcagauucugucaaggugcuguucccuccccaccccugccaguucaaagucaucgaacuggggggccucucugaccuccuggacugugcagaccaccgugucuucuaguagggucaggggagggcuugagauaaaucuguagggcucuucacucaaccaccaacccacuguccagcucgggugccccaagugccaccucugcugggcucuguguggaugcaucagugacaagaugggaagccucuggcccuggaagagcuuguuccgaucaggagagacccgaaagcaagaaacacagugaacaaaugcaugaugcccauggauggauggccguaagugcuaaggagaaaaauaacaagcggggugggggguguugaggguguggaggacagggaggggcugccauugacaaucggagagccugcagaccugccugagagugacguuuggagaaagaaggaaagggaagaaguugagggaguuuagccaaauggacaucugggaaagagcucagguagcagaggggcuggggcgggggcgcggcggcagcaugcugcauuccaggguccucugcguggcugggacagugucggcccuccccugcacaucccucagagccuucgcaaaaacacccacauggggaccuucuaaauacaggcagcacacgccacccauugcgugaccacacugucccucagaggagccgcuggccacgugcgucccguccacauggagaugugcuuuaagcuucuuuacacacuggguuucaaagacuuacuacggaaaacaguguaaaauaugaauaaucuacaauaauugauuguuaucaaaauaguggauugaauauaaaacauaguuuuuugcuuuuaccgguuuuuacuuuuuuuuuuuuuuuuuuuuuuugagacggagucucgcucugucgcccaggccggacugcggacugcaguggcgcgaucucggcucacugcaagcuccgcuucccggguucacuacuuuuuuuuuuuuuuuuuuuugcgauagggucucacucuguugcccaggcuggagugaacuggugcagucacagcucacugcggccuccaacuccugggcucaggcaauccucccaccucaaucucccacggggcugggacuguaggugugcaccgccacgccugacuaauuguuuuguauuuuuuguagagacuaggucuugccauguugcccaggcuggccucaaacuccugggcucaagugauccaccugccuugggcuccugaagggcugggauuacagauguugagucuuggcacccagagucccccacucccggcccccugccccgccuuucuuuaaugcggcaacuagaucauuuaaaauugcauauauaacacaggccacccacaugcaagccucacucuugggagauucucccguuggagaaaccuccaagaagcugaucugccuggauuugcaaacugccccacuggcuccagagggaagccgcucuggaaucggcucuucaauacugcccuugaguauacuguguaccucuugacuuucgaccagcacaaagcuccuuauuaaacgcugacaaaaauuccuuccauucuguugggagcaggcccccccaaaucuggccauaaacugacccuaaaacuggccauaaacaaaaucucugcagcacugugacacguucauaacggcccuaacgcccaggcuggaagguuguggguuuaugggaaugagggcaaggagcaccuggcccacccaggguggaaaacugcuuaaaggcauucuuaagccacaagcaguagcaugagauaugugccuuaaggacaugcuccugcugcaguuaacuagcccaaccuauuccuuuaauuuggcccaucccuucauuucccauaagggauacuuuuaguuaauuugauaucuguagaaacaaugcugaugacuggcuugcuguuaauaaacacguggguaaaucucuguucugggcucucggcucugaaggcugugagaccacggauuucccacuucacaccucuauuugugugugugugucuuuaauuccucuagcgccgcuggguuacggucuccccgacugagcuggucucggcacauuccaggugccauaauggaauuaauuaaucuccuauugauaguuuuuugcugguuuucccacuuuuugcuauucuaagcacugcuaugaagauucuccuuuaacccccaccugccugugucuguuggagcucacaugcucuaccuuccagcuguaacagcugagugcccauucaccccaagcccugacacacucaagucucuggguccccuuggcgggaugugucuguggacacagggcugcccugccacgugccccaccccauaaccuuccaucuguggccugcuccuugugauacccuaaacuuguggccuccccuccccuccucuccucuccacaaagccacccuuaucggagacagucagucugcuucccuccaccugcuucccaguucacccaaggcaaagccaaaguccuccacugggccacucuccucuacggacuccucccucacugucaggucaggucaaagggccccaaccagagguuccccugggcccuuucauaagacaggagcuuuuccucucaggucaggcuacaggcacgucguacccgcaccucaccacaggagugacagcuccaggcagaaagggccugguucuuuugccaaaauccuguccugacucacccaaggcagucuguuaacaugcacaaugauuacagaaacacagaaauaaggcugggugcaguggcuccagccuguaauaccagcacuuugggaggccaaggcagguggaucacuugaggucaggaguucgagaccagccugaccaacacggugaaacccaucucuacuaacgauacaaaaaagaucaggugagcaugguggcgcaugccuguaaucccagcuacuugggaggcugggacaggaaaaucgcuugaacucaggaggcggagguugcagugagccgacaucaagccacugcacuccaggcugggcaagagggcaagaucccgucucaaaaacaaacaaacaaacaaacaaaaaaaacacacacacacacagaaauaaaaucuuaaucguaguaagacacagcugaaaagauaugaaggacugacuccccgaggcuacugcaugccacccuuucaaucauuuuccauucaggaaacuucggaucagaucauuuacauauguacguuuagacaagggguccuauauuaaugaaucuucucugucaaaauccuggucaaagucagaaaacaaucccaugggacuccugggagcaucucacauuggggaaaccuggagaaguggagaagcugaucugcccgauuugcaaaccgcuccacuggccccaggggguccagcagcaccggugcccuccccgugagagucggagccucacucagacccacacagucaggaucuacaccuccgcaggcuccccuaggcaucucugggcacacggaggcugggaaaauagcacacgggcccugggguugggggucccagcacaguccagccuauucucuuuuccuccugaacacuuucacuguggauauguguuagggaagaggggagggaagacagagacagggagaggagacagagacugagugaugccuccauucugcagaggaaaacaucaagacccuaucucagcacucagcacucagcacccugcugacccagacagcaggaccagggcuaggaccuauaaaugucucugccucucagugcucuggucugccaugugucuggcugccucuuacauccugacaagcacaaugacuguaauuccaaacacaggacugggaguugggggugaagacggagagaaccgaggaguggggagggaaacuguagccuuugggcagcuacucucuaauaaacaaaaacacaacaccagaaagggcuuguggaaaagaaacacaaaacggaacccaauuacugacauacggcccucuguucuauauucacccgcacuuucuuagccgaaaugccauugugaacgugcaaucugguauccugauguuuguccugacuacguuaccguaucuucaccuuucuaauuuuaauugcuucugauggcccaucagauugguagagcccuaauuauuuaaagagccuaauucucccugauaaaagguuggaguccuguaucaaaagcuuuuagcuuucuguaaccaagggggaaaacaugcuucuuucgaaagaugacaaaaugucuagcuucgaagggucauucgaguauggcacacaaaacggucugcauucacagaaaaugaugccauuacacaaaucucccacugugccacauggugacaccaucauuccaacacacugccucccagacccaguaauuuuugcaaaauuaauuacugcacuuuacacugaaaagaucccaucaaauaauguauguacacaggaagguaacgggcccagagccgugggaggcaaaauggcgcuguucucaguuuccccuuccacccuacugggcuccgaagccagcauugcuucagacaccaaaggugcccauguggggcucaagccugguguccaauaaauaugugugucauugaccuaaugcacguccagccaauggaaaccucacacuucugacuucgguuuuaagguucuaaucuugaagucuuaacaguuuacacauauugaccugaggauauuggauacuuuuaauuagagaggguugaauuccucuaaaggacuucauggacgaagaagacagcuagaaccccugguuuccugcuccucaguggagauuccaggcaggaggcaggcagcaaacacuugcauuccugcgaagcgccaggcauggugcugggcgcgggaaagacaccagugaagacgcagguacgcgcagcccugaacaucccugcugcagccacagggcccggccccaccacggagcucugugaacucagggaagguggugcaacucaggcgccccuugcucauguguaaaauagggauaagucauugcccaggaucacugaggcccugccacauaacaaagagucauuaaugcuaguuauucucacuaggauuggaaagguuuguacuuacucaauuuauguggacuuucuauaaauacuguauugauauucaccucaccacaggcaaaaaggacgcagcuuucacaugcagccuacccuaaggaugcaccuggacuucccaguacacucagcuccaccaggcaccaggaccuucagaagccacaaccugugacuaagacaaugagucacucuugguguguggcacaguguucuguggcaguggggacuuagucaugguaaguccgccauucagaguuauggagcuuauuucagauugagugaaaaucaauuuaaguuuccagacaugucuugggacaacagaagauacauaaagaggcagaagaagagaaagaaaaaaaaaaaaaaaaaaaaaacagccugagacagaagauauccaagcaaguagaaaaaacaaacaaacaaacaaacaaaaacagccugagaaauacuuucuucauucaaggcccggggagucgggaauauagaaaagagaaagagauuuucaauuguaucuuauaauuaaauaauauacacucuacugagagaagaaaaagcagcccaucacauaauaucguucuugccaccuggacuccuaucacuauaaaaaggcauuuuccguuccccuaacaaagccacccaaagaauaucuguguaauuuugggcaaaucggguuuugcucacuuuugagcauuaacuagauaaagcagcuucaccaagaaaggucccugaaaaacaugguggagaugguggaggccugacacaauggcucaugucuguagucccagcucuuugggaggccaaggcaggaggaucacuacaggaggccaggaguucaaggccagucucggcagcauagugagauccugucucuacaaaaauaauaauaauaauaauaauaauaauuagcuggucaugauggugcauuccugucuucccagcuacucagaagguugaggcaggaggaucacuugagcccaggaguuugaggcugcagugagcuaugauggcaccacuacacucuggccugggugacacagccagacauaaguacucuucguggucuacgggagaguacaauauuuggaauuaagaucuguuuugcuccuaucacaaucacguaugcaccucaugcccuuaccuaacuuacuuuucuuucugagucuuucuccccacuuccaaaaugaggacacgccucucuugggaucauguauuuaggcuuggagauaagaaguguaaagcucuuagaauacaaaauguuuucaacaaaugguagcuaugaucaucuuaauauacggaauuuuaccauaauuucacaucugacagaaaauuccccugaaauuaauacgugaaugugaauauguucucucaucucuagcuacaagcaauagucuucuaugucagggaaaaucaaguacuaacauagaaucagaauaaaaugguaaaagaauggggacacugagauauucucgaggaauaaccuacuuacuguaaggguuuguaaaucuguggcagcuaagaccaggcccucugaguacaucuggaggugaacuuccuuaaaagaaaugcguccaaaugcuccaacagguucaagaucguaucaccgaaggguaaagcucuuuacagagucuacaaaaaaauugugacuucagcucugccagggaaagagugcccaggcgacccgccauggcgggcuuccccagggacagcccaggugugacccaugugggcucgaggccaccauauuugaugccaccugcagagcugagggcagcugucuccuauuaacccgagguugcagcaaccaagccgcguuccccacauaauauugguuuccaaaguaucauuuuccccagaaaagaagaggcguggacuuacuaaccuucaauaugucuaacuccucccagguggcaaaaccaggguaacagagaacaccgcgauucugccaauguauccuaaucucacaugccuguacacaaacucccgcgcauuuuagcaagcuuuuggacauggagcucaaaggaaugacccauaaauauuuuccaauacaugcaguaucuuaauuuuuuuucuuucuuuuuuuuuguagacacagagucucacuauguugcccaggaugcucuggaacuccucggcucaagcgagccuccugccucggccucccaaagcacugggaugacaagcaugagccaccguacaaggcccacagcaccuaaauuccaaaauaaccuugaaacccugacuuuccacccgcccugguggcuuccagagaucaguuccucuuccugugccaaagguuucuugucuuucgcggcccagguaaggucacucaaggugcucccucugcuucugaaggccuuugacugagaagccacucuggguccuaucccgaccccaaggcggcuccauucguacccgcacaucuccgggccgguuuaagucacgcgggccaggcuauuuccacuucacucuccuguuucuucaaucccauccucugcugcaucacguuuucuuucucugagaacccagcccugcaggaagaacguugaugcugggguccuuuuacuggaaugcuaacgccagagcacuucccgggggcgcugcagggcgggcugcggggcggggccuggcgcugccacccgggucucccgcggggggcgcugggccuggggaggcugcgcugcgggccuggggagcgcgcggcgcacgggugucggggccggggcucguggagacgacgggccgggcaucacguaggcgcucguggcgggcggggcggcgcccacagcgccucaaccugcggcacccgcgcccgccccgcgcgcucaagggcgaagggaaggucacccgcgcagugggcagggggugcauccccgcuccaacccugugcagugcgcggccccgaaacgggaggaaauccgccauccgggccuuuccacgcaucugcggcaggaggaaccgggaaaacaaaaaucaaaacccagcucggggcgcgccgcgucuccagccugcgcgaucgcuaaggcucccagguugcguucgccugggaagcgccgaucuacccgccagggauugcacggaucgggacacuccaucauccgggcaccggcgcccccacgugcacccggggccuggggcgcgccgagucuccgccaccuuccgcucuucaauguuaaau

SEQ ID NO: 192399 - RNA, 75462 nt, Homo sapiens
gggucgcgucagugcggagacagcgguguccugcgcgucuucgggucaguacggggggccgcgucguagggacucacuggcggugcgcgaccugggcuggcuccggggguggcgggcgcagcugcugugacaggugagugccgccaucuuccuaccugucaggcgccgagucguuccccggaugccccgaagaggagucgggacacugcagggcucaagggggugcaggggcagucggggcauaguggcggauggggugcaggugggcuuggaaugcagaggguccgugguggugcaggaggggucgggucccuggaggacccguggcggugcaggaagggccguggugcagaaggguucagggugcaagagaagucggggcgcaggaguaguccguggcggugccagagggaccagggugcgggagggaugggggcccggggcggugcagaagaugucggaguccaggaagagucggggcgcuggagggguugggggcagaaggguucggcccggggucucuccccgcccccuuugcuucggccugggcaucccggggaagugcgucuccagggaagcacuugggaggcccuucagagaggagaauggccuuucuucucuccaaagaguggggauggucggcuucaagaaggguggugaguguggagugacggaugcugaagugauuaacacagcgccaugauauuguuccccuuuugaagacuuccuuuuccuucccuucccccugaaagcagccaccgcuggagggaaacauuuuaagacagcuguucaccggaauaacacaagagcaacaauaauaauguacucauuuacuaaaccaaguugaauaaauacauuuuuccagguugugagugaaaauagcuuaaggucugccagguuuuuagagauuuugucauuuaacuuaaacgcuaaaacauucgucccuugaagcggauaccauuauagaaaaguguuaauugcuuggaaguuucauuuauugaaguucaaguguuuuucucuuaaauucaguauguuggccugugaguuacggucauaaaaguauugcaggaauuauuuaccucugaaugagaaagcucaagauaguuauaucuccaggaacuuucuucgucuucugaacuucccccaaccccagcagacacacacacuguucugguuacuuuccugaucaaauucgagucuuucaaaauagcuuuugauaugucccaggaguuaaacacgguauguaaauaugaacucaccaauguggaacaaauggagugaucuguuauccccuggguuuagacgcugccuuucuauuaauacugcucacaggagacagaguagggacucgugugcacuggccacgucucaacagcagugugaccuugggcaaggccuuccuaagucccgacucccuguccucuaacaugguguucauaucagccucauuuucuuacugggaagguuacguuauguaauauaugccagccauuuuugcaaagugcuguauacaggagaucuugagugaguguguuucccuccuccucuuuuuggguagcuauguuaggcuguucacuuugggcauuugcccugaacuaaaaucccuaagucccuuuccccaaggugaaacuaagauagaguuuucauauuuauccugucuuauucuuuucagggaaaagauuuuacaucuguugaauuucauccuugguuuaaaguuguucuuuuaacuacugagaucuuuugaaaaucuugauggcuauuuaucugauuaaugguauuuccuaauugauugucauccacagaauugaugguguauguauuccaugccuucauuucgucaaugacaaaacauuuuaagcagguuaauacugaugacagauuucugagguugccuguagagaccauucucuuccucgauauugcucagaaguugaauuuggugucucagcccacuaggaauucgucuaacaguguuauuacgauaaaauguuacuacaaacuugauuaaacuucugguggaaauuccaucacauuuuaugcaauuuucaauuuauuucuccaauuuauuuuuaaugccacauggacauuauauuccuuaaccauucuuuugcaugugauuaacauuugugaaauuaaccacuuaagcaaguguuuuugcuuugaugaaagaaaaauguuuaaaauccuacuggauaugaaacugaaaguaauguuuuguguuuuuuguuucaaaugaaaguguaaauuaagaauuuguuggcagggcgugguggcucaugccuguaaucccagcacuuugggaagccgaggugggcagaucaccugaggucagcaguccaagaccacccuggccaacauggugaagucccgucucuacuaaaaauacaaaaaucagcugggcaugguggcgggcacuuguagucccagcuacucaggaggcugaagcaggagaaucacuugaacucaggaggcagaaguugcgguuagccgagaucacgccacugcccuccagccuggggagacagagcgagauucugugucaaaaagaaaagaauuugucguauugcuguuucaagcuacuuugguuauguuaucugccuuccucaaauuauacacacuuaggagaaugauaauuucuauagcuacaaauuaauuaauauuggaaauauugaaaagaaucuggccaggcgcaguggcucaugccuguaaucccagcacuuugggaggcugggucaggugaaucaugaggucaggaguucaagaccagccuggccaggauggugaaaccccguaucuacugaaaauacaaaaaauuagccaggcgugguggugggugcuuguaaccccaacuacucaggaggcugaggcagagaauugguugaacccgggagguggagguugcagugggucgagaucgcgccacugcacuccaaccugggcgacagagcgagacucugucucaaaaaauauauauauaaaagaaucuuuugagaaagagcagaaagcuaaguguucauugaugcuguuuaauauuacagcauuucugucacgcaggcuggagugcagcggcaugaucucagcucaccacugccuccaccucccaggguggagcaauucucgugccucagccuccaggguagaugggaggcguguaccaucacgcccagcugauuuuuguauuuuaguagagacgggacuucaccauguuggccaggcuggucuuaaacuccugaccucaggugauccgccugccugggccucccaaaaggcugggauuacgggcaugagccaucaugccuggcccaauauuacagcauuucuaaagaugaggaauucagcuugcuaacacaguguguuuauggguuucauuaauuagucgaauguuuggccagugccugcuguguguagagcacugugcugcaucacagcugugugccuguuguucugacugcuuacaagcagugggguguauuacguacacggcaacauauacuaagggcaggugaacuggacagacuaaaugagucaggaguucagaaggagcguuuauucuguuaaauccaugguaggauaaagagauugaauuuuuagaggggacuauuuauaguuucuugaaaauaauguuuuauugaaaaccagaaggacauuuaaucuccauaagccuucuuuguaauaugguaaucuguccaauaauauuggguaaaugugaauauuuugaaggaaaauaauuacguuuuggaaucucagguuucucuuugcuuguauuuagguaaaacagugcauagagguuaaagaagguuauauuuggagugaagaaguuuguuuuuucucuuuacaguucuauaaucaguuuauuaguguuuagucuguuaaauacaaucgggugccacauaacaaaugauguuuuggucaacaacagaccucauguaagaugguggucccauaagauuguaauacucuauuuuuacuguaccuuuucuauguguagauauguuuagguacacaaauagauaccauuguguuacaguugucugcaguauucaguacaguaacaugcugugcaggguuguaggcuaggagcagcaggcugggccaucuagccuagguguggaguaggcugugcaccuagcuuuguguaaguguacucugcgauguucccacagugacgaaaucacguaacgaugcaucucucagaaccuguccccauccuuaagugauguaugacuguguugaaaggcucuuaauuggauuugggaacucugucucauagggauguuaugaggauuagugacucuuuguauuuauugauccauuugagccuuacagcaauucuuuguaguagcucuucagccucugguagaucugccaguccaccaacuuucuuccaguaucucuccauuaauucuuucuguuuucacuucccuuccugucuauuuuagauuccaugguauaccauuucaguaguuuuacaaacaccugccacuuccuugucccucuucccaugauaccaaccugaaaacccccuaaacuggugauuaaacauuuaaauaagauuuaugcuacgccgguugagcauccuaauccaaaaauucaaaauccauaacaugacacaaguggaaauuuccacaccuuaccuugugacagacagguuguagucaaaaugugggugcgcaacauaguuuauucaggauccccuagggcaaaauaaaauuaccuucaggaggccugcugugguggcucaggccaguaaucccagcauuuugggaggccgagcugggcagaccacuugaggccaggaguucgaaaccaccuugccaacauggugaaaccccgucucucuuaaaaauacaaaaauuagcugggcaugguguugggugccuguaauuccagcuacuugggaggcugaggcaggagaauugcuggaaccugggagauggagguugcagugaaccgagguuaacaccacugcacuccagccugggcaacaguggagacgucaucucaaaaaaaaaaaaaaauuaccuucaggcuacgugcaugagguauacaugaaacauaaaugaacuuugaguuuagccuugggucccaucccuaggauaucuuacuauguauaugcggauauuccaaaaucugaaagcaucugaauucugaaacacuucuggucuugagcuuuuuuuuuuuugggggggccaaggacugaguuuccauggaggauguggugugaaaggaaggaaguggugauaggaccaauacagacacugggaaaaaauguggagggugugaauacagagaugauaagauuacuccaguaugaaaaaaucuguauuuggugccaaguuccagggaggugauuguaggaaaugcauacauuugguuguaguugaucagcagaaaaagauugccggcgguauugacuauuuugugaaguggcgaagaaagcaagcuaaaccaaagagaacaccaugcaacuuacggagaggcuggaauagccagugagauaaaaucagugauccaaaacuuauaauuuugaugagaaaggaaaggugauauuguaaucucugcauuuuugguaacgaacuuguagaaugucuggaaugcaucagaauguuucuacagaugaaguucuuaagagagggaagggaaacccuuugcugguuuuauuugcuucauuuaacugaagauagagucucccuuuuucucugaggccauaucaggacagcuuucacaggcuuuugaugugguuucuuuuuuuccuuuacaaaacauacuccauaaacuacaaaguaacuguuuuauguuguaaagcaagacuuacuucuccuuuaaaaauaggccuacacauaugcaauuugagaauaaaagaugauucuuggcuuucugcuugcggaaagauggagacuuauuuuuccuuauuccucccaugaaguacaucuaaaaacacuggacauauauaaaacaaauguaagagugggccgggugcaguggcucacgccuguaauccaagcacuuugggaggcugaggcgggcagaucacaaggucacaaguuagagaccacucuggucaauauggugaaaccuugucuccgcuaaaaauacaauaauuagccagaugugcuguugggcaccuguagucccagcuacuugggaggcugagguaggagaauugcuugaacccaggagguggagguugcagugagccaagauugugccauugcacuccagccuggggaacagagcgacacucuguuaaaaaaaaaaaaaaagagacugaaagauggagaaaagaagguagacuuccuucguacauugggaccacagaaaugacaccaaacuuaguucugugaguuuucuuuuugccucauguaucucauauguugugcuggauaagcuagcagcgcagguauaaaaggacucagacaaaacaaggcccaagaaaagccugcucucugugucugaaagaccaggaaaggggcagccuacaaaucacagaacuuuucgaugguaaguacuuuccuccagcuaaauaucacaggaaacccugcagcaccacccucacccugcuaaucagagaacuuuucggcgguaaguacuuuccuccagcuaaauaucacaggaaacccugcagcaccacccucacccugcuaaucagaggcugagcagguacuucagauucccacucaugacaagcugggaugagaugcuccucucugcaggguugcugucagagaagacuggcugaggaguugggguuuuacuucugcuggguggugacagagcacagccuccuuucugcuaggguaucauaagagggaccuugcaaaacucaggaacuuuacugcugcccuguggucaugaggccaccccccuguggugugggggagacuguauagggagcagcacggaggcagcccugauucagccuugguggugggaguggaaguucggcaggaggcugaacuuuccuucucaugcagggguccguggaggcugagugggaaucucaacuuccaccucaccguccacauccaccuggcagaggccugcucuaacagaagacuuacaucagauccugagucugaugucaggauuucaauggaaaaucacucauaggaaaaucucaaccucaguaagaaaagaccacugaugccaacguagagaugacacagaguuuagaauuauuugacaaggaccuuaaagcagcgauuguagaaaugcuucaauaaccaauuaacauucgagacaaacgacaaauagccucaggaagaaaauacaggauguaaaaaagaaacacaaaauuucaaaagugaaaaauagaauaugugaaauaaauucaguggauggcuuagcagcagaaaggagaggacagacaaaagaagcugucaauuugaagauagaacaauagaaguuacccaaucugaacagcagagagaaaauagacuggaaaaaagugagcagagccucaggggcccgugggacuuuaacagaagaugcaacaucugucaucagaggucuagaaagagagaaggacgggguggggggaaaacgugucugaagaaaucacugcuguauguuuccuaaacuuggcaagccauacaccuucagacguaagaagcagcauaaacccagagaagauaaacacaaagaugcuaagacacauccaggccaacuucugaaaacugaagacagaagcauaguaagagagauaccacuugaccuguagugggaaacaauuugagugacaauggaucuuuuuuuuuuuuuuuuuuuuuuuuuuuuuugagauggaaucuugcucugucacccaggcuggagugcaguggugugaucucagcucacuacaaccucugccucccagguucaagcaguucugcccuagccucccaaguagcugggauuacaggcaugccacaucacgccuggcuaguuuuguauuuuuaguagagacgggguuucaccauguuagccaggcuggucuugaacuccugaccucaggugaucugcccgccucggccucccucacgcuugcuggaauuacagucaugagccacugugccuggccugacaguggaucuuaucagaaauuguggagggcauaaggaaguggcaggacauuuuuuucaggugcugaaggaaaaggacuaucaacucagaauuuuauaucaagugaaaacuuccuucacaugauuuaucuccagcugaccuacucuaugaaaauaacaaauaaaggaaauucuccaaacagaaaggaaaugacaaaagaaaugugggaacaucaggagggaagaacaaagaauggacagcaaaaauaucggucaauuuaguauucguuuauuuucuaaauuguguuuggaauuugaagcauaaccguggugugguucucaguguauguguaggaaauauuugugauuacguuauaaauggggaaagguaaagaagcauagaggaaaguaagauuuguauacuuuaugugaacugguaaaauguugauaaucaguagacuacaauaagcuguaaauguauaauguaaaaccuagagcuaccacuaaaaaguuauacaaaacaggcaaacucagaaauacuguagguaaauaaauaugaaauuauaaaaaauguuuaccccacgagaaggcaaaaaagagaauagagggagagagaaugaaugauacaccaugaacaagugcaguuuauuuuguggcuacaagguuggaucaauguuugaaagucaugaguguaauugguccugucaguagguaaaaaaaaaaagcuacuaggaaaaaaacaugauagaauucagcacucauucgugaaagaaacucagaaaaugaaugauagagggaaacguuuucaacuugauaaacagcaccuacaaaaaaaucuauagcuggcaucaaaguuaauggugaaacacaauauuuucacccgaauauucagggcaaagcaaggguguuugcugucacuauaguaauuuaagauaguacuggaauuucuagccaaaucaauaagguaguaaaaggaaauagaaggcuuacaaaccacaaaggaagaaauaaaacuguccuuuuuuuuuuuagaugacuuaauaguugacauagaaaaucccaaggaauccacaaaaaaucuugaacuuuagguucagcaagaauguacacguuuaauacauaaaauccaguuguauuuauacuagcaauuaacguggaaaccaaaauaaaaguacaguaucauuuaaacuuacacaaaaaauaaaaagagagauguuagucuaaaauggagaaaagauauguaggacuuuuuuuuuuuagaaacggagucuugcucugucacccagguuggagugcaguggcgcgaucuuggcucacugcaaccuccgccucccggguugaugccauucuccugccucagccuccugaguaucugggacuacaggugccugccaccacgcccugcuaauuuuuuguauuuuuuaguagagacgggguuucaccguguuagcuaggauggucucgaaguccugaccuugugauccguccaccuugaccucccaaagugcugggauuauaggcgugagccaccucgcccagcccgauacuaggacuaaugcagaaaaaaccuugacauggaggaaaguaagaucuaaauaaauacuguauucauagauuaaaagacucagcauaauaaauauaccauuucuccccagauugauguacagauuuaacacaauuccuaucaagaucccagcaagauuuuuguagauauguaaaagauuauucaaaaauguaaaaggaaggacaaaggacuagaauagauaaaacaaaauggagaaagauuuaauaggaaucacuguaacugauuuuaagacauacagaacaauaauagaaacugcuuguauuaguccauuuucacgcugcugauaaagacauaccugagauugggcaauuuacaaaggaaagagguuuauuggacuuacaguuccacauggcuggggaggccucacaaucauggcagaaggcaaagaggagcgagucacauucugcguggauggcggcaggcagagagggagagcuugugcaggaaaacucccccuuauagaaccaucagaucuugugagacuuacuaucacgagaacagcacgggaaagaccugccccuccaugauucaguuaccucccacugggucccucccacaacacauuggaauucaagaugagauuuagcuggggacauagccaaaccauaucacugccguugguggaaggauaaauauguagaucgguggaacagaauagagaaccaagaaauaaccccacacaaguacagugaguugauuuuuugacaaaaguccaaagcaguucaaucuaggauggaucaucuucaacaaaugaggcugggauaauuggauacacaggugaaaacaaacaacaaaaaaaccuugacuuaaauuuuacaccuuauaaaaaggucaguaccauauagguaauaaauuuagaugugaaacagaaaacuauaaaaaauucaggagaaacaggagaaaauguuuggccccuagggauucaugaaaaguucuugucaugacuuuaaaagugugaugcauagaaaaaauuaucaacauuaaagaaguguugcuucaugaaaaacucuuagaaugaagagcaacagauugggagaaaugauuugcagcuuaaccuaugugacauauaauucauacuauagaguauguaaagaacucuuaaaucucaacaguaaaaaacccgaauaauacuguuagaaaaugggugugaagagacaccucacugaagaggauauguggaugacaagcacaugaaaagauagugucacuagccaucagggaaaugcaaauuaagaucacagugagauauuacacaccuaacggaacagcuaaauaaaaaaguagugacaaagggaugccugcacuugcagguauacacagcacuguucacaauagcaaagguauggaaucaaccuaagugccuguugacggaugacuagauaaauaaaauguggugcgcacacacacacacacucugcaauaccauucagccauaagaagaaugaaauuaugccauucgcagcaacauggauggaaccagaggccauuauuuuaagugaaauaagccaggcacaaaaagucaugucucauguucucacaugugggagcuaaaaaaugugaacacauggagguaaacaguggaaaaauagauagauaauagagaccgggaagggugugagucgggggcggagggaggaugagaagagaguuaaaagguacaaacaugcaguaugauagaaggaauacauucaguguuugacagcagaguagggugacuauccuuaagaaagcaguaucuuaggccgggcgcgguggcugacgccuguaaucccagcacuuugggaggcugaggcggguggaucaugaggucaggagauggagaccauccugguuaacacugugaaaccccgucucuacuaaaaauacaaaaaauuagccgggcgugguggcgggcgccugaggcaggagaauggcgugaacccgggaggcggagguugcagugagccgagauugagccacugcacuccagccugggcgacagcgagacucugucucaaaaaaacaaaaaaacaaacaguguuuuacuggggugguggacacccuaaauagccugucuugaugacuguguuguauaccuggcacaaaauuucucauguaugacaaauuuucauaaaagaguaaugacaauaccaaaugcuggugaggauguggauaacugaaucucucauguguuccugaugauaauguagaaugaaacagccacccuggaaaauacugauaguuugacacucuuagaaaaaaaccacaaaaacuaaacaugauuaaacauaagcaauucuguuuccagguauacccaagagaaauaaaaguauacacauacaagaaauuugcacuuuaaccuucauaauaaccuaaaauauggaaacaaccaaaugucugucaguuguauuuggcaauaaaagggaauacauuaccacuaugcuacaacauagauggacuuugaaaucguugugcuaagugaaagaagcugguugucacagaccagagcguauguuguaugauuccauuuuuaugaaauggccagaacaggcagauucauauggagagaaaguaaauuagugguugccuagggcuagcugggaagugggugggagaaaugaggagugagggcaaauagguguggggcuucguuuuggggugauaaaaauguacaguugauugugguaaugaucgcacaacuuccugaguauacugagagccauugaauugugcacuuuaaauaggugucuuacauggugugugaaucguauaucaagauuuuuuuuaaagcuaaauauacauuuacccugugacugagcagccuuauucuugggcuguuuauccaaaagaaaugagaacuuagguucacauaaaacccuguauauuauuguucauggcaacuuuauuaguaauaguaaaaaaauuggaaagaauauauauauauauauauauuuuuuuuuuuuuuuuuugcagcaggugaaugguuaaacaaaugguuaaauguccauacuguggacacuagcuaguaauaaaaaggaaaaaacuguugauacaugcagaaaauugguuggaucguaaccauuaaauugaguggaaaaaagaaucucaaaaaggguaacugcucuuugaucauauuuacauaacagucucaaaaugacaaaauuguagagaugguuacagauuaaugguuaucaggaguugagggauggugccagggaguugggguaacuaauggguagugugggugaucuguauggugaguggaguguuuuguaucuugaacauguggcaccuaaaggaauuuauauauguaacagaaugacaacuauacacacauuauacuaaugucaguuuguugguuuagugaaauuaacuaacaaauuaacagauuguacuguaaugauguaagauguaaccacuggggaaauauggaccaucuuugcaacuuccugugaaucugcaguuauuucaaaauacaaaguugaggccaggcacaauagcucacaucuguaauccuagcacuuugggaggcugagguggguggaucaccugaggucaggaguucgagaccaaccuggucaacguggcgaaacccugucucuaauaaaaauacaaaaauuagcugggcaugguggugcaugccuauagucccaguuacucuggaggcugaggcacgagauucuugcuugaaccugggggauggagguugcagugagcugagaucgugcaacuccacuccagccuaggagacagagcaagacucugucucaaaaaaaaaaaaaaaaaaauugggaacuucauaacucacaugacuguuuugguugagaguuacuagaagcuugugauuaaguuaaagcuuuuaaaaacuguccuaaauaauaggcaaacugucuuccaguuuucuaacauuuuuggguuaugcuuggcuuuuaaaaaaguuuuaauaacaaaauuuauauaugagaguucugcauaguauguaagaaacaggaaacaaagcuaaacuguauauacucacauucauauuuagaaagacauuuagaagagauauuuagaaaaaugcuacgacuuccuugaauucuaagguuaaauauguugauuucuacuguuuuauuuauaauauuaaaaauaaaugaagugaauuuuuauaagugacaauauuuucucuuagaaaaauauuuucauccuugguauuuaggauuauaauuagaaugcuuaauaaacugaauaggaaagaucuuguuuauguuauuaauaaccuuuauggaagacacucuaaauuuuuugugaauacauuucaucucuguuaagaauacucucuucuauguguagauaaacuuauuuuucaaaacaggcugacuuguuuaaaaagaagggaacgcuagugauuuuaaaauauuguagaaaaggaaucauucuauaacaaaguaaggagguguuagggcuauugaguaagugagagccauuuggaaggaaaggaguagcauuucagggaugugugucugcaccugguaaugucuaaggaguugauaaugaagagggcugggcacaccagaaauaaggucuugccuugaggcucaggcuauugcuguugcguaagucaccauuguaacugucuacuuggaauuuagauguuuacguaguccuuauguguauuuuaaagguuagcguauuuuuccuuuacgcugauauauucacagaaccauccccugcucuugggacuugggccagucuuuucucuaaaagaagaugauggaggcauguuggcgucugggaggucgugggcguguccugcuuugccuuugacugcauaugggucaggcauucuuugacagugaggugcugagcuggccugaugauaggauuguguucaugggaggagggaucaguaauagcaaaaaaucagcagguaauguucaaaauagcaaaaucuguaguugaagaaagaagauauguguguaaauauauuaccuaagauuguaguaaguaacguagugauauaauugggaggaaggauggauaauaacagggaaugaguagaaaaugcccaaaguggguaaaucauaauauuuaaauuagagauuugaauaacuuaaucacaugugguuaguuugaauugagauaugcuguaaauauacacgcugaauuucaaagagguaaucauaaaauaucccauuguuuuuuauguugacuauaaaauauuuuaaacguauuggguuaaguaaaucauuaaaaguaauuucauaugcuuuuauuuuuaaaaauguggacacuggaaaauuuacauccaugacuugcauuauauuccuauuggacagcaugagucuagaauguguagucuagaauaugcaauuaacauugguucccucgggggaguagacugugccuggggaauuccguuggguuaagggagagcaauuuuuuuuuuaaauuuuaaaccucuuuuuugccauuugauacuuaagauguuaaugaaauuugauaaagaaauuacuucuuuaauaaaggcuguggucccuaccuuaaaacaucuuaauuugucauauuccaaauuauauaguuaauguuaacuauaguaaggaagcuuguaauuagaagucaucauuaucuucuucacuguuuuucuuuuguuucaacucgcuguaucagaaacacuguuuuuucuugcuguuuuuagcuuauugcaggagugaccaggacacuaccuccuagaaguaaugcccacagaaagcgcaaguuguucgacugcucgccaaacaaaacagaagcgcaaaucccauagccuuucuauacgaagaacuaacagcucggagcaggagaggacgggacugccaagagacauguuagaaggacaaguaagcuacgauugauuagggccuuauugauugauugauuuuugagacagaguuucgcucguuuccccggcuggagugcgauggugcgaucuccgcucacaaccuccaccuccuggguggaagugauucuccugccucagccuacugaguagcugggauuagaggcaugugccaccaugcccggcugauuuuguauuuuuaguagagacaggguuucaccauguuggucaggcucaucucgaacuccuaaccucaggugauccaccugucucgcccucccaaaguguuaggauuacaggcgugagccaccggccccgggaucaaggccuuauuuuaaagauggugauugugucugugacguuauaaaaguagccaaauauauaaaggucuccaaaguaaaaaaaaaaggguuggguuacuaagaagaaagaucaccccucccaaauucccccaaaauaaacucauuaaaacuucuaucaaauacaacagcauacacagauggguuagcauauguauacuaaguaauaacaaaucaaaguggguaugagaguugggauuaguuuuauucuuuguacaggcuugcggacaguacaauucuggguuuucugucucuaacagucucaagaaaagaagaguaucauauccuuuuaaugaucucuuucuguucucugaagaguuuuuggaaucagaucuuuuagugacuuugcuuagguuuauccuugucucugccgccaugaguaugucauucuuggauuaaaaugaacuaauuauuuuugauaaagauaaguuuugcuuauacuuuuucuaguucauuuauagcugaugaaauucugucagaauuuuuaaagaguguugugaagucuagacgcaguauauuuauauuaaaauaagcucuagauauaucuaauauaugguuauauauguauauaacuauauguaaacuuacaaccauuccuucacaauuagaacaaauucaucagccauaaugcuguaggaagauaaagcuuaaaccugagaaauuggcuucugugaauauuggauuuuguuaggaccauguggguaacuuuaugccaggacuucgaggccgggaccucuacacugaauacagcagugugaacccagaauccgacaugacuguugccacgaagaggaucuuuaccucaaauuagaugauuaugcauugaauaaauaaaccaguaccugguucuaauuucuauaaaaagugauuacauuuuaacuuaguguucaaaaaaauuacaaaaauagcuuugguauucuuaguguauuacuuugcuaggacucccauaacauaaugccacagacuggguagcuuaacagacugggcagcuuaaacaacagacauuuauuuucucaugguccuuccaggcagcuggaaguccuagaucaaggugugagcagggcuaguuccuccugaggccucugucuguggcucgccgacaccaucuucucccuguguccucacagaguugucccucucugcgugucuuguccuagucucuucuuacaaggaccccugucauacuggagggccuuccuuuaugaccucauuuuacucucaccaccucuuucagggcccugcuuccaaacacagucgcaugcugagguccugggccuguggaccccguucaacacagcacuuaggagacagcagagcuaugcggcaggacuccuguggugggggcagugucuguaucuguaucugcugucugaugugggaaccaccagucacguggcugcugagcacuugaaauguagccagugucccgggacaugagauuuuaauuuuuaaaacuuuuaauuacauugaaauuuacauagucagauguggcaaguggcuacccuauuggacagugugaguaagcaguccaagauagguuuuccuaauuuguagguucacguacauuucuagcaguggaaacccugcagccuccccugcuggcauguucuagaguugucuccugccuggggugaaaguguucuuuucugggcccugaaugcccauucuccuuugugacacagcagaggcggugacugcaucucaugguaacccucacgaagguagcucagaggucuccaagccgcacggccucguccucugcuccaccuuuggccugugucucccacgcucgcucccuagacggagcucauuuguucaaugagcagugauucggagugggaccggucagcauguucuguaaguggcccccgugaggugcucugccuucccccugcccugggcgggagaggugaguggcccccgugaggugcucugccuucccccugccgugggcgggagagagcuguggugucugccgcacgcguuuggcaugguaggugugaggggggcgaucucagaacagggagguguugauuaacguaggagugggcucguucuagacaguguagagugacgcccuuucaguuguugaggagcagcaauauagaagagagggcagaugagucugagggagacaucguguuagguuuaacuuuauacaucucagauuugccagucugaaguaguuuagaaagccagguucgcgcaggcgcaggaggucugucguugccgagaacugcgacguccacgugcacacagugcuggcugcggccugaagagcuggcugcuucccgcacgugcgugcaggugcuuucagguguguguuggugucgaugugauggaagaaauucauuuaaaagcuuugcugagucacggcaguagugucuugaguuuucucaagugguaccaaaaguucaacaacucguuugagagucugugaaauugaauggcacagaaagggagaacugauggaaaagguugaaagucauuuuguaagcgcgcucuuccugggcucaaguugcccucuagugggacaaguccucauuucucugugcauuuaguuucuugauuauaaagugagguuaaugcugacuucucagcuuucuuuuccauagcaauuccuuuuuuuuuuuuuuuuuuaaauuuauacuuuaaguucugggguacaugugcacaacgagcagguuuguuacguagguauacaugugccaaggugguuugcugcacccaucaaccugucaccuacauaaggcauuucuccuaaugcuauccuucccccagccccccaacgccccgacaggccccggugugugauauuccccucccuguguccauguguuagcaacuacuuuuauauuaauaugcacuuaauauucaaguauauaugacaugauguaauuaguugcugaacaauaagagccuuaaaacaugauggguauagaugaguaggaacugauucuguaggaggagauuggccuuguguaggagucagaagggcuuuuggggagggaugcuuguggggagggauguucacagagugggaauggggcgugcagaggccacagggcagggaaaauacuaauagugauucucaguucagcacaagcuuauguuucauaguuauuggaacuucuuuuuuuuuuuuuuugagacggagucucgcuccguuguccaggcuagagugcgguacugaucuuggcucacugcaaccucuaccuccuggguucuagcgauucucaugccucagccucccaaauagcugggauuacaggugccugccaccacuccugguuaauuuuuguauuuuuaguagagacgaaguuuaaccauguuggccaggcuggucucgaacuccugacuucaggugaucugcccaccuuggccucccaaagugcugggauuacaggcgugagccacugugccuggcugggauguccuuuuugauggccuaguuuuaauuuuuauaguuacauuuuccuuucuuuuuuuuuccguguucuucauugguuuuagaaggauguuuagaggcuauaguaccaauucaguagauucaguauuuaaaguaguauauauaugugggugugcgugugugugugugguuuguaaaauuuuugugagaaaucugugauaacuguaaaacucacauugcuaaaaugcugucauuuuucccuaaaauuucugucuuuuaaguugaucucagaaggauuuaauaaauauagugcaucuuuuuaaaaaguuuacaacucggccacgcgcgguggcucaugccuguaauccuagagcuuugggagaccgaggugggcagaucaugaggucaggagauugagaucauccuggcuaacacugugaaaccaugucuuaacugaaaauacaaaaaauuagcugagugugguggugggcaccuguagucccagcuacucaggaggcugaggcaggagaauggcacgaaccugggaggcggagcuugcagugagccaagaucgcgccacugcacuccagccugggugacagagcgagacuccaucucaaaaaaaaaaaaaaaaguuuacgacucaucagaauaaaaaaguuuaugcuauauguaaauuugaaaagucccauuaaguaucagccaggcacaguggcucacgccuguaauuccagcacuuugggaggcugaggcgggcggaucaugaggucaggagauugacaccauccuggccagcaugugugguggcgcacgccuauagucccagcuacuggggaggcuguggcaggagaauugcuugaaccugggaggcggagcuugcagugagccgagaccacaccauugcacuccagccugggugacagagcgagacucugucucgaaaaaaaaaaaaaaaagguaaguauugaaacacuauuuuagaaauauuugauggggauuuuuuugaaaauuacucuggguguugggaguaggggacacauaccaaauagugcauaggccaugcccucagggagguuggaguggcacauggcuguaucuagcaggcuccuguugacugguggguccaagcagugagugccugugauauguuuggugcucaggaccugcuuacuugcuggaccacacuugacaauguagcuccuucccuucgccuucccaggggugcgggaaacacacaggcaugaagagcguggccugggcaggaaauaaaaaguuaauguuuucacucaauuaauagacauuuggcucuuuuuugugaaauuuuucuuuuuuuccucuucacaacacucuuuuagguguuaugucgagugaugggagagugacugugcuuuugcuuaaagugcaguggguguggcgggaacucugcaaaggugccucuuccaugagggucuagcagauuaaaauacuuguaggauagcguaugauggcacucagaggcuguuuauaauaguucauuuaugggagcugccgccuuucucuccaaauuuggaaguuuuaaaauaagguaggcuuauguccucucuuguaaagggaaaaauuguguuauuuugaaggaguguuuauuuucaaaucccauaucauacuagguagccauuuauacaauuugauuuauagucuccuuggcagaaauuuggaacuuuaaacucuuuaagcauuuuauauauaaaaauauguaauaauacaaaauaagaguuuacaauaaaagauaauucacuuuggaaaaagcauauuuguacuuagaguuuuucauucauucauucauuuuaaacaaagucuucuucugcaggauucuaaacugccuuccucgguucgcaguacacuucuggaacuguuuggucaaauagaaagagaauuugaaaaccuuuauaucgaaaacuuagaaugugaguaucuccuauuuuaauauacuuuuauagcuuuaccuauccauagucaaauuuaugaauagacauucaucacuauauuaguuuucuguucugcuguagcaaacuuaaacuuauuuuaguggcuuaaacuaacacagauuugucaucuugcaguucugugggucugguauaauucccacgaggacuccgucucaaaaguaaauaaauaaaaauaaaaaauaaaaaauacauggaucuuaucauuuucccuacaccaaguacaccauaaauugagaaaacauugauuuacuuuuuuauuaauauaccaucauuugaaaauugaugcauauacuauaucugacuuauuaaagacaaaucaaaacaauuuugaauuagcuuggcuuuaauuuaucuuuuuuuuauuuuggaaguaauggccauaugugcuuaaaaauuuaucagacaguauaaaaagaaaucuaccauuaccccucaagcccaucgcacucuucaaaggaagacauuuucugcauguuuuugcuuuugguucuuuuggugguuaguccugugaauguaaguaaucaucuucugguuuuagaucuauccgcuuuaguguuaaugcuucacagugaaauaaacagguccuuugcgcugcucuauuacuuuccaguuuuucuccuucaggguuuguguuuguaaaauuuauauauauaaagacagggucucacuguguugcccaggcuggucucaaaccccugggcuuaaguggucuucccaccuuggccucccaaagugcugggauuauaggugugagccaccacacccaaacuauaaaauuuguacuagacaaauguaacuacaaucaagucuuucaugcuuuaucuacagguugauuccaaagguugaauacuaacaaagagcauuuccauuguuaagcuguuuuucacucuguaacuaaguggugugguuggaugaauaaugaagagaauauaauccucugucauuuaaacuuugcuuuuggaaauuuuaauguuaauacuggauucuccuuuuuaaagaguccaccuuuacaauucauagagggaaaaaucauuucaacuuuuuuguuuuuuuuuuugagacaaaaucuugcucugucaccuaggcuggagugcaguggcgugaucugggcucacugcaaccuccgccucccaaguucaagcgauucucaugccucagccucccaaguagcugggaucacaggcacccaccaccaugccuggcuaauuuuuguauuuuuaguagagaagggguuuugccauguuggccaggcuggucuugaaccccuggccucaagugaucugccugccucggccuccaaaauuguugggauuacaggcaugagauacugugcccagcccagaauaauguuuuuaaucgugcagaaucaaucacuauggaaacuauguugaaaugcgggugcugucuuugagacccugauagcagugucuuccacaguguagcaagugugugagcuuuuacuuuuggaaugguaucucuaaugguuucuuucuuucuuuuuuuuuuugagauggagugucacucuguuguccaggcuggagugcuguggcgugaucucggcucacugcaaucucugccucccggguucaagcaauucuccugccucagccuccugaguagcugggauuacaggcaugcaccaccacgcccggcuauuuuuuguauuuucaguagagacacccuguuggucaggcuggucucaaacuccugaccucgugauccaccugccuuggccucccaaagugcugggauuacagacgugagccaccucacccagccucgaaugguuucuuuaguuuuuugagaacucuaugaauugugaucuugcuuauuagaauauuauucaugucuuuguuuauauaacacuaauauauagcauuuuuucugugugcgaguuuuggaaguggugaguacacuuaaacauaaaaacauacuuuagauuuuugaaaacuuuuuucuucccaguacguagagaaaucgacacucuuaaugaacguuuagcugcugaaggacaagcgauugauggagcagagcugaguaagggccaacucaaaacaaaagguaaggugaaucccaugaaagucuuguccugcagauuauacaugcaggaaauuuggaauuuagugaaggaugcuggcugguuugcguuuugcugucagcagaccucgaacuaucuaauucaggugugggucuaggagaauaaggagcucgguucuuguuccuguucugccauggcucugugucacuagggucaaacgagccuuucugggcccccuuucuuccugugcaagacacaagacccauuugugaggcuauaggucuuugauugugugauuguguuugauugucacucucugucccugcagccagucacagcaccagccagcucucccagaaacugaagaccacuuacaaggcuuccaccagcaagguaugcaggccacuggcucuugagccaucauguggugguuaaggugugcagauguguacuuuaaguuguuuauuuuccaauuagaaaggcauagcagaaaaagauaaaugguuuuaagggaaauuuaguuuuuuaaaggaauguccuggcugggcaugguggcucaugcuuguaaucccagcacuuugggaggcugagguggauggaucacuugaggucaggaguuugagaccagcuuggacaacauggugaaacccugucucuacuaaaaauacaaaaauuagcugggugugguggcgggugccuguaaucccagcuacuugagaggcugaggcaugagaauugcuuaagccugggagguggagguugcagugagccgagcuuacaccaccgcacucuagccugggcaacagagcgagauuccgacuccaaaaaaaaaaaaaagaaugucacuaugcaggcauuuacauaguagcuuacccuaguaccuacagggauuaauauaugauguauuaguaaauauauugucuuuagagggaauauauaauuucucuuguuaauuggcuuaauauaaagggucugaauuuggaggaagcuaauaaauagguacaaauuagugaaaauuauguucugagcuaaaguuacauuuuaguucauuauguucuuuuccucaguuuccuaagugugaucaggaagugaaggucugucucuaaggcaaauagggauguucaugguuuuuguauuuucuuaaaguaucucgugcugaccuucuuaaaguggaaaggguuuaauuguuugggaauucauuugucugugauggauuacuaucaagugauauuuugagguaauuuuguaugcaucuguacuuuggcauauuucaaggauacaaagauaaauugaaauuuucagugaucuugcuaugaugguguaaguaguucuuguuagcuuuuuauuuuuccaauuuguuuccuugaguuuaaaguuaauuuagcaugacaucuauaguaagauuaacugcaauuaauagagcaaauuuaguccuucugccguuuguccucacuugauagucuuugguaauucuuuguuauucaaaagaaaaucugaaauuguugguauuuucuacuguacuuuccuucgauaacaucuagaauguaaguugcuaauuuauuugauuuuuuuuuuggccauguaaugucuagcuuauacuuacaaguuuugaacuuuuuaauaaauuaacuugaagcuuuuucuucauaaugaagugugaaauuauguucuuccucauuuaauuucuuuuuacauuaucuuggauuauguuguuuuuucugguguguacaguuguauauauacaauguauggucuuggaauuccaaaacuuucucauuauuacugaaguagaggaagaaaugauuauauaaaguuguccuuuaccaugagcaguaaaaaauaagauuuggacaaggguaaggauauguauaguaaugcuuugcuuuaaaaaauguauuagagauauuuaaagcccagucauuuuagguacuagaaauucaucugaauuuauaagaagcauauuacuaaugaucuuuauagccuuugcacacugcccauacccauuguaaaaaauaacuaugaaaauauaagacaucugaagauugaagaaauaauuugguaacagaauauauucugauucguacuacaguguggauucuuggugccaaagcuaagcaugaaugcaacaagagaaaggcuacagucuagcuuuauuacuuucccuccuucugacccagagccacgaaaagcaaguaacgugccuggugggauagcgggaacacaaaaguguguuacgugaacgcagaagagguuuuuccccuuccuggguggcuaaugagauuucugaugccuacgggggagggaagugaggaagucuaaccugcagcccucuuuaaagaaacuuauaaaaaucagaaagggcuuuuuccacaaagaaagacacuuaucuucucaaaaauauuugcaaacauuuucacaaccgugcuuuagauugcgccgcaguucaaacgaucugggaugaugggcgugagcgucaguuugcggcuuuguucugcugcuuuucuguuaugaacguucccucuagguaauucagucuguuuuguugggccucuugguaaugacgacuaagucagcuuuucuaaggaaaaagaguuaagguaauagauggucaaagugcagugggcauuuuggaagcaacacaugagaaaauauuugaaaacggcacaugauccccugcacagcuccagcagcacagcuccagcagcacagcuccagcagcagugcagucagagccucugggaaggagccacucuguucuuacccugcgaauggagcaggugaagaauguaacucuaguaguuuguuucuuauaauacuguuauuaauguuagaaguggugagagauuuggaaaaugaaauuuacgacaauacuguuacuuauguuagaaauggugagaggccuggaaaaugaaauuuacuacaauacgguuauuaauguuagaaauggugagagacuuggaaagugaaauuuaccaccgcuuauuauggugggagguuguguguguccuuuaauuucacucccuccuaaaauguuacaauguuauuuaacaucugaaugacacuuucuguaagcaaaagcaucucccauguuguggaggcauaauuuuccuggauugaauaggauauuaguguucagaaagaaaagaggauaaugauggguuugagguugaacaagugcuuuugcaauuccucugaccaguugcaguggaaguucuuccuguuacuggugaaaauguuggccucuuccucagccuuuuauaucacuguauccgaggagaauaacucgagggugcggacccaaauccaugugacaguggguugugcuuuauggucuuaggaagaaugaauuuagauguguuuuucagggcuaugccaaaucaguguuugaaacaaguuguguaaugccacugauuuuaguucuucacuuaguuuuuuuguuuuauucugaaaagucuacauuauucugauuuacuuaacagcuggacagcuguuuucuuaccaaagaaaaauuuaaaaagcaaacucugcagaaaucguuguguugaauuaguuucuuccucacucacuucauauuuuuccugacaagagggcaugagaacugucugcugugugugucgucauucgagacgaugccuuucugugguccgugauguguucgcguugucuccugcugggcugagcauguccaaaaggccaggggccuacggccgcgcugcccugcauccucauagcuggugccuguucugagcgagcgccaagucucgggcaaaccggcacaccuauuagugucgucuuuugauuccuccccaccacaggcuuuuuuuacacuugaugauacgugguugguguaaauucucaaaaacagcaaaaugugaacauguacagcgaucagugucauuagcuaaaguuaaggguuugggauguccuuccugacuuuuuuguaucugaguggcuagcuaacgauuuguuuaagaauuuggaaauuuugucucaugguuuggguuugggggagaggaccugaaacaccuaaauccacccuucugcagugagaccuuccaugccuggcugucagacugaggugggggagccugcacaggucgccgcgagagcugcacgcauucucugugauaugagcugaacccgccacccuuuccacgcagggcguuucagcucacacuugcgcuguguuccuugaugcuuuaacuguccuagucagugauuugugcauuuuccaagacgucuuuuucguuuucucuuucuugacuuagaaaaauuuacuucaguaaauuguuucacaagacuccccaucuugguuucagauugucuccagcuuuaagaccacgacaucgagagcugccugccagcucgugaaggaguacaucggccaccgggacggcaucugggaugucagcguggccaagacacagccaguggugcucgggacugcaucagccggugagucgcacacggaccuggccagccugcggaagcauggcugugcuuaaucccugagugauggacauucacuuuucuguggcagaggaacccuagaugcaaaagcgucauggaggagucaguggaaccccccacacauuaacccuuggugaugcuuaguguuguggccugaaguccugcauuccguggucuugugggagggugugcagcugcaccuugcauuuuguggucccguggguggguguccagcugcauccugcauuccaugcucccaugaauagaugugcaucugcacccugucuuuuccagguccccguggguagggcguugcaacucacagugaaccaaguaucugaggaaagaaauacuuguuuggaauggauuuaacuuaaauguguugaggaaucaguauuccaauuauuuguuuucuuuuucuuauuugagacggagucucgcucuguugcccaggcuggagugcaguggcgcaaucucggcucacugcaaccucugccaccuccugcguucaagcgauucuccugccucagccuucccaguagcugggacuacaggcgcccgccaccacgccuggcuaauuuuuuuuuuuuuuuguauuuuuaguagaggcgggguuucaccguuuagcuaggauggucuugaucuccugaccuugugaucugccugccuugggcucccaaaguguugggauuacaggcgugagccaucgugccuggcccucuuuuucuuauccacagccaaguguguuucugauuuguggauguauuugacuuuuuucccacaaguggagugcaguugagggacaguaguuugguacucacugaaagugaacacuaccugggcacguagccagcaguggaggcugauggccucccccagcagauguuugcccacagaaucacaggggcagaguguggaaagugacccuuuguuuucucuaaaaaaagauauuuuaugaaagcuaucuaagguggcauaauaccccuugagauaaaaauugcucaaauuacaaaugaugcucauugaaaaugccgucccagcuugugagacguuaaucacucacuggacucugcuuuuuagaggcagaagugaaugugauaaaccauuugaauagcgaagaaaguucuugcuucuccuuugaaacuguuuucauggaugagcgccuuggauugcuuuggaaaucauaguuuuaaaaaaagaauaaaaagguccuuucugauauuuccgaaauuucauuuggcuaauuggugcuuauuucucagauuuucccauuaaaucuacuuaaaaaaauaauggcuauaagagaaagacccaaagauccaaagacaugcuuaucucaacaguuguaacuggauuuggaugcuguuugaauuugaacucugggagauguucuggaacauuuuaauacuuuaauaaaauaaugaaacugugaugggaacgaccucugucugucauuuuccagcaugaugcagccagccugauaguaaaguaggaaaucgagucucugguuguccguuagcugacuucauggccucagacaggucacagcuucucccauuugggaaauguuuucuuugaucaauugaagcauacagaguaauagaaucaaagguggaagagauaucaguggucguguaauuucccauuuuuagaguauuugucuuauucuuucauuugaaaaacuauaaacugaugauagcuaaguuccgacuucuucauuuccaucuugcagaucacacggcuuugcuguggagcauagagacagggaagugccuagucaaguacgcaggccacgugggcucagguaagcacugccuaaggagugccguagccagaggccguugccuucuccaguguguuuuuaaaaucgugcaugauaaagccagcugcuacuguguaggaagccuuacuguuucgguugucaggggacaguguggucuguucagagacugggauaacucugucuugagcuuguaugggcucaauaacagggaaaagcuuaacucccuaaacaauguacauaucauguuagucugcauuuuauuuaauauuguauauaacccauauguaggaaauuuuguaacugaaaugugugcguuauuuuucacaaaauacauaucuguuuuagagguuuacuuuugauguagugauaacuuggauguauucaauaaaggauacuccaugaaugugcuugcgugcccguaguuaaugcuguccacggagugaaugcuguccacguaguuaacgcuguccauguaguuaguuaacgcuguucacguagcucuuuucugccuuuucacuuagagcuguguguguaccaguuuccugaccagacuuuguuucuguuuccucucgcacgugcugugugguuccuucccccgcagugcccucuucacuugcucacucgcccucccucacaccuccacgcugccaggcugagagguggcaucgccugugugcacagagggacagguguggguggggcccguggcucugagcgccugucugcccguccacagggcccugaugagcuguggagccuuccccuccccuuucccaggaccuccucuccuuuggccauuccugcugucacagugucuucucuuucuugcccuggacauuuccccuuaguguguagacaggcuggcgccuuucccguguuagacccccuccuccgugcugccuucuuaccugucuuccuccccuggcaucccacagacuggcuggggugccacagugucaccugcaguuuucuagcagugccuggcgugugugugauuggugcucaaauguagagcaaaacgcuguuacaggaacgagugcuguauucuguuuccuccuucaaauuuccucuucagaaacguuaaaaaaauuaaauauaugugcauagguuaaaaacuuaagacuugaaaaucgaaaugacuccuugaucccugggcuacagaauggauguuguguuaguaggcaugaaaucagcauucaucuuguacaucuccaucagagcucuuaggugagcaggugcguugucaaugagccaguuguauuaugauagguguaggucuuaaugguaggcuuaaaauacucagucaacaaugcugucaucagauguacugucauccaugcuuuguuguuccauuuauggaggacagguagaggagauguagcguaauucuuaagggcccugggauuuuugaaauggcaagugagcauugacuucagcugaaagucaccagccgcauucgccccuaacaagagucagccugucccuugaaguuucgaaggcauggaugucuccuuucuagcuaggaaaguacuagacagcauauucuuccaauauaaggcuguuuguuugcauucaaaaccuguuguuuagaguaaccaucuucaccaaugagcucagcuggaucuucuggagaacuugcugcagcuucuccaucagcacuugcuguuucaccuuguacuuuuauguuguggagacggugucuuaaaccucauaaacaacucucugccagcuuccagcuuuucuuccgcagcucccucaccucucacagcccucagggaauugagagucagggcccugcucugaauuaggcugcagcuaaagggaauguuguggcugguuuaaucaguccccaccacucaaacuuccuguguaucggcguucuugucauuuguguguucacuggaauagugcucuuacuuuccuucgagaacuuuuccuuugcauucagaaguuggcuguuuggugcaagaugcccagcuuucagccugucucagcuuuugacuugccuuccucacuaagcuuaaucauuucuagcuuuugauuuaaagggagcaaugugcaacucuuccuugcauuggaauacuuagaggccauuguaggguuaugaauuggccuaauuuuaguauuguuuugucucggaguagagaggccugagcagagggagagaugagagaaaggcugguugguggagcagucauaacucccacaacauuuauugaguaaguuuguggucuuaugugggugugguuugugccucuccccaaaaugacaaugguagcaucagagaucacaggucacuauuaacagacauaauaauaaugcaaaaauccaaggucaaggugcuggcaaaaagaaauuaaaaaaaaaaaaagaaaaaguuugaaauauugcaagaauuaccagcgugugucacagagacgugaagugaacacaugcuguugggaaaaucguggcaauuagguguucaacgcaggguugccacaaacccucaauuuguaaaaaauccaguaccuacaaagcacaguaaagugaaggguaauaaaacgggguaugccugcauccacacauagacguguacauacacgcauagucauuucuguucucuagaggggauuuaauuuucccuuggccagcagauagaguggacggcaagccuugauugacuuaaggguugguggccgguggguuucaggcuuuagggguucugcuguuccucucgcuuucccuuguucuaagggaguuguccuucaagggugugucuucacaggcccugagcuuuaguuucaucugccaguccucuccguguuagcucuuagaggcugcuuucugcuugguguccgcccucaugcccaguuuaggugcugucagugccugggggaggcgagcagcuggcccgcuccuuccuggcugccucuucugagggauccagccucaguuccugucacggccgcucacgucuggacugcacccucgcuccggcuggucucugugccuugagggagugcgucagcuaguggggcuuccagugcuucccucuggggccucugggccugggggccucagggcuuccaugaugacuucaagccuuguguuuauuuuuugcuguuuaucugcagcuuuuauaauuaauuccacuagggggucugaguggauccacagaggcugccuugucccagcaggaagaagucucuuccuguucuugugccuggcuuguguuuuuuauuggcuuuccguucuucacgcagguuaauucagccuucccgugcucacccacaauucaaccuucccaugcucacccacaauucagccuucccgugcucacccgcaguucggccuucccgugcucacccgcaguucggccuucccgugcucacccgcaauucaaccuuccuguguucacucacucaccgucaccaucugcucuucuggccuccaguauucggugucgucucuucgcucaucgucucuuuaguucuuucuuugugggucuguuccuguuucuuccaggaugccuucugcauuuagagaggugucagagaggggagaagacgccuguguuucuggcacguugucguguugcgugugucucuccucuuccuccuggggacuuguguuuguguuuuuccacuaggggauuuuucuuuuuuugagacggagucucacuaugucacccaggcugaagugcaguggugcaaucuucauuugcugcaaccuccgccucccacguugaaacgauucuccugcuucagccucccgaguagcugggauuauaggugcccgccaccacgccuggcuaaauuuuguauuuuuuuaaaauuuauuuuuaauuaauuuauuuuuugagauggaguuuugcugugucaccaggcuggagugcagugguaggaucucggcucacugcaacuuccgcaucccugguucaaaggauucuccugcuucggccucccgaguagcugggaguacaggcacaugccaccacgcccagcuaaguuuuguauuuuuaguagacgugggguuucaccauguuggucaagcuggucuugaacuccugacuucaggugauccagccgccucggccucccaaaauguugggauuauaggugugagccaccgugcccggccuggagauguuuugaucucuuaaguugaccuaacuaaagggagugguggggcuggugggaguugaaucaguacaacucuacaaggagauggucuugacccugaaucacacucugccucuuuccucuuggguccucugagcacaaugcccaacagcagacuccccgcucuggcccccaggagaggaaaaugggugagggucccaguuucacugugucugcgccucucagaggcagaggugacacugguggcagagguuguuguccccuuuguucuucucucuuuagauuucagcuuaaauuuuaugacaguuaaaugugcacgugauggaaggagccagugccuuugacacuggaugaaggguagccguggcuggcauccccguuucugcuccccucguggccacuguggauugggucaggugcccauggauucugcugcugcgccuuuaaaucauggcucacgugcugccccggccuuccugcuccagccggccuguugaccguccacuauggaaggugaccgggggugauugagcucucucgagggccucguuauacaggcgugguuuucauccuaaccccaacaugauucugugccgauuuuguaagaucaggggucaguuuucacacuauuuugagugggugagcagugcugcgaagcaacugccuccacagcucccgucaccaugugccugccugcccuaccccuccuucugugguguggugccuuccacccacaccucacaguggcccagcuucguuugugauuagcugaggguugggauagacauaauaaagugaaaauugaugauugaucuuaccaaaauuucucaucgaaauuggaagcauuaauacuauuuguuagugggucuagugaucguuugguuuuagcuccauugagugcuuaaguuuauugcuuauaaguguacacgguuuccaccaguuuuucccacaguuaucuguauuuuaauauuaauaaugaggcuaucuucuagcauuuuucauuuaguuccuuagaaaaauauaauucuaaugguauagcuaccaacauuuuguuaaggagauaaccuauucagauuuggucaaauuuccuauauguucuacguuagggacaugcauuuucuucacaagggguggaaauaaggguugguguccccagagugacaggagucagcucuuugcucugcugacuggugcugacugaugguagcucaccccaucccaauuccugucguuugcuuugggaacaucccaggugggcagugugggcuccagacuaggucaggccuguggagccgggcucuguguucaaugcuggcauuuaugugcgugcuuguggucuugcugaccacaugucaagcuauucugucuacauucaagacaggagcaagggggaaggugaagugccagggucuccugcuccuuuuucaagaaaaugauaggccgggcgcgguggcucacgccuguaauccuagcacuuugggaggccgagacgggcggaucacgaggucaggagauugagaccaucuuggcuaacacggugaaaccccguuucuacuaaaaauagaaaaaauuagccgggcguguuggcgggcgccuguggucccagcuacuugggaggcugaggcaggagaauggcaugaaccugggaggcggagcuugcagugagcugagaucgcgccacugcacuccaaccugggagacacagcgagacuccgucucaaaaaaaaaaaaaaaaaaagaaaaugauagcuuccucagaccucuggcugggugcgguggcucacgccuguaaucccagcacuuugggaggccgagguaggcaggaguuugagaccagccuggacgacauggcaagacccggucucuacuaaaaauacaaaagaccgugucucuacuaaaaauacaaaagacccucuuuuuuuuugagacggaaucucgcucugucgcccaggcuggagugcaguggcucgcggaucuuggcucacugcaagcucugccccccuggguucaugccauucuccugccucagccucccaaguagcugggacuacaggcgccugccacagugcccaucuaauuuuuuguauuuuuaguagagacgggguuucaccauggucucgaucuccugaccucgugaucugcccgccucggccucccaaagugcugguauuacaggcgugagccagugcgucuggcccgacccugucuuuacuaaaaauggcaagacccugucucuacuaaaaauacaaagaaaccccaaacuagucagguguggugguacauucuugugucccagcuacuugggaggcuaagguaggaggaucaccugagccuugaaggucaaagcuguagugagcugagaucgugccauugcauuccagccuaggcaaccagagcaagacccuaucucacaaaaaaaaaaaaaaaaaaaaaaaaaagaagaccucugccaaauaccccuuuuguaaggaaagugggaggacaucauagacuguguaacccaguccugauucauucucugaggcuggcagagguuauacucucugggguccuggcgucucuacuagucacagaacagacugggguccuuaggcugggaaggaaggcggauggggcggggcuuaugguaauaaauugugucugccacacuauaauuugucuucacccguugucauaauuauguuuucuuuuuuuuaauccugauuuauuuuuagcuaaaaaugacaucuuugucuauaaaaagaacuagaugaugaauauccuuuuccugggguccuaaacuauagcgauuuggugguucauaccuuaguuguuuuuauugugccuguguucuaauucacacauuuauuuauaacuuaacugaguggaggaucaaauauugaacucauaguucuuuuaauguugacuuugaaauacacgcuauagcuaauaaauguugauaacauguuuuugucacuuuaaaccuguuuuuaucauauuuuuauuuugcaguaaauucuaucaaauuucaucccucagagcaguuggcucucacugguauguugauuuuuuucuuuauugaacaaaaugauagauggucuuaaaacaacuauaaauauuccuuucuuaucguagcagaauaauccauggcuuuuaugaaaguuaaucuuuaguagacauuuuaugaauuaaaugagaaauggauaaaggaaaauacauugagcaguacuuucuagagacaguaguggauaagcaguuggauuuauugugagaugaagauggcuucacggucuucucgaagccuuuccguacagcaucaguauguuugcugcuccccccgcaguuccuguagacggagcuccuugaggcccugugguuaccauucuguucccuuagauuguaggcaucugauauggaggaaaagagaaaaguagcacagagacacagcaaguugccaaugucagcauuuuuacuucuuucuggguaauuuaucuaacccgugguagcuuggauuugcuauaauuucagaguaguuuuaaaaacgugccuuccuuggucgcuuuuucgaggguagccuuacaguacugaggacuuuuccugugagauugucagacccccacagauccccaugauagcccagggacauuggugaugaucucgaaggauguguguaggcuuucaguagaccagagguccuuaugauuuuucuguaaaggaguaagcagugaauauuuucaucuuugcgggacauucaggcucugucgccaguacugaguucugcucuugcagccuaaaagcagcggacagugcacugaugaguggacauggcuguguccacuuauucacaaaagugggcggcugucuggguuucgccuaugggccaaauugugcugacgcaggaauagaacacugagguugagaugacuggccccuucaugcagguggaguuguuuaagaaggagccccagcaacagguacuuccagugugugggaugcagcgagucaugcgguuugguuggaguuucuaugugagagagaaauguggugggaggguuagccugagagucauuuugagcaggcccagaccacauagcugacuuucaccuucauacguggaugaagacuaaagcagacaaggaguuuacaccuuacgaaguuggcgguuugugggaugauugaaaagggagcaaggagacugguggcaauuagacguguccagauucaaaccaaagggcuggaaaagaggguggaaccagacacauccaggaacugaugaagacuuggaaacaugagguaauggacauagagaggggagaguuagacuaggaaacaugagguaauggggauagagaggagaguuagacuuggaaacgugagguaauggacauagagaggggagaguuagauuaggaaaugugagauaauggggauagagaggagaguuacacugggaaacaugagguaaugaacauggagagaggagaguuagacuuggaaacaggagguaaugggcauagagaagggagaguuagacugagaaacgugaggugauggggauagcgaggaggguuagacugggaaacaugagguaauggguauagagaggagaguuagacugggaaacgugagguaaugggcauggagagaggaggguuagacuuggaaacgugagguaaugggcauggagagaggaggguuagacugggaaagaugagguaaugaacauggagaggggagaguuagacugggaaaugugaggugacgagcauggagagaggagaguuagacuuggaaacgugagguaaugggcauggagaggggagaguuagacuuggaaacuggagguaaugggcauagagaggagagaguuagacugggaaugugagguaauggggauagagaggagaguuagacugggaaacgugagguaacaggcauggagagaggagaguuagaggggaaacgugagguaacgggcauggagagaggagaguuagacugggauugggcaugauguugauuugaggaggaguugcaaguccgggcaguacauucauuugcaucaaaugugcugcaucagcucagagcagcuccuuuagagaagcuggguggcagugaagagaagguggaagccagccugcccgugugugggugagagguggccaugcugguguccgaggccuguucugugccccgcagugcuguccuuuugucuuuccaauccucagucaaagcguuuccucgcaaacuggcugcugaaaacagagugggacgggagccgcacacaugagcagugcugauaggugccuggcccauugaaaggccgcguguguguugaauggauggagaugagugucgcuuucccgaacgucucagaguugauugcagcuguaaguucugauaugauaggguuucuuagguuagauagauggagaggaaaaucuacuauuuguacauuuucucugaacuuccaggacuuucuaugcuaaaaugaaaggugaaauaguuuuauaaguaaucauuauuuccucaauuuuggacauguacucuauuuucaauagcauuaugcagucucagaaaagaguuauuuaaguaaaaaguacauuccucucacuaaguggucacuaagcuggaaaggucugacugcugcugcuuagccauaguggcggugaagagcgcauuuuaccauggucugugccuuggguaauuuuccccgauuucucucuucagcuucuggagaucagacugcucauaucuggagauacgcggugcagcugccgacaccccagccuguugcugacacuaguguaagcaccuuuccuuaccugugaauguguaggaugcugaugucugcgaaucugagaauccauuuaugauaucugucauggacggaauguuuguguccccccaaguucaguguugaaggccucacccccgguaugguugaauuuggagauugggccucuaagguaguaguuaagguucagugagguugcgugagguccucauaagaggagacaguggagagcucaccuguguucucaaucucucugucacucuccgugucacguaagagcagagccagagggcggccgucuuuaaggaugagcccgcaccagaaccugaauuggcuugaucuuggacuuccagccuccagcacugugagaaaauaaaugucuguuuuuuaugcgucgcccggucugcggccuuuuguugcggcagccagagccaacugagacagauuucaguaccgcgcgcagagcgggggcugcuggagaaaugccgacgguguggaccuggcuucgggaccgggaauggguacaugcugcagacguuuucagggaccugcuggagaaagccuccauagcggcgaagagcuuguugguagaaauacggacaucaauggggacucgggugaaggcucagagaggaaaggggagagcuggagagaaagcuucuagcaucucagagaaugcagguaucauagacagaauguuguggaaaaguggauguugaaggccuuucugcugaggcuuagaggaggcgagggacaggucacggggaaccggaagaaagugauccucauuacaaaauggcugaggacuuggcugagcugagauccugugaaugaaauguuaaaggugcagccuggcugcucuccucgcuuacaauaaagugugaaaggacggagauacuccgaaagaguuguuaagggaaaggggacgagaacuuguaagauuugggaaauucccagccugugucugugacaaaaaaaagagaaagcugguuccgaagagcacaugcaggguuugucugaacagccaguugacagggaggcgagugugggugggagccacagcuuuaagcacccaccgcagcaggauccaggacuggagaugggauuauacccagagaccccgccagcuugaaccagaggggacaugguggggacagaaugaaggaaggcaucagacugcugggauuccacagcacagaaaccagagcugccugggcgagaaccuuuaccacccuucaagaugagggaagaaugccccgaaggugauucugagguuggcagggcugcagcucucacugcagucccaggacaagagccuguuucuuccuugguuucgaagugugggagccuccuugguuucagggccagguugcccaugguccagugcugugggggugggguugccaggcugagccaagggggugacaccucugccccagcaugccuggaggguggcgcauccagaccaagagggacucucuggagccugaagagcucguggaguuugccuugugggguuuuggacuugcuugggccccaccacccuuucccuguugccucuuucucucuuuuggaaagggagcgucuguccagugccugcccuacuguuguauuuugggaacauguaacuuguuuggguuccgugguuuacggcuggaggggagcucagcuucagggugggcgaaucgcacucugagucccacccaguccugauucaggugauguuuuguugagacuugggacuucacaccuuagcgcugaugcuggaauaagacuucuggggcuguugggaugggaugacuguauuugccaugcaagaaggauaugaauuugggggaggccagggacaggauguucucaacugaaugucuccgucccccagaaaucuguguugaagcccuaacccccaguguggcuguauuuggagauggggccucugagaaagugguuaaagcaaaaugagguaguggaggggaugcccugaucccauaggaugaguguguccuugucagaagagacaccagacagcucacccuuauggcugcccuugugugugcacgcucucuuucuacccccuccccaucuguccguuuuuuuuuuuuuuuuuuugagauggagucucgcucuguugcccaggcuggagugcaguggcgugaucuuggcucacugcaaccuccaccucccggguucaagggauucuccugccucagccucccgaguagcugggaccacagaugcgugucaccacacccaacuaauuuuuguauuuuuaguagagaugggguuucaccacguucgccagacggucucaaucucuugaccucgugauccgcccuccucggccucccaaagugcugggauuacaggcgugagccaccgugcccagccucucugugcuaauauuaauagaagagccccugugggcacgcggcaggauggcggugccacacaccggaagaggggacucaccagaagcugcacugguugacacguuggucauggacuuagagucuccagaacuggaagaugacuaauuucuguuuuugaagccuuuuggccuguagucuuguguuuuggcagccugcguugaaugagacagugccuagaaagaugcuccuucaccucuguaugcaugcaucugcuccauccuuccuuucaacagacaguaaacauuuaccguccacucucuuacaguugauguuuggauccuguuucucacuguuucaucuguuuaauauuagacaucugguguaucuuucauggacguuuaucaucacaucaacuaauggccuuuaugacaucaauuuuaugugguucacauuuaaacguagguaacaaaagauguguauugagaagaaugaauucauguauuuauaccauaaauucauaaaauucuucacuuacuguuugccuugugcucucugcaguagcccagugcccuauguuuaugaucacaaagaggccugaauguuucucugagagcaguuaucucccuaguuucaaugacaggauaaauguuaguggcgugaucuucccacgugcucagcccccccaguucggugccugaacaggugggaacagugccaggcagacaguguaaaugacguccacgucuagaaguuucaguuuguauugggcugugauuguugcaaggaugaaaguaaucuaguuuugauauuuucaucuuggaauauuccuugaguuuucugcuuugugaacauucuaaacacuguucuauguggagauaguuaagcaguuaauaaauuccagugauaaaugaguuuucuuuaguccuaauagagguuaucauaguucauuuuuaacugcauguauuguguauuaacacaguuuuguucucuuuguggaauugccagacuauucauuauguagcgcauaacacuguccacuaacacgcacauuuagugaugaaacaagugaaaugugugcugauggugggcgugguggagaggugaggagggugagcauugaugcuuaggaaauucagcgugugcacugaugguguggcggagacgugaggagggugagcauugaugcuuaggaaauucaaaaugugcacuaauggcgggcaugguggagaggugaggagggugagcauugaugcucaggaaauucaaaaugugcgcugauggcgggcgugguggagugguggagaggugaggagggugagcacugaugcucaggaaauucaaaaugugcacugauggugggcgugguggagaggugaggagggugagcauugaugcucaggaaauucaaaggaguuaauguauggauuguuuuccaaauaaaauaagaaaaacacuaauuuugugagagggaagauucauguccaguacuuacauuaaaaacaccuaauaguuuacuuagaauguucacuuaauuuuauuuucuucuuuacuacuuugcuuguguugggugagugcacuucucauauugauagcugccaccucaagauuuggggcugguguuggggguucugaguuaaagaugaaccucugugaugugcugugacuugagcuguccugggagcacugcacacacaguuguguugggcccucccuaauaaggaggaggcagugcagccuguggacggccaggucccugcagaaauggcgugggaggcuccuuccagcacuacuggaugaaaugaggcuccuuagguggaaagcaguuuuguuuucugaagcuuuugccggccaguguugacucugauuugcuuagcaguucuaauuuucaauuuuaacacaaacucuaaucuguuaaaaucuguguucaucuugaaucauuauagcuuuugggcaaacgucuuguguuuuaaaauuugcaucugugaguuuugcuugacauccacaguguugauaaggaagcguuuggguggcguaguggaaacagacuuagaccaacagaaugacugucacaugugaguuagguuacacugaguuacucguuuaacuuccucagccuucuuuuucuucuuugagggguucaccccguggcugcuccuggcucuuugcugugcucccuccagagccguuuucccagccacgugcagugcugucacccaucacccccugccuucaaggugacguaccgaguaccccccugcugcagccugucugggggccucugccagccuugugagccucgggccccccgucccgacugagcugcacgugccacccugaacuugcugucucuggguguuccuuuccuugugccacccgucucaggaaacgucccugucacccagugcuuuagaccaaacaccuuuccaccgucugaacgccuguauuguucucuuacugccuguggaaaucacccugucagccacuccugcagcagagggcgcuucaguucuuucuucccacccugcuccaggccgcccucccugcacuucucucaucuccuguccgucucccccguuguuuucuggggcugccauaacaaagugccacaggcagggugacuucugaacaacagauccguguucuaaacaacagauccguguucccacaguccuggaggcuggaagcccgagaugagggugugagcagggcugguuccuccugaggcgucuuuccauggcucauagauggcgucuucuccuggauccuucaucccucugggagugucuguguccucaucucuucuuacaaggaugucaguccuauuggaauaggauccacucuccuggucucauuuuaccuuaauuaucucuuuaaagccccuuucuccaaacagccccauucugagguccuggggugaggacuucgacacaggaauuuggguccacaguucugcccauagcagccccuuccacuguucccuccgcaguuuguucacacagcacacaccgggcaucacauccugccgacagccgucuggugauuuugcaucacacggaauaaaaccugguguccuuuccagucucccgggauuacaggagcuguucccgacuuugccucccguagcuguuccgcacauggcgggaauguuguuccucagcccgggcgagccuuacuuaaccuuuccuuuccucacauccgacucacgugcgaccucaucagagagucccuccucaguaauucugugugaaauagcgcccccauccagcugccccuuguccuguuuuauuuuacuucauagaaguuacuaccaccuuacucugugucuccauguugauuuguguucccgugcugcucugcauccaugugauauguguucccgugcugcccugggucccugugacgugcuuucccuugcugcugugcgucccugugacgugcguucccuugcugcugugcguccaugugacauguuuccgugcugccgugcgucccugugacguguguucccgugcugcugugcgucccugugacgugggaacccuugcuguugugcgucccugugacguguucucgugcggcuguguguccaugugacguguugccgugcugcugugcgucccugcgacgugcgaucccgugccgcugugcgucccugugacgugcguucccgugccgcugugcgucccugugacgugcguucccgugcugcugugcgucccugugacgugcauucccuaguaauguauaugugcucaugacgugccuguguuaggccauucuugcauugcuauaaaaaauacuugagacaggguaauuuauaaagaaaagagguuuaauuggcugauucugcaggcuguacaggaagcguggcaccagcaucugcuuggcuucuggggaggcuucagggagcuuggagcuuucacucacagcagaaggcgaagcgggagaaggcgucaugugauggaaacaggaguaaggcgggggcggggggugccccacauccaagcagccagaucucuugagagcucacccacuauugugaggucagcaucaggcuaugaggaauccucccccaugagccagacacccccaccaggcccggccuccaacacaggggauuccaguucagcaugagauuugggcugggacaaauuuccaaauuaucaguuccaguacuaguacuuguguauauaugacauaccucuccauacuaacggguguguguguguguggucucucucuuuugcuagaacagaaguucucugagggcaggggcuuuaccagggguccucacuccagaguuccuaccugcuagauugagcguaguuuugcaugugugcaugucagaagccgucuguccucuucugcauuguguaagcagcaccugggcuggggguggggacuggcacucugucacccccugauaaauauuuguuggaugaauauacagauuuucuuacagagcuggcuguaauguguuuguuuuagccuuggccuuugacagggggcuugauguuacaaaggaaaauagacucuuaugacuauagcaauagaauuccaaguauauuuuaaauaggcucuugagaaugaaaaugccuuuuuguaaugugauaaauuacugacuuucauuuguauuugguuaguuuuauauugcauuucuacuaguaacugaugaaagcuuaaauguugaaaaucauuuuauuugccauucuguugaugcguggaaauaaaugguaguucgguugacaauguuguggauuccacuuuuuuuucuguacgagauggucguagaguugauggguguucacgggcagcaguuaugggucagaggaggacauacucaucacuguggccagcaccaggcuccuaguggugaccaucaugauggauauguccucaagagauuaaugagaaccaucuauuuuguagcuaugucagaagaaacucaagauuuccaggaaaugucuuucuuuucuggccuucccuuuggcagcagauaucuggggaagaugaaguagagugcucugacaaggacgagcccgaccucgauggggauguguccagcgacugccccaccauccgcgucccacugacaucccucaagagccaccagggcguggucaucgccuccgacuggcugguuggggggaagcaggcugugacugccuccugggaccggacggcaaaccuguacgacguggagacguccgagcucguucacucucugacaggugccuggguucucugaguccgccgccuccuggcugugcauguuaguuuauguccauggguuaugucugaccuugccacuuacuucuugaccagaaugagucucuguguucuuggcucuucugugguaauuuuuggagauucuuucuauuaauaauagaacuauugguagcuaaauuuauuuugucuucagggguuuuaaauuguagcauguaguaucuagauauuggacauaugguaguuguauuaguuuuccauugcucuguaacaaauuuccacaaucuuagugucuuaaaacgacaggaauugacggccucaugguuucccaggucaguaauucugggcccgugguagcugcucuucucccugggcccucaaagaccuaagugagggugcugccuggucaggaccuccccaaggcugcgguccucuuccaagccugcuggucauuggaggagcuccuucuugcgucuggaguuugaggcccugucuucuugccagcugccagccggggcuccucugggcgugcagaggcugugucuggcccuggggccccugcacagggcuugccuuucccacacagcagccgcuuuccucugcagcuggagcuccccugcugcucugaacucuccaacuucugggacccuuuuuaagggcuaggccagaccacccaggacaauauucccuuugaugaagucaaagucaacucauuuagggaccuuaauuacaucugcaaaauccuuuuugccuuauaauguaucauaauuaccagaaagauaaucucauccuauuuacaggcucugcccuaacugaagggaaggguguuaggcauguacgggguggggguggcuuggggccaucuugggaugcugccugcugaaguugcuucugcgaaucuaucucuaagugcauuuccugcaugagcguuaaagauuguauuugacugaggacccauagcguuguaucauuagaagguauucuaagcaaagaaucaagauuuaagugguucucacauucaaccuguuaauuugccugaccuucuaacugguagggucagaaaauggguuaugcaccuguuugguuuucuguuccuuugacauggacggcugaaaggacuucagcuucugagggaaaaccugccccacugugacccacaugcugcugagugauuccauuaggucagguucacagucucagagagacggcuucuuggguucuugugcuguugaaaagcgucucucucagcgugcuccucaggugaugaccuuguguuuugccaucuugguuacagggcacgaccaggaguugacgcacugcugcacacaccccacccagcggcucguggugaccuccucccgugacacgacuuuccgccucugggauuucagggaccccuccauccacucggugaauguuuuccagggacacacggagugaguugcgguaguuuagacaucuguccuuagucaugaaaaaguucuguggguugacaugaaaacuuaauucuagccuuaauuuucaguauuuccgacucuacuaucuuucaaaaaaauaacuaccuuucaaauucugcuauucuuuuucuaaacauuuagcuccauuuuggcuauuucaaaggauguaggagauuaagagaaggcacccuccgaaguucucucaagaaguuuaaugcagacagaaugggggaguggguggagaggguuagagaagagcagggcugccagagccuguagcugagcacaggggccggccacgccaccauaggagccgcgggagcuguuacuccuacccacggggugucuccuggaucuuuuccaucuaguuuuuguuauuacacgugucugcgugguauauucugggagaagguauacacauagacgcgcaaacacagacauagacccucaauccagugugucccucucugcuuggguuucucuccggcaacucaaguguaaggucuuuuuuuucugagacggagucucgcucugucgcccaggcuggagugcaguggcgcuaucucggcucacugcaagcuccgccucccggguucacgccauucuccugccucagccucccgaguagcugggacuagaggcaccugccaccacgccuggcuaguuuuuuguauuuuuaguagagaugggguuucaccgugauagccaggauggucucgaucuccugacgucgugauccgccugucucggccucccaaagugcugggauuacaggcgugagccaccgcgcccagccguguaaggucuuaacagaacucuucaguucuuuccgugaccgucuccuucccccagucuggcccugcucagucaaugaugagaccgucugcccagucacgggggcugucuaccuagaguguucccugguucuucucuuuuaaucucuguuccccguucccccaucaugccccacugugguccacuggcaagucuccugccagccaugccugugggaucuucccggccgcuccucgcuccuccaugcucccccuaccucccaccagugcugcucuccaccccgacgucuggauaagcagugugcauugaaagguuuauaaaugaacuccaaauaugaaaaucuguuuuauauguuuaacguuaguuacuaaguuuuagauuuaauguucaaaauguuaguaagauguuggaaaggaaaauaggacuuuuuguuuguuuguuuguuuguuaauagacggagucucuuucugucgcccgggcuggagugcagugguaugaucucggcucacugcagccucugccucccggguucaagcgauucuccugccucagccucccuaguagcugggauuacaggcgcccaccaccaugccugguuaauuuuuguauuuuuaguagaggugggguuucaccauguugguugggcuggucuugaacuccuaaccucaggugauccgccugccucagccuaccaaagugcugggauuauaggugugagccaucgcgucuggccaggacaacguuuuuaaaaagaagcuugagauuggaaagcuaauuccuugacucugaggcuggaacgggagcaggcagcagucacgaccaugcguagagaucuuuauggcagccugggucuguucugggggcaucacacgcauuaaacugcuccguccugacaucaggucagcguuuauucugccagcuccgucagcgauagccauaguaauacagaccucccgguggucaguggcugaacgcagcacuguguuguugcugcaucagggugcagcaggcgcugagcugggcccccaugagcuccgccacaugggccugaccccgcugcaggccagcucauuggugaggaagaugcugcagcucggggagcgcugcuucccaugcauguuagcuuggauguggugcuccccgacguccaccagaugcagaggggccccacagcaaagcccuggcuggaccugggcccaccaccuggcaccacuguguagggcggggcagaggggcccgcaugacugcccugcuguuucucaugagaauucauuggaagggcagucggaggccuagaggacgggaggagcaagauggucucacuccugcgccugcagugcuuuccuaagcuuuuugcuuagaaaaguuucaagccuacauaaaaaccaacagaguaguacaguguacccacaaacccuucaccuagguucgccuguuguauugcagcacugcugucucuuuacacauguguacacaccucucucugaaacacacgcccacuaacccuucaccuagguucaccuguuguauugcagcaccgcugucucuuuacacauguguacacaccucucucugaaacacacgcccacuaacccuucaccuagguucaccuguuguauugcggcacugcugucucucuuuacacauguguacacaccacugucuguaacacacaacacgcacuacccugucaccuagguucgccuguuguauugcagcacugcugucucucuuuacacauguguacacgccucucucugaaacacacgcccacuuccccuucaccuagguuugccuguuguuguauugcagcacugcugucucuauuuacacauguguacacaccugucuguaacagacacgcccacuuauccuucaccuagguucaccuguuguuguauugcagcacugcugucucuguagauguguacacaccucugucuauaacacacacuuguauauuuucuuuggcugagcccuuugaaaggaaaacuccagcaugcauuuucuaagaauaaggauguucuccuaauacaguaccauuguucaaauaagaaaauuaguaaaaauucuauggcauccuuuaucugguccacauuuaaauuuacucaguucuccccaaaaugucuuugauacuuuuuuuagagcuaggauuuaaucaggauucucucaucacauuuagauauuauguccuuuggcuucuuuuaaucuagaaugguccuucccccauuuuuuguuacuuuuuaggauauugaguuuuuuggugaagaauccaagccugcucuuuugcagaacgccccucauucugcauuuuucuuaugacuuccuuuaagugccccucugcugugcuauuggugugcugaagcgcuccugcaguuaagauggcgucugcaggucugccugccagaggugcucuccuguuucaaauagcgaagcgacacuauucuauggauguuaauuccccagugaccuuuccucgguccagggcuucagcucauuguuacgcugaguccugcagaaggggaucuuuguacuucugucuacacugguuaguuggcacuguguuuuuugaguauuagcgagcauagacaccugcacuuuguugguguuggugguugugaucccugugguugcuuugguuuuggcuucugugaugccccccccccccguggaaccugcagggcccugagugccaccauccuggcacagcucccugccccaggcugggaagacccagcagcucucacugcauugacucuggucaucuguauggagcacaaaaaucugucagagcuuugagaauugggugaagaggguaguuuugugucuagagagcagggcagcuuccuaugugcuucugauauggggguugcagggauaggccagugugcccugcugugccuguccccuuugagggcaggauggaaaggccgaagaauucuguccagaggaggacgcaguggagccagggcuuggugaguugcugguuugugccaggcacuguuggagccccuggcaucaccccaguucagagagagaaacugaggcaugaggaggccaggugguuugcugaggguuuggcucuagggggucauuccagagcagucccuccuggugccuucaaggugccucuuguguuauuuaagacccuucuaguccuguauugucucuguucaguugccauauuuaacuggaagauuuuauuuuuguuuuguguaaaaagaaaaguuuuuguauuuauaucaccagaguugauugcaagugcauguuuucgcuucuaaggcuguugcaaccguguggucuuggccauuugacugugaagugaagucagugcugguggcaucuuuaaaauaucugcuuaggcugggcgcgguggcucacgccuguaaucccagcacuuuggggaucaccugaggcugggaguuugagaccagcuugaccaacauggagaaacucugucuuuacuaaaaauacaaaauuagccaggugugguggcgcacgccuguaaucccagcuacuugggaggcugaggcaggagaaucgcuugaacuugggagguggagguugcggugagccgagaucacgccguugcacuccagccugggcaaugagcgaaacuccaaacuccgucucagaaaaaaaaaaauucugguuaauuugugguacauuuuugcagcuaguggauacaugaaacaaugguaguuuuuuagagagcuguacuuaugaagaauguaguaaguguuaugaaaaaguucuuacuaauguggaccuaugaauacaguuuccuaggguuuaugucuuccuauuggaaucagguguggggguagaguaagguggaguguguaauucccgugugcccuuucucccacaugggucuuccaggcuguaggcugugcuuccauucaccugaaccacgggggugaggugaacguggaccagaccugcccgggccaugcuuacucagaucguuuacgcuuucuuuuuucuuacucaaauuaucaugaacuagcguaucuuguugauguguacauccaaaaauacguuuugaaaagaucucucuuuggcgcuaauuuuguugcugugucggggcgaguccgcugggcuguuggacauugagcuuccccucaccggccuggcgguuucucagcugugcgcaugcaggaugagggcuuggucagcagguggagccguggacgccuuuauugaacacaaacucuuccuuccugacaucagaucagcuguaaaccuuuagacgugccucauaaugagaaaagcaggaaaugagucauuuuacaaaaauguuucaucugaggugucuucuuaguaacacuugccuuugucuccggcauggguuuuguagguucgagccaauacgacaaauaaaaccuacagagugcgugauccuuacaaauguguagagcugugcauccgcgccacagcacaccagggugagggccucgcagugcgguuuagguccugagaugugcguccgcgccccagcacaccugggugagguccggggugcggguuuaguuccugagaggaauggccagguuguguguguguguuccguuuggucacuugucugggacguucugaacaugacuuguaagagcacacccuggguccccugccuucccugccaccaugucauucugagggacccucugcgccgggggcuucucugcaguggccacggcaucgccaaggacauccgugagccuccgauggguguccagcguguuagcgcccagacccacagggccuggcacccugauaggugggaauguuggcccagggccgggccugaggccugcaggacugccugcucauccgggaaguagcucugccgguuuuacagggugauccugaguucuuuucacuaguucuuuuccugagcauugaaagcaaaagucagacauguguucuuaggaaguuugcuguucuuguugauguaggcuggaaaguuauaugcaugguguuuuuagugauaccccuuaaacagaggcaguauuucuucaacaugugugacuaaaaauacccuuucucacauaauuuauauuaacaugauguggaaugugcuuuucaaaguuuuaucuuagggcguauuuucacuuguaggaacuaagcguaaauucuuuaguauaguauguuggaaucuaaugucuuuuauaauguaaauaauuaacugucuaguuaaggugaauugcuguauauuggguuuucuuaaggcaagaaguagcucuaaaggcuuaagguaacuggcccaguuuugugauccaguuuccaggagagauuuuuccccacuuucuuuuuuuucuuacuguaauccccauacuuuuacuugcauucugugccuuuuugaaagacuggaguuugaguuccaaugcuucacuguaagaaagaaaaguguagcgaaauggguccccugaaacguguggucauuaccuuugcuggauggggauggagcuccgugcugugagcugcugaaggcuuugauccuacguguuuagaaggaccagucaccuuuuccuuuugaugugucuuauuucuuuccacucuguguuguggcaucucuguauuauagcaggaauuuuaccaugauaguacuuaguuggcguaacuguguggcuguuuuuauuugacuguuuguuagugacccagcguguacugauuuauaugaaaagcaauuuuagauacuucauauagcagaaaugugaaguuguaguauguguuguuauuagaaauaauaaaaaggcuuaauuugaaaauuucagugugucacaggaauucagcuguugguggcuauuucucucucucucuuuuuuuuuuuugugagacggagucucgcucuguugcccaggcuggagugcaguggugcaaucucggcucacugcaaccuccaccuccuggguucaagcgauuccccugccucagccucccaaguagcugggacugcaggcacgugccuugguggcuauuucuuacaccuuguuugauugcacuccguagauugauguuuuuugcaaaugaaggucuguggagcccagcccuggcugagcaggucuguuggugccaguuuuccaacagcacgugcucacuuccugccucucucucacauuuuggucauucucacaauacuucuuacuuuuucauugugauuauaugaggguggucagugacuuuugcuguaacuguuauaauugguuuugaggcccugggaaccuugcccauagaagacagugaacuuagucgauaaaucguguguguuccgacugccccacuaacuggccguuccuucgucucucaccuucuccuaaugccucugacuucaugagugagacacaacacuguugaaauuaggccaauuaacaucccuauagcagccucucaguguugaaaugaagaguugcgugucccucacuugaaagcuggaaaugacgaagcuuagugaggaagaugugucgaaggcagagaggcugaaagcugggcauccugcacuggacagccagguucugaaugcaaaggaaaaguucuggaaggaaaguaaaacugcuacuccagugaacacacgaaugauaagaacacaauccuaaugcugauaugaaggaacuuugaguggucugcauugauuaaaccagccacaacauucccuuuagccaaagccuaauccagagcagggcccugacucuucaauucugugagggcuuagaaaggugagggagcugcggaagaaaagcuggaagcuggcagagguugguuuaugagguuuaaggaaggaagccgucuccauaacaugagagugcaaggugaagcagcaagugcugauggagaagcugcagcaaguucuccagaagauccagcugggaucaucgaugaagaugacuauguuuaauaacagauuuucaguguagacaaaacagccuucuguuaaagaagaugccacguagaacuuuccuagcuagagaagagaagucacugccuggcuucgaaggacagacugaugcucuugugaggggcuaguacagcuggugacuuacaguugaagccagugcucauuuaccauucugaaaauccuagggcccuuaagaauuaugugaaaccuacucugccugugcucuauaaauggaucaccaaaggcuggaugagagcacaucuguuuacaccaugguuucugaauauuuugagccuauuguugaggcuacugcucaggaaaaaacuuuuuuuucaaaauuguccugcuuauugacagugcaccuaagggcucugacggagauguacaaggagaugaaugguguuuucaugccugguaacacaacccccauucugcagcccaugguucaaggagucauuuugacuuuugagucuuauuauuuaaaaaauacacuuuguaaggcuauagcugccauagauagugauuccucugauggaccuuggcaacgucaauugagcaccuucuggaaaggauuuaucauucuggucgccauucagaacacuugugauucaugggagaaggucaaaaugucacaggaauuugagagacguugagggguucaaggcuucaauggagaaagucacugcaggugugguggaaacaggaagauaacuaggauuagaaguggauccugaagaugggacugaauugcuacaaucucacaauaaauuugaauggacgaggaacugcuucuuauggaugagcaaagaaagugguuucuugagugggaagguacucuuggugaagaugcugugaacauuguuuaaaugacagcaaaggauuuugaauauuccauaaacuucagugguaaagcagugguaggguuugagaggacugacuccaguuuugagguucaauuguggguaaaaugccuuuuuuuuuuuuuuuuuuuuuuuaagaugggagucuugcccuguugccuaggcuauagugcaguggugcuaucuuggcucacugcaaccuccgccucccagguucaaacaauucuucugccucagccucccgaguagcugggauuacaggcaccugccaccaugccuggcuaauuuuuacauuuuuaguagagacaggguuucaccacaucggccaagcuggucucaaacugcuaaccucaaaugauccaccugccuuggccucccaaagugcugggauuacaggcgugagccaccaugccuggccccaguaaaaugcuuuuaaacagcaucacaugcgguagagaaaucuuuuguaaaaggagaaaucaauugcuauagcagacuccauugcuguccuauuuuaagaaauugccccagccuucagcagccaccacccuuaucagucagcagccaucagcaucgaggcaggacccuccaccagcaaaaagauuaugacuuaccaaaggcucagaugacuguuaguguuuuuuagugguaaaauuuaucuuacuuaagaaaugcacauugcguuuuuagagguaaugcgguugcucacuuaacagacuacaggaugguguggcuauggcuucuguaugcaccggaaaaccagacagcucuugugauccgccuuacugcgaucuucaccucacagcguguucuggaaugaacggaacccgcagaagcuccgagauugccuguguuuguccuaaccaccaggagcugcagcuggaagucagugcuuuucaccugaacuaaguucuuuucuguucguguguuuuucacccggcaguguaauuccauaagucuggcccucuccuggcugcugcauucccuugcacacacccagggggcugaacccacacgcaggccauuccagcgugggcccucacugugcagaccgugggugaauagacgugccugcaagaggcuuuugcugucaugacauuugccuguuuagaucucagccucagcccucagaccucccucagcacaccccaaucccguagaguuuuccuccccuccccaucucccuuuuuuguuuuuuuuuuuuuguuguuguuauuuugguugcuauaaaaaggagcugacaggcgaggugucacuggccauuaagccuccucuguggguggcagguggcucugccuugugccgggcuggcaguguuugcaaugcggauaaacuuuagcauugaaaaaaacaggagaucaucucaacauggaugcaauauuugaggaugcaaaguuuuuuguuuucuuccuuuuuaauucuuugcaaacgauuuuaacuuuauucccaaaauguggucuuuggugcuuucuucuaaagaaaacaaaacacacaucuaaccaaacaaaauuuuaaaagaucaguugagaaauuauaaugaucacuuugaagugaugacauguuugugugcuuuuauuuccaaacaccugggggagagauuugguacuaaacacugaguucuagaucaugugcucagaaagguaaacacaguuuugcagcuugugucaugguguuaacaguuuuccuuaugcuuuuaaagggaaaagauguuuggaaaucgacauuuuuaacuggaugaugggcaguuuuaauugcaccugaacuuugugcuuggucacagucagcaugcaggugucagcuugggugugggccucugggugcuguccggccagcuggccgccugggaggugcguguuggaaaggacgcauguggucucuaaaucaguuugcuuuccacuuucagaucugcuuucuuuuuggugauggcuuuugaguccuugucuguggggaagguggagagccagccaucuaccagguggugacuuugcagacagcagggcccuguggaagggccucuggggcggaagugacauggagaugaggacggccugcaggcuguggggccuuggaagcacaccugugucuccucucaguguuacauccccuacccauaugccugaaagcuuggugguugucuuuuuaauuagauuacauuagaguacuuuaacaaaauguuguauguauucauggggugugagugcaguuuugcuaccuugauguacuccacucaggugaggccagggccuucagcauaccccucauuggagugaugcucguugcacgcaccaggcaaccucccgucauccaccccgccccaggucuccacucuguccaucagucuuguauccaccccacccuggguugucucugcccuguccaucaguccucccgucauccccccugcccugggucaucucugcccuguccaucacccaccccgccccgggucucugccaugucucucaguccucccgucacccaccccuccccgggucucuguucugucucucaguccucccgucacccaccucacccugggucuccacccugucugucaguccuccgcugucccugugugcacguaguuuugcucccacuugccaaggaggacacacgcucuuugucuuucaguguuugcauuguuucacuuaagauaauggcccccaguucuauccauguugcugcauaaauuaauaaaggugauuuuauuuuuaggaaguguauagauuuauauaaauacaacucuuaauaauaacuggcugauauccaagguuaucauaaaacccaggcuagggucacuaaggacuccaucugucgcccgugacagcuuuucggagcuuugcugguuggccugaguauggugcagauuccagagaacuguagugggcagcaguuggcgggaacagaaccucacugcagcagucauguucagggguggucuuggguguuuccuuuguauuaguuagugaauguuuugucuugugaccacagaaacugccaaggagacguuagcagauacagugugcagcugggcacaccuaggcccagugguucuuucugugcaaaggagaauccuugucucuuaccagcagagcagcgcuguccgugccaccaccugcagagcugccguuccauccuccucucucaguguccugugauaugaaccuaacaguaacuuccugagccagucccuuguugaugcauguuuuuaaauuuuuauugguuuauuuuuuugagacagggcgucacccucucgccuaggcuggacugcaguggcaugaucacggcucacugcaaucucgacuuccugggcucaagugauccucccaccucacccuccugaguagcagggacuacagggcugugccaccacucccugcuaauguuuguauuuuuuguagagauggagucucaccauguugcuuaggcugcucucgaaaucuuggccgcaagugauccucuugccucagccuccaaagugcugggauuacaggcaugacccacugagccuggcugccuauugaugcauuuuaaagucgcuuccaaguuagaauauuguuuuuaaaagugagaggagauuuaguguaucucuguuuuacccuuuuaaaguuccucauuuaagaagggcuacucaggaacucauaaauaaggacuuaaggaaaugauugcguuugaaucgcucuacuggacagcuuuguuucggccugucagauucugucacuuuucuuugagaugacuguaagacagccaucaggcuauugacacauacucaaaacuuccuaacugugagguacuucaggacagacuccggagacaggugggggugucugaguccacaagucagcagaaaccagcaugauacgcagagcgggcagcauggggagggguggcugccuaaagcgucagcugacguuuggaaaagaugguggugaccaugcugugugcauggccacugcagagccagggcccggguggcaugugagggucgccuggcagccucuuaucagcaucugcgcugcgugcacucagccacccucagccagcucuguuugaagucccugcacgcaucugagccgcgugcacucagccacccucaaccagcucuguuugaagucccugcacacaucugagccgcgugcacucagccacccucagccagcccuacuugaagucccugcacacaucugagccgugugcacucagccacccucagccagcucuguuugaagucccugcacgcaucugagccaggugcacucagccacccucagccagcuguuugaaguccaugcacacaucugagccgcgugcacucagccacccucagccagcccuacuugaagucccugcacacaucugagccgugugcacucagccacccucagccagcucuguuugaagucccugcacgcaucugagccaggugcacucagccacccucagccagcuguuugaaguccaugcacacaucugagccgcgugcacucagccacccucagccagcccuacuugaagucccugcacacaucugagccacgugcacucagccacccucagccagcucuguuugaagucccugcacacaucugagcugcgugcacucagccacccucagccagcucuguuugaagucccugcacacaucugagcugcgugcacucagccacccucagccagcucugguugaagucccugcacacaucugagcugcgugcacucagccacccucagccagcucugcaugaagucccugcaggcaucugagcugcaggguuucuggugcucagcagcagagcagagaaacacuucauuuaacaccaucuuuggagagcacgauguuccacagaagcgauuucuccaaugaucccucaagaaccaacacuuuguaaaaaaaaagacuauuucguguguguguguaagagagggacauaccagugcuuuaggagugugcacgcacugccacgcugucucccugcccugauggccccgcagccugggcguuacuguuugucucuguugaguguuuuguuucagcuucucuggaagucagcuguugcuuuuugccauuuuugugcugguuucuaaugcuguuucucacucaaucccacugauuucucuuacuuacugcuccugaacauucuaaaacugauaacguagaaaugaaaaugaacccugaauaaaagacuaagggccauuccuaugaagaaaaaacaugagugcaucggcguuaggaauuucuucuguauaccagaaggccgugcugcaaaacaagucaagagcauauauuuggaaaauacgucuguacaggcuccugcagaugcagugguugugagaaacggucucuguccuugguagccuugacguucuaggaugauaagaucaguacacgagacagagcagagcaagagaacacagagcugagugcuguuacugaguccaggcaccacaggucaguguuucuguaaugggucuucuuucuuugugucauagccaaggugaagcucuucagcuagcagaagaguguucucacugugcccccauagcucauggaucucaucuuuagaaucuuauuuuuggccggaugagguggucagguuauacugaacuaaauguucucuuugaauagucuguggaaagguucuuacuaauucaguuagucaaaucuuagggaggcuuuagcauagucugaagucacuuuagaagcccuucucugugggccaugguaaacacagauguugcagaggcuucuuguagcuuugcuguggugccuguuggcagcacuuccaggccuuagggugcuguugugcgccuaacacugcugaccuuauaauauuauaaguggccagucacuugcccccuucgcugggaggagggaggcgucacuggagugacuuuaccuccuccucuucugcacacugucugacgaggagcggggccugcacacagccagugcuuaauaaauauuuguugcaugaacaguucuguagugcagcccuuaucagugacuuaguugggaaaucucucauuauuucugccgagagggguuuggagaguagcauggccccaugagacuacugagguagaacuaugcauuaggagaacugacuucuccagggaacaguugaauuugaaauucugaaaaagaaucacaugugauacauacuugauuuuugcuuugauugauuuuuaucugaaggguccacuuuuuggggagguagccaucaaggaguauugagaaaugugucuuauuugaaugugacuucuccguuucuuggucaguccucugaguucgucaaaugaaugcuugugugaguucuugaauuccaaaaggcgugggugaugagaaaggccgggauggagcuucggagaccccgagugugcauuugggcugccuggcugugaagagaagaccuguuuaauguguuaggaguuggauuucaugcagauagcuuggaaguugcaggaagggcucugaugacuccaaacacaacacagcuaccccaugucuucccuugcgcuaugaagcgccgccuccgaggggcacccggggguccuggcuggcuuauugggguguccuuugguuacuuacucagggcacuguuuuaaagucaggacuguuggcgacgcagguguuguacuuuuguaucagcgcuguaacagaacaguugacaugccaaaguaauaaaguaauaaagccacagugcugccuguuucacagcuguucauuuucaaagaucuguucucgguaccuugacugagaagccuggguuccaaggaaggggcugccguccacaggacucccucucuguggacacacaggcgugcuccucagaugugaacacauuaccuugaggaagcugcguuuuaaaaauaggaaaggaaacgaucgucaguguuugaugucgugccggaaaagcacucccaucagcgcuuuguggcccaguguuuuccacaucgugucgucuuuuccuuagugaaauuucggcagauuguuaugcagaagcgguucugugucucugugugacugggagacagcuguucauccuaaugaggaugccagcuucgcggcguuuccgcugauggagacccgcggagggagcggaauguuccagaccaggcaguggugugcggcgaggaggugcugcacugucagcuggaggagcacgcucggcugccccacacgacaagauaaaugaguuugccggaguuuggcagcgucggaaccauuuccagugcacggccgugcgcgccagccuccccaugggaccugugggcugagggugccuuggaaacugcugccucuuugccaguucuuuuuucuuuugauguccgacaauacuugucaggauugugauuuauuaaaaaccuaaugucuuuuagcauuucauuaacauggaguuaggcgaucuuuuguugagccuuuuuuccuauuaauuuagcagaauguucacugaaacuuaacuuggccaaaccuccugaagacuccaguucaaagagaaguugggggcaccucuccucucauucuuccaggcucccccagcagccgaaguccucuaagccucauuguaaccuucucacugaagcguggcagcgucugauuuauagucaagcucucauguuguucuuuauuuuuuuagaugaagacucuggaggaguuacuggguugauuuugcagucucucuccucugcccaugcugcucucguaacccgugcugcucucguuacccaggcugggcguuugcuuguguccugccccgugugaugccgugguuuccaguugggcaguuuccccccaggagacaguguuuguugucaccccuggggaggggucugcucuaguuucuaaugugccugggcagggcggcugcuacauccacaggccaggaugcugcaccacagggaagggccccgaccagacaucagguccuagcgggggaauaagugucagcaauccacaccgcagcugugggcaccacgaccaggccuuugagaaugcagacgugaaaacggucgccgccgcaucauccugacuguguuccggggucucggugucagagcguguugccagguguuguugacgcaccuugauucucaguagcuuugcuguacuuugauguuauauuuuuaaaaaccuugucuuaaugcaguggaacuuagacguaauuaggacucagcugguguccacuaaaugaggaggauuuucauaaaugggcuuugugacugcguggugcuucucucauccagggccgcauagagcaugaaaucccaugucacgguacagcuucaguggcugggacaacuggcauuuaacuggacuccagaguuccaagcaauuuugauggacuggaccucgaugaggguagauguggaaaccaagcuuuugguccacauuaaauuagugauuugugacgacaagaggacacuuccuucauggauagguggaaauucacaugcuuaucaucucguagguaucucagcugcuucagugcggggugaggcggguuuugagccccuguacagagugagugaccccaguuuuugugcccugggagacaguguaggggucaagccugugucucucugagaaggcacugccccugcgucucaggaucugcccacucugcccugaagucagaccaugccuuccugggugggccacucaugcccagcugcauggcgagcauggggacccaccccagcccugagccaggcaggacgcgcagcccccuggccguugcugaagacagcaguggaucaugccuggauugugugcccuuagcucacggggaaaguaagguuuuuaucacauucuuuuuacugaacuuugccagugagcaaagaggugauugaauuuucuucuucaaaugucauuuuauuauuugaguucuaaauaccuucuggcaagugccagagacuuuccuuugaucacugguuaagguaaucaccccagccacugccagcacagccucagcuggugaggacaugauuuccucugcagauuuugccuggguuucuucagugauucucagugcaauucaagugauaacauccuuuguuuacauguuuaauccgauuuuaccacggguaagacuauuuaauauacuuagcaccaugucaaacacuuuuuuuuacauuucagaagaaaaguuuaugaaagaguuuaacauaaacugaugaaaccuuucuucccccucucuucuuguuuuuaugguacuuuucaucuuuagggcgugggucucccaucuuagccauuucagggccucuucgguuccucgagccucucccugagggccacauauuucaacacauuugaauuaaaaagaaaacuauuaauuauuauuuuggauuuauagaagcagguuccaagagugguugugauguugaauuuuucuccucaaacuuuuuaagauaaagauugugguuaaauauacauaauaugaaacuuacuauuuuaacuguuuuuauguguguacuucaguggcauuaaaucaauucacauuguugugcaaccaccagcacuauuuccuaugcuuuuucauuaucucaaauggaaacucugcacuugugaaacuauucaugcccaucccccagaccccgagaaccucuguucuacuuccuguuucucugaauuugccuaguccagggaucuuagaugagggggauucuugaaaguucauucaugucauagcacguguuagaguuucuuuuuuuacgacugaauaauauuccauuguguguacacgccgcauuaaauccaucugcugauggacauguggguuguuugcaccucuuuggcuguugucaguaaugcuacugugaauucugguguguggggcuucuuggcuguuuguauaucuucuuugggaaaauguugauccaaguccuuuguccguguuugaauuguugucagaguguuuuucucuuaacuccuguguuaugauuacauugauugagaguuguuguuggaauggauuucuuuuaaauucucugcuauagaccaagauauguuaugauuacauugauugacaguuguuguuggaauggauuuuuuaaauucucugccauagacccagauguguagacauuugggcauguucuguccaacccuacuuucuguaaccucucuucguuccguugccuguagauguggaauagaguagaauggacuguguguuucugauccacugggaagaaaucaguuguccuuuucuugcacugguggagaggcuuugggaggcgggagcaguuugcagaggagagagcugugaguuugcgcuucuccgaccuccuucccacccacuuggucaggguugugugugggguguggugucacguccugcaccugcuguugcaucugacucugugcccuuuguucauagcacugugacuucugccguguucaccgugggagacaacgugguuucaggcagcgaugaccgcacggugaaagucugggacuugaaaaauaugagaucccccauugcaacuauucgcacggacucugccauuaacagguaaagucaaacuguugguuaaguaaguggcuuaguuugaugugaaaggauugauugugauuucauguuuuauucauggagguuuaauugauagaaccccgggaacaaugguuuaggcuccuuuguccucuaaugcaguuucaguauuccaugaaaacuuaaacuaacuuagccuaaaaccagguuggaucagugagauuugugagaaugagaaugacccguuuguggcagacaugcagggcuucucuugacuucuugugaggauuggucuugugucugggugggucugguucuaccauugagcaguguguguguguguguguguguguguguguguguguauuguguguaugugcauggggucugugugaucuuguagcuacgugugaguaacuuggucucuuuugaauaccguaagcaggugguacacgcaguguguucauguagucggccuugaaaugugaauaauauggaaccuccugcuucauuaucugucaacucaaaaacuuacagugucacuguuucaugcacaacccacuuuuaccucuucuuugcaggaucaauguaugugucggccaaaaaaucauagcccucccccaugacaaccgacaagugagacuguuugauaugucaggagugcgccuggcgcggcuuccccggagcagccgacagguaacagcacggucggugaacauaugcagggcacaguggaggaggacggguagagauauuuuacauucucauuuucuuacuaagucuuugcaugcuaaguuuuccuuggaaaugcuugagcuguauuuagaguucauaaaauuuaaaauugaagaaguagaguuguacacucaaguuauuccacaccuacuucaguguuuuuuuuuuuugagacagaguuuugcucuuguugcccaggcuggagugcaguggcaugaucucacggcaaccucugucucccagguucaagcaauucuucugccucagccucagccucaaucucccgaguagcugagauuacaggcaugcgccaccacgccuggcuaauuuuguuagucaggcugguuaguuagucaggcuggucuugaacuccugaccucaggugaucugcccuccuccgccucccaaagugcuaggauuacaggcgugagccaccgugcccagcccaguguucuuaauaccaugaucggcuuuucaguuuacaaauaaagaaaacaugcagcuccucuguuucacaggcaugcggaacgagcucuuuggugcacguguuaguggugguggcucuguggggaagccgucuuagaugucugcaguugugucugugcagauuggaaguguugagugggcauuguggccaggcagaagcuggguugguuguaggcugggggucuuuaaggugggaccucuuccaccuccagccagaagaacacguuucuauggcaggcuguugcgacaggaagaaauauauuuaaauguuaguuucuuguuagugaaggguugcuccuugcuaacuucagaagacggcggagggaguuucucgcuaugugcuguucagcccacccguccugguugccuggaaggcgcaaagagaaucgagacuccauggcacccgcacagaugcagaggcccagggggccugggggcccguguucagauucccuggcggcucugcugugcucugcagccgggccucacuauaauguggguggcguuugcuguuggcucuccccugggaggucacagggucagcugcgaugcacagaaacuccccggggucaguggcuggucgcaguggcugacgccuguaaucguagcacuuugggaggcugaggcgggcagaucacgaggucaggagaucgagaccauccugacuaacacggugaaacccugucucuaauaaaaauacaaaaaaaucagccaggcgugguggcgggcgucuguagucccagcuacucgggaggcugaggcaggagaauggcgugaacccaggaggcggagcuugcagugagcugagaucgcgccacugcacuccagccugggcgacagagcgagacugugucucagaaaaaaaaaaaagaaacuccccguggucgaggcagcgucugcccagccuugugcguaauggaggcccccccagaggaucccucuuuccugucuucuuuugauuuuguuggaguacugucuggauaccugugugaguaaauggauuuguuccccgaggccuccuguggcugcacagggccacacgccugccggcagcuuggguggcccccucagugccucuguggcuccuucuguggacaccagcucauggcucgugggccgcagcugcucugcacggggugugagccucagaaccugcaggcaggccggguggucagggaggcacgugcgaaaguggggguucucucagcgcagcaacaccuuuucuuccgguagcacagacuuucuggaaaugagcuucccugagaccgggugucucuucaguccccuuccuggcaugagagugcacuguuugaaguuaauuauugaguuuuuacuccucgauacacauccaaauaguggaguagaaaaauuucaugaaauuagagugacuaaaauaugcuucacaacccuuaacacagccauaaauugcuuguccuggggaagcuuuucauguuuuguuaacagcugagcaucacucauguguccucacagcugcaucuuagacacaguagaauguucucuuuucaaugugcccaugcggauuuuaaaauuucugugcagcauguaaaguuugcauuuugaaacacaaauucaugaaaacuauuuguuuaugacugugaacuaugacuuuauuacuuugagaguauuuucccucagaaaaacggaauucugaaugguucuucuuggccuuaauucuguguagacaguuuuauuuucaguuaucugugaacauucaacuuuguugauguuguaggauucuguugugccuggguuuauucccuccuaaagugguaugugaaauagauuuauuuuuaagauuaaugaaugugauuuaacuuuauuuagaacuuguaacaccucuucagauaaauaaaugugguuuucagugucacagaacccugcuggaaaucacugacuuauauuguccuuacuucuucagcugacugacuugaaaaagagaaaacaaaacacuuauuugagccuuuaaguaguggagugaaagggacugauugaaaauauuucccuguagugcuggaguaggugucacuucccagcaugaguuuugggaaagcgagcuugguggagagucaggagguccggggucaggguuccugugaagagcaggcucauugggcgugagggucccugcgcaagggucucugugacguggaggcucacggagugugagggucccugugauguggaggcccguggggccccgugcugagcguccuggagcacaucacgugcacuggggcucaugacggcauggggcgucuuccgggugcaucugcuuccuggguggcaaugcugugggcgcaugagagauggaaaucccaugggagcucugccggaggugaaagccuggcuggcuuucuucuggaagcucuuuggcacuucugcagcgaaugccuugaguuucacugugcagagcucuugcccacagccuugguuuugccuccaguuaguggaugcauugcugcuuccuuuuuugugccuuuuguaacccuuuguuauguggucuuucuuauaauuauuuuauuuuucuggccuuuuguggaugucuuuccagauguauaaauagcuauugugguucucucuccagauguauaaauagcauauuuaugggggaauauuuucaggagaacuuuaugccauucuuugaguguuucuuaaucugucaacuuuacuuaauacugacucacucuuguaccugaugcuguaacagcaacguaucagagcuguuguguaguuuagaaaaugcagaugggugcuaaggcacugcuuacagauauucuaaguguuggcuaagagccugcaucugcuauguacauacacaccgauaugcuauugcucugucacauauuuugcaguaacuuuuccagcaugcugauauuuaacuggaauugcugaagauggcaggaaucuaccuaaaaggccauuuauuuauccuuguuuuauaugacaccaaauguauuuuuguaguuccauuauuacugaagccaguuauuuguuaaaaugcaauuugaagucuuugagugaauaucauuuaauuuaccucuaaauaucuccuagcuucauuuauucaaaaauuucacauugaucauuuauuuuuuugucugacuguaaucuuacucauuuucuuaaagaaggacucauacagugcuuuugggcggguuccaccaacccucgugcucacuggugucucggcaucacucauucuggccuggcugcacguccuggcggcucugccgugcucggcgguccaugcucggcgguccaugcucggugguccugcucagugguccaugcucggcgguccaugcucggugguccugcucagugguccaugcuuggugguccaugcucuaugguccauggggugcucggugguccgugcucggcggugguuggugcucggcaguccaugaucuguggcccaugcacggugguccaugaucuguggcccaugcacggugguccaugaucugugguccaugcuuggugguccgugcucggugguccaugggacugauccugcacaccauguuguuuuccuauaacuuacguacuuugagugaugugguuauucauuucgcugaggucuuauaaucuuacuuucgggaauaaugcacugauuuugguuuguuugaucaucacuagggccacaggagaaugguaugcugcucggcauggagugaagaccaccccgugugcaaucuguucaccuguggguuugaccggcaagccauugguuggaacaucaacaucccugcauugcuacaagaaaaauaaggacaccggcagcccuuaguuucacuguuugccagcacagaccuuugaugggugcaggcuuuucugcguauuaaucagccauuuuugugagaguuugacccuggaaagggugcuuuguauauguucuuuucacauagugcccagcuugcaugaaauguacagagaaauguguggucguauuuuuuacuuuugucuuguauauguauguauauuggguccucugggcaguagaggcaaagcucaccucccauguagcacaugaaaugcuugugaguuguugacauuggacaggugaacaguagggcauuacauuugugugaauuaaaugugaacuucuguauuacguugcggcgucggcaguccugcguucccuggaguaacuguacguaucugccuuugcugggaagacuguggggcugccuguguuggcuggcgaccagcaggauugcuccaggauuuuguguuuaccucgcgugaaguucagcacgugcugucguguagucagcuucuacucuaauuucuguuacaguucugcaaagguaaccuggaguuuagaaguuaaaaaaaagcaugggauguuggauuugcaccauuuggaguuucuuuaggaaagaaaaguuuucugcuuuuuuauagaaaaucauuucagucucccgaggucucaugcuagcaaauuuugaaauaggauucuaaucacugauuucaaauauuaagcaaaauguaaagcacuuuaauuuauagcuaugguuauaaacagguuuuagauguuucaaaugacuuguccacugaaugucacuugaccuugauaagaggccgccugcacacagagcccaguuaauucuccgcaccucgguugugugcuuccgaaugggcucacucccguggugguguuugagagccaacaacacuaccucagagacgggucuuugggaaacuuugggucucacuguugccuggcuggagcacuuugguuuauagcuggaauacugaguucaguucagaaggcaggaaagacagucacaccgacguguccugaagguguaggcucuccacuuaggcgcacaagcugacggcugcagccagcaggccccggugacgagacacuuccaggucuugugguggggacgccucucagugccagucccgccacugcugagugagccugguguucuugccuucuuggaaauuacugcucaccugguaucuguacguuaauguuucuugcugaguuacaguuuugauaaagaggcucucauuuccugugucuuguauauucaguccuuucaauacguccaccuggaggcucaccacuuggagagacacaggaagguaauauuuacagcugucaugugacauccccaggucuuuguguuuugcccuguuuuacggugagguaggagggaacccaucuggggaccgguaggugcaggugcaguaggacgugggacuuuuggacccguccuuuggugcagcucgccagggaugagaggcaccucccuacuugggucuucaggagcugguccaaggagcuucgaaucuaagucaucuagaaugacccugaaaugacugacagccccgggcccaagaaaaacccauaaccaccucagauggaucugacguggcuaagggacaaacagcaaauauuucagucauuuugauuuuacaaauaaaaaauguguuguguuuuuguccgacauuauuuccugacugcacuguucugagaauggaguccaccuggucccucugguugauuagaaucucagguuucagcuccugcuguccugagcgaacuugccugaugcagggcugugcuguguccagauguugcuggggccucacuuuuucucuuggcuggagguccaauugccagagccucccacacugcacauacaaaggucugagcccagggcagcuucuggggccacugcacaggccaccugcuuggguuccucggaguuuaauuugaaagucugggugucuuaggaugaugguuaggaacauugaaaaauggcugcaaauagccaaaucaaacuuaagaaccagaucucugccagauuaaacauuuuugaagcuuuuaaaagucaauauuccuaguggccacugaguuccaggcacacuggugcccuuuacugccacagcugcucaccuugucuggcaaacuggagggaccucagaaacuggacuccugcauguccuugggggcgcagcccuguggugcucaggcagagcucucaggagccggggcaccuugcuguucgcugcugugucgucuucuaaugugagcucauccacugcugcugcagcguggugaucaggagucacagacaagaucggggauggugugugugugugugugugugugugugugcacguguguguggcuaaauuaagucauacugucaaccacacgugaucucgucugaaacaguguuuggaagugggaacaguuuuguccuguaugcugauguguccagaauuucauuuaaugauagacggaaaaugugugguuacugaaaacuguauaugauacagaauuucauaagagccaugcuguugggcaaagcaacucuuuuucaaccacugcucaucaguuucuguagagacaaaaacucuguacauauuuuggaaucugaagaauccuauguaaaucauuuguuacuuaagucugugaaaaacauauuucuuuggaggaaaauguaugcauuuauaaguguuccauggaaucaguuuuuauuguaucgauauaauugucucuaaguguugacugucuucauugcaauaugaaauucauuaaaauguccauguuccauaauuacuauuauaaaagcuuuguguuauugggagucuuauuauuuuuauaguuuuucauguuuugcuuuggugaaacauugugaaugacuauauaaacaucacgaugagcuagaaauugaacaaauauaauacuggucacucg

SEQ ID NO: 192400 - RNA, 76219 nt, Homo sapiens
agcauccugagguuagcauuacacuucucccaguggagcccaugacuucugaucaggacgcuaagguuguggcugaaccgcagacgcagagaguccaggagggcaaggacagcgcucaucuggugggugcugucgaauggggugguggggaguccauugcuuuuuuugauaaaggacucuauauuggaguuaguaaggaguucuaaacaggaacacuggcacaucuuaggaucugcauacagauauuagagucucguaggggagaaaagauuucuuacccaucugaggaucauggcugagaccccugcaacaaaagacagaugaacaagagaaaagcauacacauuuauuuaguaauaaguuguaugugacaugggagccuccacaaaggaagaaccaaagaaacagggaaaacuguauuuuuuuuuugcgaagucuaaugcagauguugacaguuguggagaagcaugauuggacaaaagggaugugaccuagagcuaauaaacuggagaagcuuagcaaggcuguuguguucagguuuuucuugacaucccuguguguuacugcuccugguacagagcagggccccucuggaagggucuucaggggaaugucagcuguguuuuauggccugcuucaagggagaaggggcaaggagaauucuuucuaguuuccauggccugauucugcuguuuccucaaaugucaaugugccauauuuuuuggggagaaaguccugagccccaucagucugaaaaauguagagguagcuuaguagaggaaacuauaaguaguagaugauaacaaaaacaaaauuguuauagcucuagauacucaaauccauuuauuuuuuaaaucaaggauauguagugauuuguaaauaguuuaauaacauuauagucacuauaguaggauguauuuaaagaguuaggauuuuaauauacauuuuuuugacuacuuuuguucauuuaaacauuuuaugucaagcaguaauauuuaaaguuccaaaguggcuuugagcaaaguagcuuuucuuaguuuuccccauugaaucuacaaagaacuuuaucuaugauguucauucagaauuuaaaaauuuuaagccuccuacauucugaauaucuuaugaauucaugaauuugucaugugaaaugugcauuucuugguggguuuaguuuugccuaauuacugugguuugaaaauauguuguuucuuuuuaaacauuguacugauguugucuuuguuuucaauuuuacagaugaaugguccuauaucucaaaccacuucucagacaaguuccaucccaccuuugagucagguaauucaauuuugagauuaaucacagauuuuuuaaucacagucaaggcucagagauacuuccuuaagaaaaauguuuauuguaacaaaaauuagaaaauguagauauuucucaaaaaguugugguaggggauccauucaucaccacaaccccuggguaugguaacugucaauacuguauguccuuucuagcuucugugcgugucuguuuugugugcaguucugccaacagcagcauaccauuuagauuaauuuauuuucaaauauuacaaaauuuuuauuguaucauugauaaucuguuauaugcggaugaguagcuuuacauuuugguagcuuguguuccuuaaaccacacaaauugaauaguaagcuuuuacucagaaaauuuguuucacauuuuagcugugauuaaugaaagaauaaggaaguagaauucauugguuuuuaaauccuaccuuucaucauuugcauaugcauauauaaagugcuucagagagcuacuacuggaaauucaguuugaucaaaggaucuuauaaauugcauaaaauuuaaaaaguaaaaauauuuuauguaaaaaauaaaaauuaccauaaaucucaucuauuccccccccauuauaagcaguucacguaggaauugaggaguuggauuguuaauccaauuguuuuuuuuuucaaauagagacgaggucucacuguguugcccaggcuagucucgagcuucugaacucaaagugauccucccgccuuggccucccaaagggcuaggauuacaggcgugagccaccaugccuggccagcuuguaacaaagaagaauuuuaaaaaaacaaaagacaccuucuaaauuauuauauuuuauaaauauauuauuuauguaaaauuuuuauguauucuguuuuacauugauuuuuaauuuauuuuuuuauuauuauuuuuuugaaacagaguuucccucuuguugcccaggcuggugugcaauggugcgaucuuggucaccgcaaccuccgccuccuggguucaagggauucuccugccucagccucccgaguagcugggauuacaggcaugcgccaucacaccuggauaauuuuguguuuucaguagagacaugguuucaccaugucggucaggcuggucuugaacuugugaccucaggugaucugccugccucggccucccaaagugcugggauuacaggcaugagccaccgugcccggugcacauugauuuuuuaaaaauauccaaauauaagacgcuugguagucuaagaagaaaauuauauaagacauaaaguagauaucccuugaguauaaaucuuuaagggaguuuguuugcuucaacaaguuccuguucucuccgugguugacuuucaguccaacauaauauucagacaucuuuagaaaccuauuguaggcauugcuaugaauguuuucuaauuagcauuguucauagugcaccuaaagguguggagaguuacaugcuucauaguugaccaggaguuugcauugguuuagugauuagguggcagugcucagccaguuguuaugaugggcaagugaauacauuuagcagucaggguugaggaaccaggcuauuuacaguuuagccauucugucagaguugaguaggaggagacgugcaauagagauacccaaagaaauacaugaauaauucaggagcagauuugcauuuauccacugguacuauuuaguuguauuuauuagacagcuuccugcccucuccaaaaagcuuacugagcuaguaacuauuuacaggguuagccaaagaacacaaaaaagugaucucuauuagacuguaagaauaugguuucccugagaucgagaccauccuggcuaacacggugaaaccccgucccuacuaaaaauacaaaaaauuagccaggugugguggcacacgccuguagucccagcuacucgggaggcugaggcaggagaauggcguuaaccugggaggcagagcuuguagugagccgagauugugccaccacacuccagccuaggcagcagagugaaacucugucucagaaaaaaaaaaaaaugguuucccuauuuaguaugagaacaauauauuauaaugagugacaugauugucagaauuacucaaauuuguguacauguuuucuccacuaaacuguaaacuucugguacuguguucuguucauuaaaaaaaaaaacuuuauuaaaguauaauuuacauucuguaaaacucacccauuuaaaguaugcaauugaauuauuuuuaguagauuuacugaguuguguaaucaucaccauaauguagucuuagaacuuuuacauuaccccauuaaacccccagcccacccccaggcccacuuauaguuaggcccugucucuaaggaugggagcauccuugggcaggcacaaacaugcucugugucuccacauucuguucccuucuguggccagcucaaugcauugugucugguaggcaagcagcuaguacugccugcauaaaauuugaguauccauccauucaucaaaacugagugcaagugaucaugauggcuaagacauuuucuauggagagguuguucagaugagcgugagauacacgucuucgaggagcccuaacacagcaugcaagauugcaugaucacauugugugugagccuuagguacaagaugagcguacaccuggaggugggaggcacugagacguaggugagucuagaagaagcacucuuuaucuugccccuagucaagcaaggucauuuugaauguucucaccuugaggucauaaggaucuacugauuuugaaguauaucguaccaauaguuaugauuacaguacuuugcauuaaguuuaccugaguuccaggcagggacagugaugaaacucucgauucccucaauauaucagaaacaggaaggaaucuaggacgcggaguggucagagggaugggaggaaaaccagaggacagugugggguggagauagaggcagggaggcugacucaagugaaguguaguaagguaacaaagcgaggggucaguugugaccuuagcaagaguauuucccaggacugauaggagcaaaagccagauugcagugggugagagacaggagugguagacacaacuuagacggugacauuccuccuaagaucuuggcuuugaagguaaggugauagaaggcgagaggggauugaaaggguuuugaggguguuuaugaugaagagugaccacuggcagugggccacagcgauggguucuccuucuugaggaagaaaaaauaucugaccacugguauucagcaacagugucguuugguuaaagguucuuuaccuucccuguuagcgccacaaacuucaucuauagcaaacaucauucucagcggcuuuuugccccuccugaagcccacucagggacuccaguucuuacuccugugugcgaccagccaaguaccugcuuuucccuuggagacacuacaucagccuggaaaccauuuucuguugaaaugauccucuuguguuuuaucauaaaucaacagcagguuugagagaggaaugugagugaaugaugauguuuaagggacagguaauauuagguagaaguguuuauguuaaauuaccuccucagaagaaagaugcaaagucacagcaagucuuuucuaaucauagugugaaacuggaaaucugaaauuggaaaucuaacucauccucauacuaaacucuauguacaauucagcaaaacaucuauaucagaaugauuuuuuuuuuuuugagucagccucacucuguuacucaggcuggcuauagugcaguagugcgaucucugcucacugcagccucugccucccggguucaagcuauucuugugccucagccuucugaguagcuggaauuacaggcaugcaccaccaugcuuggcuaauuuuuguauuuuucguagagaugggguuucgccauguugcccaagcuggucucgaacucuggccucaagugaucugcccgccuuggccucccaagguguugggauuacaggcuugagccacugcacccggcccagaauuuuuuuuuuuaaacuccuuuacagaugguaauaccaaaaaacuuuagucccuuccuuuaucaguuuucaaaaaaccaccuuugccuuuugaugacacagcuucugaaugaauaacuauuaauuagcaauucagauuaauuauugcaggccuauauuuugaauaagaguaggcuuagcaaucagaaagcuugaauuucuaugaaaauauccaacuccuguauuuguacgcaagugacacguggcugcucuugguauguuaaucuugcagguuagaccuuuuggcagguuguuaccaccuugucagucuguuuuaagaacagacuugggccaggugcgguggcucaugucuguaaucccagcacuuugggaggcugaggcgggcggaucaccugaggucaggaguucgagaccagccugaccaauaugaugaaaccccgucucuacuaaaaauacaaaaauuagcugggugugguggugcacgccuguaaucccagcuacucaggaggcugagacaggagaaucgcuugaacccgggaggcggagguugcauugagccgagauagugccauugcacuccagccugggcaacaagagcgaaacucugucucaaaaaaaagaaaagaaaagacuuggccggauguaguggcucacaccuauaaaucccagcacuuugggaggccaaggcgggaggauuucuugagcccaguucaagaccccauaucuacaaagcaaaaaagaacaggcaugguggugugugccugcugucucagcuacucagguggcugaugggggaggauugcuugagcccagcaggucgaggcugcagugagcugugauugcaccacugcacuccagccugggugacagagggagacccugucucuaaaaaaauaaaaacaaaagaccuaagaacuuuccuuaaggauguugauacaguuuccugucuuagaaauauguuuguuacuaugucaggaaguguaaagcugccuuuaccucagcaugauuuagugacaaaacaauccauuuacccccagaguguaugcacgguucuuggucuccugguacuucggagaacuugccccaggaugggggauacucugaccagaugcccucuuuuccucuuagaauguauucgugcugagacggaguagauccuuuuuaauguaggauauuucuuuuugaugacauaguauuguaacauuuugauuguagcauuuuggccacugacagaaggaaugccuucuauaacacauacccgugaucuuuucagcuccaaggcauauuuaaaaauagagggauuucuucauucucuguuuggcuuacuauucuuaguuguauccuuguguaaaugauuuacaugcugcuaaaacuucucuuguuguggaagugugacagauguaauaguagucuuucaaggcacugggaucaguaaaaacaucucucaacuuagaacauuuuguaauuucuuuaaaaaaauuaguaauuuuauugcuuaguauuugcaucauuuagaauaugacaaauaguuuuuuugcaaacucuuuuucauuuuaggauucaguuuaauugcuauuaaggcauuuuguucaauaguagauuuauaaaucaacuuuguguggcaguaccaugcaaacaguuguacugagagaauagucacaucacugggaggaagcgacagaugugucggaguccgcugccuggcaacuggcugccuuccuaggccccgguguccuuacauguguguggaaauacaacacauacagcuaugugcacagaucguaaaaguacaacucaguguauuucugcaaaauaaacacacguagguaauccacugccagauccugaaacagcaauuuucaguuuuggcagcaauucgaagacaugucacaauuauagaaauugugaaaguaggagaaacguguaucuucaaaucagggaacuuguguagaugagauacaugagucacgcaggggugucagaguuucugagauggucaggcugcuucauuuuuuguuuggacuucucaucucauggagccagugcuucucaccuggacagcugcagucacuccucacugguguccccaacccacccuuccuuucuaacacaguggccagaggaucccuucgagaaggccaagucagaaccugccacuccugugcucaacaucacaguuagccugaguucuggcaggucccuagccuucguagucuggcaccuguccucucugacucugcugcccacuggcucuccucuggcacgcugcuccagccccagugggcucuugacccuugaccauuccagcaucaccuuaccgcagggcucucugccucaauugguucuggugugccccuuucccagaagucuuugaggcuuaugcucuuaccuuucucagucucggccucaccuucucagcgagccccaucuauccgcauccgucuccucacuucuggcuugccucagacccuuuacguguagcaguuagcaccuucuaacaauguuagguauuuguuagauuuaguguuugucucccuggacuagaaugcaagcuccaucaaaucugggguuuaguuuuguuuacugauguauuccagugucuuccugacagguaggugcuccauaaaugucuccaguguaaaagaauauaucacauauggugguaaucacugcagacucucauggcucuuacugugcacucuccuaacacuuccguuuacucauaaauuccuguuagcccuacaccugucuuaccccuagguacuguuauccccauuuuacaaaugaggaaacugagacacaaagagguuuaaguaauuuauccccaagauuacuggacuaaaaagugguagaaccaggauuugaacccaggcaaucuggcuucagaguccaaacucaagaggaaauacuuuguauuuggcaccguuauuucauuuaaaaagagaaaccagaaggaaauaauuuaaaacacucagcucuuucagccaucugaaaggcuuuucagaauuguuuguuuuuuuagagacagggucuugcucugucacccaggcuggagugcaguagaacaguaauagcucacugcagccuugaacuuuuggacucaaguuauccuccuaccucagccucccaaguagcugguacuacagacacgcgcccccacacccagcuaacuuuuaauuuuuauuuguagagauggggucuugcuguguuggcgaggcuauuucagauaucuuuaaggcuguucccccaucacaggcccaucacauuugcccucuaggagggcagaaggguuuugguagaugagcacugggggcccuccacaggcuugcugcccagagccgccucggaccucugcuccccacauccugugcauugcuccuuagucaccucagcugcugcuugagugggcccagugguggcuugagcugcggcuccagaagguacaagucauaaaccuugguggcauccauguggugcugauuuuucaggcaagaagaaugcuagagcuguggggcagccuccaccuagauuucaagagaugucauggacagccugggggcccaggcagagacuugucacaggagcagagccacugcagagagccuguacucgggcaauggcaagcagaaauuuggaguugaaccugcugcagagaagcccccaccagggcauugccuaguagagucaugggaguggccugggagccuuaaacuguggagcugccagcuugcagcaucagccugggagagcugugggcaggagacuccaaccccugacagcugcuggguggacugagcccagcaaagccaucggguggggcugcuugaggcccuggggagccaacccuguuccacugugcccagaggguugggacauggagucaaaggagaugauucuccagagaggcuuaauauuuaauauugucugcccuguugggucuugaacuugggaccucuugcuucuucuugccuauuucucccuuuuggaaauagauuuuuuuuucuuuucuuuuuucugagacggaguuuugcucuuguugcccaggcuggagugcgauggugugauaucugcucacugcagccucugacccgcuggguucaagcgauucuccugccucagccucucaaguagcugggauuacaggcaugcaccaccacacccggcuaauuuuuuguauuaguagagacgggguuucuccauguuggucaggcuggucucgaacuuuugaucucaggugauccgccugcuuuggccucccuaaguguugggauuacaggcgugagccaucgcaccuggucgggaauuuuuuugugugugugccugucccaccauuguauuuuggaaacacauaacuuguuacuuucaacacucagggcuggagaggaauugaucuuggggugaauugugccuugagucucacccuaucugauucagaugagacucuggacuuuuaaguugaugcugaaaugaguuaagacuauuggagguauugggauggaaugaguauuuuuugcauuauaagaaggacaugaauugugggagcuggaauggaaugcuguguuuuucaugugucccccaaaguucauguguuggaaaaucaguccgccgugcagcagcauugggagguagggccuucuaaggggugauaaggacaccaggcucugcccucacaaguggaggaguggaugagugccauuguggugggagugacugcauuuccucacaugugugauggugcagcacaaaggccucuccagaagcagccucucgacuugagacucucagccuccagaauugugugaaauaaucucuguucuuuauaaauugccccaucucagguauucuguuagagcagcacagaaugguuucacaaaggacuucaaggcuugaaaaguguggggaggagacuggagaaagaaacaacauugaggcagugugcuggcauugguuaguaugagauagaagaggucgggggaaugguaucuuagaagccgagaucauagagguaggcuggggccagauuaugggggacuuugaagugggacucugagauucuauuccaacuacuuaaagucugccuaacagcucuuugaaauagaugucgguguuggcuccauuuuacaaaugagaaaacugagacaaagagguuaaauaauuugccagagaugacacauguaaaaauggagcugagacucaaagccaggcaggugaucucgugagcuucucugcuuuacuauguccuuucauuuuacagcugguaugaaucguuugugucuuuagugcagaacguuuuugccauguagauguuuaauucucuuugaguagcauaacaguauggucaauguauggucugaguuuuguuuugucauucgaagcugcuacuaaaguucuuggugccucauuucccuuaucuguacagugaauuaguaguaucuaccuuggggguuguuaagggugcaaauuaagacgugugacaaaauggaugcauagauguaauuaauauuuugugaaacauagugcuauauaaaguguugacuaccauuaucaucauaaucauuaugaugauuucaguacuugaauuuuaguauauucauaaguguucuuguuaccuuuauguuuaaguguaauuccuaaacuuuuuaucauaaaaauguuaauauuuuuaaaaaguaaaacauuaauaggacaccagucauaacucauagguuaaagaaacaacaaaaucucucuugcagaggaacuaaaagaauuauuuuguuuuucacauagccugucagaaccauaauaagaaaaagaauuacuuauacuaaaagcaaaacaucacagaugucaauguaagacaagacccauuaugugaguccacaguuagggacuggaccacauaguacaugagcaacuuguuuaguuguggacaacgccuguuuuucaccagauggcaggcugugcguuccugcaucaaguacuuucaagagacuuucuaguucugguaccagagcuuguagaucuauuuucccuuuuuuuucuuguuccuuccuuuuucuuaauuggagugcucagacaucugcagaaguggagcgaauaauaccaugaaccaaaugcagcaucauuaacuugaacauuacccaucgccacauucgacuacuguuuuguuuuguuuuguuuuguuugagauggagucucacucuugucacccaggcuggagugcaguggcgcaaucuuggcucacugcaaccucugccaccuggguucaagugauucuccugccucagccuuccgaguagcuggaacuacaggcacacacucccaugcucagcuaauuuuuuguauuuuuaguagagacggguuuucaccauguuggccaggcuggucuugaaacuccugaccucuggugauccacccaccucggccucccaaagugcugggauuacaggcaugagccaccacguccggccuggacuacugucuuuaaaucuuuuccucccuguaugcacaugacuguuuuaacuuuuauauauguguguauauauuuacuauauuugcuagggcauuuuaaagcaaauuguagauaaugugucacuuuaucccagauacuucagcaugcaucucuaacugacaucauuccauuuucacaccugacacaauuaguaauaauuucuugauaccuacagauacuauuuuuuauugcuauuuauuuuuuugcucuccuuugauuuuuucgucucuuuuuaaauugcuauuuauuucagacaucauuucguaaagcuagaaaauuagauacaacugugaguagcuauauauuuuacggaacaaaauucugauacuguuuuccuuugggggaauuuaugaacuauuuuauuuaguuaccaccaucccaugaaauauaauuugggaaauacuggaacacuguagaaaaaccagaagccugaaaucuuucuggcugggauaauauuuuaaguuauguuuuauugaguuuaugagaguaagaaaaaauacagcgcagcauucuugcugcuguucugagcuuuuggauccugguccuguuuggaauugggcacacggaguaugcuggcugucagucgggcucuguugucauuaggauuuggguuugaguggcaggaacaugugaccgcugugcaagggguuauuuuuggucucuggguguuggcuucuccucagaaauuauagcaaguuacugugaggugcgucuguggaggcuugggaccagcacgccugucgugugcuugugagcucucaaacaugggcugcugcuucagcagagaacuaaguagugacaaugacagugaaaaaacuggccuguuacaaaaaucuguggaggaaaaggaaccagaaaacaagauaaguaaaacuuugucuucauuauuugauaccgucaaaggugaggagguucaccguacuggcaguggagccagcaguguagcuggcguuagcgcgcggacaaggauuuucgcagggucugggcacaaacagggucauagacccaagcagucauugaacccucuuuccucuuuuauauauacauucucaacaagguaugaaaacuugggugagaaugacaagaauucagauauuguuguuaaugagcagaauucugagggggucugugaucuacuguguguggguaacggcagccgacaagguuguugggaagaugaggagcuuuucucaugugugcuggugccuucugaccgaggccugcaggaggaagccuuugugaguggccaucugcacuguuacccagcuacuuguaaaaacucuuuaguagagaaagaaaugguggucagcguucaccucagcaguggugaugagaguaagucuuuagaccuauccgauagggagaggaaagauggaaacccuguugguauugaugaucagcaaugucaggauucaggagagugcaaguuucacagcauuuguguugccgacucugccugcccaagcguggcagaggagcugggcaccuggguagacacaguagcugcaagaggagaguguugcucuucagugccuucagccucgcgugccaugucaggggcgggcgagccagagccacggcaggaagaacucucgccuugggacacgcuggguccaggugaaaggacaggggaaugcagugggaaagccaagccuugcccugagccuguggcguucagccaugcaccuugugaagcaaacacugauaacgugcagauggaggcuuuacaggcagaagcuugcacugaauucccuaaaaauuacgcagaaaguagugcacuacaugguauugaccuacucccugaauuaaauaacaacauggacagugacucacuaagucaugcguguguccugggagaaagugagagcuguaacucaggaguaggaagugagauggaucauccaccugguggcuuccguacugacacugcacauucaccugguagcuuuuguacugacacugcauguguugcagggagugaugacccggaggugguaacaguuguugucgaccagaguuuacauucuaaaaaggagagagaaaauaacucuaucacaccacuaagagacaacgaugauuucuacuuggacguuaacaaagcagauaguauccuuccuguuggucuagauagaauugauuuaaguccuaagaggccuaucacugcaguaagauuuggaagugggugucucucaggucacgcuaauucaagagaagcagccccaagccagcuugaugacugcugggagccggaaccuguccccagacaagucaggaaggcacagcgcagaggggacugcagccuggaggccagaaguccccugcugccagacagaggugaggugucucugcaaucugaaaauagugccuuuuaccaagaagaggacagaauuggcguuuggaaggcugagggucaugguguaagggcuuuugagucaaaaucuuggugucaagcagaugaggcugcaacacagaccugugaccaaacuuguguggagcgugugguggacacgcaggggacggugcagaggacagauggccuaaagcuuagcauggcacaaggagugccccccgauggcaagucucccagucacuccagaucucuucacaguaacuguguuuccuccgcauuuauuuucaccugcacagaggaagaagagagggaaacaagcccaggugacaaaacagagggugaaauaugugugaagaguucagucagugugucacgagaccagcugagugacccucaaagguuagaagguagugaaaaagaaucacugcaagcaaaguauagugagacaagugaagaugacauagagacugucaagucagauucuaaaacaaccuaugagugggaaacagguacacaaagacaugaggcagugccaagucaggauguacucuccuguguuaguucuagugcaacagagaacgcugauuuugaaacuaaucaaauagaaaaaaguuaugaaacacaccgaguauacgacugcaaauauaauguucuuaguguguuaccacauuucaguccaaguguuaauccaguuauacagaagucagaaauaguagagaauucuguuaguggugguaaaagcccaaaauggaagggaauuuccucugaaucaauugaagaagcuucugguaucuuugguaauaauacaucaggguugaguaaaccaaaacuaacauguaaagaagaggaagagagacuuuauuuggagaaagauaguauugaccccagaauuacugacugccuggguccaugugggacgagugaacgugcacaccauuucaaagaaggaaacgccaaguccacucuuacacagucgacuuuaaauggugaaauggguuuuaugggaaaugcuaaggugaguuuugagaaaauagagucacgugacacucccaguggcaauuucuuucugguugguguugaucccacccuagcggacagauacacaggugcccccugcgaugcagcgcaggggauucccgcuguccccguggacagcaaagacacgauuguaccaaguaguggccacauuuuaucacucacagaagguguccuaaauagaugugaacaucccucaaaaguggauuggcagaguuucccagaaggagucucccguuuuuugagugaauuuuccuauuacccgaugggaggguuaggaaacccagcauuuucugaaagacuggccagugguugugguggauaucaaaugggcuaucucuggacuaauacagucacaaaaggugcucuagaaggugaaacaauauuuagugaggaucugcaccauaagccacaggccuuggaaauugcuuuguuuucagaaaacacuccucagcuaccggugucagaggacgguguuguuuggggauggcaugauagagacggacaguucguaaguauguuuucuguguguuuacuauugugcugcgguaugcugggcuauacauuuuaauuuauuauuauuauuauuauuauuauuauuauuauuauuauuauuauuuauuuuuugagacagagucucacuuuugucacccaaguugcaguggcgugaucucagcucacugcaaccuccaccucccaaguucaagugauugccggguucaaguaauucucgugacucagccucccgaguaauugggauuacaggcaugugccacuacaccuggcuaauuuuuguauuuuuagagaugggauuucgccauguuggccaggccgguuuugaacuccugaccucaggagauccacccgccucagccucccaaagugcuggcauugcaggcaugagccaccgggcuggccaauuuuaauuguuuuuaacuuaaaauuaauaaagauuuacucuaaacaguggguaguuauuugaaugcuuauauauggcugugaauuacuauaacauuaaugauuuccaaauuggagaauaugaauucuuguuugguguacuuaagccagagguugugugcaaacucuuguuagcacuaaagcaugcccugagcucuguguugacuuuuuucugucugugaauuuugccagcucuucugucuuccuggccgcaguguugucagagcccuuugagggcaucuuaucucgugggcaguguaguugauucgauaagcaugugagcccauugaagguauaagucacacugcagaagacaaacuuaccuaaaaaucugugcuuccuuauaucuuuguaugugucugaggcagguagaauuugcugcuuuuaacugccuaugaaaucuugguucugucuucuugcaguuagaauuacuguggagcucuuucuuuuucagaaccccgagauaaggcugucccucugguuuggaagaagcuuagcaaaugacucuaugggcagcuaauuugagcaucuuuccagaaauucuguaauaaaugucaacaucauucaacaacaggaaauuaguuuucuuccacaaaacagacauuuaucgaagcagugugauugaaagcacauacucagaguagcaagaucucauuauucaaccagugguuuauucaugauuuuugugggcaaugaagcaaggaaaaguauugauauuaaggagguagagauggcucaaaugucaacacuuacuauauggaaauaaacaaguagaaauccccuucuguaguguaaggaaugauccaucaaccucuuuuauuuccgugcccacacugggaguuuuucuggagagaguuauguucaaauucauuaguuuugcuccuuaaauaguuguggaggcaaaacaguauaaaacuacaucuuuaagauaaucugcaguuaaucuuuuacagaagugacauaauuuucaguuaguuaccagugucacugccucagacaucaacaaagagcauaaaugaugccuaagugagaggugugcuuccaguuuuaaauuagcuuuuccauuaugagguauucccaaacaguauucucauacgaagcguuaccacguuuaacgauggugccuugccuuucagagcuucaauuuucaaagugcuguuacaggugucuuuuuuuuuuuuuuuuuuuaagcaaaucuuaauauagcagcuauuacuccauuucacaaagaacuggagguagagccuuguaugguucugaagucagcaaauugcccugaauuacuaagcuuuuuagugcaucuguaggagugguuggugcuugcauggaauguuucuuuccccuauuucucaccugcuuucuguaccucaccggccagucccccuucuccagcauuaauuacuccaguuccuagucaguaacuugucagagagacuguucugucucguaucgguaguuauacaagcuuauuaauugauacguuauuuuucaaaguggagcauauuguuucgcacaggauggggugggguggaaggguuuauuuaaagcaucagaacucaggcauguucacuuuggaauguggcuguuaaggucagcuugccugugguuuuaauaaccauugcuuagccauacauuuuuaauggaaaaauaagacuuauagucaagcagacgacacuggaguuuuuuuuuuuuuuuuuuuuuuuucaaggauggagucuugcucugucacccaggcuggagggcagugguacuaucucagcucacugcaaccuccgccuccugaguucaaaugauucuccugccucagccucccaaguagcugggauuacaggugugugccaccacacccagcuaacuuuuguauuuucaguagagacgggguuucaccauguuggccaggcuggacuugaacuccugaccacaagugaucugcccaucuuggccucccaacaugcugggaucgcaggcauaagccaccacacccggccgacgcuggaguucuugauaaccauuuagaguuccauauuacugcaagagaauaaccauauuuuauagaaauaguaggagauucagaucuuuguuuaauacaaacuauuucucauaaauuauaaguuaaugaacucuugaugaguguugaauuuugcugaacgcaauugcuuagaaucuaacuuucuaauuaccaucguuuuuauggggaaguuacucuaccuuucucugccuugguuuuuucauuugugaaaugaguccagugaauaacgaccuccaagacuuguucugauucaguacaaggaagugcguagaaugugcucagcacgugguagauccuugaaugucauuaagccuuaaaagacaucuucauucuuucauuccuggugacaucucuucagucacagcauugauugaacauuuccuaacugcauacacuugauuuggacuucuucacuaagagguagucauugguuaaggguagaguccuagucauuuguggcauaaaaccuugcagaaguugucaaauaguggaaaauauaaauuuauguuauuuauuaaacauugauucauuccucauauaucuugagcaccucccuacugaauucaggacugugcuggcuaucagcaguacuacagugaggaaaaugcccauggugacugccacccuggaauaggaggaacacgagggccacgggagccccaacagccaugcugucacugcuuucaaagugcuguuggucuguauuaauaaaccacaaaauguauuuugguacuauaggacagucaacugcaaaagguacuaauaauagagaagguuacuguuaguuaguguugggaauuuaaagcacguguaguaugugcaugagcugaggggagccagcuaaguggauggaauggaaccgaggcuggaaaacuggauuguguggugguggugaaaacagacugggucuaauuaggaaaggugauguauggaaguauuagagugggaaagagaauagagaaaugaauuuacaaagacaacagaucagguggagcggcguaaacgcugccagaggcaguguugugggugaccuguggcugucuccugcccccucauguagcuccaugagcuccugucugcuuccuucaccaucacaccugccagcucagugccgugccuggcacaagcaugcuggugaacaugucagaggcacuuguuggacagauggguggaugagagagaagagggcaaguaacacuaugcagaagcagaggccaaaaaugaaguuuagaugcaaugcaagaaggaaaauugaagaauuggugcuucuugauuauaauauucuugaaggaacccaauaauuugcccuaucaccaguacuuaaaacaaaaacuaaaaagaauuccagauagauacucauuuaaacaccugguuuuaugggcauggugcucauuggugcuccagugacugggggagcaggaacgaacaaaccacaucagcugccuucucucaguuucagaaauaguuucauguuuuuuacuaccagccccaucaccugagccaauguggauuuauucugucuuuuaaaaauuguuaaugcacccaucguuuauuugacggcucauggugguccuuuccagcccuucuccuguguucugggccgcagaaacuggugugucuaugcugcaugcugggguagugcaguguaacugcucccagcuugcagccugauuccaaggggcaccggggaccagggaccugucccuuccuccagaagcuuugacuuccugcacuguggugugaagguggguggcacauuugaaaaggcaaaucauguguaaguuuguugaaggauuguguguuuggacauuugacuuuucuuuaggcuuuggggagugcuuguguaagcauaagaaaggcuuguaucagaaaaaucaggggaguagggaguauccacauggugggggacuuuuguggguuuauucgcugugucaggaaggaccaccaguccccagucucugggcaggauguucuggacagacggacgggaagagcaaaagugccagugugcccagagacagcaaggaggucagugugccuggaaauggacaaggccagggagcagugagcacaggagggcgcuguggcugcagugggaacuucgucuuuuacuccaaaugagccaagcugaugcgggaggguuuugaguagaggacugcccugugggacuaacugagcaugcgugacugucaugauggccgaugagcuugguaugugccaggcaucauguuguugugcugucuuccaggugagguuuagcccauguuccacagcuguccauggcagcuuuggccucagccccagugaucugagaguccguuguccagaacacuggacuagcagcuucauggucaccuguggauuuucuuucaaggugauacugaagcucuauugggaaugggaacagguaguucugugaaaaauaugagauauuuuaucuucuuccucaaaggaugccugagcuuucuuauccuguaguaucccugacagaccuguuagaacaccuucauucuuaggagcaauuuucaucuucuacaccuuuuguuuaugugacuuuuugaagcuuucuuucuuucuuuuguuuuagagauggaguucugcucugucccccagguugggugcaguggugcgaucucagcuuacugcaacccccgccuccuggguucaagugauucuccugccucagccucucgaguagcugggauuacaggcaugcgccaccacgcccggcuaauuuuguauuuuuaguagagacaagguuucuccauguuggccaagcuggucaugaacuccuggccucaggugauccgcccgccuuggccucccaaagugcugggauuacaggugugagccgccgcgcccugcugacuuguuuaagcuuucuaauuagaauuuuauucaucugccuuguauucaaguuuguaaaacccugaauugugauuuuauuaggagucuaggaagucaccagcuauuccucagguauaguuugugaaacacugaaucuuuugguggcaggcguguccuuccccaucucugcaagccuuggucuugggaggaggaacuuaaaacuuggggggaauuuaauggaauucugacugcuuuuuuuuuuuuuuuaauuuugaaccugauuucauuccaaagguguguauaaauacauaggcugagccuuuggagccuauaucugaugucucuuaacucugcauuaaugaguaaaauuguauuugguugacauuuggauacaaaugucuaucuuacauuucuuccuagguaccagcaacuaagguuucagagcugaacccuaaugcagaaguguggggggcuccuguguuacaucuggaagcaagcagugcugcugacggugugagugcugcaugggaggagguggcuggccaccacgcagaccguggcccgcaggguaaguugagcauggccguggugugcagcccccugcuuucaggccugugcuuuuguugccauuuuaaucugucuuuaagauguuguucauucauaacugugucaugguauguggcagugcuugagagcccagaggucuuuuacagucuaaagaaguugagucacugcaaguguaagcuuuguuuuaagagaaaguuaugcuucuaacccugccuuuuugggguaaacuccuaauuguaggaucggaugccaauggugauggugaccagggccaugagaaugccgcauugccagacccgcaggagucggacccagcagacaugaacgcucucgcucugggucccucagaauaugacucucugccugaaaauagcgagacagguaaacauaucuuaugggugcauuuucccagggaauaugggcugcuuuauuuauuuuuuuuauuuagaguauuaacauucucuacacaaugggucuuucuuugccugcuuuuaauucuacuuuaaacucacccuuauguggaugcagagaagaugagaggcccugguuagggaggugccauggaggaauguaaggucucaaaagaugaaaccugggccgggcgcgggggcucacgccugucaucccagcacuucgggaggccgaggcgggcagaucacgaggucaggagaucaagaccauccuggcuaacacgguaaaaccccgucucuacuaaaaaaaaaauacaaaaaaaaucagcugggcgugguggcgggcgccuguagucccagcuauuugggaggcugaggcaggagaauggcgugaaccuggaggcggagcuugcagugagccgagaucgugccacugcacuccagccugggcgacagagcgagacuccaucucaaaaaaaaaaaaaaaugaaaccuauuuaguagugcgaagugucaguaaaagugcagagguggaacguuaauguuggauuugagaguaagacaguuuggguaaagggagggggauagagagggaaugcugugguauuguagguaggggcaauugaggccccauuugcaagucuuagaagccauucacauuugaacuucuuuccuguugaugaggaaaugagugacaugaagaaaauaaguuguuuggggaagguaaauuuugcaggagugugaaagaauggcuuggaggaaagcaaauguaagaccaucuggauagaaucucuguuguucucauguaggguuguaaguaccuuaguauguaguaguggcuaaaaaacggaaaggaagagaguaggugggaaaggagauguucaggcccaguuauggaguguaccacacguuacuggaaaugcaggaacuuuuucauguuuucauuuuuuuuuuuugagacggagucucacugucacccagccuggagugcaguggugagacaucggcucacugcaagcuccgccuacugaguucaugccauucuccuaccucagccuccugaguagcugggacuacaggcgucugccaccacgcccggcuaauuuuuuguauuuuuaguaaagaugggguuucaccauguuagccaggauggucucgaucuccugaccuugugaucugcccgccucggccucucauguuuucauuuuuauuaccacaauuguucuuaaccagucccuguccccucccccaccccacuugccaugggcuuuucguuaucccagugaccagggaaugcacugggcagggcuggagaggccagaccucgaugcuguaaggcacagccaugcagaaugacuucauuggcuuaagacugucaaagucagaaacugucacuuaagagggaaaauguguagauguucugugacgguuguuuuuuuuuuuuuuuuuuuuuuuuuaacuucaguggagcuuauugcuuuaaauaauuguuugguaaaaugaaucaaguauuuauaaagguacaaaaauuaagccaugcuuguuucuuguaaauauaaauuugccaucuugaauuugcauaaagugaauuucccgucuacaugagcaguuuucuaaaucugaggaaggccaguauucagcaauguaauuugauuacaucccccuuguuaauucaccaguaacugguuagugacuugggaauggcagaacauugggauaaacuggagucauguuagaguccauugaauuuaagauggcaaaggaaaggaaugcucaucauuaaaacagauuuuuacaaaagauaaaaaggcauuauacauugagggagugagaauccuaaugguaggaaguaaaaugguucaaaauaaacaauuuaaguuucagacuaaauugaaaugaccuaaucuugaacuggggucagaauuuauacagaagauggaagauagauaggagguagacagaugugaagaucugucuugaggauggaagauggguaauguuaucaacagugaaauaacuugugaaaaucugccugaagacaggagauagauaacguuaccaaaagugaaauaacauguuaaaaucuaucugaagauagaagauagggaacauuaucaaaagugaaauaacaacauguuaaaguauauucuggaaaguuuaauuucaaaaggugauucuuuuuaaaagggguauuuaaaacuauuuucaaaaagaagaaaaagaauaccuucugcuuugucuuccuccuucaucugccuccaccuacucccucucucacuccuauaaagcauuagugaggcauaaccgauguacaauaaacaucauauacuucagguauaccccagauuuucuguagcuuacagacaauugaggaaauaauacauuauuaauguguugccucuuucauuccucuuugcuuuguccacccaguuugauaaguuguucuguaccuguaaaauccucagcacaaucaagaucacgaacaucccaaacaccaggaagagcuuccugugcccucuccuuucuccguggaaccgguggucuguuuuuuucuuuuugagauggagucuugcugugucacccaggcuggaaugcaguggcgugaucucggcucacugcaaccuccgccucccggguucacgccauucuccugccucagccuccccaguagcugggacuacaggugcccaccaccacacccggcuaauuguuuguauuuuuaguagagacgggguuucaccguguuagccaggauggucuugaucucccgaccucaugacccgcccaccucggccucccaaagugcugggauuacagguguaagccuucaugcccggcccaguggucuguuuucuaucacuauaugucaguuugcguuucguagauuuuuuuucucuuuaaaaaaaaagauggaacuccugggcccaagagaugugcaucagccccacaaguugcuggacaacagacgugugauagaauuugacaguguguacuguuuuugucugacuuagguuacuauuuuugagacugauucauguuguaacaugaauuaaucauuuauuuuuauugcugagaaguauucaugauauggauagaucacaguuuguuuuucuauuccccuauucauggauuuugggauuguuuucaaaauguggcuuugccaauaaaaaguguucauaaaagugaacauuugucagcaagauuucauauaaacauauguuuucauuucucuuggguaaaauaccuaggaauggaguagcuggaucaucugguaggcauguuuauccuuuuaagaaaugguaaggcaguuuuccaaaguggugguaccauuuucuauucucaaccagugguggauuaaagcaccacauccuuaugacccuuaugaccucagggucagucuuuaauuuuagcugcuguaaaagggagacaguagaaucuuacuguggcuuuaauuuauguuucccuaaggacuaaugcuaucaaacauccuuuuuaaaaaaaagacuguuuuuuuuagagcacuuucagguucacagcgaguuuuaguggaagguauagagaucucccauauacuccccucccccccacccccacacaugcauggccuucuucacuauucacacucccucaccagagggugccuuuguauaauugaugauccuauauuggcacaucauuauuaccuggagucuacaguuuacaugagggcucacucuugguguuguacguucuguggguuuggagaaauguauaaugacauguacccuccauuguagcaucagagagaguaguuucccugcccuaaaagucaucuguguucugccuacucaccccucccuccccccaaccccuagcauccauugguuuuuucacugucuccauaguuuuaccuuuuccagaaugucauaggguuggaauccugcaggauguagccuucuuagauagguuucuuucauuuaguaacguacauuuaagcuuccuccaugucuucaaggcuugauaacucauuucuuuuuagcacugaauaacauuccauugucuggacauacuacaaauuacuuagucauucaccuacugaaggacaucuugguuguuuccagguuuuggcaauuacaaauaaagaugcuguuagcauucaugugcagguuuuuguacggaaggaaguuuuuaacuccuuuggguaaauacccaggagugugauugcuggaucauaaggucagaguauguuuaguucuguagaaagcugcugaacugccuuccagaaguagaauuucuggaucauaugguaauucuuauguuuaacuuuuuuugguggaaucaccauacaguuuuccauacaggccauaguauuuuacauucccaccaucaguguacaaggguuccaguuuuauuaaauccuugccaauacuuguuauuuucugauuuuuuuuuuuuuuugaaauggaauaauucuguugcccaggcuggagugcacuggagcaaucucagcucacuacaacguccaccucccggguucaagcaauucuccugccucagccucccaaguagccuagauuacaggugugagccaccacgcccagcuaaauuuuguauuuuuaguagauacgggguuucaccauguuggccagucuggucucaaacuccugaccucugcccaucucagccucccaaagugcugggauuacaggcgugagccaccacacccagcuaacuuuuguauuuuuuguagagacaggguucaaccauguuguccaggcuggguucgaacuccugaccucaggugaucugucugccucggccugccaaagugcugugauuacaggcaugagccacugcgcccagccuauuuucugauuuuuuugauaguagucauucuaguggguauaucuuuguaguuuuggcuugcauuucccuaaugguuagugaugccaagcacccuuuuuguucuuauuggccauuugucuucuuuggauaaaugucuauucaaauccuuugccuauuuuugaaucagguuuuuguuaaugucuuuaggaguucucaauauauucuguguauuaaucccugaucagauacaucaaucacaauuauuuucuuccauuauauggguugccuuuuuauuuuauucaaagugucuuuugauguacaaaauuuaaaauguucauaauguucaguuuguuuauuuuuuguugggcugccuaugccuuuggugucauaucuaagauaacauuguugaauuuauuauaaugaagguuuugucuguguuuucgucugaguuuuaucauuucgggucuuacauuuagaucuuugaucauuuugaguuaauuuuuguauaugguauaaaguauggauccaacuuuguuuuugcauguggauauccaguuguccuugcacuauuuauugaaaagacugcccuuucucuauagaacgaucguggcacgccuguuaaaaaaaacaauuggccauguaugcaaggauuucuuucucggcccucucuucuguugcauugggcugugugucuaauaggccaccgcagggaaagccuggaauuuuaacugugggccuacaagaauauagaggagcccucauuguuaaccaacagggggauccaaaguaggaguuuaagcuuaaaaaauuuuuaauuuuguuucaggucagauuuuugcucuuuaauuuuaaagagaauuuuuaaggcuaaccauagcauuguugggucuuucuagaaauuggcuugcauuuccuagugguuagugaugccaagcacccuuuuugcucuugauguuuuuaucaguuguuuaggaugagauuucuaaaauccuuuuuuaaauuuacaauucuaauuuaaaggauccaucuuuuggccauugacauuuagaauuuucagugguguauaaaguccaggauagauccuggagaggacauagaagaagcaauuccaaagauaccucccacaaaacauuuacugucaggaaugagcucaaucagcaaagacucuuguugacacagacuaaccaggcagcaggaguugagaugacaaaagccccuuacacgugggaccucuuauuaagacaaacucccgagcgcuugacguaugcagaacaaaaagucuuggguuccugucuucagaccggccacccgaccugauccgaaaaucguaccucccccaaugguggagaccaaagagugcucccacuuggucacaguucaagcucucaaggacauaaaacaagacccaaaaaacuuuuguuucugaggccuucauuuugggguauuguuuucugagugccagcagagguuucuguugauagauccucauccauguccagucuccuaauagcccaucaaaggcagucugcauuucuguuacaguaguuuucaucucucacaguuuuuuucccccuccuugggauuuccaucucucugcuugcauugcccaccuguucuuaccugcugucuccuuuauccauuugagcccuuagcaucuuauccuaguucuuuuaaauucccugucucauaauucugacaucucugucaugccugguucuaaugcuugcucugcucuugacauuguguuuuuggccuuuguguaugccuuguaacuuucuugagagccagcugugacgugcuggguggaaggcacuguggugacuaugccuucagugcuguggggugaggugugggcaggggacgccuuccauaagaggccugggagucucaagucuguagugagcccgggcccuggacugugaagcucacaggagcuucucuucuuuccuccccucuuagguggggcagcaugaccagaggaggcaggagcuagguguuucccuuccucuagguauguucugcucugauuaaaccccagcaaguuggacugugguuaaacugucuuuccugagggcagaccuuguuaagaagaacagagugcucugguauuuuucaaaacgguuacuuuucuccuacucgugccggaagcacaaagggauuuuucucuaguauucccugugaggaccugaucgagcuccagaaaguauaagucacaaaagugcaggaaccccucacccgccaaugacugagacucccugcaguuuuuaacucucagacuuggccacccugagccuccagcaguuaaucaguuccaggacaguguuuucuguccucgccuugguuccugcaaagguuucugcuccauauguugugaucgcuucucuauuuaucugucugucuguccaauuuggcagcaguuguuugccuugugacuuuacguaggaucuaagaagaguuguuaauuguucuuuuuagauuuuuuacuugucagaccagagugauaacuugcaggcuucucacaugcagaaccugaaguugcagcauuuuuuuguaaugcauauaucuuauuugguguugugccuguuugugcauuuucuuauuggguuguuuuauuacucacuuuugauaguuauuuauauguuuuggauauaaguccagauacgcaauguacuuuguucucccaagaguauuuuugaaaagcaguuuaaaauuucuuguguaaucaaguuuaucauuuuuuucuuuuauggcucuuccuuuugguuuauauuccuccuauaaguuuaauugcuuuagauuuuacauuucuagguccauuuuagguuaguuuuuguauaagguaugaaauauggaucaaaguuauuuucauuuugugcauaggaaucugcagcuauugcagcacuguuuguugaaagacuucucucugcugcguugccuuugcaccuuucucagaagucguuuguccacguaggucuggauuuauuuuuggacugucuguucuguucauugaugcgcuagcccgcuuugacuccaguagugcacugcuuggauugucagcagagcuugcuucauugugcuacucuucauugugcuuugcagcuaccaccuucuuuauaaauugaaguuuuguggcaacccugcaucaagcaaguaauuggcaccauuuuuccaauagcauguauucauuucaugucucugugucacauuuucauaauucucacaauauuuuaagccuuuucauuauuauuaaugcuaguggugaucgaugaucuuugguguuuuguacuacugccauuguuuuggggugccaggagccacaccauuuaagguggcaaacuuaauauauaaaugacguguguguucugacugcuccacuaacuggcucuucccuugucucucucucucuuugcuugggccuuccuauucccugagacaugacaguauugaaauuaggccaauuaauagcccuacauucccucuucugaggguuccagugaaaggaagaguuuuacuuaucucacuuuuaaucaaaaacuagaagugauuaagcuuaguaagcaaggaaugucaaaggcugagauaggcugaaaacucggucucuggagccaaacaguuaaccaagcuguaaaugcaaaggaaaaguuauugaaggaaauuaagugccccuccagugaacccagaaaugauaagaaagcaaaacagccuucuugcugagauggagaaacuuugaucuggauagaaaaaccagucacaacaauuauucccuuaagccaaagucuaauccagagcaagaccuuaacucucuuaaguucugugaaggcugagaggugaggaagcugcagaagaaaaguuugaagcucacagagguuauuucaugaaguuaaagaaaagaagcagucuccauaacauaaaaaugcaaggugaaacagcaaguuauccagaagaucuggguaagauaauugaugaagauggcuacaguaaaugacagauuuucaaucgagacaaaauagccuuauauuagaaggaaauguuaucuaggacuuucauagcuaaagagaagaaguuaauccugguuucaacauuagaaaccaacucucuuguuggggcuaauggagcuggugacguuaacuugaagccagugcucauuucccauucugaaaauccuagggcccauaagaaugaugcuaaauuugcucucccuguguucuuuaaguggaacaacaaagccuggaugacaggacaucuguuuacaucaugguuuacugaauauuuuaagcuuacuguuuagaccuacugcucaggaaaaaaaaaaacaaagauauuuuucagauuuuaauuucucauugaaaauguaccuaguuacccaagagcucugacagguguacaaggagaugaauguugauuucauggcugcuaacacaacauccauucgguagccuauggaucaaggagucauuguguuuucaaauuuucuuauuuaaaaaauacauuucauaaggcucuagcuguauagaucaugguuccucugauggauucuggaaaggauucaccauucuagaugcuguuaagaacauuugugauucgugagggaaggccaaaaugucaacauuaaccagaggcguugauuccagcccucacggaggacauugagggguucaugaccaguggagaaagucacugcagagguaguagaaauaggaagagaacuggaaucagaaguacagccugaaaauaugacugaauugcugcaaucucauguacaacuugaauguguaaaacuugcuucuuauggaugagcaaagaaaaugguuucuugaguuagaauguauuccuggugaagacgcugugaauauuguugaaaugacaacaaaggauuuagaauauuccauaaaccuagcugauaaagcagcagcaggguuugagaggauugacuaauuuugaaagaagucccacuguugacaaaaugauaucaaacagcaucacacgcugcagagaaaucuuuggugaaagcaagaguccguccacgugauauacuucgcuguugucuuaagaaauugccgcagccacccaaguuuucagcagccaccauccugaacagucagcccucaucaucaaggcaggaccagcaaaaaagauuauuauuugcugaaggcucagaugaucguuaacauuuuccaacaauagauucuuuuuauuuauuuuuuuccagacauaaucucacuccgucacuuaggcuggagugcaguggcaugaucacagcucauugcagccucugccuccaggguucaagugauucuugugccucagccucccaaguagcugggacuacaggcaugugccaccaugcccagcuaauuuuuguauuuuuauuagagacaggguuuugccauguuagccaggcuggucuugaacuccugaccccagguguuccacuugccucggccucccaaagugcugggauugcaggccugagccagcaugcccagccagcaauagaguauguuuaaaugaagguauuguaguuuuuuuuuuaaggacauacugcuaucucacauuaaauauacaacaguuuaguguacucauaauuuuuauauucacugggaaaacagaacuuugugugacuugcuuuauugcaauauuugcuugauugcagcacucuggaacugaacccaugauaucucugagguaugccuguacuguuaauaauucuugaaauuagguagugauagccuuccaacucuguuuuucauaguuacuuuuuaaauuccaguuccuguguauuuccaugcaaauuagaaugagguuguuaauaucuacaaagugcugagauuuuuguugggggguucacugaaucuauagaucaguuggagaacauugacaucugaacaauauccaugaacaagauguaucucuuacuuguuuagaucuuuaauuucucucagaaguauuuuuugguuuucaguguacuggucuuuuacaucuuuuauccaguuuauaaguauuuuauauuuuuuggugcuauuguaagugauuuuuaaaauuuguauuugcaguuguuuguuacuaguauaucaaagcauucauuuuuauguauugaguccaaacccagaaauuuuguuaugcucacuuauuaguuuuagacacuuuuuuguagauuacauuggauuuucuacauagaugauuggauuauuuuagaaugaagacuguuuuacuuucucuccaaucuugaugccuuuuauuucuuuauccugccccguuguacuagauaggcccuccaguacaaaggugaacagaaguggaaagaaugaacaaacguuuggguugucucuggucuuacaagaggcacucaguauuucaccaugaaguauaacguuaguggugguuuuaggucugugcccuuuauauguugaugaggcacucuucuuuuccugguuugcugagagauuuuuaugaggaaugaauauuguaauuugucaucuauggagaugggcauauauuuguuguuuuuuaguguguucggaugaauuguauuaauuguuuuucaaaugugauaccaacauuuguggucuaaaccucuguagaucaugauacaguauacuuuggauauacuacuggauuccauuuaccaaaacuuugcuuagaauuuuuacaccugggaucuugguuucuaguuuucauuucaguguuuuucuuucuauuuaaguuuuuggaagagguuacguauuauuucacccucauaugaggaagugaaacaagucaugugggcaggaguuuuccuuuuuucuucuuuccuuucuuacuuacuaaacuuacuuaguuuaguugcucacagagucuugcucugccacccaggcuugagugcaguagcaucaucauggcucacucagucccaaccucccggucucaggcgauucucccgccuuagccucccaaguagcugggacuacaguagcacaccaccacgccuggcuuauuuuuguauuuucuguagagauggaguuucaccauguuacccaggcuggucuccaaacuccugagcucaagcgauccgcucaccucagccucucuagaugcugagauuacaagcaugagccacugcgucccaccugggcaggaguuuuauuugugggaaagcuuucaacuacaguuuauuuuuucauagugcuacucauuuauuucuucuugagggagcuuugguuuauauaguuacaaagauuuggucuauuucaucugaguugugggauuuacagcacagaguuguucauaauacucuguuaucaccugugaaaucuguagucauguuacaucacucaucucuguuauugguaauuugugucuucuuuauaaucccaaucagucuggguagagguuuguuaguuuuauugaccuuaucaaaagguguuuucuguugggcauggugguucacaccuguaaucccagcacuuugagaggccgaggcgggcagaucacgugaggucaagaguucaagaccagccuggucaacauagugaaacgccaucucuacuaaaaauacaaaaauuagccgccugugguggcgggcgccuguggucccagcuccucgggaggcugaggcaggagaacugcuugaacccaggaaacguagguugcagugagccaggaucgcaccauugcacuccagcaugggggacagagcgaaacuccaucucaaaaaaaaaaaaaaaaaaaaaguuaguguuuucauuuuaucgauuuuucucauuuguuuuacucuuuccuauuucauucuuucuucugauguuuguaauauacucucuuacgauuucuuuggguuuaauuuacccuuucuucuguguccuaagguggaagcagagcucauuaauaugaggccuuucuuauuuucugauauagucauuuaguuuuacuauuuuccccauaaguagugcuuaagcagaaucucucaaauuuagaugcauuguuuucauuuucaguuacuuccaaauacuguauuucuuuuuugauuuuuuuucuuugacucauagauaauuuagagauauuugauuuaguuuacaaauauuuggggguuuuccagggaucuuucuuuuauuaauuucuaguuuaauuucauuguggucaaagaacauacuuuguaugacuugaauuucuuuaaauauauuaagucuuauuuuauggcuucaaauaugggcugucuuguuaaauauuccauuuguccuugagaagaauauguguuuugcuguugcuauggggaauauuuugucaguguuaaugaggucaaguugagugguaguguucaagauuaauguacucuuucugauuucugucuacuuguucugucaacuauugaaagaaagguucuguuaauuuuugcauuugucuguuuauccuuuuaguuuuaucaguuuuugcuucacguauuuugaagacuuuuuuguggccucuugauucauugaccccucucuuuaucuuuaguaauagucuuugcucucaauuuacuuugucucacauuaauguaaucacuccagguuucuuuugacuagccuuaauaugguauaucuuauauccuuuuuacuuuaagcuauuuguguauuuaauaaagugcauuuguuguagauaacauaacauuuggguuuugcuuuuuugucuucuauuuagaacguuaacauuuagugugguaauugcuuugguuagguuuaggucucucaucuugcuauuuguuuuagaauaguuuuagacuuagaaaaauugagaugauugaacacacagaauucccauauaccuggcacccaguuuuuccuauuaccgacaucuugcauuaauaugguacauuugucccaaucacugaaccaguagugauacaucguaaccuaacguccuuuuucuguugcgggaucucagcugagaaccacauuauauuucauuguuacgucuccuuaggcuccucuuggcuguaacaguuucccaggcuuuccuuguuugugguaguuuugauauaauaguucugaagaguacuagucaaguauuuuguaacaacauucucuucuauuagaauuugauguuuuccucauuaugauacuauagugguaauggguuugagaagguaaaacaccacuuuuaucacauauaucaagggugcacauugucaacgugacuuaccacuguugguguugaucuugaucaccuggcuguuuacuggguuucucacuaugaaguuacccuuucccuccccauuuccauguuguacuguuuggaaggaagucgcugcguacagcccacacuuaaggaguuggggauuuauggucccccuccaugaggacacgaaucuucguaaauuauuuaaaauucuuauguaugggagauuugucucuucuccuuuauuuauuuacuuauucaacucuuuauagcaguguggauuccagaauguuuguuuuauacuuuugguuauaauccaguacugcuuuauuuuguugcucaaauuguucuucuagcuuuggccaucaggaguucuggucggcucccuuugacaugccccaucaacauaggguuuuuuugugguuauuuuguuuuguuuuguuucuccuugcuucagccuuagaaucagccauuucuccaaggagcgcuggguccuucauuggacagugauaucagaaaccaagauugagugcuagacguguucuguuucuuuuugucccauguguucuucguuccucuuucccuuuuuuucuguuuuccuuuggagcagccuucuucuuuguuucgcuguuuuaaugauuucuuugcguuuugcuccacuuccuccggcuaacacagucuaccuugagguggcugcgugcugcuucacauagagcacagcaucagggcagucugccgccguuucucucguggcccggaugcuuuggucaucaugccuuuugcaguuacuuaugcuauaaacugacaauauauguuuuuauuuuuauuuaaaagucaguuauuuuuaaaagagauugaaacuguaacaagcaaaacagcauacguguuuguccaugucauggcgguuucuggugcucucuacuccuguguguagauuuucucuguguugagggcugacuauaccagggucugcuguuacacuugagcucagcugcucgauguuguccgcagcuugcugauccucucagcugguugugcuucucauuuuucuguuugauuuugggaagcuucuguuacugugucuucagguucccgagucugcuguaauguuuacccuguuguuaaucucaucaaguauuuuuaauaucagacauuggaguuuucaucucuauaaguuuuuucuuuuuuuuuuuuaauaacuuuuauguccuuaccugacuucgugaacauauggaauacaguuaugauaacuuuuaacauccuuuucaguuaauuuuaacaucugugucaguucuggauuggcuucuguugguugauacuucucauugucaugggucauaucuuccugcuucuuucuuugcaugcaugguaauuuuugguuagauugaguuuuacuguauucagggcuuaguauuuuuguauuucuuuaaauauuugauauuuguucugggaugcagccagguuucuuggaaacagugugauccuuucauaucuuguuuuuaagauguuaggugugagugggacggugcuguguggggccuguuccuaucaccgaggcagggcuccgggaaucacaagaguuucugguggggaggguuaaccauuucaggcucugcacgugaaugacauauauuguuauacuucugauccccucaggugguucuuccacgagccuuggguaguuucaucacauccgugcuuugcaaagaaccuggcugacaacgugauggguccugggcccugugguucucuggagcuccuccugcugucuggccuaugcaaucagccucccuaucuccugcauucucuuuuucucuuccacacagccauacacuggguucccaccugacuucccacucccugggcacagccugggacuucccucagggcagugggcuggacuuguggggguuacuuuaaugucucaugucaagcugggcacgguggcucacgccuggaaucccagcacuuugggaggcugaggugggcagaucacgagggcaggaguucgagaccagccugaccaacauggugaaacccugucucuacuaaaaauaccaaaaaaaauuagcugggccugguggugugcgccuguaauccccgcuacucaggaggcugagguaggagaaucacuugaacccgggagguggagguugcagugagccaagguugcaagaucgcgcuacugcacuccagucugggugacagagcaaggcuccgucucaaaaaaaaaaaagaaaaaaguuucaugucacauaggaaucuauguccuuuguugcucuaugucccacaucuggaaaacugucauuucaucugucuuauuugguuucuuggugguuuuaaagggaaaguuaaccuagccccugugacuccaucuaccuggaggcagauggccugugucuuaccaacaccaugugcccaaccuccagucucccugagagcccgucucacuugucauugucuuugcuccucaguguccucugucugcagugccggguguuucuugcaugguugggucacuccccaucuuucuaaggugguauuaucucucaucuuaggugaagccaccccgggcagcccaucuuccacuguagaacacuucagcugucugcuugcugucccaucuccuugcuuccauucccucuugagugcaguccaggucuccuugcuuccauucccucuugaguccaguccagguagacaguuguccuaagcagcauuugucgagcucuuuaaugacccuggugcagccagaucuaguaguuaguuucaacuucuuaacuuaccuggcucuacugugucauguuauaguggaugauucucuuggcuccuaacuucacaguauccuaguggucuucccaccuugcuggcugugagccugugucccuuggcccucaugcgcuugccuccugcugaaggugggagugucccggguucaguccugggcugcuuuucuuccuucccuuguggcuucggcaccaccuaucgcuuggagaguccucccuagugcccuguccucagugauugcauuaucuuccggcuggugccugcacagucugucuacaccauggaaccagagagauauuuucaaaaugucagccuugaauugauuuucuauuacguuuagguuacuuuaacguccuccuugaucucacucacacacaccggccucugugaccucauuucuuacugugucugucaccccucuucucagcugugcuggccuccuacugcuggacucuaccccuugagaggccccaccuugggaccccugugcuugaggcuccccauuuagaacacacuucccaccuuccugugugccccaccccuccucuaucagaucauauggcacuuccugucuggauggcaccaggccuugcugccccucauccuggguuguuuccucaguguccguuucucucugacaugauguguauaguuacugguuaacugucuguuaucugccucucccaccagaguguuggcuucacgagagcacaggcuuugcguuauucaggcugaauucacagagccugcaguagugccuggcacuuggaaauauuuaguaaauaccuauuaaacauggggaguggagugugaauuuagaugagugacccggagacaccuuagucuagauggacaguggcaucagguuguguuuucaauuuuccauuuucagucucauugagucccaugauuugguuuuguguuaugguuacuuuagcaguuuugguuucuuuuugcugauggggguggauuuuuacuaagcucauuguauaacaccauacaaacucucuaucccucucauuuguccugaacgccccacuuugucuuugccuuuucauggucuuuaacuuugacuuuuaagauacaagugucucuuguguuagcauggcucuuauaugauuguaccaugcuaauuuauauaggaaggcaggaaaaacuuaguucuuagcauuucagugccugucaucgcaacauuauuaaaauaccucuuuaugcaguguccggaguccagcaguuuaugcagugucuucuagagcuccaaauucacagcccugugcugccugugaccacacacaccaugcccucuggcaucuucuuagaaauuucuuccaggauuuagaaccagcuuuuguuuccucuugaagaucugguuuauuuaucauucucuuacaggaauucuguaacaugacaauucucacuuguuccuucgacucuggaaguuggaaggcaaauugaagccucuguuguagaaacugucuaguccuagagccuguuugaucuccagccuugguuuuuugcugguuaucuuuguuguuguuguuuuaauuuuuuccucuguauuuuauuauuguuuaggguuuguguuuguguagguuacuugaaaauucuuuuugcagugagacaaggcauuaacuaagcuuacacuugucauuucugguagaaaaagccccugcugaacucugcuaaugagacuuagauuauuuuucuaaacugugcuguuuuuguuuugggggauaaagggauagguuuuuuugcaugauuuacuuuuuugauagguaaaguagcauuuuucuuacuuaggauacacuuacguaguugugucagaacguaaguugaaagcauuagaacugcuguacugaauuaucugcuuccuaaauuuuaagccgguuuuccuaaguugauuauuacuuuuauguaggaggaaaugagucucaaccagacagccaggaagacccccgagaaguacuuaaaaaaacauuggaauucugcuuaucuagguaaggcugguggugguuuuucuaguaccugauauuucuaguauugugcaaauaguuaaaguauauacaaaugugauauuuuaugaaggaguaucuacucauauccauauauauguauaugaagacguggaauauugaguaaugacagucuuuugacauuugagcauggaacguaaccuucaugucugugguccccaguggucucgguggucacugucuggaaugcgucuaaagugccccgcccgcccugugcugccgagucagacuuccucacacugaaguuggagaacaagugugccacguuguuucugaaagcacaccagacacugagauagcaaguuguuuuauuuauauaacacucauuuuuaaucauuuuucuuuccccugaauaauacccuuuucuuaguaaaaccuuuaaaguuccaauggcagaacuggacauaaaggaggaugggauuggguuugauguaauuucucugaguaugacaacaaccgaugggccguguauaagguuuucugucgaugaugauuuuccagguguuuucucuggagcccugaggauuccacacaggugucugcuaggggcuccuugaagccugugggguguaugagguggaggugugaggggcucugcuggccuccuccccaugcccaugcuguuccacgauuggagucugagaauaccgcaccaugacaugguagacgcaaaaggugcaggggcaccaguggaacgcccuaguggagcacaagugugagcucucugccacucacauccauguguagccccauggggccagaaucagcuacaccuggaagauggccgagaugaggguggagcagggccuccuccugcauggccuccguuugaucggcagucaugggccuucaccgagggacacugagcagaggccccaggaacccagcacugugcucaguuuugaaauguuucuuagggccuuguucacuacauuacaugaugccuugagaauucacaggaaacauugaucuuuggccaaaacaccagaaaauagcucaucauggcccaaacugcugaugauuuguggcucaccuuuggauuuuguggguaaaguuacuguuuccuucuuuuuaauucuggcugcuaggaagccagggcuggauauaggcccucuggugaguguuccagagucuacaggaggaauuuuggguaugaccuuauccuggccuuuuuauguuuuccuuucuuguucauugagcuggauuucuuuacuuuaaauuguuuuucuuucuuuuuuuuugagucagaguuucacucuugucgcccaggcuagagugcaguggugugaucuuggcucacuguaaccuccaccucucggguucaagcgauucuccugccugagccucccgaguagcugggauuacaggugcccgccaccaugccuggcuaauuuuuguauuuuuaguagagaugggguuucaccauguuggucaggcuggucuuaaacuccugaacccagaugaucugccuaccuuggccccccaaagugcugggauuccaggcgugagccaccgugcccggccuaacaaaauuguaugcauuuuuaauaaacucuuaagcuacuucuuaggacaaaaaugacagcuauaaauaauuacaucuuauuuaaaaauaaccaucuucucauaaauuuugauuguagaaaguacaguauacuuuuacuuuugcacucccugccucuccaaggccgagauuuugcaaaaauguaccugaggcuggagagacagcaaauaacagauggguccugggcugagauuuaacuccaaagcaauaccaugccacacucacgccucuugugaaacuggaauuacaguaggugaaacuuccuuuuaaagaaauacugauuaaaagagauuguuuucuuucaacagggagaaccuugcuagugacauguaucuuauaucacagauggauagugaccaguaugugccaaucacaacgguggcuaaccucgaccacaucaagaagcucagcacugauguggacuugauuguggaagugcuaagauguaaguaaaugacaauuuaaauuaauaauacuuguccuuagaguauuugucuuaucagcaugaaccuuuaaaucuauagccaucaaacguuaagguccuugauggcgaaucagauucuuuucuggccuuccguuccuuucugcccagguccaauaauucuggaguagcgccugauagucccugggaaugccaguugaacccguuaugaaaccucaaacaaguuuugggacauaugaaguagaaaagaaucuuguuaauggggauuuuaaagauagcuguuucauucaugaaaaacaaaauaaaaauaacauuuauaguuaaaguaaaauacacuuuaguuacaguuuuaccacuagagguuuuucuuucaaauugcaacuuccuguuuauguucggaugaaauaauuauugcaauuuuucuuaaaauuauguugugggccaggugugguggcuuacgcguguaaucccagcacuuuuggaggucgaguugggcggaucaugaggucaggagauugagacugucuuggccaacauggugaaacccugucuccacuaaaauacaaaaaauuagcugggcgugguggugugugcuuguaaucccagguacuugagaggcugaggcagggaaaucacuugaacccaggaggcggagguugcaguuagcugagauugugccauugcacuccagccuggcgacagagauagacuccaucucauaaaaaaaaaaaaaaauuauguugugagugaaguuguuucuuugaaguuuggcaacaucaaacaguguuuaagcauuaaguguggauggugccccuacauaguuuugagugauuggacauugcuaagccugacuucaagucucaauuaaguccacugccuauacucacauagaaggguuuucacguugucccuggcuuaucuguacugacgacagucugugcagguuuuuuuuuuuucuuguaugaauuugacuuuacaguaguauaaaaaagugagcaucuuacaugagaacuuaguuggauuuucuuuucacaaauaaaauauaaaauaaaaguuuuauguuuuucuguuuuuagacaaauagcauggguuauuaaauuauuggagacagugaaaaaacugacaaacauaauuaccauugacugugaguucugagagcggcacugcugucucccaggauggcgccgugcucccuggugucaucaugcagaacagaagcuguugucugugccagcugaauugggccccaucuuugaaaggccagcagcauucuugucccuguuuguacucugaagucuuuuugguuaugauuaggaguuucagguuuaguuauuccuuuucggacagaccuugcaaacgcugcugccccacugggaugauuucucaguugauuguuacuggcaaggggucguuuccaccaaccaugaggauauuaaauugcucugugugcuugcuuaacagagcccaccugcccauaggcgauccagggcaggcuugucaccuauuucgucccaucuccucccgccuuuuuuaugacuuaacuuuuauccauuugcacugagcucuuuaguuucucauuuugucuuuuuucacucgauuuuuggacagaaauguacaugccuuuguaagaaccuaugugacaagaauauaguuagcaaguuauugcauucauuguagcucuuaagaggaugaaaaugucauaaauagguccgcaggagcaaaguucucaucuuacuuuuuuuuuaaauuaaguugaauggacgaaugaauuuauuuauuuuugagauggaaucucacucugucgccaaggcuggagugcaguggugucaucucagcucaucgcaacucugccuccuguguugaagcaauucuccuaccucagccucccaaguagcugggcauuacaagcgugcaccaccacgcccagcuaauuuuuuguacuuuuaguagagacgagguuuuaccacauuggcagggcuggucucaaacuucugaccugaagugaucugcccacuucagucucccaaaguccugagauuacaggugugagccaccaugccuggccucaucuuauguuuagaucuugugcccaaauuaccuagcagagacucagacacacagcagauauuugaugaauauuuaauuuuaucuuuuuacaaauuaaacucaagauugucugaaugauuuuccuuugaauagugcagcucuuguguuaaguugcauaaguuacauuuccagauuauuuuuaaugucacaguaaacacaaugugcgugucccaguaugucugagucaagggcuguuuucacccuucauguaacugaacugcuaauuaaaaagacaugcuaaaauauuugucaccagaauaaauacguuguguuauauacacacagugaguaccagagcuguuacagugagcuaggccuacauauuccaacaagaauaaauuuuaaaauuauaauguuuauaaaagcguauuuccaaauuugugcaaggugauaccauguauauaaagcuuggggguguguaaagcugaagcacaggaauuuuuguggguucagaggagcacggagauggugugaaagcaugaacgggauugaagcucaucauucagugucacgucaugggggcaggugaguugggcgaggcaugaagugcagagggugucaccccugccuguauggagguagaauuuacauaccauaaauuaugcauucuaaguguacauuucguaaguuuuaacauauuuauacacccaugaaacuaccacaaucacgauaccaaacagccaucacagcccacccccgccaagcguccucuacccccuccccaggcaaccacugauuugcuuccugucacuacggauuagcuugcaguguuuacaaauuugauguaaauggagucgauuaugcaauaucacuuucuuuuggucuggcauaacuauuguuguuuacuggauuaguaggugauugcuucuuuuugcugggaaguauucucucaaauggguauucccaguugguuuaugcaccuagcaguuauagacauuuagguuauugccggguuuugaccacuacaaauugcuguggacacuuguguaaaagucuccgugugaccaugugcuucccucucucuuggguaaauagccacaaguggaaugucuggauugugugguuaggugugugagcaacugugaaaccaccugccuguuuuccaaagugguuggaccauuuuacgguuggccaccaccagcagggaugagagcuccaguugccccauauccuucugacacuucguaugcaaucauguuaauuuuauguuuucuaauaacuauauagugauaucuuguugaggcuuuaacaucuguuucucuaaugauuaaugaaguugagcauuuuuuaaaugagcuuauuugccuuccuuuuucuucuuugcaguagugucuauuuagaugucccacacauacuuuauuaguuuuauuaacaauugaguccuuucuuuagaaguagacuuuauuuuuuauaacaguuuuagauucacagcaaaauuguaagcaaaguacagagaucucccauuauauccccuguacacaugcauggccucuucccauaugaacauuccgcagcagaggaacauuuguuauaauugaugaaaccaacacugacacaucauugucaccuggaguccacaguuuacauaaggguucacuugguauuguauauucuauggguucagacaaccauauagggacauuaucuaccauuacaguaucauacaggguaauuuuacugaccuaaacguccucugaguuccacccgugcaucccugccucccccagucacuggaagccacugaucuuuuuacugccucuguaguuuugccuuuugcagaauguccuagaguuggauccuauaggauguagccucuucagauuggcuucuuucacuuagcaauauauguugaagguuccuccaugucuuuucguggcuugauagaucauuucuuuuuaguguggaauaauaguucauugucuggaugucccacaguuugcuuauccaucuacccacugaagugcaucuugauuacuuccaaguuuuggcaguuaugaguaaaguugcuauaaacaucuguaugcagauuuuguguggacauaauuuuuuagcuccuuuggauaaauaccaaggagcacaauugccagaucauaugcuaagaauauuauuuguuuuguaagaagccaccaaagugucucccaaaguggauguaccacuuugcauucccaucggcagugaaugggaguuccucuugcuccacauccucggcagcauuugguggugucauuguuugugauuuuugcugugcugacagguaugcagugacaucucauugaugucuuaauuugcauucccuaugacauaugaugugaagcguuuuuccauauguagauucgcccucuguaaaucuuuugugaagugucuguccaggucuucugcccauuuuuuaaucuuguucauuuucuuauuguugauuuuuaaaguuuuuugugcauuuugauguuaacaguccuuuaucagaugugucuuuugcaacuauuuuccaucagucaauggcuucucauccuguugacguugccuuucacgaagcagaaguuuuaaaucuuaaugaaauuuuuucauggaucaugccuuuagugugguaucuaagaaguuauugucagacccaaggccuucuagauuuucuccuauguuuucuaggacuuaagguuuugcauuuuacacuuagguccaugauccauuugggguuaauuuuuaugaaugguggugccaggucugcaccuagauuaauuuucugcauguggaugucgagugguuuagcagcacuuguugaaaagaugcuccuuugcuccacggucacauugucaaugauguauguguguacacuuaaauauguauuacacgugauuuacaaauaugcucucuaaguguacagcuguuuuuuuuuuuguucuaccagugucuuuugagaagcagaaguagacauuuuuuauauaguccaauuuguaaauuuuuuucguguuacagaucuugcuuuugguguuguaccuaagaaaucuuugcuugguccaagguuaugauaguuuuccuuuuauuaguuuuauguuuuacauuugaacauucgagucugucaucuauuuugugcugauguuuguacauggugugggguauggauccugugugcaucuguugcagcaccccacgugucuggggccuugucguauugacugcccgugcacguggguguuggucucuggaacguguguuuuauucccuugauuacuugucugauuggaugcuaacacuacagugucuuaaucacuguaacguuauagugagucuuaaaguagguucagaaccuccagcuuugcuguggcccuuguaaauguuuugcauuuuuauaugaauuuuagaaucaucauuacaauuuuucaaaaaguccuguugguguuuuuauugggauugcauugauuguauaaauucacucgagaagaauucacgcauucuaccaguguuaaguuuuacaacccacaagcacagaauaugucuuuauguaggucuuuaaaauguucuuuuggcaguguuuugcaguuuucagcauaugagucuuugaugaucuuuugucagauuaagauauaaaaacuaaguuacagucaugcaccaguuaccuuucuuguagggugagcuuuggugguuuaugucuuuuaaggaauguuucuguuucauguaauguauuagugugaacuuuuucauaauauuccguuguuaucuuuuuccuguugauagaaccuguaaugauguugccacuuucauccugaugcuggugauuugugucuuugugacagugggcaccucugagcccuaauugugaucauuacuugcugugacucgaaucugcgcauugcguaauuucuuagaugugaugccaaaacccaauuuauguaaaaacuggcgaaaucuaaauuaggccuauuacugcagucacaugagcauccuaauguaaacagugcacgaccguuaggugagggaugaucaucagggagccagggaagggcacacagaaacaaguuaugaaacaagauuaucucacuuuagguacugguggaaaggagaaagccguuaacccuguauuuucaucugcucuuagugcuugagcuguuuagaaccuuuguuucauaguguuacauacauuauggcuccugcaggauuuuaaauguccauauuccugagcuuugaaaaaucuaacgugagauugguuuacuuugcccauuugcagguuucuuuagcuuauuuaguaauauaguaauauaauguaacacauuccacuggcauaucauauuuuaauauuuuuguuucaccauugauuuuucuucucuuuguagcuuuaccuuuaguccaaguggaugaaaagggagaaaaaguaaggccaaaucaaaaucgcugcauaguaauauugcgugaaauaucugaaucuacccccguggaaguaaguaauuucuccucugaagguuacuuggacauuuucccaaaggucuuuguugguuuugauuuuauuuuacuuuuguguuuuuuugggcuguguguuuuuuagacugaguacuuacauuaacacuguuuucccaggauuuacacacagugaguuacagaguaggagggaaugauaaccaaaccuuuugaucucaggacuccuuauaauaagauagugaagguuuaugcauuucuauauuuagaaauuaaaaauaacacauuuaaauauuuauuuaaaaauaagauuaguaaacccauaaauaaugaaaaagagcacuuuugugauaaaaaaaacuuuucaaaacaaguauuucuaugacaaaggggcaucgugaauaacucccugagccaccagugcagccugguccaagccagcacggccacucuuagagaacugguaacuuggggaguaauuuuuuuuuuuuuuuugagauggagucuugcucuguugcccaggcuggagugcaguggcgcaaccucggcucacugcaaacuccaucucccaggcucaagcaauucuccugccucagccucccgaguagcugggauuacaggcgccugucgcugcgcccagcuaauuuuucuauguuuaguagagacgggguuucaccaucuuggccaggcuggucuggaacuccugaccucauaauccacccgacuugggcaguaauuuuagggaaccacaguaucugauagcuuaaaaguaaugaaaagccauuuacuguuauguguugcuauaaaaucuacuguuuguccagaugccuaaacugaguugcuuuguguaguaaacacacugauggucacaccuugagaucaugagguaaagucuuuguagaaggugcuggcaacuuaguuuauccuaccucagaaaacggaaucugccugcuuuggggacucgcagaacacaggaagccuggguuuguuguuggucucaucucucacaugauuucagccucgucguucaugcuaccucuuuccacacaccuucucugcagaggagauggacguugcgguucaggcuuuucaguccgaguggguuagugugugugagaguuucuuaaggaaaacaacccuagcaugugagaaagggcaggauuccaacaaagcucucugccuagcguaagaaauucuauuacucucauagaaguauggucuuauucuagcaaguuuuaccuucuguuccacuuagccugucuuuacuaguucuauauuguaguauguggagaaaaacaacuuaggauuauaguuuuuuccuccuauuuuuauuaagggucugaauaugaaggaccagcauauuucuugcuugcuuuuuuuuuuuuuuugagacggagucuugcucugucacccaggcuggcaugcaguggcacgaucucggcucacugcaaccuccaccucccagguucgagugcuucuccugccucagccucccgaguagcugggauuacggccucccaaagugcugggauuacaggugugagccaccgcgcccggccgaggaccagcauauuucuuaugauuaauuuggacaucuguauuaacucaaaguaauauuuaaaacauagauccuaauuuuuaagacuugaaauguuuguaaaacuuuaaccaaggagaauuuucugcauuuagcaguagacauugauuuuggaguauuuauauuauucaaaacugcugaccuuaugucuuuuguaaaacuugagcaaugaaagucuuaagagagaagguuuaaaggaaacucuuugauaaauuaaaaguuggggaaaaaaaggaaggaaaauaaguagccuaaaacaauccacguaagaacauaaguucccaaggacucuguauaauuauuauagagcccuucuacugggucuuagaaauguaggcuaggaguuuccagaaaauuauucuuuaaaugucacuagguacuugucagugauuaguacauuuuaaauacugauucugauuuucuuaaaaauaggauuuucccagaggcagaggagucaaccauucuugccacuaguagacugauagucuaguggccuuaaaguauuauuguuugacuuuaaaagucauaauccuaauuuaccguuagucaaguaugacuuugcguugauguguuuuaucuuuuaaccaguaagcauuuaccagugaugggacaacaacauagggcauuagaaucccuggaaaccguuuuuguaguucauuugguugucaaauuccuuuuguacuuuuugagguguaccuggcuaguaauuuuuuauggaauggcccuguuuuuccuuguugcuguuuuuccucuggaauuuggaaugaauauagccacucucacguuccuugauugacauuaguaugguaugucuuuucuauccucuuuuaaccaacccauuuguguuuucauauuuaaaguggauuucuugugagcaguguguaauugggucuugcuuuucuuauccaaucugaaaauuucugucuuuuuuuuuuuuuuuuuugagguggcaucuugcucuguugccaggcuggagugcaguggugugaucucagcucacugcaaccucugccucccggguucaagugguucuccuuccucagccucccgaguagcuaggacuacaggcaugcgccaccaugccaagcuaauuuuguacuuuuaguagagacagaguuucacaauguuggccaggauggucuugaucuuuugaccucgugauccguccuccucggccucccaaagugcugggauuacaggcgugagccaccgcaccgggcccaauuucugucuuuuaauugggaguguagcccaucuacauuuaagagguuaaugauguaaugaugugauuaaauuuaaauuuaucaucuugcuguuuguuuucuguuuugucucuucuuuauuuucuuucccuuuccccuccuuuuguuugggauuaaauguguauuuuuaucuccuuuuuuggcauauuagguauaacucuguguuucuguuuuuuaguggugcuuuagggcaugcuucuucagcccgugggcggcaugccgcccaggacggcuuuguaugcagcucaacacaaaugcguaaacuuucuucaaacauuuugagguuuuuuuuuuuuuuuuuuuuuuuuuuuuuuuuuuuaaagcucaucagcuaucguuaguguuaguguauuuuauguguggcccaagacaauucuucuacuuccauugugucccagggaagccaaaauauuggacccccuuucuuuaggguuuuuagcugacccucuaacuuuacuagaguccguguaauucacagagcaccaugccucuuuaccuuacagccaugcucucccauuuacagccaugcucucccauucuccacuucuagccugugcuguugucacacauucuaauucuacacagucauaagccucacaauacaucguuguuacguuugcuuuaaacaagucacuuuuaaaaagagauuaaaaauaagaaaaacauguuuuauauuuauucaguauuugccauuuacaguccuucucauuccuuuaugucaaucuggacuuuccuucugccuggacauuccuuuagcaugucuuguacaggucugccgaugaugaauuuuuuucagcuuuaguauguuugggaaaaucuuauuucaccuuuauuuaugaaagguauuuuugcugcauauagauuucuggauugaggggguuuuuuccucccuuucuguguuuuaaagauacucucucuucugguauacguuuucugugguuuuuaucaccauccuucuguauguaauaagucuuucucuggcugcugugaagauuuuacuacugguuuuaagcaaguugauugcaauaugcuuugguguaguuuucaaacuucucguaccugaaauuuaucgagccauuauuuuguuaaauguuuuccucugccuuuuguccuuuucuucagaaagugucuagucagcuguuaaucuuauuuaguguaguuuuaauuucagacauuguauuuuucaucuccaguaaaguuugauuuuggucuuuuaaaaaaaaucuggccgggcgcaguggcucaugccuguaaucccagcacuuugggaggcugaggcgggcggaucacgaggucaggagaucgagaccauccuggcuaacacagugaaaccccaucucuacuaaaaauacaaaaaauuagccgggcgcgguggcgggugccuguagucccagcuacuugggaggcugaggcaggagaauggcgugaacccgggaggcagagcuugcagugagccgagauagcgccacugaacucuggccugggcgaaagagcgagacuccgucucaaaaauaaauaaauaaaaaaaaauaaaaaauaaaaacaaucuuccauauauauuuaauaugcucagucuuuaccuuuuaugggauauggaauauauaugcaguaaauguguuauguguauuaagucuaucguaucugucauuucuaggucuaaucuuuugcauuauaggucauauuuucuauuucuuugcaugcuuugugauuuuugaggagaugcucggaguuuuaaauuuuacuuuacugaauauuuuuguauucuaauaaauauucuugagcuuuguuuugaaaugcagugaaguuaccuggaaccaacuuucuagguggaaucagagcagccuuuucucuagggcucauuuuccccacugcggaagcagugcccuucugagcacugucccugcuauccuguguguuuaggagaguuuuccacuguggccggugggaaaacaaaccauuccucucuuggugagccuucccugggcuuguucccucucaucccucaggcgguuguuucccaggcugaagauguggggaaggccaucugcaggcuuacccugccggcucugcggcccaggcacugaaggccaacuccccuguucaugucccucucagggaucacacucguguucacgcugggguucagggccugaaacuguucuucauguauuuugucuuugguuuuuuaauugagucaucugggagaguaaaucuaguccaucauggccagaagcaaaaguccaagcaaauuuuuuuucuuaaauugccuuuaaaaaaaaaaaaaaaaaaaaaguugugcaguuaucagcccagaacaugauaugauaguuuucacauuaaucuagcuuaaugguaucuugagaguaggggaagcuguaaguugugugacugcuuuucucuauggcauugugauucugauucuggaagcccugcugaacccucauccuuuuuggaagagagauuuacuaggcaucaugguacguuuguuuaaggauaguuccuuaagagaaugcauuuguuaaaaaaauuuuuggugaggacaaaaacugacauuguugagaauuaauuucuaacaucucuauuuccuguaggaaguagaagcacuauuuaaaggagauaauuuaccaaaauuuauaaacugugaauuugcauauaaugauaauugguuuauuacauuugaaacagaagcugaugcacaacagguaaguucuuuccaccaucacccuaugaauugcauaguuuaccaguuuuuacuauuagugcauguugggacuaaacuugggcauugagauuacuugugaugguaaguuugaauauaaucugcagaggaaaucaaguuguagaaacuuaaauauuugaguguauuuguauggacaauuuuuauagcaauauaaaaagcaugugauuuuacuuucuaaggacaacaagcuaagcaaccuaggaaaaucaguuuuguucuucuaucugggcagagaaguuuuacuauuugcaaaguguuuggggggaaauuugaaccuaaucuucaucucccagcagacuucauuguauuuuggaagaugcuuuuaaugguauugagaaguaagcucuguaaggaggcgugaggaguuaguaguuuuccugcuuuuaagggaagcaucuuauuugugaggaaacuaacgcacauauuauaaaguguuaaaugguauaaacaguaugugggguucagaaaagaaaacacagaaaccugaaagauggguuuuaauuggauggagggggaaaaggggaacggaagauagaguaaccauuuuuguggaguggagugugagcucugccagcccguguggcgaauguggucggaugauauugaaucaggugcagggccuucacaguuuuauagggguuuaauguagaauuaacauggagaagaacaaggagauauaucaagaaugacuuuuggauguuaugauccuaauccuuuuccuuccugucugguauuuccugaacugcauucuccuaaucugaaauugggaugaauacuaggaacucaguauucaucauuuuccaccaggucaagguucuuagccaguggucuuugggagacuucuauggcaucuguuaauacuuacaaaauuguguacaaaucuuguuugugagaauuugggguacacguuccauagcucuuaugagguuauuuuaagggaucugugacccagggagugucaagaaucauuauucuagguucuguucaccauaauuuaauuauauauuucccuauuugagcuauugagugaacuauuggugccucuuauucauaagguuaaucgaauggaauuuuguacuuaauuuugcccuuaggcuuacaaauaccuucgagaagaagucaaaacuuuucaaggaaaaccaauuaagguaagcaagaccauugguuauacuuuguuuauuugcaaauugauguucuuaaguauucuaauagaaacuuacauauuuucaaacaggcacggauaaaagcaaaggcaauagcuauaaacacauuuuugccaaagaauggauuuagaccccuggacgugagccuguaugcccagcagcgcuacgcgacgucguucuacuucccucccauguacagcccccagcagcaguucccccuguacagccugaucacuccccagacguggucagcaacgcacagcuaucuugacccacccuugguacgucauuucuuuacuaggaauuuauguuguagacacuaugcuagauaauuugaaggauuaaaauccucaucuaauaggaagccagauaugugugcagucugacauacuaaaacagaccuucaaguuaugugggggauuuuaaauguagcugagaacagagcuuaugcauaaagaacuuuggauugcugugagcacaauccuugcacagcccgucuccccucuugucaugcagcucuuagcaagacgcagagggcgauaagugcuguaguguaccuggcguccccuacacagaguacaaugcaagggggauuaacugaggaggaagagguguuuaauaggcuucugacagcaaggccaaggagaaggccugcuguuuuaccagccuuauuuuacucacuucucaccagcauuagaguuggucgacaggauuaauuuuuauggauuuuggccuuuguuaaggccuaugguuggaauucauaagucuguacuggaucuagacauugucucuuugugugcugcuauagaugcuugaaagaucaagugcauucugggugggaauuagcaugaguuugguggcauuggaugcacgagagucagcaauacacggaugagcauguccuugaagcugaagucuaguugagaagugaagauggguucauggccuagagguuugcaugagguagcaaugcagguuaguuggaauuggagagauugaaggguagcauacauagaagguuauggucagaaagcagaaauugaguuaguaacuuugagaagaguucauguccaggguuucgcuguggacuaagggaaagacugagugguccucagggucggauggcugggagccaggcacccugaugugcagggaugucaccgcugacaggcagaaaaggaggguaggugcagagcagagagaacuugagaaaacaagugccuguauacacggaaaguaaagauacggguccaugaaacaacucaggcuggaaaagucaaacaugccaaggagacacguguacagaaugccagaacacugacaggucuuaucagggauuguguugucaucuagguugagcuuuucagguuaaguaugaguuuuucagaaggaaucaaagagaaguuucaugaacagaagauggucguagauucaugggugucugagcugaagcguacaccggguggcagggaguuggggaacgagcuggcaguuuccaggccuaacugcgcaggugcuuagcuguccugaggcaugugggcuuuggccuagugcuugugggaaggugucugagguuucuaagcggagaaaugaaaccauacuccauuuagaaaauagcuccuaaggccgugugaagggcagguggggacagggagagauuuucagaggaccccaauucccccugagucuggaaccaccgcaguguaagaaccuuugguaaaguuacuucugucucuuuugaguaaguccugaugguaagaaaaguuucuggcuuuuugaaguagcacauucuauaaaaguguacccauagcugaauacuucguuuucccaaaagcauaucaugagagaaccucagagagacuugaguccguaggcucuggguguugaagaaucaucgcugcacguggcuugccaugcuaguccuuucaguucuuccugcagcaguugcuucuuccguuucuuuaaucaugguugacccucucggggauccuugggguucugggucagcuuauggccuugacuuauguuguauguucagguugcggugugugccagacagcugguccugcucugagucugugauacuggggcucuccaucgcagccuuuuacuugugcuaaaacaugugcguccuuuguucugcagcugaagagauugugccuauuaauccccaacaaguaauaauaggaacgcauuaauaaucaacuuuauuuuuuauauaugaccaauuuuauuuuuuaucuugagcaaaauuacuggaauaucagggcucugucuguaaaaugacuugcuggaaaugauuaguccucauugcucugcccaugauuuacagccucagauccaggucugcauucauggcucuucaagugugauguauuuucuuuuucuuugagacagagucucucucugucgcccaggcuggagugcaguggccggaucuuggcucacugcaagcuccgccucccggguucacgccauucuccugccucagccucuugaguagcugggacuacaggcgcccgccacuacgcccggauaauuuuuuuguauuuuuaguagagacgggguuucaccauguuagccaggauggucuugaucuccugaccuuuugauccgcccccccuuggccucccaaagugcugggguuauaggcaugagccacugcgcccggccaugugugauguauuuuaaaaaguccgauucuuacagagugaagaguuucucaaguagcaaauugaagauucuaacuucccuuuuguaugauuuuauuuuaguccuaagcuauaauauucuuuuucuguuauaucuuccaguuagcucuaauuaaggagaauuacuugcuuuuuuccuuuccuuucucucuuccuccaaacaaggagggcucuaugcguaucucugucacuuuagugacauugaggguguggacuggaaggcccucaggaacuaagugcccugugucaggagcauaaggagcgagauaucagugaugcagaacguauuggaaaccauggguccagaagccagagaauuagaaugaauggucuugaguuuuguuuguuuguuuguuuuuaaaggaacuguuuuaacaauaaguuuuaucuuauuuuuguaugugucuagauuuuaaaaauaguuggccgauacuuaaaauucuaugcucaauauuuuuaacuacuuaagaucuuuuagggguucugugacccuuucuaauuucuucugaaucuuauguuaguauauuugcaugccauacuuaccuugugacuuggggaauaaugaugaucugaaaauacccugaucugcagagcaggacuugugucgggguaaagguaaaggcccugucaggcugugguuggaugaagccgagugagcagcagugggugugcaggugcuccuaagauugagaauguugaugaguuguauuaaagccaucaggaaucaagaacuguugacuuccugccagugauggaggucguaucagacugacaugcuaaagguuacaacacuuguuggagcccaugcgcucuugaccacgucuuuccucucagugccugcuuccgcaugugucaguucuccucgcuggauuguuguaaggauuggcugaaaggaugcacaaaagcuccagccuacuucuaaacagcacccauuggugauaaaauuguaaaauacaugucucagcaugggucaugacucugacaacaucaagaaaugcccucaguuuccacagauuuguugguauuaaugaaauugaagucuguuuuaugguuuauuuacuugucuguuuucaaaugaaucuagguaacuccauuuccaaauacuggauuuauaaauggguuuacgucuccagcguucaagccugcggcgucuccucugacuucucucagacaguauccuccucgaagcaggcaaguuccggggcggucuuagcaguuuuggucuuuacgcuacugcccuuccggaguugggaugagagagcuuugaucacuaguccugcuccucgcagacagagccaccugaagcacacagcugcauucuguaaagacuaagcacuacaaucuggcaugggugcccgccucagauucucugagaggaggcuuuggggcaacuuguacacaucaggugugccugauuuuaauuugggccuggacugaaaaacagcuaagcagaauuguggcacauuguuaauagauuugcauuauccuauauguuaggaguuaaccauuccaaauccuauuuuuauacuuuauuaaacagagagcagauuucagcuuagcuauuccaugucaguaugcauguuauguaaugccuugaucauuuuauaacucaacacauaaaaccauuuuuauuuacaggaauccuaguaaaucucaucugcggcaugcgauuccuagugcagagaggggaccuggguuauuagaaaguccuucaauauuuaacuucacugcagaucgauuaauuaaugguguccggaguccacaaacaaggcaagcaggucaaacuagaacacggauucaaaacccuucagcauaugccaagagagaggcugggccugggcguguggagccaggcagucucgaauccucuccugguuuagggaggggaaggugaguuguugagcaguuacuguguaacaucauaaacuaauauuuuaaaaauuauuuaauuuagauauguuuuguaauugucuuuaaauaugucacagaaaaucuaacugaaggcuauaaacauaaggguuuuauauaauugcuaagacuuaaauggcuucaucuuuuuuggaauaugaaaugguucagugagaacuguaguuguuuuagaucauuauuuguagaaacacuggagcucaauagccauagacuccaucccaugugccugcagucuccucuuggcagcaccccuggcucaccaggccccucugcaagggcgguguccaggcucugccccauggcugcuggccuggcgcccuccagcugggugugcaccaggcacugcagguggagccuggagcggguaaccaggcagaucagcauugcagucucaucucauuggaggguugagacuagccaggacgggucuuagcugugcuuccugcccaccauuuuugguuuuguuuaacauuuuuuuggcaucaauccuguaguagguuuuuguuuguuuguuuguuuguuuguuuguuuuuaagacagggucucacuccguugcccaggcugggguacguuggcaugaucauggcucacuacagccuugaacuucuggguucaagcaauccuauugccucagcaugcugagaagcuaggacuucaaaugcacaccaccaugccuggcuaguuuuuaaauauuuuguagagacaggaucucgcuguguugcccaggcuggucuugaacuccuggccuagagccauccuccugccucagccuuccauaguggugggauuacaggcaugagccaccgcaccugcccauuguugauaaggccaguugaucuucucaguccuugccuugguaaggaccgucaggauuuuccucucauaagugacaaacaagugacucaaauaccugagcuuuuucaggguguucuauauacaauguguacagcaccaucccugacgugcaagcuccucuuccugccugccacagugcacacccucugugcagugagaauucaacaugaagaggcaucagaagcaucucauuccugcccauaaugauucaaugagcacauaggaguuccugcagggauugugcaguggcauuggaaggcaccauggucugggagagcuggcacuggccugugucucacaggaaacauggcaucagguuggcucaacaggccuuggagaugcaaagccaaaaggggcccaccgugucauggagagucagugacuucagggagcaguugcuagcccugggucucaguuugggguucuuaagacccagacgcuuggagggaggaggguugcagagcuggggcucagacuugggacagagcccuacucaucaaggccauguggcucccucugaggggcaucaauugugggcacgguguggaaggaggcagacuagauggacaaggccccccggccucagccuccugugcucuucagugugccuuguucauacgagcgucacaaggaguuuccuggcaaaugaaaguggggcuuguugaauuccagcuaccucacaaaauguauacagguggcuuugaagcugagaguccaaagcuugcugacgaauguggucuacccaggauacccuucaacaauacuugaacuuccaaaugcaacuguaacaaguuuaugcuuuugccugacagaugcagaucuugcaccaauggagacccucucucuccccaccaagggaggacaacuguccucccaccugagaccugagcacugcggcagggagugguuuaggaagcgcacaccagcaugggcacggugggcagggagugguuuaggaagcacgcaccagugguuuagggagugguuuaggaaguggugggcagggaaagcgcaugcaacuccugcagccuguuucugcgauggguucugaagccagagcugaccuucguaaccuccuccuucccucugucuugagaaagagcuugugcuguuuugcagggaggugugccaggccuugcuugcccugagaaccugauccacagcagccaugccuccaccuccccuuuuugggaggguuuguuuuguuuccauuaacuuucucuauuggaccaaagugcuaagauguccuggagaaccccuuaccagaguccagacacaugucccuacccuugcauggcggccauggcagggcacggcccagcuggguugaauggcaugaggagccccaggcgccagguggcugccuugguggagcuacuguuaggaucagcugggggaagcacaccucuucagggucucaggccuucacaccacugcauucagagucgcgggugucacagugauguuuccucuauggugcugggaccacccugggucccuugcuaccccuugugagcuguaacccaccauggcccugucacugagccuuggcucagccaaccugcucucugcaugaugggcacugacagcugacaguguucuacggcugcaggugggcuucugggucugacacggguuacguggagcccagugagggugugggggaguguuggcugggcccacugauggugacugggauaggaccccauggcaggcaggucuguguccuggacaccgcuguguuccaagggaugggugccccugcgucccagccgguagugacgagcaggcugcccuuggcggagggaugcccugugccgagcccugcgggauguccucugcccauguggcugcugucccucuguccagcgcucagggcaaugccucugggcaagcaggugcugacaccauccgucucacaccccucccagguccccagggccaguugaguccugucccacugaagacucucaucugguugcaucccuagcucugcucaugggucauuguagccccaccuuuccacuacuucugaauccuggcgcagcggaguaggaguucagcucccuggguuuugggagcacccccuauuagggaguggugcugagccagguguguacugggguggcuguccauaaugcaggcccaggacccucucucccugugaggccacaggcauggauccaggacaaggagcaccaagcccccuguuccuacaggagguuggguugucaggacucaugccccaccuguggcucaguacucauccaugucccauagucuggccugcagucuccgcaaggcaccaguagaaagccaggagcuauuuccagaaaguuuucuguaggagauaauagggauuugcuccagaauccuaaagguuugugccguccuugcccuagaggguuuggcccaagguuccacagaguuuuccacuguuaggccaucuuaggcaagacuaguuuuugguuuucuguaaaugaaggaauuagucaagacuauuucuuaacuccuuuccagguuauguaauacaaggcccuugggggagucuuugcauuccauuaaauuauccauugagaugaaugugugucaugugacuuguuagaccacauaaccuguccagggaaaugggaaugucuuggccauccuagaguccuaggucuccacgugaagucaccacuuaaucagugucuguccugugguuaucaacugcguguguggcguggccuugcugccugcauggggagguccagaaugugguuccugaggcugggaggcgagggcaggaagucuuuggggcacagagguccuugugugguuuucgugggaaggggucagccauugaggcaguaguggaggaagcugagagggcagaggaagggaugggacgcgguauuuggggucuuuuaaaucugauguaaagcaaaucugcgccgggaaaauucucaccaccauuuuaaacaacucauugauggagcucagucucagauuuuaugugucuugucauuuccacccaguggauguucaguacucaugucuuaacagacaucccaaggaggcaccagggaguugguuucagucaguguuuucuucuguucuuuaucacuugccuggacuuccacguuagucccuugcugucaacuuuguguuguucugcuuacgcuuccugaaguugggauuuuagaauugaaagucaucuuugaaagguuucaaagugauaaagacugaauugauguguacuuugauuaugugagugcaaacgugcucaauaauaaauucuccaagugggaaaaaaauaacagucuuucacuuuccacuccucuaggaagaauuccuuuggcuaccggaagaaaagggaggagaaguuuacagugaguacauaaagcauauaccucuucacaagacauuuaaaucuaauuuauaccaaaccugagauuuaauuaaauggauuaagguuaaggcacaagaaugagcauuucaaaagacuuguaacgugaaauccacuaaguaauaacugacacccuggcuggccuaggaggaagcaacuguagagguuuuggaaauagcgaugugcugcacaggacuccacagugcacaggcguguugugcuguggcacaggcauggccaggaacuugcugucgcaugcacugcagccuacacacgggugugcacgugagcucuucuguguggcagcuguaccggagagucugaaaugacuggagccauucauuucaaugagcagaguaagcaucuuccacggagcaauuuguuugucgguguuuuuccuucaaaacuuucgaauacucucccacuguguagaaagcauuaucuccuucugcuauaacuuacuggcaggacagacccaaacauaagugauagguuuuuguggcgguaaguacaugagacauggugauuuuugcuuggguugauuaaucagaguuucuccuguggaaaauguuugugcuggucuuuaguggaggauggcauggacuucuccacagccaguggugggauggcacgguggcaguuagcaguacccacaaagaugggagggauggcacgguggcaguuagcaguacccaugaaccaguggugggacgguacgguggcaguguuagcaguacccacgaagaugggagggauggcacgguggcaguuagcaguacccacgaaccaguagugggacagcaagguggcaguuagcaguacccacgaagaugggagggaugccuccaugggcuugcagauguggaauuccauacaaggaaugcuggaggagaccuggacaaauccugguccagccccucaagccaucacacaggugcuuucucaucacaaaagauacaaucucuguuuagaacucagaaauugugccuuucaugaggucggcuuagucuaguuuuuguuuaacuaguugguaaggcaguuuuuaccaguuaauugcaauuggaauuagugaauuccugugaccauuuggacuaacaagucaagcaucuaaacacagggcacuguugugccugccgugauguuuucccacagccauuucucuuccguucuguuuugccuugcauuccugaugcauguguucaugacugugaccugcuuugaagcuucggcuuguggcccaguguuguauugauuacagagcauacgcccaucgucuuauguacgugcucucaggaccucagaaagguccagacgcuuuuucuguaaaagugugugagccucgggccuaaccacgcccaugggaccugagcaguacucagaccucacccagaggugcucagauccuagaggauuuuaacacugccuuccaagucaagucccaucugugggugaugucauuuuguaacucccacaucugggcaguuguugccugccucuuuugcuucuacaaguugagauuuaaauacauuuuuggggaaggcugucucucuaauaaugcuuaucuucugaaaagcuguguucaccucagaaacgugcagauguuuaaaaccgcuuugccaucauaguggccauguguaacuuagagcuuugcaggaucauuuugagcaucauauucacaauacuagguuacagagagcauacaacagccagcugcucaguagguaacaagcuuacugccaaggacaccuaacugggaaaagcuaagcuaaaauuaggcaccugucgcguggagcagagaagcaagcggaaugcccaacacagacuggacugggguuugugucagccugaauucauuuucauccuuugaccugcuuucacuucugacauauuuucucuagaaucuacugaugcagggauucaccuuccuguguauaaacuuuggagaaacauuggcacuuuccaguuagguggaucccaugagaucuuugcuuccuggucagaguagcucauuguuucagcuaaaaauaguuguauucuuuaguuaauauaaauucauuucuaaacuaaaugcaaacucauuuccccuuucugugccauguguccuucagccgaggaacugcguacucgcaaaaugacugccagcuuguuaaagcggguugauagaucauuuuccaauaaaagguauuacugccuuucuucugagauuugggcuuacaaaguacacucacuucuuauuauacugaguuugcuuucuuggaagucaaagaaucugauuagaauuuguugucaaauccuguguuuuuaauuauuuaaaaauauaaacuuucauuaaguuuauuuucagagaauucgagcccccuucccuuuuguuaaaccacuuuuuugaugcacguguguaaaauuucuuacacagguuguggagagagugucauauuuuguuuuuuacaauuaucuugugacucacauuaaaaacuaugcuguaguaacacaacacuugucugaaagugagaaaguuuaaugucuagacucaggcugcccugcuuuccaucuggugggcuggagucacuccagagugucucccuugccuucagcugccccugcuguucgugagugcuggcagccauggguggauagcucuuuggaugucaccuuagccucacuguguccuuugugacacaucucuugggcagcagcauccuugagauuucaguuuuacagcucugcucuagaugguugaaguugcuugggagaaccuucaauugagugaggaagcccuugucuggguugaaugaucugcuuguuucuacagauauuuuccagacagguguggaaacgagaagcugcuuggccuucucucuccauaccgugacccuggggugucauucuguugcagagcagccagacacagucuccaacgccaccaaagccuccgucgccaagcuucgagcuggggcuguccagcuucccuccauuaccuggagcugccggcaauuugaagacagaggacuuguuugaaaacaggcuaucuagcuugauaauaggaccauccaaagaaaggguaagggauauauugcaugucuaauaguugccaacagugucuagguacggguuccgugucaggcgcuuugcugagcucuuuauacauguuuguuuuuaauacucaagagaggcuuggaggccacgugauugcagaggucacacagauuuggaguaaggccagccuugaacccagggcugggccuucuccuuaacauugcugucugaugaagucagagguagaaacgugugccaugaugugccguacacacccuuucucucacccagaaacuuagauugcauugucauuguuguaguucagaccugccuuuauuuuauaaaacaacagaaugaaauggaaacaucugaauuguauuggaaaugauuaaaauguguaguaaucuacaugagacaaggagcaagaagccugggagaaccucacuguagugucgguagcuucuggugaggucugggcugccccacgaggugccgccuccacugcagugaauaucaucccaggagucgucccgagcugcagaugacagaggacacucagcccagcacucuggccucuaaugugcuuaggagguggaagugggacuuggccggcugccacaccuggcguugaaggcucugggaaguacagaggaaguuuucugcccaguuaccuacugugcauaggaagagcccaggaagaaccugcugagcacuccagguugccgguguccccugugccaggggcccuuuccccagcugugccccagaguuaccacgugucuguuccacgccacaugaccgugcugcuugcuaccccacccaggucugcagagucagugucucuuccacccugggcuuuagggaaggccccgcaguagauagaaccauuccucacuuccuagggcagaauuuaagguggauuuugaugcaguaucuuuacaaugaaagccaggugacgugucuaguccuuuucauauugguagauggucaugcuccuguuuggagauugaguacauuccaggauugucacauuagccuuaaauuuccacaccgucauuucuaagguauuagugccuugagaagaaaugcaguuuaaagaucaugaauucuaguuuuccaacuguagccuacucccguugguauugaguggaggagaagaggcaggucuccaacccugcuucagaaacagcagcuccugcugugcccaguuugagucuuguguaagguuucucuugaagaaagaauugcuucuuugaaaagccugacccugagccuuaugccaccacccagguguagugggcuccauugcugcuucuugggagcuucuugagucaacagcguggcccuuggguuucaaagugggguggaggcuccagaaaugaugggguucagcccuuccccuguugacauggagcucgugauggucacucugacuugcuucaugaccugcaguuguggaucugcauuucauuugcauugggacugcacauauccugaauuaauuaguuaauuuguuuauuuaagauagagucuugcucugucacccaggcuggaaugcaguggcacgaccuuggcucccugcaaccuccgccuccuggguuccagugauucuccugccucggccuaccgaguagcugggacuacaggcaugcaccaccacacccggcuaauuuuuguauuauuaguagagaugggguuucaccauguuggccaggcuggccucaaaccccugaccucaggugauucguccaccucagccucccaaaaugcggggauuauaggcgugagccaccgugcccggccccuacccugaauuuaaaaugagcuuuuacaaaaggaguccuuugcccucuuguuuccaccaagcuggauuccugcuggucgagcgcaggaauugcagcggauucugguucuccagcuggaagggcucuaggucugucgucagccuucaucuaagggcagaaguguaaagagcaccugcccuccugccuuuuuuaaguugcaugacaaguguaucaucacaugccauauguauaagaucaagcacacaugaaauagccccugcacaggggucgcuggcuggaguaaggagggaguaaguuucacuccguccuuugcuuccuggccuugggcaaauuaacuuagagguauugggccucaguuuccucaccuguugagaugggggcauucgcacaccugcuuccugggguugugaauucagggagggcugggagcucacauuuauauggguguggaggcgccgauuguuuuuucucagcggugugaaugaguuguguuggacuguguuaggauucgacacucagcagauaugcaugugguguugugccgugccgugcugggcccaaagugccaggugggugagauguguuugaugccuguucaguuaagaaauaagcuuguagaucaucauugcgggagaggagauaagggccugugauguaagaacaguggggcauuugccgagaaagagaagggugggcgaucuguggggcagaggauaguccugggcucugugacauuuuugcuggagaagacccucuuccccuauguccuugugcugcucucccaaggcuguucacggguggggugaacgggcacugguaccagcuccgcuuagugccggcaggacucugaugaacacucuugacccuguuucagacccucagugcagacgcaagcgugaacacccuuccuguaguggucuccagagagcccucggugccggcuucuugugcuguaucagcaacguacgagcgaucccccuccccagcucauuuacccgagugaguauugguguucuuccagcgccuugguguugacugacuugaauggccugugauguugcaugagauucaaauaucggguggcauuuuuacagugaucccaagguggcggagaaacagagggaaacccacaguguggacagacuuccuuccgcccucacugcgaccgcguguaaaucggugcaggugaacggagccgccacgguacguaccucgugccugccuuccugcacgacagccgcgaggcucuggugugaacagacgcugcgcacuccugcaccugcucguuuuuuaaucacaucuaauuugguggguuuuuauuugcgucugucuguguuguguuuucuguacaaaauaccuuuaauauuugcuaauaauuuuccacuaacuacucuaguucuuucucagaccaccauguaguccuuuuauuucaguguuggucaauagagguuucuugaguaguaacaagaccccagcuccuguuucuccauagacuuuaggaucauuucagcauuucgcgcguguguguauguuugcgugcgugcgcgcgcaucgugugucugaugaagagacaggaagagcaagaugguggccccaccagccuccaaccccugugggcccagcaggccugaaccccagcgacuuccuuucugcuguuuucccuacugggugaacuguggccucucuuacucugaguuguggccucuguaguuugaucuugggggagccuuuuccuugaauuugggaguuuaaucccuuacuguccccugggcugagucuaaaaaaggauuuuuuauagguuaaaauuaauaauuuuaauaauaaauaauaauaauaauaaaagaggccaggugcuguggcucacgccuguaaucccagcacuuugggaggccgagguaggcagaucaugcggucaggagauccagacaguccugaacaacauggugaaacccugucucuacugaaaauacaaaaaauuagcuggguuugguggugggcaccuguagucccagcuacucaggaggcugaggcaggagaaucacuugaacccggaaggcagagguugcagugagcugagauugcacugcugcacuccagccugugcgacagagugagacugugucucaaaaaaaaaaaaaaaaaaguuauuaagggaaauauuuuacuuuucuguuauuuagucuuuaugcuuccacuuaccugaaaacccuauuacacauuucuugaagauuuuagcugucuucaucauucuuagauauuuccaguccuuuguaguuugaaaugugcaaaacauuuuuauuuaaagacuguuuuuggaguuugccuuucaggguugaguaccgugugaggguccauugcccaccgugggcaccugggacacccuucuguuguccugagcuggcggagccagugugggcagcauccggacucuuccuaggcuuccgcauugcccaagcaggcauagggcuggguagggaugguguugagucagcacucuucuucgucaugccuuuucuaauuuuauccauuacuacaguagcacagagggaguguucugcugcaggggaaacuaaaucauuagauuuuaugaacuuuuuaaaaguuaaaaacacuagugaagauggaaacuuaguuacaguugaaaacucuuuuaucuuaagugaacuugauuuccugucuugucccuagagacaccauuucacacagguaacccaggauugucuguuuccaggaauugcgaaagcccagcuacgcagagauuugucagagaacgaguaaagagccuccuucuuccccauugcaaccccaaaaagaacaaaagccaaacacuguugguugugggaaggaggaaaagaagcuggcagagcccgcagagagauaccgggagcccccagcccucaaguccacaccuggagcccccagagaccagaggcggccggcggggggccggcccucgcccucggccauggggaagcgucucagccgagagcagagcacuccccccaagucuccucagugaaaaccguacgucugggaggggucgcagagcgcuguguuaaccacaaacgagacacucucccacucagugcgagggcgagccgcugguuaggagcuugcagugucugaggccugugggauccucaaguugguuuucuucugugaguuggauucucccccucuugaaaaaaaaucgauuuuucaggauuuaauuaauacaaaccuuauuuuagguuggugcuuaacuggaggugaugcauaagucugauuuuuuuuuccaagauagaaaaagcauuuauccuaacaaauugguauuuuuuauuaagccuccauguggcucugaaugcaagcuauauauagugaguuuuucuaaauuaagggaacucugcuuuuuuuuuuuuuuuuuaaguaacuggucuguaagugcauaucucuagaacguccccgcagaugaaugagggccaguggccuuggcagaggcagguguggccucguagaggcagugcuggccgcgccagggcaucagugcugaugugggagcugugcuuccaccuaagccguugguaggggacuguggcauuuaagaauguagagagcgcauccuuuuugaucuccugggcggagugaaccugcaggggccaccccagaaaccuugguucugaugcacugcaagcaaguaaccagcuucucacuccaguuucaaguggcuauuauguaauauaaauucaaagcacauugugaauagaaccuacaugaaaacauacacuuuguugcccacugacauguuaccagaaguuguaccaugauguuguuuugaccccugugagcugauggccccggcccugcucugugcacauuucuguccguguuccccagcacucugguuggagagaguccacaucuucagcuccguguggacaucucccuguaccucugcaucagcacauggauuuaagaguuauguaaucgugagagaaugguguuugugguuuuucccccucuuuggcugguggaggauaaaguuccugcucuuuuaccuccaagacgagggccucauugauucacuuccagaagugcugcacuucugaagaacaaggaugcacuaaaguuagcaaguuuauaauaaaguuaaauauaaauuauuuuguuuuaaaaugccucaaauuuuucuuuauucuaagcagcaaacauuaaaauaagaauauuuccugcuaaauguaaccauacacuuuauuccacaaaauguuauuuaacaagacugaggguuuuuuuuaagaaaaaauuauuuccauccaauauuuaaagacuugaauuuuauuuaaacuugaaaaugacuuugccuuaacuuuuguauaagacagcuuagaguccauggagcccggcccuggguuggcgugagugggucagaguuacucaguuacugcguggaucuccugucgcuaguuuuacugaguaagcauacuguaguacaagagcuaguaguaguuuuuguaauauaccuuaaagaucuucaacaguugaucuuuuuucagaauguuggaaaauccuguaaaugcaaauagucaauacuguauuaaauacgugcacuuggagugugcuucgcuuguacaguuguaaauaaucagaacauaugaaaaagguacccuacagagaaaauucugauacagauuauugauauauuauaaauguugcuguugagcgggauguagauaaacuaaauguugugguuugaauauuauuuugauuuguugagauuuucuuuuuucucuuacaucgguguguugaacugauucugccucuuugcugcaaaagggaauuggaaagucuuauuaaaagccuccagauguuuucauacucuuuuaaaauguauguaaaugcauacuaaucauaucuaaugugaaagaguuuuaaaguauauagagagcaaaaacuggcaggaucguaagugaaggugacuaguaaucuaauuuaaaucaccugcagcuaagcaugauugacccugccagaggaaaacaugccuauuugaccauuuccuuuaaagcaguugccauuauucaaauacagagaaauagccacagggcuaguguuuuucaaaugcauuuuaaagaacauggggauuuuuuuuuguaguugucaguucacugaccaaaaaaaaaaaaaaaaucagaaauaauugaucugugaaacccaaacucucaauacucagaaagcugggaggcaaccucgaggccugggccuacgagcugcaucuucgcuacggaagggccagggcgccaucagccauucccaaaacacaaggccugcccguccgccagugaguccuugguuuuuaauaaugagaaguccuuucccccaaggugugagcauugcagcgcagugugugugugugguuagagccagcuuaguccuucacuuugucgaccgaagugggagcucaacagcugcaugaggagggcagcgcgugcauuagccagucgccacuggagggcucugcugcccuccggucaauacacuguaguuacugccuagccagcagcagucuucugcaucaagaacugaaacguugcucggaggugauuuuuauagcauccuuuuuaauuaaaggugaaauacagauugcuauauaaugucugaaaaaaccugauacuacuucaagaguuucugcucagaagaaaaugagaguuaucauaauaggaagcuguggcgguccaugccaacugugcugugucacauacagcgaugagaguggcuuucauacuuuuuuuuuuuuuaaguuaacacccuccuuuacccccagcaguaucucagguuauagaaucagagaugcagcagugacaaauggcauuuuaacuuguaaaaucgugugaugaugcuuaucauuuugaaauagaagaauaaaaaccuggucccguuucaccagacaugaauuucaaguggagucgucguucucugagagugagugucuugacauuuucacccaggcccuccugucaucacaucaccggcugucacuggcggguggccguaaacguccugcguugcuauauuaggaucucugcaguucaggcuucaaaaccaguucaguguauccgggcgacggguagugguggugcaugccugucugugugccccgcuggcgagcuguaguugcggcuugcgugccucgcggcccacuacagggcugcagacaaucgaggcgagggcgcuggccgccagcagcucacagcgcgggggucauguggucgcuccucgaggguuucguuuuuguucugcuucauuaagacuggaaucaagcuuacauguaaacuauugguaauuuaaguuuccuuuugugucauucaguguaaaacugucuaauuugaaaaaaaauguagguuaugaaaauaaagauuuaggcacuguuc

SEQ ID NO: 192401 - RNA, 66378 nt, Homo sapiens
gcggcuuguuuucuuuccuccagucucggggcugcaggcugagcgcgaugcgcggagacccccgcgggggcggcggcggccgugagccccgaugaggcccgagcguccccggccgcgcggcagcgcccccggcccgauggagaccccgccgugggacccagcccgcaacgacucgcugccgcccacgcugaccccggccgugccccccuacgugaagcuuggccucaccgucgucuacaccguguucuacgcgcugcucuucguguucaucuacgugcagcucuggcuggugcugcguuaccgccacaagcggcucagcuaccagagcgucuuccucuuucucugccucuucugggccucccugcggaccguccucuucuccuucuacuucaaagacuucguggcggccaauucgcucagccccuucgucuucuggcugcucuacugcuucccugugugccugcaguuuuucacccucacgcugaugaacuuguacuucacgcaggugaguuucagagaggcuccuggaggcgcucaccuggcggggugguccccgcggggcgcccgaggcaggggcgauggcagccgcgggggcggguccggcccuagggcugagaguguagggagaaggcgccggcucuggggucguccgaacccuguccuguuugcgggcauuugucauaggaaacccccugccauucccaaaaggggcaaggagaaggcaggggagggcuggaggccgccgcucacucgcugccccuggcuccgcaucgugcgguggauucggggcgcuucuccgugcgcagcgcgaagcagcagcgccugcacacgccaguuaguacggauggaaggugugcccccaagggaggccugaacucuagaauuugcccugccuccccaggcaccuaacucccggccuggaaaggucuucugcacguuggccuccagauuugggccugacacugcuguuuugagcguuggcagggugagaccauguugguuuugaugagauguuuugaaccuccggcuuaggagcucuacagaacugcggcuuacuaacucauuccaccggauugcuaaacagcaggcugggguaacacccagcuccgagcugcugccgcucaucagaguuacugucugagcucaucugagaggccccaagaaaaggccauaaaagcugacuggggcucuuuuacagccacacaaaaaucacuuuauggggcauauuauuaaauaagcuaaugggagaguaugugaauuaacuuggcugcugcuuuacugcugaugguugacuuaaugaaagugcaguaauuguugagcacuuugcaaauacuuuguauagcguugcacaaagguuuaauaacgcggugccgccgucaucaucgucaucaucaucucugauucccauuagcuuuccaagcacuaagauguccauuuucacuaggacucugccgaaggggaaggcgucaacggugucaccuggugaggguaauuucagaacugucggaugggcagaaacccugugcaagcaggcaucucauuccuuuuaagugucuuuuuuuuuuuuuuugagaaaaagucacuuauuuaaaaaaagaaagaggccguaugcgguggcgcaugccugucaucccagcauuguggaggcggaggcgggaggaucgcuugugucccugaguuugagaccggccugggcaacauggcgaaacuuccucucuacaaaauguacaaaaauuagcugggugugguagugcccgccuguaguuccagcuacucaggaggcugaggugggaggcggagcccgggaggcggagguugcagugagcagagauugaaccacugcacuccagccugggugacagagcuagauccugucucaaaaaaacaaacgaacaaacaaacaaaaaaaacaaaguaggaaaaggauugcucugguacaguggaagccacugacugaaaauauggaagaaguacuuuuggcuaaaaaauagcauaugugauauuuuguagauaguauaaucuuuuaaaaaugggucuacacucagacuucuuguaaguccagcgcaucagcauauuuuccggucggagaguaaugcguauugccuguccaaguacaaccuuuaaaccugcaaaccaguucaggcagucggcugcauugcacagacacuuggguuuuguaauugaaaugaggugguucuagcaagaugcaaaagacaggugaggugauguuacccuaagaacugugacaauggugguauugcacguugagcucuuuauauuuguccccuuuuuggggggcagugggggaagaggaaaaugcagggaacugccacagcucucugguaaucacaugcaaauucugaacuuagagccggauuaggggccgggcugcacauuuucugcaccaucugcugguuggugaguaaaugcugagcaagggaaacagugaccaggcagacagagccacuccggcccaggggcccaaagucacggcccuguacucuuuauaucucccaggucugcgggcaccacagcaaaggcuuuucgccugagggcacaggguggcuggcuggagaagguggcaugucuccaucucugagugcuggcaucucagagccuggcagaacaaagccauuucuggcuuagugacaaaacugugauacuucuggggaguuauaaagccuuuugucgccaacccagcucugccucccuucuccuccucucccgcucacccccucuuucucuuacacaaaccauuggaauuaccuaaaguggggagcuuuaagaaugacuguugcuugggcccccaucucagaccaaguaaaugagauuuuuggagaaggggcugacagcuaacaauuaagaaguauguuuaagaaagcauacuuucgaucucggcucacugcagccuccgccucccggguucaaaugauucuccuaccucagccuccuaaguagcugggacuacaggugugugccacuaugcccagcuaaguuuuguauuuuuaguagagacaguguuucaccauguugaccaggauggucuugaucucuugaccuugugaucuguccaccucggccucccaaagugcugggauuacaggugugagccaccgcacccggccaagaaagcacacuucuaagcaauugguuauauuuauuuuuaccagaacucucugaagaaaguaccgguauuguccccauuuuccagaggaggaaacugaggcugagaggucguagaugacuugcucaaggucacacugucagugcaugguggagcugggauucaacacacaucugugcugucugagugugagguuugucuuuuauguacaguaugugaaaccucuuuuuauuuuauuuuuugagauagagccuugcuuuguggugaucuggguucacugcaaccucugccuccuggauucaagcgauucuccugccucagccucccgaguaucugggauuacaggcaccugccacugcaccuggcuaauuuuuguauuuuuaguagagauggaguuuugccauguuggccagguuggucucaaacuccugaccucaaguaaucugcccaccucggccucccaaagugccgugauuacaggugugagccaccgcgccuggccaugaaaccucuuaacaaugggaaaacauacccaacucuaaaucuaaccucguguucuccuggagcgcaaaaucagguugcagagaaucaaaguauacauacagcacaguuaaggcacgauuugcggcacugaagggaaugguuauugaagcgucaggagacuugaaugagacaugaguccucugagaagaagcaggugucuggaggcugaagcuggguggggaggaagagaggauggugggaaggaagucgugggggcaguuugggaauugggaaugaacuggaaggagagguccgagauggggaggaagcuuuuuucuguuguugucaguccuuugugcuuuugcagggucccuguaccugggccuuacucaucucacccucccuggugacccagaggguacuguuaccccccaacugaggcucggaggggugagaacacuugcccacacugccccguccgagccuccgugcaaugcacacgaugcugcaguacgcagccccggcugcccuuggguacacaucugaggguaaugcgaucaugagcaagcucaauuugauuaacuuaccccuaaaucacugcuuuuaaauucugccauguuaagucucuuuccaccccuaaugaccucucaggcagauccuauggcuuucuagucauacucgguaauuauuauuauuuuggagucuggcucugucacccaggccgcaguagugugaucuuggcucacugcaaccuccgccucccagauucaagcaguucuccugccucggccuccuuaguagcugagauuacaggugugcgccaccacgccuggcuaauuucuguauuuucaguagagacaggguuucaccaucuuggccaggcugguuuugaacuccugaccucaggugaucugccuaccucggcuucccaaagugcugggauugcaggcgugagccacugugccuggcccauacuccuuuauuaaaucuuuacgucugauuuaaagcuucucccacacuguccaaggccagccaggcuucgagcugcagggcuuggugcagagggugugcccaugcucucagccucuccccuuccaucuucccaggcagcccaggggaggggcacacucucucgugacugccagcgugucggccucuggucuugcucuggcgccgccucuguggguaacugccacguggccauguugacaugauggacuucagcuucuuccuagccccaucuuuggucucccuuccaucccaauuccuucuucagggggcagccacauggcuuuaggccccuuuucgaaaagcccuuuuagggcuuuuucuuagaaagccaugggaucacugaggccccuccacucccacuuggccacaugggugacaggcuggaugccuaacuagcgucuucaggacccugcaccuggcugcuuuucacuccuugcgugccuaggggcccucccaccuguaaaaaucccagguggaagcaagcaucacccuccaagugccuggugccuccagaucaccagggcacaggucaggcuccaccgggacuccaccugcaaacagucccagcucagcaagcaucugcccgggcccccuuccugcccaaucccugugagcaguguccaugugucuuucuccuuucugaccuggggugaggugcccugcugguagcaggcuguuaacucuuuuucuccaucuccacucuccaccuuccaguucagccugggaacauggggaggcggcugugguaggacugguucugcuaacucucuccgggccgucuguaugcagugucugucuggccccaaauguuuggaacauggagugcugacuaccuguuguuuccagcuguggcuccuugugccagcuuuggggaacagcugagcuucugcucccggcugcaugaggaaguggcgggaccaaggcuuugcaccaaggccuuugacucagagccuguucuaagcgcugugucaaaucaccauuuuaguggggacuuaggagaggggcaggacucugaaaccuaaggcaggcaggggucucugcucaugaggaauuauggugccuucuaccuccagguuucaggauagaggcucagaagcaaaggcgguagcuucugugcccaggcagcuccugggcagacaggucugugcccugcaggggcagaaguugauguggcggugggcucggugacaccucggcagccacguaucccagcccuucuuccucggaauucccagccuggaacucagacucuccagauucccgaguuuggcaggauggaacaggcugguucagcuuugucuugggcccuaugacaaacuccugccauugcagucacaugguuugcggaaggaaauggagaagcgaguucucuccauggggagaggugcugugaugaauggacacugaugugggaacugagaccugagacgucaccaugccuuggagggcagaugggaagcugacauuuaucggggucuggucuguucuguucugaaacucagcuagggacuuccacacccuccacucagcugcagcagggaugguucgugagucaugugguccugugggauggugccaggggcucguggugagggccugcggcucaugguaggggcucauagucgguguugggagcucaucaugggcacuaggccagcaaagccuuaugaaugaggaggcagcccugggagugaaggagcagggucccugggugcagaucuggguuccaauccgggcuuugccuccagugugggucccauggcugguuaccaccucucuaaggcugcugcuucaccagggagacagaaacuguaauacucaucccaugggucggaguggguuaaaggagaugccguguguccugaaucccuuugcuccucuccucccuuaguugagauucucacuguguguugccuacagcucugaaccuaggcucuugcuucgacacccagccacuguccugaaggucagguccccgggcugacccugcccuuuuccagccuacugugccaucaaaauuacuuuuccaccaaacagcagcuuuucuguuuguaaaacgguggugacucuuggcgcacccguagggagcauguggcaagccuaaucgcagugccugacaugagagcagaaggcacuggggguccagcagcccagccccuccuuugcagaugagccgaccagaggaggaaauucucccaggcagcccagccaggcgugcagaggcaggacaagucccguguuucaggcugaccgauccgugcuugcuacagacgccacacucugacuugaagugggucauaguccucauucuugcugguagggaacuaagaggccccuaaaagucgaauccaggaacuaguccuccgugcucaccaggaaagggacgugggugauuguaggaguaaggggcuucggcuguggcucuuggcggucaguuuagucaagacguguuuaucaaauaccugucguguggcaggcccuagucuaggaguugugaagagggaagcuucuaggccuuuuggugauuguaaagaaguaagaggcuuaggaaacagacaaggcgggccaagggcaaggacugugcucagccuggccucugggcccugcgcccauggccucagccccuggcaccggcucccugcggagcuagcucagugggcucauggccagccagaguugugugugcaccuaggugugcgccuuuguauguguaugugcaugugugccugugugcaccuguguguauguacaugugugccugugcacguguggcugcgugcaccuguguguguaugugcauaugcgugugugccugugugcaccugugugugugugggguuuguguaugugugccugugugugugccuguguguguaccugugugugugugugccugccucugugugccugugucugugugggucucugagugucugugcaugugugugucugugccuguguaugucugugccugcgugugccugugugugugccucuguuugugucugugcaugugugugcccguuuguguuugugugugucugugugccugugugugugucugugccugugugugccuguguaugucugugcccgugugugugccuguguuugugugugucugugccugugugugucuuugccuguguuuguguguaugugccugugugugugucugugcaugugugugccuguguguguggaaagguuuccuuauuuucuuggucugccguucacccccagcaccucccgcaggccacuuucuaaacauacagcccaguuucccgagcccucuccucgagccauggcagcgugcucuucucucugcagcugaggcugugaccgcaucagugccucggugaugcccugccaaccgagggggaacuaaauccuguuaaugcccucagcacucggggaacaauuaggccccucacagcacauucagcauccaaccccagugaccaugcaggaagccuggacuuccccacagcagaggcugggcugaggcugcugccgggucaccaucaggagcgcccuacugucggcuccgaacacuguggcaccugcaggcuuugcuacggcuucuugcucaccugccuuuccguagucagacaggcagaacugguagugaccagcagggaggcagggccggagcacuguccugaggcuagugcagguucucaguggaguuccagggcccagccauggcugucccgcugcugcugugcccacccucugagccccaggcuagcugcucagcguugaguggcggggaguggagggcaggggucaugacagugaggggugggcugcccagagaggaacauuugcaagauccaagacccucuacaaaaucucacugcaagcgucuuaggguuuugcaaacaacaaagucaugugaucccaagagccgcuuuugucaggcuguuccuguuggccuugcguuuccagugagaagaagaaagcugguuccugguuggaaggucugucuggguccugacauuuuggccggccaguucucucaguacagaaauagccccagcagacuguuuagacaguaccugggacaacaggcauuccccgagggcugcagaggcucauaaauauuucacuuuuuauguuuccugcagcugaagcuuagaguccauuaaccuauaaggacagaugaagcccaaaugguuuuacucugcaaguggguugauuaccucaagcuuaugugggucaggauuuuaggccugugagccacauauggucucuguugcauauucauuuuuuuuuuuuuuuuuuuuuuuugagacagagucuugcucugucgccaagcuggagugcaguggcgcaaucucggcucacugcaacaucugccucccagguucaagugauucuccugccacagccucccgaguagcugggacuacaggugcccgccaccaugcccagcuaauuuuuguauuuuuaguagagacgggguuucacaauguuggccaggaugaucucgaucucuugaccucaugauccgccugccucggccuuccaaagugcugggauuacaggcgugagccacugcgcccggccucccuccucgauuuuuaaauggcauacacacuugcgaggcugagcuacgcagucugcaaaacacagggugaaaaaacccccauacacggugggguuggcucugugggcugcucccaccccauaggcuacucucccugucaccuuggacucugcugccacagcuucuuuguagcugucagaggucauguugucccaucaggcugugugacgguccauuuuuagugcaugagugguggcagauaaggagggaagugggcagggugugagcaaccuuggcgugccgugagccuggccccaucaggcccacacucauuuucugggaagacagcacacaucuauccaugcgagagggccucguccucccagcuuucacaaagcaacauaaaguucaacuggaacauggcgauucauuucauuuauucaacagguguuuuuuuuuaaauuaaaaaaauuguauugucuggguguggugaauuacaccuguaaucccaacacuuugggaggacgaggcaggagguucgcuugagcccaggaguucaagacuauccugggcaauauagugagaucucaucuguacaaaaaauuaaaaaauuagccaagcauaguggcaugcaccuguaaucccagcuacucaagaggcugaggugggaggauugcuugaacuugggaggucaaggcugcagugagcugagaucgcaccacugcauucuagccugggugauagagcgagaccugucucaaaaaaauguauuggggcuggacacaguggcuuaugccuguaaucccagcacuuugggaggccgaggcggguggaucaucugaggucaguaguucagaccacccuggccaacacggugaaaccccaucucuaccaaaaauacaaaaauuagcuaggcguggugggcgccuguaaucccagccauugaggaggcugagacaggagaauugcuugaauccgggaggcagagguugcagugagccaagaucgcaccguugcacuguaaccugggugacaagagugaaacuccaucucaaaaagaaaaacaauguauugggcuaggugcaguggaucacgucuauaaucccagcacuuugggaggcugagguggguggaucaugaggucaggaguucgagaccagccuggccaacauggugaaaccccaucucuacuaaaaauacaaaaauuagcugggugcaguggcgggcgccuguaaucccagcuacucaggaggcugaggcaggagaauugcuugaaccugggaggcggaggaugcagugagccgagaugacaccacugcacuccaggcugggagacagagcaauacuccaucucggggaaaaaaaaaaaaagaaacaaacaaaaacagacaaaaaaccaaauaaaaaaaagacguauugaagcaaaauugacacaauaugaaauuaaccauugaaugcaugcagcugagugauguucaguacauucacaguauugcgcagcugucaccucuaucuagguccagaacauuuuuaucacccccaaaggaaacuuuaugcccauuaagcaaucacuacucagucccuguugccucagccccuggcagccacccaucugcuuucuaucucugcagauuuaccuauccuuaauauuucauaucaaaggaaucauacaauguguauucuuguacgucuucuccuuucuccuagcauaguguuuugagguucaucacauuguaacauuuaucagaacuucauuccuuuauaagguuaaauaauauugugcugcauggauagagacuacauuuuauuuauccauucauccguugauggacauuuagguuguuucaucaugcgcguuugagugcuuguugugugccagacacugugcagacuguuuaaggucaaacuuagauucucgcugcguggaacuuagccuugagcaaggaaaacagacuucaugucaacgacuucuccauugugcgauugacuggcugaugugacuuaguggcuguccuuacaguagagauaugaagugugagauguuuucaguggaaaguugaagacuuaauucauuccuucaucucugugagucccccucuaggauacaugcuuuaaaaagaaccagugguuuuugcugcuauuuaaaugaaagucaaauccaauuuaaaaaucucacuguaaugaaaucaaaauauuucccaaacacagguauucacugugaagcgaugccaggauggcuguggagggaacuucuugguggaagucgucaccugugacuugggcuguuggguuuccacccaccauugcccugguccugcuccuagggccccuuccuugggugccacugggaggugaaggcuuagguuuagguugacauagcagguguauucucaccagaaccagauucuggggcaaccaaguugggccccuggcuagucuuggguuuuguguguggaagcccccagacuccguguccuccugggcccugcuccagguuaagcuggaauuucuggucugccuggguuuguucucagcgaaucgugggguccagaccaacaugaggauggaaggguggugcuggguaacucccacccugcgcccuggggcugugaacagcacgcgucauccgucccccgaggacacacggccugucacggcuuugacagcauauauugugucuuccccgaguucucucugcuuggggucagcuagucccaguuuuuuucaguauuccuggaggaacguggguguguccucugccauccugguugcuguucccgaaggccccagugagcugggacagugucaggagcagaccaaguccccaccccuagugaggagcuucccccguuacccacauagcuuccccucgaggaggccagauggucauucucucgguggcaggacacagggagugucauuuaauaccagacacguccagcaagggcaggaguucccagggcauccuaaaaccucagaauucuccucacuucugaagcagaaaguuauucugugaggaggggcaaaaacaaacugggguacuuucccugcgaauuuauuuuguaguuuuugcaucguuugccagcaaggaucagggcacgaugguacgacacugcacacugccgcacguggcccgggacccuccugccauagggcccagugggccagcgcuggccaccgggagaaaugcauccucugugcuucuaaugugucaccuuccuuaaguacauuuagaacaauuaggggcagggcccuggcugguaaacugugaacugcaauuugugguuaagcaguuaagaaacauaacagugaugguagggccuuguguggccacagcccuugucauucccaaggccaaagagagagaauccugccagggaggcaggucagaauuauuugccuccaccucugugcggaacugaugccgagacggacuccacccaggcagugggcaggcgggcagguccgugcgcuucuguggcugaagcggccgggccgcagcuauuccugcggggcuuccagggcggaggacacgggcugacacgggcugucccugggaaggaacuucaagucauggagcugucaaaguagaagcagcuuaaugaauauuuguccuaaugcuuucaccucgcagauagacacugaggccuagaaaggucgauggagcuaaccaggaaccaacaaaguagguuccugaggguugaccagccucaccccugaauccaggugcucaggggacaagagacaauucagaaaagcagggagacugaaggacggcguuugguguggcuuuagguugacuuggagagccgcaaagggugugggugggaggugugcucucuagagucccgucuccucgcgggcugccugcugggcugacuuaucaaugugggggcucagggccacccugaguucugccuucuggguggccagccuguguuggcgccguuggauggagugaagcucaguuuaugaggcucagggaggcucucgugagccgauggagggguggaggaggggagaggugcuugcugcccggagagcugagcugcugggaacaggaaggagaagaggagcuguugggaagggggacagugaguggagaugcccuuuaucuauaaagguaaagacuguuaucccauuaucacuuaugaaaugaggaaugccuugugaggaccaagguagggacauccugggugggagcugagcuccugccuuguggggugcacaugcacaaacaugcacacacauacacaaacgcacacacaugcacacacacgcgcgcgcgcaaacacacaugcauacaccugaggaaggaucauaggcgccaggugagccaaacaggaccaugcagcggagcucucaggagggcuggagaaggcugcaaacacauccagggagcuccgaggucuauggaaauccagagaagcaauuaugguuggcuucugaucacgugggaagaagcucacugaagucuggggggcccacauuccaagggccagcacgaggccaggagcaggcaggaccagcuucuugggccacaugcuugccaaagucaaaggugggaggugaugcggugaacaccugaccauguauuccagugaccccucucacaccuggccagccugggacacagaccaggcacaccuuggcuucaggccaccgccucccagaacuuuauggcauggacagcgugcuugcuugccuuuucuggccaguuaccuucacugccacggacacaggacuaugaguggggcugugguggugguuauccagguccugagucccuggaccuauagcccacagcugacguuuggaagaaaagaacauccuaacgcaggcauagaggccccgcccuugcucgcacugucuuggagacugagccucaaaugcagauccccuccccgccgcagagccgccuugugugucuuccgggaacccugcagaaaggagaacuccggugucuggauuucggggaccgacugucuugucacccugcucugcugagugaggaugcucagcaugugggaacagacugaagcagcugacuaaugacuguugccuggggagaccagggcccugggguuugcauaauuuccccaauauaucaggaaguggguagcgcagagggaccaggagagcaaauaucgaaugcgucagugguucuuaaccuuuuucaguaugaaaguuccuuuuaugguuaggauagcaucuguggucacaguuuaguagcugugcguuuagaaucaugguuugcgaacauagaugaggacuaauaauaccaacagcagggguugcagccacccacgugguacuuacuaggcggcaggcauuuguccaggugcucuacaugucuauuaauucaccaaaugcuuaggaaaaccugguggcugguguuauuagucucauuuuacaggugagguacuugaggcacagagcaggcaggugacuuuuccaaggccacacagcugauaauugguagagccaggauucaaccccagguaagccagcuccagauuccacacuuuuuuuuuuuuuuuugagacggagucccgcucagucgcccaggcuggagugcaguggcgcgaucucugcucacugcaagcuccgccuccugguucacgccauucuccugccucagucuccccaguggcugggacuacaggcgcccgccaccacgcccggcuaauuuuuuguauuuuuaguagagacaggguuucaccguguuagccaggauggucuugaucuccugaccucaugauccgccucccccaccucccaaagugcugggauuacaggcgugagccacugugcccggcccgauuccacacacuuagccauccuucugugucccucugucagagagggcuaccgguuguggccuguuauauaggaguagcgucgucugucaguauaugugggggacugguuccaggacccccaaguaugcucagagccccacauacucacaucccuguagaaccugcauguacaaagaguugguccuccuuauauucagguuuuacguccugagaacaucguaguuuugauucccauucaguugaaaaaaauccauguauagaugcgcccaugcaguucaaacccaugcugcccaggggccaacugcacugugccuuagugaagaugcaugagcuagaacuguguguaucaacauagauaccuuccaaacacauagucaugagggaauaaacaaacugcagaagguuauggaagguauuaaugcauucauauaaagugcaaaaccauacuggacgguacucuguaucuuucacgaauccagauuuaccuagugaaagccugccuagccauaaaaacaccaaauucaggauagugauuacuuuccugggagcaaauggcaccaggagggggcaggcugggagcuccagcugugucauuuuuauuuauuaaaccacagcuggggcugggcaugguggcuuaugccuguaaucccaacacuuugagaggcugagguggguggaucaccugaggucaggaguucaagaccaaccuggccaaaauggugaaaccccugucucuacuaaaaauacaaagauuugccgggugugguugcacgugccuauaaucccagcuacucgggaggcugaggcacgagaaucgcuugaacccgggagacaagguugcagugagccgagauggcaccacugcgcuccagccuaggcaacaaaagugaaacucugucucagaaacaaacaaacaaaacauagcuggagcaaacguggcaaaguauuaaggauggagugcugggugcaugaguauuugcuguuauuucuuuguauauacauaaauuauuuuauaauauaaaguuucaaccugccaugcauuuguaacauuuucagaugaauuugcauacauacguuuugaaccagcgugugugauagagacugguuucuuuagucaggagucugugcuuggugcacuaagaguuucagucccccucaguuacugcgagggucuccucaggagucucagcccacaggcagcuaggaucaggaugcacccccuuuuaaggauagggggauuaugaaguguccagagagugguggcacagaaguggagacacuaggguguccagauguggguccuggcuuaggggagaggauuuauaaaguaaaauggcugcagagauucugaaucaagcgcagguuggaagcauagugcuuuguugguacaucagagacacugccuccagggacaucagaggugacuucuguugaguucugcugacugcacaggagacacugucauacccacaaagaauagcaggggacauuucugccagaaacaccacuaagacauuaguaaaaaugauuguaacccagcuacucaggaggccgagaugggaggaucacuugagucuaggaguucaagaccagccugggcaauguagggagacaucaucucuaaaaaauaagacaaauuagccaggcauuugggcugcaccuguacauagucucagcuacucaggaaguuaaggcaggaggauuccuggagcccaggaagauggaggcugcaaugagcuaugauggcaccacugcacuccagccugggugacagcaagaccccgccucuuaaaaacaaacaaacaaacagaaagauuguaagacagcaaaugucaacuugaguuaguaguugaaaaaauaggcuuggcgggguggcucaugccuguaaucccagcacuuugggaggccgaggcaggcggaucacgagaucaggaguucaagaccagccugaucaacauugugaaaccccgucucuuuuuguauuuguagaaauacaaaaaugagccaggcaugguggcgggugcuuguaaucccagcuacucgggaggcugaggcaggagaaucacuugaaccugggaggcagagguugcaggaaaaaaaaaaagaaaagaaaaaaaauaggcaagcgggaguucaaagggugggaacaaaucagugacgcgugaacagacugauuuaugagggcagggggcagaguccagcagcugcucaaaggccuuuaugcuucugucgaaacaaguacgucacaugcagagcucuaggccuuccugugucauccgaaaggauggggugaaggccuggguuaccaagggggcacaagucgcccacagguccgggaugaggaggccuuggcccacugugggagcggguggugcggaaagcccaugagggcucucgaacauuccccagcgccugacagcggccagcuggggacaucucccagccguggcucagccuucaacaagucaaaaagccagcaucacccacagcgucauccccagaucuauucuagguucugagguucuaggugggacuuucaaaagcagaagaaacgaugcuaaaaccgaaaggaauuugccauuagggagaaaugcuuuauuuucaccagaugacaaacuucaggguuucugaucaaaguugcugcaauuucuucuuucuccuucaggccugauucugcuccccuccccuguccucccauccuucuugccacaacgggggaagcccugaaaaaccccgguguuuucauaggcuguguggagcccaaggaaggggagggaaaggaaguggggcucauuuaccaccauucaguuccugaucggguuccccaagaagcagcugggacucuccaacccaaccucacuuccccggggucccugucauuaggcagauggcacucccauggcugucccugccauguucccucagaccccuccuugcugccucaguuucucagcccuccacccuucccugccuccugccucucccugucugcccuucucgggacccaggcuccuucugucuguccacaagcaugcucaggucuccccaucuuaaaaacaaggucuggacccccugaauaaccucuuucuugcauuucacaaacaugcgcuuuuggaaagcaguuuaugcucuugaauugacucacugcucccacuuccuccugcugccauccagggucugccuguucccccuccagccuccccgucagucgagccugcccuuggccaggcccuguggcagcuuaaggugaagugguccagccugucagccgcacuggacacccugacugucuccugcccggggccucucuccccugcagucuuugaggccuugaccacugaggggacugcucuuugaccuccucccuacucuuaguuuuuuuuuugucuuuuuguuuuuuuuuaaauaacagcuuuauugagguauaauucacauuuucugugcuguccccaucucgaaguguaccacauucagaguugcgcagugaccccacaguccacuguagaccuuuuccaucccagaaggaaccccgugccucuuaguggucacccuccaauuccccgccacgcccuccaggcccaggcaucaugaaucuguguugggccucugauuugccuucauuuucaccuucucugucaacccauggucugcagccuuugcucugcucuguaucccagggaccucucucacagcacaggucugcauuucagcugugccaaugcucccccgaagcucuccgcacccuuacccuggacagcggccucuuccuggcugguccacaccccagcccgaccuucugcugcccuccccagcuccgggcuccugcagcaccuucucuccucacccccucccucacugcuccuaaguccacaugcagguucacaccuccucaugcuucccacgccuccaugcacuuuucacaccuccacacaucacaucuccucacaccuccacacacacuucacaccuccucacgccucccacucacaccuucucacgccucccacaucuccacacgcuuuucacaccuccuguuaugguuuggcugcauccccaugcaaaucucaacuugaauuguaucucccagaauuuccaaguguugugggagggacccacagggagguaauugaaucaugggggcuggucuuucccaugcuauucuugugauggugaauaagucucacaagaucugauggguuuaucagggguuucugcuuuugcuuccuccucauuuuuuuucucuugccgccgccauguaagaaaugccuuuugccuccugccaugacucugaggccuccccagccauguggaauuguuaaguccaauuaaaccucuuuuucuuccuagucucggguaugucuuuaucagcagugugaaaauggacuaauacaguaaauuaguaccaggagugggguguugcugaaaagauacccaaaaaugugaagcaacuuuggaacuggguaacagacagagauuacaacaguuggagggcucagaagaagacaggaaaaugugggaaaguuuggaacuuucuagagacuuauugaauggcuuugcccaaaaugcugauagugauauggucaauaaaauccaggcugagguggucucagauagagaugaggaacuuuuugggaacuggagcaaaggugacucugguuauguuuuagcaaagagauugguggcauuuuacccuugcccuagagauuuguggaacacugaacuucagagagaugauuuaggguaucuggcagaagaaauuucugagcagcaaagcauuuagaggugacuucaguacucuuaaaggcauucaguuuuaaaagggaaacagaacauaaaaauucagaaaauuugcagccugacuauacaauagaaaggaaaaacccauuuucugggaagaaauucaagcacgcuacagaaauguguauaaguagcaaagagccuaacguuaauccccaaguccauggggaaaauguccccaggccaugucagagaccuucauggcagcccuucccaucauaagccuuaagucccuuuugugggcugggcccaggguccccaugcugugugcagccuagggacuucgugcccugugucccagcugcuccagccauggcugaaaggggccaacguagagcucgggcuguggcuucagaggguggaagccccaagccuuggcagcuuccauguguuauugagccugcaggugcacagaagucaaggucugagguuugggaaccuccgccuagauuccagaagauguauggaaaugccuggaugcccaggcaaaaguuugcuguggggguggggcccucauggagaagcucugcuagggcagugcagaagggaaauguggggucggagcccccacacagagucccuacuggggcacugucuagcggagcugugagaagagggccacuguccuccagaccucagaaugguauauccaccgacagcuugcacugcgcuccuggaaaagccacagacacucaacaccagcccgugaaagcagccgggagagaggcuguacccugcaaagccacagggguggagcugcccaagaccaugggaacccaccucuugcaucacugugaccuggaugugagacuuggagucaaaggagaucauauuggagcuuuaaacuuugacugaccugcuggauuucagacuugcaugggcccuguaaccacuuuguuuuggccacuuucucccacuuggaacggcuguauuuacccaaugccuguaucuccauuguaucuaggaaguaacuagcuugcuuucgauuuuacaggcucauaggcagaagggacuugccuuaucacagaugaaacuuuggacuguggacuuuuggguuaaugcugaaaugaguuaagacuuuuggggacuguugggaaggcaugauugguuuugaaaugugaggacgugagauuaggaggggccagggauggaaugauaugguuuggcugugucccccuccaaaucucaacuugaauuguaucucccggaauucccauguguugugggagggaccugggaggaaguaauugaaucacgggggccggucuuucuuguacuauucuugugauagugaauaagucucaggagaucugauggguuuaucagggguuuccgcuuuugcuucuuccucauuuuuuucucuugcugcugccauguaagaagugccuuucgccacccacugugauucugaggcuuccccagccauguggaacuguaaguccaauuaaacuucuuuuucuucccagucucagauaugucuucaucagcagcaugaaaacagacuaauauaccuccucauaccucccaugccuccacacuuuucacacuuccucacaccucccauacugccucacacuucccacaccucccauaccucgacacacuuuucacaucuccucccaucuccucccaccucccacaccuccccaugcuuucaacaccucucauaccuccucacaccucccaugccuccucacacuuuucagcaccuccucacagcccccaugccucuccacaccuccccaugccuccccacaccucucacacuuccuacaccuccucacaccacuggugcuuauuacugacaugucugucugccuguguauuucucugggacaggcccagcuucuccuccuuuuuacaauucuuggguccaacccagggucugaugcagacucagugcugaguaucaguugaccugacuugaacaccaccaauuggaaagccaggaugauguaaauuuucaucuggccucauuuguuccuuagccucucauaggggucacaccucccucuuuuucauucuuguacaucuggggacacugagcaggaggugcccgugcugucaaagcaccagagaguaugacagcagaauucacgucugccuccccacaggagccgucgccccucccagcugaguuccugccaaggucagugggagccagugcagacuggcagaaaugggcagccggauaugagagcccagccggccagagagccagggugagccaggagcuuuagcucaaguuccggacacccaccagucuuuagcaaagucucucagaacacagaggggagugggugggagaguuuagauuuuuguuuuugaaaacuugguuuaugcccuuuaauuaaugagggcaaaaguuguacugaaauuauaugugcguuuguugauauuaucuauauaauaaguuauauagauaauguaaguacauauauauauaauuucaguuucacaugccaggaauucaaacacaacuuuaaagaacuuaaguuuaggaauuaacuugaaggauuaaggaagaguuucucagcacagcuugaauagugcccagaugaauucaagagagagagagagagagagagagagagagagagauggauggaguuuugcucuuguugcccaggcuggagugcaauggugugaucucaguucacugcaaccuuugccucccggguucaagcaauucugcugccucagccucccaaguagcugggauuccaggugccugccaccacacccagcuaauuuuuauaguuuuagaggagacaggguuucaccauguuggccagguuggucuugaacuccugaccucaggcaauccgccugccucagccucugaaagugcugggauuacaggcgugagccacugcacccagccugaauucaagauauauugccacaaauuauaagaaguggauagagcuuuucaaaaccauggucaaggcuuuuauuuugauguuugcaccauggcuuugagcuugggaggaugaaaaugacugauuuaacaucagauugugccuugauaugugaugacuuuuucccuccaggcagggagguggcccuagugaugaaaugaguaaggguuugugaguuauccgcaucuuggcuggcguaagucauccuucccuuucagggcuagaauggugaacuccagggcccucuuguacucagugcauugcuugaucuguguucauguucaugggguaagggcuggggagcaucuuaaaguugcuguugcuucuccuuuguuguuguuaucguuacucuuauuaaggcugcagugaaccuucuguucauacuugguuccauagcgcagugcuucccaaacucuauucccgggaacacucauuaggaagacuguaauuggucaaauagauuuggaaaaccgcuguauaccguauguuucucuugaagauugacaauauauuugccuuugaaaggcucugacaauuccugcagggggaaaaaguuuuccuagcaguuucuaaauuugaucacgugacauuuauuuucgguaauauuucuuaccaauuuccaguucugcuggaacaccuugagaaggccugccucagaauaaauucuuacaaguggaauuguuggggcaaagcauaugaacauuuauguaugguggccaggagcgcugcaauacagccacuucguguguuggguaagaguaauccaggcgugcuggacuggguuaccuaccgcuugguaaaccccacuaagugggcaaaauaucaaaacagauuuuuauauugaacgggucaaacauuuuuuaaaaaauucuguaguuucuucuucucacuuuggcauuugugaagaagccucaguuauuaaaagcaagaucccucaggacuguuuaacagaaaggcauuguucuguguugugugaaaucaguagcauauuuuguaauggaacuuuggagucauguauuaaucuauuucuuguuucuaagagagguuguuugguaacguuucuuuuuacggaugucagagaaauaccaaaggugacgugucuugccuaaaaucccgugguggguugucagauaaaguggaaccaggacuccuuuaaagaagggucacuguacugagccaucuauugugccguuaccagagaaaaauauuuuaauguauauuaaauauauacauuauauauauuuauauauacauauauauauuuauauauauacauuauauauauuuauauauauacagguguaaaucccugccuccuaccuacuugcaaaaaggauuuaugacagagagaaaacucauagcagaaccaaauaauucuucuagaagguuggaagccucaccuaugaagcucggaggagguuauaaaagggaagaggugcuuacuuagaaaucuuuaggaauggccgggcacaguggcuaacgccuguaaucccagcacuuugggaggccgagguggguggggcacuugaggucaggcgugagccauugugccuggccgucauaagaucauuaucuuaugguucuuuuuuuaagagcugaggccucacacuauauuggugaggguggucuugaacuccugggcccaagcgauccucccauuucagccuccucccugagaagcagcggagaguagaugugacugggggauucaugagggagaggaggaccaggcggguaugcacguugagcaccgggguucaggagcuucagggggcugugggaggaaaggccccgaggccgaggguagguuuaggaacuccauggagagcaguuugcuugcaaguggggaaugugagucuucuuuccccgccccggcuucauugaaguauaauugacaaagacggaauauauucaaagugugcaccgugauguuuugauaauacauguacauaaggaaugauucccacaaucaagcuaguuaacaacauauccaucaccucacacaguugcccacccuuguuuuguggugagaacacuuaagaucucucuuagcaaauuucgaguaaacaauacauuguuacugacuguagucaccacgcuguaggagagcuccccaggacuuacucaacguggcuggaggacacuacgcuaagugaaauaagccagucacagaaagacaaauagaucccgcuuauauguggaauccaaacaaguuagaacucauagaaacagagaguacagugguacaguggugguugucaggggcugggggaugaggggugcggcaggagaauggagagauguuggucaaagaguccagacuugccggaaugggcgucuucagaugcuugacagauuguuucugaaaagcuguccucucuccuccagucuuccacacccuuucuuuccuucucccaguacuguauugcaacccuguuaaacaccagggauccaugugcucauguguaacugcuccacaggcuacccuaguccccagagaccccccacugagauccccaugagccugagccccugcuugaaucuccagcacgugcuguagcaguagcagccuccuugucuggggcguggaagcaugcguggacaccuaccuucugccuccucuucaccuucucgaaggcucugccaggcucucugccauccagugugugugggcaauccagcaauugugaagacuuagaaaagagcuugagaaaugccagucugcaauauuucuguuucagaaaacaguccaauuugauacuucuuuuguccaaagauguuuuguuauuuuaaauguacugcaaaguuugaggccuggguaggcagacacuuacuaauuuggugccagcaaaaauucuaauaaagagaguggacuguuuguuuaucuuaaauaagaaucuuaaggccgggugugguggcucacaccuguaaucccagcacuuugggaggcugaggugggcagaucaccugaggucaggaguucgagaccagccuggccaacauggugaaaccccaucucuacuaaaaauacaaaaauuaacuggguguggugacaccuguaaucccagcuacuugggaggcugaggcaggaaaaucacuugaacccgggaggcagagguugcagugagccgagauggcgccauugcacuccagcucgggcaacaagagugaaauucugucucgaaaaaaaaaaaaaaaaagaaucugaacagaaguacuuggccaugguagacuaguaauacauuuaguuuuguuuucuuuuuuaaccauguucgaauuccuuuacuauuaaaacuguaugugcaacauaagaaauguuuggcauaacaaacguggacauuucaauuauaaaaaacgugcccagcgcugggggaugaaggggcagaggaauucccagugaugguaucagucugguucugucaacauauuggaccccaaccugccaugcuuuucugucguugcaggugauuuucaaagccaagucaaaauauucuccagaauuacucaaauaccgguaaguacugcagggcaucucuuucugugguagaaggggaaagugccgacacaugaaucucaucucuccauugggguuugcacacaucgcuguucugugagccgccggaaacaguccugccugcuggcuggcugcccacauugugcacaucaugugcauugccgguaagggucaggucaucagaucaugacuucaugaaucauggggacuugcaucauacuuacccaguucagaaacaagagccuggugccuuuccuaacaggaggaaauacaugggaauaaaauagguguauguugccucuaaaccuuccugaggcacuugagaagagccucagcagaaggaaacaggguuccuugaagaugcagugcuuugccaggugcuuccccuuccccaucccgcaccucccaugcucccacugcaggugcaggugcaggugcaggugcaggugcaggugcagguacagguacagguacaggugcaggugcaggugcaggugcagcuguggcagggccucgccccugcagccugccaccugguggccuuacccgccuugucucagcugcugguaggcuccggcuccuuguuuuccagaacuucagugcccauugaacccuaaguugcuacacagcugcuugcaggguauccauccacauccagaaauacuguucugaccauucagugcucauuuaggcaccaggaggaagaauguguuauagcugagaaguggacacucuauauuuguaacaauggcuuaacacaaaggcuugcagaaucaggcagagcaggaugugcaacaugccaaaaacauggacaccgggaggcauggacauuuuguggaagagaggcuugugccagaguguaaucuggaagggaaccucuuaaguuaugugaggagggggaucugcauuuuccuauggagggguucguagcucuccccagaggggagaggccuaugacuuuccuaaggccaagaaccaguggcuuaaagaauacucagguuuggcugggcacgguggcucacgccuguaaucccagcacuuugggaggccgaggugggcugaucacuugaggucaggaguucgagaccagccuggccaacauagugaaacccugucucuacuaaaaauacaaaaauuagccgggcgagguagcgcacaucuguugucucagcuacuuaggaggcugaggugggagaaucacuugagcucaggaggcagagguugcaguaagccaagauugcaccacugugcugcagccugggcaacagagugagaauccaucucaaaaaaaaaaaaaaaaaaaaaaaaagaauggucagguuugacugggguugggggaggagaacaggccucuggaagaggcgcgggggugcagugugaguccagggguucuggcguuucugcccgggagaacuccauugccaacggcaaacauuucugaaaaggugacucuggccauugccuccuugggucaaaaugaaaaauuauuuugucauuuuuuaaaauauguuaaaucguauacauauuuuauuuaaauauauaucaucuaaaaauauguaaagacuuuuuacuuaaaauucugaagguguaauaguuuaauccugaguuuauauccaaggaaaccaguucagaagguuucucucaaguucagaaaguucugugaaggugccugggccaagauacaagucccaagacucaccgucccggguuuuguuuuguuuuucaccugaucuugcugucucccuucacugcuuuguacguggcucaguucacgucucuaccaggcucagguggaacuucagcguccacugugaaaugauguuggucccaaggagagcaauuuaaaguacagguugagugucccuaaucugaaaugcuugggaccaaaaauauuucagauuucagauuuuuuuggauuuugaaauauuugcauauacaggccgggcacgguggcucacuccuguaaucccagaacuuugggaggccgaagcagguaggucauuugaggucaggaguuugagaccagucuggccaacauggugaaaccccguuucuacuaaaaauacagaaauuagcugugcgugguugcaggugccuguaaucccagcuacucaggaggcugaguugggagaaucgcuuaagccuaagggguggagauugcaguguguggagaucaugccacugcacuccagccugggcaacacagcgacucugucucaaaaaaaaaaaaaaaaggaaaaagauauuuuuguauacauaaugagagauggggggauuggaugggacacaaaucuaacacgaaauguauuuauguuucagauacaccuuauacacauauccugaaggcaacuuuauacaacauuuuaaauaacucagcauaaaacaguuguaacuguguuuugacugcaauccaucacaugaagucagguguggaauucuccaguuguggcaucagguugauugaugcucagaaaguuucagauuuuggagcauuucggauuuugaauuuuuggguuagggauggucaaccuguauaaaguacaaguagacaguucccucucuucuccaguaacaagauaguagccucuccucugcaucuauagucuuugcccugcauccccccagccagaaauguaggucaaagcaugagugaagaugggcauaggaggagaacauucugucugaucggaccguggaacugauuuuaucuuggaagcaguugaggcugggguaauuagaugucuucuagagguggaauauaaaagcacuggucagaaaggaaauuguuuaaaaagcuuucaaccucugagcacggggacuggggucuucgggugagaagauaugugcguggggcaguccuugcuugauccuugagccaaaguauaccucaaagacaggcugcgcugacauguauggcugcauuuuauugggaagggauucacagaaaugaagggagaagauggggagaaauaaauuuggauccagauguuaaaagugagauguuugggacugggcgcgguggcucaugccuguaaucccagcacuuugggaggccgaggcaggcagaucaccugagaucaggaguuugagaccauccuggccaacauggugaaaucccacuaaaaauacaaaaauuagccaggcaugauggcgcaugccuguaaucccagcuacuugggaggcugaggcaggagaaucacuugaacccaggagguugagguugcagugagccgagauugugccauugcacuccagccugggcaacaagaacaaaaacuccaucucaaaaaaaaaaaaaaaaagugagauguuuaggccagugaaguuggagaguuccuugaaacaggagggugagguuucaaugggacaugccuguuaacccaguccuagugauuuuguugccaaauauaaagaaauacuaggaguuauuccuguguaggcacaucuuuagucucaucuauagaauuccucaguucucuuaaaccagaugccacuagagacauuucaggccacaaucucucccuugagaugcuuugguauguuggcuucuaaauagauuggcuucccucauuuaaucauaacucacuugaaauaaaacaugagccauuagucuagaacuaguugaaacuuuccacuccaaucuauuccuguaguaauucacugguuuugaagauaauuuauauuuaacucagccaagaaccacuuuauuuuucacuuaaaaucaccucuacccucccacaucugcuagcucagaguuuugcuggaguggaaggcaauuuaauucaggcuuucucuuucucagucuauguauuuuaauuuauuugguuuaagaaaugugaacauuuggcaugggaguaaucauuuccaacuguuugcccucuagcuuugugauuuuuuuaaauaaguaaaaaauacagugagccagguuuuccuuuuuuuuuuuuuuuaagagacaaggucucacccaggcuggagugcaguggcgguggugcaaucauagcucacuauagcuuuaaucuccugggcucaagcgauccuccugccucugcuuccugaguagcugggaauacaggugcaugucaccacauccagcuaauuaaaaaaaaauuuuuuuuuuuuagagacagguucuugcuauguugcccaggcuggucuugaauuccuggacucaagcgacucucccgccucagccucccagagugcugggauuacagguacacgccaccaugccuggcaugcuuuucccuuucuuuaagugaaaaagcagcggcucauguuuguaaucccagcacuuugggaggcugaggugggagcaucacuugagcccaggaguucaagaccagccgugacaacagagcaagaucccaucucuacaaaauaaaaaaaucagcugggcguaguggugcgcgccuguauucccagcuacuuggaaugcugaggugagagacucgcuugagccuaggagguugaagcugcagugagcugugauugcacuccugcucuccagccugggugacagagcaagacccugucucaaaaaaaaaaaaaaagaagaaagaaaaggaugaaaggaagggagggagggaaagagagagagagaaaggaagaaacgaaggaagggaaagagagaaagacagguagggaaagagagagagagagagaggaaggagggagggagggaaggaggaagaaaggaaggaaggaaucgaugguauugggagauaaauuuaaacaaugcuuuaccccuugcuucuguccucucacaguaggaggugucgggcacuguuguguuggcugccuugaagacucgccucaucccugcauuugcugaccagcagcacugauccuucuggucccacaagcaauguggucuucccagaugcugggucacacugauuguuuuauuucuuugggucauuucugucaucaugccaggaugagcuauuuauccuggcccuaugguuuagguuaaaaggcaguaguauugggggcaguguacaaaauucuuucuguggaaacauacuuuuuugauacaguuuauucuggccuccuuugaaaacucucucgccacaccuccagaucgcucccuuucuaccacagcugcaggcauagagggaaaaaaacuuguuuugcaagaugguuuugcauuauaaaagugauaacaaggauauuaggaaaaaaauuauacaauagaaaaagauagacauuuugugaauauagacauguggaaagaaagcaagcaaguccacugaacuuucccuccucccagcauaaaccccccuccagcccuaaggaaauacaaugauguauuccauuauagguuuuuauacagauuucccaagacaaaguugaugucuauauugcauuuccaauuuugcauccugacuuuuuaacuugauguuaggucacacauauuuuuccauauuguuuuaaaucucccaacacagccuccuuuccuaagauaauaacaggcuuuuguugaguagacuaaacaaagccuccuaaaggcucugagaauaggauuugauagauaaaaaucaagaaggaggaagguuccaggcagaaaagucagcuugcagaaagacaggagguggagacaccuggccauguuuaaaacauggaguugaccagcuugaugagcacguagccuguccauagauugagcugccucuugagugcuggguucuggaagaugcgggguggggcuuuagggcaaagaugaauuaggaaacuacauuaguucuggucagaggcaugagacugugugaggcuggcacaggaggcauggauagagugggaaugaagaaucuacugaccuugacaauggauuauauaggggguggauggaaucaaagaagaacauuacaguuagagucuaugaaaagcuauggcaccuuuaacagaaauaggaacacuuagaggcgugcuagaagagggacacuggggcugggugcaguggcaugcacuuguaguucuagcuacucaggaggcugaagugggagaaucgcucgagcccaggaguucaaggcugcagugagcuaggauugcaucacuguacuccagccugggugacagagcaagaccccaacucagaaaaaaaggacauugggaauugaguuugggacaugcuggcuugagggggcagggccuccgaauggcaggcuguuagggaaaugagucuggaacucagaucaaaggcauggcuugagacgaaagauguuugaacucagucauacaaaagucaugauugaagcuacagaaacaagcauauuuucugaggaagaguguaggccaggugcaguggcucucagcuguaaucccagcacuuugggaggccgagacgggaggaucacuugaggucaggaguucgaggcugcagugagccaugauugugccacugcauuccaaccugggugacacagggagaugcugucucuuaaaaaauacagaaaaucauaagagaaaacaaauuuucuacuuauuaaguggaagugggugaucaucaaggucuucauccucauuguguucaugcugaguaaguggaggaggagaggggagaggaagguuuugcugugucaaggguggcaguggaggaaaauccguacauaaguggccccgcacaguucaaaccuguauugcucaagggucaacuguauuucagacagcacccacgaggaaucaucuggaaaauguaaguggccagacagugcguuccccagaggcugcugcauggaguguguguacacgcggguucuggauguuuccaucuagcgcucuucacaaaagcacagcggauaaaacaauaaaagcagggcuuuugagaaucuggaauacagauuuuugguaacucccaagcggcccugccuuugucucucuccacagcuccuuuggcccauaccccccuccccugauucccccaucacugagagaacauggggcagagcacaugaaaaccguaauaccucccuguaagccaggggcugcccucaaagcuccacaggcauuauuucccucgcccacuccauggccucaagagacugacacggaacaccuccagcccuagacaggaggaagcagcggggcuugcuugguuaggugacuggcugaagguugcaugcaaauuucaguuuccugauucugaccuacaccaagggcuuuacaacagguuccaggaagagaagaaacacucccauguugaaugcacaguguuccauagugcaagaugaucccgaccguggaaacaugaaaacaugaagcaaagagugugucauagaauugaaggauaggcacuuagugggagcccggcauggcauuuugaggcuggggaugugggaggguggggcugccccucucaugcccacagucugguggggaagagguuggaggugcggagggaacagcagggccugugacaugagagagugaggggccuugcucagcgaucagggccuggaaaagaaucuguccauggcaaaucauuaacguuucuguuugaaaagcucugaguguaucaugacacaugaggucgaaucccuaagacuucacagcgcucuccaucaucacacagcucuugggggguggggggcacuguucccaucccacugcagccaugcugggguggcggguccccuccugcauguccgacucgcucaucucuccgaugcaaguacuuugucccuccuccagggcacacacguuccuuacuguggcaccuuccugcccccugagcugcuugggggcccgggcugccucaucuucaucccacucucucagcacgagccugaugagcagccagcccccagcacagggcugugcagggagaagccugcaguccuuuccgccuccccagaaaguuguuuaauuccccugugacgggucguuuucccacuagccaggggaagaucuagcagcuacugugcuuagagcauucauaggaaauaaaagggcagcccuugauagcugacgucaugcuuuuuggacugacuccuuccuucuucccucccucccucuuaaaccuucuucguggagacccugccaccuacaguguggauggagagaguggaaauggagagucucauuuuccacgggacuuucugucuagggagacgcaggcauugaucagauggucacccgucuguuuuguuauaaacugugauaagucugugaaguuaaaauaugagggaccaggagagcagaugucagagaaaccugacugccuguguacccauggugugugugcgugugaggagguacagggagggucagggguguguuugcugcagugcuguuugagcuaagaucuagaggaugagcaggagccggguagacaaaguucuuugguagaacuggguucugaaaguuaugugagagauuuuugccaguggguaaauuauuaauuacaagacauaaaaugccauucggauuagccugaguaagugggggguuguuaugucacacuggaaucugagggcaggaaauaaaacugcagcugggcauggaccugggugggcuggaaccaaggucucuuugggccauauccccugccccucucugucucuuuuucucugucugccucuuucucucucuacccccucccucucccuacccaccgacuuaucaucaguggcaugucuagagcugggacuagaaucccaguuuccauguccuagucuuuccauagauuuuacacaggucacuuaggaaguguguagcucugagaaacuacagguuaaaaauggccagugaaguagaguuuugcaucuguugauccuuggguaguugcuguggcaguuuuuuguuuuuguuuuuguuuuuuuuugagacuugagccucgcucugugccccaggcuggagugcaguggcgcgaucucggcucacugcaaccuccaccucccgguucaagugauucuccugccucagccuccugaguagcugggauuacaagugcgugccaccacacccagcuaauuuuuguaucuuuaguagagacgggguuucaccauguuggccaggcuggucuugaacuccugaccucaagcuauccaccugccuuggccucccaaaggaccgagauuacaggggugagccacugcacccggccuguggcagauuuuuaaucacauaagugagcgcucucuggacuccacaucaauaaugacuuuuggggguaaaaugcauuauacaaauucauuaucucaccuaauccccacaaaagaccuauacauaagguagguauuauguagucuuauuuucaagugauggaaccaaggcucaagagguugcauuuugucuaaguuaauucuaacaauguggaguugucagaaugccuauaaaacgccaucccgagcugugcucuccacucuucgcugugaguagggagcgcucagcgaguguccacgccagccaacgagugugagcucucaguccucacaacaucccacagauggggaaagugggguucagagagguaaaggaccauccagaggcauaauuuggggucaguuuguaauuugaaucugggaacgucuauugccagaguccaagcucuuaaaugucaccuuuggugugucugcuucuagcaguucaccaaaacacaucucaguguccuucuagacugaccugggaugugcagcugacaaguugcucucaugccuuccagguugccccucuaccuggccucccucuucaucagccuuguuuuccuguuggugaauuuaaccugugcugugcugguaaagacgggaaauugggagaggaagguuaucgucucugugcgaguggccauuaaugacacgcucuucgugcugugugccgucucucucuccaucugucucuacaaaaucucuaagauguccuuagccaacauuuacuuggaguccaagguagguggaaauguggucaagaucccucccaugaaacguguucuaaaaagaguuuccugguuugcaaaaguacauuuugaugaauuuuagacuugauuuugccuugacuuucuccguuuuauugucucccacacaggggcuacucgagguuuuuuuuuuuuuuuuuuuuuuuuuuuuuugagacggagucucacucugucucccaggcuggagugcaguggggugaucucggcucacugcaagcuccgccucccagguucacgccauucuccugccucagccuccugaguagcugggacuacaggcacccaccacuacgccuggcuaauuuuuuguauuuuuaguagagacgggguuucacuguguuagccaggauggucucaaucuccugaccuugugauccaccugccucggccucccaaaguacugggauuacaggugugagccaccgcgcccgcacuacucaaggcuuuuaacaacagaacugugguuuuuaauaggaaggguugaaucauagguugucagaauaccacugagcucaccccuauggcacacaagcuaacaaagcacuacuggcaaaagaaaauaauaucuuagguuuaguuaaugacugucuaauacaguacucaaaagucaguuuuaguuuuuuggucauguuaacuauccauuuugagccaggggucuuuuaacugucuuuggaaauugauagcuucauaacguggggcacaaaucacugauuuccagguaauuccgaguccaaagucacauuagggcuccuguauucccggccucaaagauuccagacagagccguccugagcucugccccagccauugucccucugagauuguuuacuugccuccuugagccagaggcccuggccccgggcucaccugcugcguguggaagccaagaagauccucuuggagcugagcaguggccaucagagauuuagcaaagcagccaucugacuuucuugcucguacacucuaggccacgggaaaauggugcauauuuuaacccuguuaaaggcaucuccaaaccaagucccaggguccauaugaagacacuugaaauuguaggaagaaggagugugaaaaggacucugauggaagacccaacaagaucacagugcucugagaucccaaagggcuuuaccagacugauagcaggugggggcuggggaaggggcuggugucuuggaccuggagugucccauaccuucugcucccucuuuuccagggcuccuccgugugucaagugacugccaucggugucaccgugauacugcuuuacaccucucgggccugcuacaaccuguucauccugucauuuucucagaacaagagcguccauuccuuugauuaugacugguacaauguaucagaccaggucagugggggcgcugaggaggugucaccugaccagggacucuugguauccucgaggcauugguuccaggaccccagaaaauaccaaaaucuggaugcucaagucccugauauaaaaugguguaguaucugcauauaaccuacacgcauccuucuguauacuuuaaauuaaucucuagaugauuuacaauaccaaauacaacacaaaugcuauguaaacaguuguuauacuacauuguuugaaaauuucuauuuuuaauuguuauuaguauuuuuuauuuucaaauauuuuugauccguggaugguugagucugcagauguggaacccgcugauauggagggccgacuguuugcauuucagugguucacaugggagacaaguccaugguccuuguuucugcuggugaaugacugagugaccuugagaggucacuucccuguguggcaucugaacucaucugucagaugggaucacagcaccugccuuguucccuuuugagaaaaccaggagauuacauauuuguguguauguauccacauacauguguacacacauacuuugcacuccauucucccucuuagggcuuuuauuaagcaguacuuaauuuuuuuuuuuuuuuuuugagacggaguuucacucuuguugcccaggcuggagugcaauggcgcgaccugccucccagguucaagcaauucuccugcgucagccuccagaguagcugggauaacaggcacccacuaccauaccuggcuaauuuuuuguauuuuuaguagagaugggguuucaccauguuggccaggcuggucucgaacuccuaccucaggugauccaccugccucggccucccacagugcuaggauuacaggcguaagccacugugccagccaguacuuaauuuuuuuaacaugcuuccauauaaauguaagaugauauuauuaaagggugacauuugcagauaguaagcaaauuguauucagacuuuagaaaauacauaggacuaugaaguuaugagaauguuuuuguuuuuuuugucauccucagggagugaauuuuuuuuaauggagcacguacacagcauuugagaaaaucuagacaaaagugacugaggauauuaaaguuuuauaaaagcucauggcacuaguuguugcaauaugauacucuuuuuaaaaauacauucuauaaauguauaaguuacgagucauaaagcaaaugaacaaagguagugaaaugucaucugccauccaugcucacaaaaacucaaagcaacaaugagaaugaaccaccauucacucauuugacaaacagcauuuuuuuuuuuuccucaucuugggcacugugcaaagugccagggauacaaaaccgaacagacucauucccugcccuuugggagcuuuaugguccacuaaggaaaagagacacacagauuagccauuaacaauaaagaaauguaacuucucuauuauacauuuauuagauugauuggcaaauguuccuuagcuuuucuuggaaaaguauugaauaccuaaccaucuauaaaucuucuaacaucucaauagugcucaaacccugagcuggauuuagacaguggaagaaagaauaaaaugaucaugauaagcuaaaccugugaggacaagguaaaauuguguuguaauuagaaaggauuaaaaccacaucucugaacccaaaccaacaccacaaacacaggauggcagaaagcugggcaaggcacugcuaagggcgugcacuauuuugaggaaaucaaguauaugaaaaucuaaacuuuaaacaaugauuaauuagagacaaucauaauacacaaaggauuugauuuuguauuguaguaaaauacacauaauauuugcuauuuuuuuuuuuuuuuuuugagacggagucucucucugucaccaggcuggagugcagccgcacaaucuuggcucacugcaaccuccgccucccggguucaagcgauucuucugccucagccuccugaguagcugggaauacaggcaagcgccaccaugccggcuaauuuuuuuguauuuuuaguagagacggguuucaucauauaggccaggcuggucuugaacuccugaccucaugauccgcccaccucggccucccaaagugcugggauuauaggcgucagccaccguuggcuggcccuauuuuaaccauuuuuaaguguacaguucacugguauuaaguacacucaguguugugcagccaucaucaccauccaucucuagaauuuuuucaucuuccuaaacugaaacucuguauccauuaaauaacaaagauuuggguuuaacaaaguuacuucaguuuuucuucaaguaagaaugcaugggugcucugccuauaaacucuauauauggaggaguggccauucuuucuuuacuuuccuaaucuugcuuucacuuaaaaacaacaaaaaaaauuuaugggugggugcaguggccuguaaucccagcauuuugggaggaucacuugaggccagaaguuugagaccagcccuggcaacauagcaagaccucaucucuacaaaaaauaaaaaauuaaaauuaaaaaauaacccaggcauguuggcacacaccuguaguccuagcugcuuggagggaucacuugagcccaggagcugaaggcugcagugaggugugaucgcaccacugcacuccauccugggugacagagcaagacccugucucaaacaaacaaacaaaaaauauauauauaaaauuuauaauugcaguggauuuaaaauaugacaaucuuuaaaauucuucuauuuuuaugggauauuuaugguuaucuagauguguguugccaccaaaauaaucuaggagcaagcaaaacaaaugaccacaguuguaugacuuacuugugcggaaucaaaaaagaacacaugauggagaugugauauagaggaaguaagagagugaucuuucugaaagaagcaugcguaguuuuggucaccaugcuuuaaguaugauguuauagagaaggcaaaaggguuaaguuuagguguuugggccuuuacgauugcccaaacccaaccaugugcuuuccucaggaaccuucugucuguucugaagagagaacacugcuccaccaagcucucuggccaucucacugggccucauaccaaacaccuuaggcucuguggauuguuuuucuagacaagcuagccuacaguacgcuuuaaaggguaaacaacaggauaugguuuaugugaagaaacauuugaaaguugaccucuuuauccuagggaugagacuaagggauaauaguuguaugcugcucccaagaauuuaggaggaggcaacauaaccuucucacuauucaauuguugaagaaaaucagcuuagauuuaagugagaguguuaauuuggacuuaagaguuuugggggcaugaaauauuaaaacaucagagguuagaaguuucugucuuugaauauuuugaagaagaagauaaucauuuaucucauaugguuuaaaaaauccguaucugaggucuagaccauuacuauuaucugauuucaaugugcauauuuuaggagaauguacuauacuauauuuuaauacuuuaaauagaaguauuaauauaguauauucgguaguacauucuaaaauauaggggaaugaauuguacuagaguauuagaauuauucucuguucacauuagaaagaaacaaucaaauuuauuuccucuucccuuggucugaugacucucccugucuguuucuaacaggcagauuugaagaaucagcugggagaugcuggauacguauuauuuggagugguguuauuuguuugggaacucuuaccuaccaccuuagucguuuauuucuuccgaguuagaaauccuacaaaggaccuuguaaguaaaccauuuuacauuuguaagaaaaugucuccuaauucugaucauggaaccugcaauuagaacuuuuucuucauuuuucagaagagagccucuuccuuuuguggugguaugaaaaguuuccuugacuauuuuauugagacauucauuucccuuaucuuuugagggaaaaugguuuucagcuuaguuuuauuuuacaaaagaaaugaaacuauuauaaguugcaucuuaaggccuggggaaagugauuaacuauuucuuuuaaugcaccauugccucauuaguauuugagacuuggacuugcugugaaccaaguauagaagcuucucucauagcaaaggaaaauagagaauagagaaacagaaauaggaaauagagaacacucauaggaaauaguaugccggauggcgacuagggaaugggaggauagggcaauaagagacaucauuguaaggaaugcuaaaccugcuccccuaguuuggucacauugcuguucaaccaacuuuauaugaaugucuuuaugggacaggacagaaaaugcaaaaccaaguagcgugagaaaccaccugggagccuuguuccguaaauuauuccagccacacaaacuagugguagcuuuuugacuuacugaucuaugaaacccauagaaaaguacagugaguggauuuggggcaaugugagcaaagagcggguggugaagaaggcauagaugaguaauguccuccaauaauucacaguucuuauuucauacccagaugacugaccuguuuuuuuaucuuguuuuuggaagccgccaggcuucaaaccaagcauucugguuccagagucaauggugguuuuuuuuguuuguuugcuuuuugguuuuuuuuucuuuugagaugaagucuugcucugucacccaagcuggaguguaguggcgcgaucucagcucacugcaaccuccgccucccggguuuaagcgauucuccugccucagccucccaaguagcugggaauacagaugcacgccaccaugccuggguaauuuuuguauuuuuaguagagacaggguuuuacuauguuggccaggcuggucucgaacuccugaccucaggugauccgaccgccucagccucccaaagugcugggauuacaggcgugggccaccgcacccgucugaguucaugguuuuaaucccugugcuacacuguagcuuucucuggcaucauaagguuuugagaagaaauuauauucuuaauauagaugaccuaauaguccuaucuauaacuucuguaauuacaugggaaaaaagucuaauacucuuggggggaaaucuauaacucaaacccuucaacuuuaaaggaauacacugcagguggggcauuucuuaaaaaugucaucuaacauuuguauccauaauucauuugguacaaacaggucucuaaacuuggcaugauuagagccagacuucagagucuagguaacgagauacucaaagugcggcucuuuaccaucuguauccgaaucccucagggcgcuugguguaaagauucuuaggucauguuggagacccagaccagaaucucugggguagguuccgggaauguacauuuuuaauaagcacuccaagugaucugaaugaacuguaaaguuugagaaucucuguccuuauccuuuucuuuuuugagacagggucuugcucugucacccaggcuggagugcaguggcacgaucacagcucaccucagccuugaccuccugggcuuaagcgauucucuugccuuagucuugcauguagcugggauuacuugcaugagccguguugcccaggcuggucucaaacuccuggcuguuuuuugucuuuuaaaaacagcuuuauugagauguaacucacuuacauaauucacccauuucauguguauaauugagugguuugggggauauucacauaugugcaaccaucaccacagccaauuuuagaacacuuucaucaucucaaaaggaaaccccauacuaucaucugucauuccccauuuccuuucugucccugcccuacccccaggcauaagccacuauaaucuccugugucuauagauuucccuagucucgacuuucauaugaauggaaucauauggcauguggguuuuuugacuggcuucuuucacuuagcagaauguuuuuucaagauucgucuacguuguaacauauauuuguacuuaauucuuuuuuauugccaaauaaauauuucauuguauggauagaccacauuuugcuuacccauucauccauugauggacaucauuuuuuuuuauuauuauacuauauauuauauauaauauaauauauaauaauauaaauaauauauaauauauauuauauauuauauauaauaauauaaauaauauauaauauauauuauauauaauaauauaaauaauauauaauuauauauauuauauaauauauauuauuaaguucugggguacaugugcagaauguguaguuuuguuacauggguauacaugagcuguggugguuugcugcacccaucaacccaucaccuacaugagguauuucuccuaaugcucucccuccccuaccuccccaccccccuacaggccccagugugugauguuccccucccuguguccauguguucucauuguucaauucccacuuaugagugagaacaugcgguguuugguuuucuguucuugugucagcuugcugagaaugaugguuuccagcuucauccaugucccugcaaaggacaugaacucaucccuuuuuauggcugcauaguauuccaugguauguaugugccacauuuucuuuauccagucuaucauugauggacauuuggguugguuccaagucuuugcucuugugaauagugcugcaguaaacauacgugugcauguacaugugcaugugucuuuauaguggaaugauuuauaauccuuuggguauauacccaguaguggcauugcugggucaaaugguauuucuaguucuagauccuugaggaauugccacacugucuuccacaaugguugaacuaauuuacacuaccaccaacaguguaaaagcguuccuguuucuccauguccucuccagcaucuguuguuuccugacuuuuuaaugaucgccauucuaacugcugugagaugguaucucauuguaguuuugauuugcauuucucugaugaccagugaugagcauauuuuucauguuuauuggcugcacuucuuuugagaaguaucuguucauauccuuugcccacuuuuugaugggguuguuuuuuuccuguaaauuuaaguucuuuguagauucuggauauuagcccuuugucagauggauagauugcaaaaauuuucucccauucuguagguugccuguuuacucugaugauaguuucuuuugcugugcagaagcucuuuaauuuaauuagaucccauuugucaauuuuggcuuuuguugccauugcuuuugguguuuuagaaugaagucuuugcccaugccuauguccugaaugguauugccuagguuuucuucuaggauuuuuaugguuuuaggucuuacguuuaagucuuuaauccaucuugaguuaacuuuuguauaagguguaaggaagggguccaguuucaguuuucugcauauggcuacccaguuuucccaacaccauuuauuaaauaggaaaucuuuccccauugcuuguuugugucagguuugucaaagaucagaugguuguacaugugugguauuauuucugaggcuucuguucuguuccauuggucuauauaucuguuuugguaccaguaccaugcuguuuugguuacuguagccuuguagcauaguuugaaaucagguagcaugaugccuccagcuuuguucuuuuugcuuaggauugucucggcuaugugggcccuucuuugguuccauaugaaguuuaaaguaguuuuuuccaauucugugaagaaagucagugguagcuugauggggauagcauugaaucuguaaauuacuuugggcaguauggccauuuucacaauauugauucuuccuauccaugagcauggaauguuuuuccauuuguuuguguccucucuuauuuccuugagcagcaguuuguaguucuccuuggagagguccuucauaucccuuguaaguuguauuccuagguauuuucuucuuuuaguagcaguugugaaugggaguucacucaugauuuggcucucuguuauugguguauaggaaugcuugugauuuuugcacauugauuuuguauccugagacuuugcugaaguuguuuaucagcuuaaggagauuuugggcugagacagugggguuuucuaaauauaugaucaugucaucugcaaaaagagacaauugacuuccucuuuuccuauuucaauaugcuuucuuucuuucucuuggcugauugcccuggccagaacuuccaauacuauguugaauaggaguggugagagagggcauccuugccuugugcggguuuucaaagggaaugcuuccuguuuuuacccauucaguaugguauuggcuguggguuugucauaaauagcuauuauuuugagauacauuccaucgauaccuaguuuauggagaguuuuuaccaugaacggguguugaauuuugucgaaggucuuuucugcaucuauugagaucaucauguaguuuuugucauugguucuguuuaugugauggauuacguuuauugauuuguguaugucgaaccagccuucuaucccagauaugaagcugacuugaucgugguggauaagcuuuuuaaugugcugcuggauucgguuugccaguacguuauugaggauuuucacauugauguucaucagagauauuggucugaaauuuucuuuuuguuguugugucucugccagguuuugguauuaggaugaugcuggccucauaaaaugagucagggaggauucccucuuuuucuguuguuuagaguaguuucagaaggaaugguaccagcuccucuuuguaccucugguagaauucggcugugaaucuuucugguccuggacuuuuuucgguugguagguuauuaauuacugccucaauuucagaacuuguuauuggucuauucagggauucuacuucuccugguuuagacuugggaggguguauguguccaggaauuuauccauuuccucuagaucuucuaguuuauuugcauagauguguuuauaguauucuuugaugguaguuuguauuucugugggauugguggugauauccccuuuaucauuuuuuauugcgucuauuugauucuucucucuuuucuucuuuauuagucuggcuagcgguuuauccauuuuguugaucuuuucaaaaaaaccagcuccuggauucauugauuuuuuuugaaggguuuuucgugucucuaucuccuucagcucugcucugaucuuaguuauuucuucugcuagcuuuugaauuuguuugcucuugcuucccaaguucuuuuaauugugauguuagggugucaauuuuagaucuuuccugcuuucucuugugggcauuuugugcuguaaauuucccucuacacacugcuuuaaaugugucccagagauucugguacauuaugucuuuuucucauugguuucaaagaagaucuuuauuucugccuuaauuuucuuacuuacccaguagucauucaggagcagguuauucaguuuccauugguugugcaguuuugagugaguuucuuaauccugaguucuaauuugauugcacuguggucugagagacuguuaugauuucuguucuuuugcauuugcugagcaguguuuuacuuccaauuauguggucaauuuuagaauaaaugagaugacgugcugagaagaauguauacucuguuaauuugggguggagaguucuguagaugucugcuagguccgcuuggucuagagcugaguucaagucccugaauauccauguuaauuacaugucucauuuaucugucuaauauugacaguggguuguuaaagucucccauuauuguugugugggggucuaagugucuuuguaggucuguaagaacuugcuuuaugaaucugggugcuccuguauugggugcauauauauuuaggauaguuagcuguucuuguugcauugaucccuuuaccauuauguaauggccuuuuuuugucucuuuugaucuuuguugguuuaaagucuguuuuaucagagauuaggacugcaacuccugcuucuucuuuuuuuuuuuuuuuuuuugcuuuccauuugcuugguaaauauuccuccgucccuuuauuuugagccuauguaugucuuuucacgugagaugggucuccugaauacagcauagugaugggucuugacucuuuauccaauuugccagucugugucuuuuaaugggggcauuuagcccauuuacauuuaagguuaauauuguuaugugugaauuugauccugacauuaugauguuagcugauuauuuugcccauuaguugaugcagcuucuuuauaguguugacgggcuuuacaauuugauauguuuuugcaguggcugguacugguuguuccuuuccauauuuagugcuuccuucaggaggucuuguaaggcaggccugguggugacaaagucucucagcauuugcuugucuauaauggauuuuauuucuccuuuacuuaugaagcuuaguuuggcuggauaugaaauucuggguugaaaauuuuuuucuuuaagaauguugaauauuggcccccacucucuuuuggcuuguaggguuucugcagagacagcugcucuuugucugaugggcuucccuuuguggguaacccgaccuuucugucuagcugcccuuaacauuuuuuccuucauuucaaccuaggugaaucugacgauuaugugucugacgauuaugugucuugcccuucuuaaggaguaucuuugugguguucucuguauuuccugaauuugaauguuggccugucuugcuagguuggagaaguucuccuggauaauauccugaagaguguuuuccaacuugguuccauucuccccaucacuuucagguacaccaaucaaauguagauuuggucuuuucacauaguuccauguuucuuggaggcuuuguucauuccuuuuuauucuuuuuucucuaaucuugucuucuugcuuuguaucauuaaguugaucuucaaucucauauccuuucuuccacuugaucgauuuggcucuugauacuuguguaugcuucacgaaguucuugugcuauguuuuucagcuccaucaggucauuuauauucuccucuaaagugguuauucuagguagcaauucaucuaaccuuuuuucaagguucuuagcuuccuugcauuggguuagaacaugcuucuuuagcucggaggaguuuauuauuacccaccuucugaagcguacuucugucaguucaucaaacucauucucuguccaguuuuguucccuugcuggcgaggaguugugauccuuuggaggagaaguggcauucugguuuuuggaauuuucagccuuuuugugcugguuucucccuaucuuuguggauuuaucuaccuuuggucuuugauguuggugaccuucggauggggucucugaguggacaugcucuuccuuucuguuuguuaguuuuccuucuaacagucggaccccucugcugcaggucugcuggaguuugcaggagguccacuccagacccuguuugccuggguaucaccagcggaggcugcagaacagcaaagauugcugccuguucuuuccucuggaagcuuugucccagaggggcaccugccagaugccagccagagcucuccuguaugaggugucugucagccccuacugggagguaucucccagucaggauacaugggggucaucgacccacugaaggcggcagucugacccuuagcagagccugaacgcugugcugagagaucuccuucucucuucagagccaucaggcaggcacauuuaagucugcugaagcugugcccacagcugccccuucccccaagugcucugucccagggagauggggguuuuaucuauaagucccugacuggggcugcugccuuuuuuucagagaugcccugcccagagaggagaaaucuggcagucuggccacaguggccuugcugagcugccaugggcucugcccaguuugaacuucccagcggcuuuguuuacacugugaggguaaaaccaccuacucaagccucagcaauggcggaugucccuccccacaccaagcuugagugucccaggucgaccucagacugcuucugugcuggcagcgaggauuucaaaccaguggaucuuaguuugcugggcuccguuggggugggaccuaccgagccagacuacuuggcucccuggcuucagcccccuuuccaggggagugaaugguucugucucacuggcguuccagaugccacugggguauggggaaaaaaaaaaaaacaaaaaaccuccugcagcugguucagugucugcccaaauggccgcccaguuuugugcuugaaaccuagggcccuggagagguaggcaccagagggaaucuccuggucugcggguugugaagacugucggaaaagugcaguaucugggccggagugcacaguuccucagguucagucccucauggcuucccuuggguaggggagaaaauucccugacuccuugcacuucucgaucgaggcgacaccccacccugcuucggcucacccuccgugagcugcacccaccguccaagcagucccagugagaagaaccagguaccucaguuggaaaugcagaaaucacccaccuucugugucgaucucgcugggagcugcagacuggagcuguuccuauucggccaucuaauaggugauauguuuuuaucgcuguaugacaucacugguuuuaaggaauuuuaaguuuuucuuaaauguuuccuuuuuaucauuucauuucaagcuuuuuuuguuuguuuguuuauuuggauacagagucuggcucugucacccaggcuggaguggaguggggugaucucagcucacugcaaccucugccuccuggguucaagcgauuccccugccucagacucccaaauagcugggauuacaggugccugcuaccacgccuggcuaauuuuuguauuuuuaguagagaugggguuucauuauguuggccaggcuggucuugaacuccugaacucaggcgauccaccugccuuggccucccaaagugcugggauuacaggugugagccacugugccuggacuauaauuucaaacuucuugacccacaucaagaaguuugaaaugauaaaaaggacacauuuaaggaaaccauuuguggauaugaguggacauuugggucauuuccaccauuuggcuaugaugaauaaggcuguuauaaacauuuguguauaaguuucugugugaacauauguuuucauuucucucggguauauucuuaggaguggaauugcugggucauaugguauuucugagugucacuuucugaaaaacugccagacuauuuuccacagagacagcaccauuuuacauucucaccagcaguguaugaagguucugauuccuccacgcuccuagcacuuguuaucugacuuuuugauucuagauaucauaauguguauuaaaugauaucuccuuuuggcuucugauguauauuucucugaugacuaaguuugucgaggaucuuuuugugugcuuaguggucauuuguauauccucuuuggagaaaugucuguucacauccuuuguccauuuuuaaacuggguugucuuuuuauuauugaauuguaagaguucuuuauauguuuuaaauauacucuuaagucccuugucagguauaugauuugcacauauuuucucucauucuguagcugucuuuucacuuucuugauugguauccuuugaagcacaaaagcuuuuacuuuuguccacuguauuuaucuuuuguugcucguguucuggugucauacccaagaacccuuugccacaucguauacugauggucccugauuuacaacaguucaacuuacaauuuuucaacuuuacagauggugugaaagcaggacacauucaguagaaacuauaauugaaauuuugaauuuuuuaaucuuuuccuaggcuaacaauaugggguaugauaaucucucaagauguauagagcagugaggcacagcucucagucagccaugcgaucauaggggucaacaacugauacucuaugguguguauuuuuuauuuguuuucaacuuacaaugaguuuaucagaauguaaccucaucauaauuuugagaagcaucuguauuugccccugaaaacuugccccuauauuuuuuucuaagaguuuuguaguuuuuguucuuacauuuggucuuuaauacauuuugaguuauuuuuuguauauggugugagauaaggauccaacuucauucuuuugcgcguggcucauagguauucuuaaacuauuaaaaagaguaaauuuuaaggcaauccaccuuguguuaguuccacuuugcuccuuauguuuggcugcaauuagucuuagcaaagcaggaauucacauuuagauagccgucauguggccaccucuguucauguucuauuaacuuuuaaauaggucacugauguuaagaacaaugaugucaaaacauaugccugauuugguguaccauauaaucuaguucugaucuuguuuaggcuuuccugacaaagacaacuuuacuuuuuagaagcugcuggcagaaaaggcuuuucaaaccccaacagucaucccagggcagcugugauacugaaaacuggcaaugaccucuaggguguaccugagaccagucauuggaaauuuuuugagagguaaacucaguuugggggcagaaacaggaugaaaugauuauagaggcaggagauggaaaugggaugagaaauccuccccaaaugauuucaccauuguuaugacugcucucaugauuuauauccaaauugaacuaucuacuuuauucuggcuaauuugggcaucaucuagcuuuuaaaaauuuuuuuguagguacauagauaauagguguguauauuuaugggguacaugagauguuuugauacaggcaugaugauuauuucacaucauggagaauggugucuccaucccaagcauuuauccuuuguuuuacaaacaauccaaucacacucuuuuaguuauuuuaaaauguacaguuauuauugacuauauaguccacccuguuguuagugcuaucaaauaguaagucuuauucauucacuaaaauucuuuuuuuuuuuuuccccauuaaccauacucuccccccgccacuacccuucccagccucuggcaaccauccuucuccucucuguguccaugaguucaauuguuugaguuuagaucccacaaauaagugagaacaugcgauguuugucugugucuggcuuauuucacuuaacauaaucaucuccaguucauccauguuguuccaaauuacuggauuucauucuuuuuuauggcugagugguaccccauucuguauauguuccacauuuucuuuauccauucaucugcugaugaacacuuagguugcuuccaaagcuuagcuauugugaacagugcugcaacaaacacaggauugcagauaucucuucaauauccugauuucccuucuuuuggguagauaccagcagugggauugcuggaucaugugguagcucaauuuuuauuuuugaggaacugccaaacuguucuccauagugguuguacuaauauacauucucaccaacaguguucaaggguucccuuuucuccacauccuugccagcguuuguuacugccuuuuagauauaagcgauuauaacugcagugagguaauaucucacuguaguuuugauuugcauuucucugaugaucauugaugaacacuuuuugauaugccuguuugccaucuguauguugccuuucgagaaaugucuguucaaaucuuuugcccauuuuuaauuuugauuacuacaccuuuuccuaauauucugguuguuaaucccuugucagauggguaguuugcaaauauuuucucccauucuguggguugucuugacuuuguuguuucuuuuacugugcaaaagcuuuuaacuugauaugauccuauuuuuccauuuugcuuugguugcuuguaggauauugcucaugaauucauuuauuuuuauuuuuauuuauuuuugagauggagucuugcucuguugcccaggcuggaguacaguagcaugaucuuggcuuacugcaaucucugcuuucuggguucaagugauucuccugcgucagccuccugaguagcugggacuacaggcaugagcuaccacacccagcuaauuuuuguauuuuugguauagaugggucuucaccguguuggccagccuggucucgaacuccugaccucaagucauccaccugccucagccucccaaagugcugggauuacaggcaugagccacugugcguggccaagaauuaauauuauuuuuaaauuuuugucuuaauuucaaaaguuuuuggggaauagguaguguuuggucacauggaaaaguuguuuaguggugacugcugagauuuuggugcacccauuaccuuagcauuguacacuguacccaauguguagucuuuuaucccucacccucuuccacccuucccccagguccccaauuccauuauauugcucuuaucccuuugcaucuucauagcucagcuccugcuuauaagugagaagauauaauguuugguuuuccauuccugagaguuauuucacuuagaauaauggucuccaacuccauccagguuguuguggaugcuauuucauuccuuuuuauggcugaguaguaguccaugguauauauauaccauuuuucuuuauccacuaguugguugaugggcauuuaggcugguuccauauuuuuguauuuugggaacuguggauuguguggcuauaaacaugccugcacaagugucuuuuucauauaaugacuccuuuaccucuggguagauacccaguaagugggauucccaccagcaguauaaaaguguucuuuuuuacuacauccaugccaacaucuguuauuuuuuuauuucugaauuauggucauucuugcaggaguaagguauggggcaucucauugugguuuugguuugcauuccucugagaauuagugauguugaggauuuuuucauguuuguuggccauauggauaucuucuuuugagaauugucuauucauguccuuagcccacuuuuggaugggauuaguuguuuuuuuuucuugcugauauguuugaguucuugaagauuuuggauauuaguccauugcuggaugcauagucugugaauauuuucuccuacucuaugacuugucuguuuacucugcugauuauuuccuuugcuguacagaagacuuuuuguuuaauuaggucccauguauuuaucuuaguuuuuguuuuauuugcuuuuggauucuuggucaugaucucuuugccuaagacaaugucuagaagaguuuuucugauuuaucuucuagaauuuuucugguuucaggucuuagauuuaagucuuugauccaucuugaguugauuuuuguauacggugagagaugaggauccagcuucauuguucuacauguggcuugccaauuaucccagcaccauuuguugaacaggguguccuuuccccacuuuauguuuuuauuuguguuguugaagaucaguugucuguacauauuuggccuuauuucuggguucucuauucuguuccauugggguaccugccucacucugucacccagguuggagcacaguggcacaaucccggcucauuggaaccuccgccucccagguucaagugauucuccugccucagccuccugaguaggugggauuacaggcaucuaccgccaugcgcagcuaauuuuuguauuuuuaguagagacgagguuucacuauguugaccaggcuggucuugaacuccugaccucaagugauccacccgccucggccucccaaagugcugggauuucaggcuugagccacugcauccggcccugccugccuauucuuauacgaguacuaugcuguuuugguaacuauagccuuguaauauaguuggaagcuggguaaugugauaccuccagauuuguucuuuuugcuuagucuugcuuuggcuaugcacgaucuuuuuugguuccauacgaauuuuagaauuuuuucuauuucugugaagaaugaugaccuuuuuguuuuuuugagacagagucuugcucugucguccaggcuggagugcaguggugugauauuggcucacugcaaucugugccucccagguucaaguaauucuugugccucagccuccaaaguagcugugauuacagguaugcaccaccacaccuggcuaacuuuugcauuuuuuaguagagacaggguuuugccauguuguccaggcuggucucgaacuacugaccugaagugaucuaccugccuggccucccaaagugcugggauuacaggugugagccacuguauccagccugaugaugguaucuugaugggaauugcauugaauuuguagauugcuuuuggcaguauggucacuuucauaauauugauucuacccaucugugagcaugggggauguguuuccauuuguuucugucaucugugauuucuuuuagcaguguuuuguagcuuuccuuguagagagcuuucaccuccuugguuagguauauuccuaaguauuuuguuuuugcagcuguuguaaaaggggcugaguuccuuauuugauucucagcuuggucguuguuggugaucaguuuuaggagcuuuuaggauaagucuuuaggguuuucuagguaugcgauuaugucauuggugaacagugacaguuugacuuacucuuuacugguuugggugcccucuugcuguugucugauugcucuggcuaaggacuuccaguacuauguugaauagaaguggugaaagaggguuuccuugucuuguuccauuucucagguggaaugcuuucaacuuuuccugauucaguauaauguuggcuguggguuugucauagauggcuuuuauuaucuugauguaugucccuucuaugccaguuuuucugagggcuuuaguccuaaacagaugcuggauuuuuucaaaugcuuuuucugcauccauugagauaaucauaugauuuuuguuuuuaauucuguuuaugugauauagcccauuuauugacucauguauguuaaaccaucccugcaucccugguaugaaacccacuugaucaugguggauuaucuuuuugauaugcuguuggauucaguuagcuauuaauauuuuguugaggauuuuuacaucuauguucaucagggauaaacauaguuuugcuauguccuuuccugguuuugguauuagggugauacugguuucauagaaugauuuagggaggauucccucuuucacuaucuuuuggaacgguuucagaauaagauugguaccaauucuucuuugaauaucugauagaaauuagcugugaauccaccugguccuggacuuuuuuuguuguuggaaauguuuuuauugcuguuucgaucucgcuaguuguuauguucaguuucuauuucuuccuaauuuaaucuaggaggguuguauauuuugauuuucuaguuucuguaaagguguucguaguaaccuugaaugaucuuuuguauuucugugguaucgguuguaauaucucccauuuuguuucuaauugagcuuauuuggaucuucugucuucuugguuaaucucacuaauggucuaucaauuuuguuuaucuuuucaaagaaucagcuuuuuguuucauuuaucuuuuguauugccuuuuuguuucaauuucauuaguucugcucugaucuuuguuauuucuuuucuucugcuggguuuggguuugguuuguucuuguuucucuaauuccuugagguaggaccuuagauuuucuauuugugcucuuccagacuuuuuugauguaggaauuuaaugcugucaacuuuccucucagccccacuuuugcugugccucagagguuuggguaaguugugucauuauuaucauucaguucuaagaauuuaauuuccaucuugauuucauuguugacccaaagaucauucaggagcacauuaauuuccaugcauuuauauaguuuugaggguuccuuuuggaguuaaucuccaauuuuauauuccacuguggucugagagaguacuugauauaaucucaauuuucuuaaauugauuuagacucauuucauagccuaucauauggucuaucuuggagaauguucuaugugccaaugaaaagaauguauauucugcaguuguuggguagaauguucuguaaguaucuguuaaguccguuuguucuaggguauaauuuaaguccauuguuucuuuguuaacuuucugucuugauggcuugucuagugcugucaguggaguacugaaguaccccacuaugguguugcuaucucauuucuuaaugucuaauaauaauuguuuuauaaauuugggggcucccauauuaggugcauauauauuuaggauugugauauuuuccuguuggacugauccuuuuauuaauaaauaaugucucucuuugucuuaacuguugaugcuuuaaagucuauuuugucugauaaaagaauagcuacuccugcuuacuuuuuguuuucauuugcauggaauaucuuuuuccaccccuuuaccuuaaguuuaugugaguacuuaugcauuaguugagucucuugaagacagcagauacuugauuuguggauuuuuaccuagucugccauucuguaucuuuuaaauggagcauuuaggccauuuacacccaacauuaguauugagaugugagacuguuuuauucaucaugccaguuguugccugaauacuuuuuuuuuucauuguuuuauaggccuggugagauuuaugcuuuaaggagguucuauucugguguauuuugagguuuuguuucaagaauuagaacuccuuuuagcauuucuuguagugcuggcuugguaguggcaaauucuuagcauuugguugucugaagacuuuguaucuuuuccuucauuuaugaagcuuuguuuugcuggauacagaauucuuggcugacaauuauuuuguuugaagaggcuaaagauaggaccccaaucccuucuggcuuauaggguuucuccugagaaaucugcuguuaaacagcuuuuaaaauucuuuccuuugucuugacuuuagauaaccugacugugccugaucaucuuuuugcaauuauuuucccagguguucuuugagcuucuuguauuuggaugucuagaucucuagugaggccagggaaguuuuccuugauuauucccucaaauauguuuuccaaacuuuagauuucucuucaucuucaggaacaccaauuauuauguuuggccauuugacauaaucacaaauuuauuggaggcucuguucauuuuguaaauucuuuuuugucuuuguggauuggguaauugccuugucuucaaguucugaaguccuuucuuuucuacuugauucuauuguugaaacuuuacagugaauuuuuuauccuccaagugcgucuuucauuuccagaaguugugacaguuuuuuauuauaucuguuucucuggagacauuuucauccauaucuguauuuuaaaaaagaguacuuaaguugguuuucaccuuucucugguaucucuuugaguagcuuaauaaucaaccuucuuaauuauuuaucuggcaauucagguauuucuucuugguuuggauccauugcuggagagcuggcaugagccuuguuauagaaccuuguuuugucauauuaccagaacugcuuuucugauuccuucucauguggguagacuauuucacuggaaaaaucuggaacucaaagcugcuggucagauucuuuugucugggugguuccuugauguggguugcuuccccuucuccuagugauggggcuuccugugagccagacugcagugauuguuauugcucuucuuggucuagucacccagcagggcuaccgggcuuuggacuggugcuggggaaugucugcaaagaguccugugaugcaauucaucuucagaucucccagcuauagauaccagcaccugcuccuguggagguggcaggggauugaaguagacucugugaaagaccuugguuguaaguauguuuaguaugcuggcuuucuuaagugcuuuaugcuagcaaugaaguugccaccauggacagacucaggaccacuguuuagccaggauguuggaggcaguagaauuagcuguuguuuucuccuuccuuggagcaggggaucugucaugaguugcuguaauguccugaggugguuggccuccagccaggagguggcacuuucaagagagcaccagaguuuuucaccugucucucagaauuugcaguggccugccgcuucuuuccaagugucugugaauuccuucaguuuuccugguaugcuccuguggugguuccuggagcaaaaguccauggugugacucuccacacacuguucugucuguccaagugggagcugcauguaagcccuaucuccuauccaccaucuuccccucaaaguauuuauauguaaauagaauagaugaacagaaucuagauccagaugcaaaucugaaauccauucccugccuguugaacuuucacuucuucaggaaacaaauucucugcucuuuagccccaaaccucugccaugauggcagugcccauagggacacucucaagaaauuuuugcccagacccaugucuuggcgauauuccccaauguuuucuuguaguaguuucacaguuugaggucuuagguuuaagucuuuaauccauuuuuuuugauuuuuguaucuggugagagauaguggucuaguuucauucuucugcauauggauaucuaguuuucccagcaccauuuauugaagucuuuuccccaguguauguucuuggcaguuuguugaaaaugaguucacuguagguguguggauuuguuucuggggucucuauucuguucuauuggucuaugugucuguuucuuuucuuucuuucuuuuuuguuuugagacagagucuugcucugucgcccaggcuggagugcaauggcgugaucucggcucacugcaagcuccgccucccagguucacgccauucuccugucucagccucccgaguagcugggacuaugggcaccccccauuucgcccggcuaauuuuuuguauuuuuaguagagaugggguuucacuguguuagccaggauggucuugaucuccugaccucaugaucugccugccucagccucccaaagugcugggauuacaggugugagccaccaugccuggcccuaugugucuguuccuauaccaguaccaugcuguuuuaguuacuauaacucuguaguguaauuugaagucaggucauguugauucucccaguuuuguucugcuuaaaauagcuuuggcuauucugggucuuuugugguucuguauaaauuuuaggauuguuuuuucuauuucugugaagaguaucauugguauuuugauggggauugcauugaaucuguagauugcuuuggguaguauggccauuuuaacaauauugauuccuccaauccaugaacagaaaauauuuuuccauuuuuugguguccucuucaguuucuuuaaauguuuuauaguuuucauuauagagcucuuucacuucuuuguuuaauuucuagguauuuguggcuauuauaagugggauuacuuuuuguuucuuuuucagauuguucacucuugguauauagaaaugcuacugauuuuuugugcaacuuuacugaauuuauuaguucucauacuuuuuguggagucauuaauuugacuuuuucuauuccaauuuggaugcccuuucucuugucugauugcucuagcuaggacuuccaguacuauguuuaauaacaguggugacuguguguuccacaucuuagaggaaaggcuuguaguuuuccccuauucaguaugauacuagcuaugggucugucauauauggcuuguauuauguugagguauguuucuucuuuccccgguuugaggguuuuuaucaugaaggaacacugaauuuuaucaagugcuuuuuuagcaucaauugagaugaucauaugguuuuuaucuuucauucuguuaacaugaugugucacauuuauuugugcuauguugagccauccuuguaucacauggauaaaucccacuuagucaugaugaauaaucuuuccaauguauuguugaauuugguuuacuaguauuuuguugaagauuuuugcaucaauauuuaucagagauauuggccuacaguuuuaugugucuuugguuuuaguaucaggguaauacuggccuccuccaugaguguagaaguacucccucuuccucuauuuuuuuuggauuaguuugaguaugacugacauuaguucuucuuuaaauguuugguagaauucugcagugaagccauugggucccaggcuuuucuuuacugggagacuuuuuauuauggcuuugaucucuugccuuuuuucuccuuguuacuaacagugaaagucuuuagaaaaccuuaagagagcucugaaaagaacccuuguuuuagggacagaagaacugaagaaaagcugggagaaaacauugcuuucucaguggauuagggagcagagaaauucuaguuagguagaauaaaagacuuguuauuggucuguucggguuuuagucuuuccgguuuagucuuaguaggcuguaugugucuuggaauuugcccauuucuucuagauuuuacaguuuauuggcauauaguuacucaucaucuagcuuuucaauaagggauuaaaacaaugaugacucacuguugcaagcaagacucugauagaagacuuugcccauacugauaaaaggcaaggcgaaucccucucaaacauaagaguaacugaaaugaauauuccagcugaacagauauagccuacauucaaaugaauagaacaucuuuagucuccuacaagaaagagaucuuauuuuugucuggugcaaggcaugaugucuguaaguaugcugaaugauuaccugucuuucuagaccaacccuggaaugguccccagccauggauucagucccagaucuuauuucuuugacaacccucgaagauaugacagugaugaugaccuugccuggaacauugccccucagggacuucagggaggguaagacccuacuucauguuagacaagccucaucaggagggaaggguuacaccaguuaaauagauucaagcuaaaagaaaauuccuacguuaaaacugugcagccuuaggugguauaagacuggauucucaguagaucauuuuacuuaugugaaacauucaggaaugagaaaggacauccgguuuuuuuaaagccccauagcauuauuguauacaguaguguuuccuaaacaauauuccaugaaacacuauuuucuuaauaguuaugcugugcaaaaggaaaugauaaucaacuuuuuuauuucuuggagauagggucucacucuguugcccggcuggagugcagaguggugcaaucuuggcucacugcaaccucccgcucccagguucaaguaauucuugugccucaggcuccugaguagcugggauuaccggugugcgccaccgcacccagcaaauuuuuuuauuuuuaguagagacgggguuuugccacguuggccaggcuggauugaacuccuggccucaagugaucugcccaccuuggccucccaaagugcugggauuacaggcgugagccacugcacccggccagaaaaaaaacuuuuuagaaaaugccgagcgagccuguaauaugcuaaugugugcucugaaucuccaagagggaaauacagcacuugucuauggaaucacucaauggaacaugauaucuuuaaucacauguucuaaagcuagagaguaaaugcaguaguauuuauuuauuagaauaaauuauacauuauaaaggaccaaguuuucaaauuugaaugaugucaguucuuaauuuaaaauuucauuuacaugaaggguauuuauuuggucucaauuuucaugaauacuuauuuaauaaauacuucuauagcaucuacucuguaucagacacuguucuaagagauucacaaauaucaacucauuuagucuuaacaguccugagaggucaguacuauuauuagccucauaauacagaugaaacugagguaucuagaggguagguaacuuguccaaggucacacagcuagcaagugaucaggcuacaauucuaacucaggcaguuuuguucaaauuuguuuucugaaucaccauacuauguaaacaguuuguauauaaguacccugucucuuagucucaccuacgcuuauguuauacuuucacgugaguuuuaauagcaggagucuccuuccuugaaucuacaugcggaucuggcccagaaaauguggaaagggcaguuaaauacugagaguucaaagcagcauacauagaggguguaagacaauacaugaacuaccaguccgcugccaucgccuaaucuucagugaauugggaaggcaaauaaaaagagggaagcaccugaaauugcaaccauagcagagauccaccccaggauuccaaguuuugcuuaccucagcaugggcauggucugcaaacaggaaggguaguugcuauugggauucccuucccuuuuccucagccugcugugcucagccauacuccacuacccgaugacuaucauguuuccccuuucagccuguggcucugagacggugaggccagcaggggugagaggagccaaaagggcugacauagugccugccaagccugucuucucucugcuuguccucucaggacccccauccuguuccugggaaaggggagcuucuuagaaagugaaagguuaucuuauguaaucuuuuguaagauuaaagacuuagcauuaacaacuuuacaacuuuuuucccucugggaugaaaugauaaaaaauauaugcuugccuuuuuacuccuuguuaguaacagugaaagucuuuagaaaacuuuuuaagagagcucugaaaagaguccuuguuuuagggacagaaguacugaagaaaagcugggagaauacaugcuuucucagugaucggggagcagagaaauccuggucagauaggauaaaagauugucgcugagaaaaaagaagaaagcugcccaaugcgcugagccagcagauguaaagaacguaagcuggaagcaagccaacaaacaagaaggacuucuugaagucaaaagcuguccuuugggucacucagauucugagcuccaccucuuccuuaaaacuguucuuuuccaguuaccccacugcaucuccuauuaguugcuuuccccuuuaaacccauauucugcuagagcugucccacccucucaccugccagaaaugacuuagagcugagggaguccucacuaccgauauggugaagacaagacccccuuucuacuacauagaggaacauaauuauaaugaaaacgacuuacguguauugagaauuaacuauauauuagacacuguucuaagcacuuuacagauguuaacucaguccccacaauaggcccacgacguaguuacuaauauuacucccauucuaagaugaggaaauugaggcauagaaguuacuuguccaaagacaccaccacagguugugagcuguacuccauguuaggauucagaugcaguuuguugcugaaaacauuuccuaugcauagugacuggcuggguucucuagucaugcuguauacucugugcucuaaagaguucaguagaguugucggugggcauuucagcccuguguguagcaugguuuugugggaaaauggacuuuaagagccauuuaaaagaacuuuagaguuaucuauaguuuacacaaaaaucucagcucugucuaccuaaacuagacuaugucauacauacuauauaauguuucaagucacugaaauauuuuuuucuuuuuaaguuuugcuccagauuacuaugauuggggacaacaaacuaacagcuuccuggcacaagcaggaacuuugcaagacucaacuuuggauccugacaaaccaagccuuggguagcaucaguuaacaguuuuauggacgauuccucagaugaaaagcuucagaaaagcauagugacagcugaauuuuuagggcacuuuuccuuaagaaauagaacuugauuuuuauuuguuacagguuuccaauggccccauaggaauaagcaauaauguagacugauaaacccuuauuuuaguacuaaagagggagccuugcuauuucaguggguauaauuuaaacuuuuuaaagaaaaucuguacuuuuauaaagauguauuuuguauaacuuaaauaauaaugcuaaaguauacuaggguuuuuuuuucuugagaauguuacugcaaucauguuguaguuugcacagacuuuuaugcauaauucacuuuaaaaauauagaauauauggucuaauaguuuuuuaaagcuuuuggacuaaaguauuccacaaaucuuaccucuuuaggucacugauggucacuccgauucugagugccacauugguagacuccuaaaauacaguugacaacuuagccaauugcaacuccaguguugauaauuaaaaugaaaugguaaagcagcagacuguaaggucuuuagagauuuuuuuuuuaagguucaggccguagguuccucaaggaaucucuuaaguuuugcccaaagacugguacuuccuuucaguagggcgcuaauguauacacauuaaugauaaguugauaacauuaaaaauguagcugacuuauccuauuaaaccuccucugcuauguucacaga

SEQ ID NO: 192402 - RNA, 89350 nt, Homo sapiens
gggaggcgggaggagagggggcugccaggggcguccgguuacauccccgccuuccucuguccuggccgcgggaccggguuugcgggaccgcaguucgggaacauguuggccucgagcagccggauccgggcugcguggacgcgggcgcugcugcugccgcugcugcuggcggggccugugggcugccugagccgccaggagcucuuucccuucggccccggacagggggaccuggagcuggaggacggggaugacuucgucucuccugcccuggagcugaguggggcgcuccgcuucuacgacagauccgacaucgacgcagucuacgugagugagccccgggagggcgggcgaggggcugcagggcgcggcgggccgggggcgcccguggagccggacggacuugggcguagcaggcggggacccggacccgcuggccgccggggcaccgggcacggcgcagggucucccgccucugcaggguccgcgaaggucuucccgacccggucccugcuauccgaagagcgggucgcggggucuggguggcuccgcgcgccccgggccgugaccccggcacccauggaccccgcggagcuuccuccccggcggcugugggcugcaucgccgcagggaggucaguccgcgucccucggcuguccagucccuucggggcuaggaccuggccggucccggguggagccagguucucgcgcggagccuccgcagggcaagagccggagcuggaucgcagucugcgcgcgggccccgggacucuuguggcugcgggagaguuucgccggcagccuccuguauuuguguguggacuccggaugugucuuggcagugaugcugcuuuccaguugggcucguuucagaguccagaguccagagcgggaaacacagggcucccagugaucccauuuccuguggccaggcauugucaccacggaggccccaaacgaggagcgggaccagaugaccuacagcucccuggauccuccccgugacuggccgggccuggggucgcugucaacuuguugaaguccuuucgugccgcugccuuccucggccgcccaccauguggauuucauauaaggcuugugugcauuccagaagugugggggguuggccgggggaaggggguuggaacugcaaacgcagcggcugcagccuguccugcccgugaaauggcugugcucccggucuggccugggaacacugcgccuuagacaacacucacguggaacuuguaggcuuugccuaaaacgaaugagcccuucaagucuggauccacaaagagcccucccccauguugguugacugcccuggccccuuugcacacuggugaagccuguggaucccuuuucaguauaacgcuuuuauuuuaguuuuuagagagacgaggucuugcucuguugcccaggcugggugcagcggugcgaucuugggucacugcagccuccaacuccuuggcucaagcuguccucuggccucagccuccugaguagcugggaccacaggcgagugucaccaugcugggcaguauaaaguuuuaaaugcauaaaauaaaauccacaagaugaccaaggaaggcaauuauguugaaauacagaucaaaauauuaaaaaaacacacaucuuaugcucuuauguacuauauaugcuuauaugcuuacuuuauuuauuuauuuauuuauuuauuuuuuuuuuugagacagagucucucucuaucccccagccuggaguuuaguggcacaaucucagcucacugcaaccuccaccuccuggguucaaaugauucuccugccucagccuccugaguagcugggauuacagaugacugccaccacacuuggcuaauuuuuguauuuuaaguagagacaugguuucaccauguuggccaggcuagucuugaacuccugaccucagaugaucugcccaccucagcuucccaaagugcugggauuacaggcaugagccaccaugccuggcccaauauaugcuuacuuuuuuuuuuuuuuuuuuuuuugagaugaagucucacucuguugcacaagcuggagugcaguggcgagaucuuggcucacuguaaccuccaccucccagguucaagcgauuuuccugccucagccuccugaguaggugggacuauaggcacgcaccaccaugccuggcuaauuuuugcauuuuuaguauagacgggauuucaccauguugaccaggcuggucuugaacuccugaccucgugauucacccaccuccgccucccaaagugcugggauuacaggugugggccaccacgccuggccuauaugcuuacuuuuaacaacauuaaauaacaagguguagcaguggauccaagggcaguucagguaacgauugaacuuugaagaucaugagcaauauucugagacacaugcagcaacuaugaugugauaugaaaauaucugugacuucuauuagugacugcuuuguugccugcauucauaauuaaaggaaaugcuaaauaucaguuuuugguuauucuuuuuuuuuuuuuuuuuuuuuuugagacagagucuugcucuguugcccaggcuagaguacaguggcucaaucuuagcucaccacaaccuccgccucccagguucaagagauucuccugccucagccucccgaguagcugggauuacaggcgcgcaccaccaugccuggcuaauuuuguauuuuuaguagaggcgggguuucuccauguuggucaggcuggucucuaacuccugaccucaggugauccgcccgccuuggccucccaaaguguugggauuacaggcaugagccaccaugcccggccauuagagauuucuaaguagauggcugacacgauuuaacuuuaaaagauuaucauucucuucaacaaauaaauggcaugguggggaaaaagaaggagggagaccugguguggaucaaaagagacuucagaggcuugcugaccaaaugcaagugaggacuuuguuucagccugauuaagacaaaucggccauaaaaaggugucuuugagacaaacugcauuucgagaagagguauacaugcaaauguguagauauaaguuucauuucucuuggguauauaccuaggacuggaauuccugggucauaugguaacucuauguuuaauauuuugaggaacugucaaaguguuuuccaaagcgacagcaccaucugacauucccaccaacaauauaugaggguuccgauuucucgacguccucaccaacauuucuuauuucugacuuuuugauuuauggccaucccagugggugugaagugcuguguugugaaucugauuugcaucucucugauggcuaaugauguugagaaucuuuucaugugcucauuggccguuuguguuucuucuuuggagaaaugccuguucaaauccuuuggucauuaaaaaaaaaucguguuuuuuuuuuaauuguugagaagggccucaucuuucaacaagaauacuucauaaaugagaccagccuggccaacaugguggaaccucaucucuacuaaaaauacgaaaaacagccaggugugguggcgugcaccuguaaucucagcuacucaggaggcugaggcaggagaaucucuugagccugggagguggagguugcaguaagccaagaucgcgccauugcacucagccugggaaacagagugagacugagacuuugucucaaaaaaaacaaaaaaaagagaagaauccuucauaaacgaagcuguauuuuucacauuggauaacauuagccggcaagugaugucugguuauugcuuggcuugccacgcuaagauuaauaccugguguuaaggagauuacagccagaucaugccugugaaguuauauuuuuccccaggugagcagcaacugagcuacggggugacacucauuuuggccuuaucaucuauuuccugcccacuaaucuuucaccuaaugguuuuagcaucuaucgaugaucuuugccugaaacaguaauuaaauuaaaguuugcaggaugauguuuuauuuuauuuugcugguugcuuguuucugucauucuuucugcauuuauuagcuggcauauucuguaaagagguuuuccucaucaaccaugacuuuuggguaacacugauauacuguucauucuggaaaggcagauaaaugcugaacucuucuccuguaauuuuuuauguuuaaguuaaggaauuuguguaauacaguacuaggcuccaauugccacagguaaacuucugauaucuauauucagguuguuaaggagaaacaugugucuccccagagauugggggucucacaccccaaggcccuugguguugcauccucaagggcuacuucuuugauagacacacccguaguuaaaauuuaaagaacccaacagauuuuuuuuuuuuuugcccagucuaauuuagccugggggguuuguauaucaacuuuagugauacuaaugcuaauaaguucagauaacccacuaccaucggaaaagccccaaccauuuuuaaauguuggaaaguaaucucagguagaaauuuucugcagaagagagggguaacugauccaaagucacuuggacauuaacuggauuaaguugaaaauauugacucaucucuauuacccuuaugucagaggcaugugaacugagcaauuccaucuugaacaggcgcuggguaaaaugaggcugagaccuacuggacugcauucccugaugguuaaggcauucuaagucaaaggaugagauaggaggucagcacaagauacaggucaugaagaccuuccugauaaaacagguugcaguaaagaagccggccaaaccuaucaaaaccaagacggcgaugagagugaccucuggucauccucacuacuacacucucaccagcaccaugacacuuuacaaaugccauggaaaugucagaaaguuacccuauauggucuaaaaaggggaggcaugaauaauccaccccuuguuuagcauaucaucaagaaauagccaugaaaaugggcuacuagcagcccuuggggcugcucugucuauggaguaacaauucuuuuuuuuuuuuuuuuuuuuugagacugagucucacucugucaccaggcuggagugcaguggcacgaugucggcucacugcaaccuccaccuccuggguucaagcaauuuuccuaccucagccucccaaguagcugggacuacaggcacaugccaacacgcccagcuaauuuuuguauuuuuaguagagacgggguuucaccauguuggccaggauggucucgaucucuugaccucgugauccucccaucucagccucccaaagugcugggauuacaggcgugagccaccacgcccggcugcuguucuuuauuccuuuacuuucuuaauaaacuugcuuucacuuuauggacuugcccugaauucuuucuugugcaagauccaagaacccuuucugagggucuggaucgggaccccuuuccaguaauccuuagauugucccuaagcuuuauuuacuaauccuuuuguuucuauuucuauuucaugccagagucauuucuucugugggguuaauggggaucacuugcaauuuggacuuggaguucuguucuggcacuucuaguguuugaucuuaggcaaguuauauaaacuaaaacucauuuuuucucaaaugaagaaugaaaaugguauuaaucuuuacuagguuuaaugagauaacuaaaguaaaaaugcuuuguaaacuguaaagcaccuugcaaacggauuaggcuccagguccacuugugggcucuaggcugaaauuaaucagucuccaccuugauugugucccggacuugccuauuuucuggacuuccuuuuuguguuuuacuuuuuuuuggacucauuuuguuuuccagcuuuuuguagcuacccagucacuaacuuugaagccaucccaaaaaacauugcaacuugcaugacuuuugcccccagugucucuaaacuaggcagccaaguguaacagaaagagcacggguuacggacuccagcaaauguguguuccguucuugguucuaucacuuacuggcugugugacauuaaagcuaaauuaaaaucucucaucauuuccuugucuguuucaaguaugcgaaaagagggaugguuguacuaaaugccugucacaugaaauuuuaaaagauaaaaagagccuuaguaaaggaccucaacauuaggugacagcccauguuugcugcauuuccacucuuuauguuaaauuauuuuaaguuccugcugccucucacccauggaguuugcuuuugcaagucucacugucuucucaguacagcgauuuguauuuguaaaaggacccuguuuguuucuuauuuguuucuaccucaaguauucucuaaacacacauguuuuggagaaggcucccccuagacuauugcagaaagcagccuguuacuaggcucaucuaagcccccggccaaguggcuguuguuucacuuuuucagggaguauuuggacauaagaaaucuaacauaaauuuuaaauuuauugagcaucugcauauagacuuucuccggugauucaugcuaucugaaaguucacguuaaagaugaaaugagacaggaagugcuuucuaagaugggaaacacccucccauuauaaguuaggugcucuguccauccccuucuugucaguuggguugaaacaauuguacauaagugguuccagcuguuacccauguggugcuuggcauuuucacccuggguuuuuuugugaucuaauugacaugcucugcccuagggcagcuggaugaaaagccguauuguuuguuguguuucuuggggugagugggaagacaugguucuguaaaggggcauuuaguuuuacuagccacauagugagcugaaguuuaacuuugcuaaaggaacuuuuucucagugugaacugauguuguaagcaguauuucagggaaauauuuacauugcucaacaugcuggaaauagcuguuuuucaguaaacaaguuuuuacuccuuaaugcaaauucacaaagaaccucaccuaggcaauauuugguuaccuuaaguuaccuuaagaugauaauauuacauuauuaucaucagcagcacucucagugauucagaugggcuuucucagaaaugcauucaccccaugaggguuuugcgauaugaucaauacagcaaggaacgugcugcugccauugggagucaggaucccuaagugaggggucaagaugccaauugcaaacuuagagagaggggcagacagaaagaaacaugugauaaacccugguugggaggucagaaagccuucacaagggaaaauaagacuuugccaagcacaugagcugagaauuaucaagaagguuuuuugaggagguuuucuuuuucuuuuuuucuuuucuuuucuuuuuuuuccuuuccuuucucucucucucuuuuucuuucuuucuuuccgucuuucuuucuuuccuucuuucuuucagucuuacucuguugcccaggcuggagugcaguggcgagauuucggcucacugcacccucagccuccugaguagcugggauuacaggugugcaugaccacgcccggcuaauuuuuguaauuuuaguagagacagaguuucagcauguuggccaggcugggcucaaacucccgaccucaggugauccgcccgccucagccucccaaagugcugggauuacaggugugagccaccacgcccagcugaggagguuuucaagaaggagggaaucauagauccaaaagcauguaguguuaacuaggagagacaccauggagaguuuggagaauuaaaagcaaucuaaaauuuuuuucuggcacauuucuccucuagccuuuuacucaccaacauucauaaaaacuaaagugcgaucccauaauccauguacuuuuuugagauggauucucucucugucucccaggccggagugcaguggcacagucucagcucacugcaggcuccaccucccggguucaagcgauucuccugccucagccuccugaguagcugggauuacaggcacccaccaccacgccuggcuaauuuuuguauuuuuaguagagacgggauuucaccauauuggucaggcuggccucaaacuccugaccucaggugauccaccugccuuggccucccaaagugcugggauuauaggcaugagccaucguguacuuuuuaaacuaguacaaauguagugaacagaaagugauacugguaacugccgugcaauacuuacgcuucauguuuuuguuuuuuuuuuuccuggacucagggcacuguauggggugccucaggcucuguaacuuuugauuaguuuuaauuacaaaaucugcuuuuaccagcaccaccuucugcucauuaauguggucuaaugugcccagugcaacuaacacuccugugucccugggaggggaguggcagugguaggaaagucuggggaaggaagaaauucaaagaccaugaaggguggacguagagaguggaauggugguuaccagaggcugggaaggguaggguaugggacgaaaagagguugguuaauggguacaaacauacaguucgauagaaggaauaaguucuaguguuugguagcagaguagagugacuauaguuaaccaauauuguauauuucaaaauaguuagaaaagaagauuugaaauguucccaaugcaaagaaagauaaauguuugagacggugaauuuccuaauuauccugauuugaucauuacacauuguauguaugcauguaucaaaauauauacuccacguguaccccauaaauauguacaaauaugaugcaucaauacaaauaaaauaauaaagugggucuucacgaacacaaaaagacagugaaggagucccucuucuuaauuuuugcuuuuguugcuugugcuuuuggugucauguccaaaauguaauugucaagaucaauaucaaggaguuuuuccuuauuguuuucuucuaggaguuuuauaguuucagguuuuacauuuaauucuucaauccauugcgaguuaauuucuaugagugcuauaaaauagggguccauuuucauucuuuugcaggaggauauccaauuuucccagcacuguuuauuggagagacuaccuugucucauuguguguucuugguggcccugucaaacacuaguugaccguaaauguguggguucaccucuaggcucucaguucugucccguugaucuaucacggcuaucuguaauagcuuugcuaaccaacuugauugugcuauucauuucacaacauauaccuguaucaaaucgcguuguacacccuaaacuuauacacuuuuguuuaucaguuauaccucaauaaaccuggaaaaacaaaaccaaauaaaaacaaggacaaugagccacaggcccuacugacagagaacguuagucuuggcuuaucuauuagagccauuugccuuucuuugcugaacuucagaucaaucagguuuguuguauguuuuuuuuuucuauuuuuauuuuuugagauggagucucacucuguuacccaggcuggagugcaguggcgugaucuugacucacugcaaccuccaccccccggauucaagugauucucaugccucagccuccccaguggcuagaauuacaggugugauuagccacugcaccagaccuguuauauguuuuuaaaaaauaaacuuuuauuaugaaaaauuucaaauauacucaaaaauauaaugaacucccauguauccauuaccagcuccaacaaguaccaauuugagacuaaucuucuuucauugauguccucacuuauuccuaauguucccuccccauccccaaacugaauuauuauuauuauuauuauuauuuuugagauggagucuugcucugucgcccagguuggagugcagugguguggucuuggcuuacugcaagcuccaccucccggguucccgccauucuccugccucagccucccgaguagcugggacuacagacacccgccaccacgcccggcuaauuuuuuguauuuuuaguagagacgggguuucaccguguuacccaggauggucucgaucuccugaccucgugauccacccaccucggccucccaaagugcugggauuacaggcgugagccaccgcacgcggcccugaauuauuuuuaagcaaaucccaaauauuuuaucguuuuguaaauguuucagaugugccucagaagaaaagacucuuuaggccgagcacaguggcucauaccuguaaucccagcacuuugggaggcugaggcgggcggauagcuugagcucaggaguuccagacuagccuggccaacauggugaaacccuguguccacuaaaaauauacaaauuagccagaugugguggcacacaccuguagucccagcuacucgggaggcugaggcaggagaauugcuugaauccaggagauagagguugcagugagccgagacugcaccacugcacuccagccugggugacagagcgagacucugucucaaaaaaaaaaauucuuuaaaaaaacaaaauaguaaaaucaugaucauacuuuaagaaaugauaauaauuccuuaauauuguccaauaugcaaaugguuucaugaaauguuuuauuuugcuuuucaggugauugguuuaaaucagggcccagacaaagcccacacauuacauuugguagaugugucucuuaggacuuuuguuuugagauggaguuuugcucuuguagcccaguauggagugcaaugacgcagucucggcucacuguaaccuccaccucccagguucaagcgauucuccugccucagccucccaaguagcugggauuacaggcaccugcuaccucacccagcuaauuuuuguauuuuuaguagacacaggguuucaccauguuggccgggcugcucucaaacuccugaccacaggugaucugccagccuuugccucccaaaauacugggauuauaggagcaagccaccucgccuagccaucucuuagaauuuuuaaaaucuauagguccuccccuaaccccagcucuuuuuuuucuuuaaaauuuauuuguucaagaaacuagauauuucuccauuuuagugcuuuauauucuggauuuugcugauugcaucccauuguguccauuagcauguucuucugucuccuguauuuccuguaaacuggcaguuagaucuggagacaugacugaauucaaguuaugcacuuuuuauuuauuuuauuuuaguaauuggcauuuuacuccaguggcaagaacggcaguaaugcacaguucucugacccuucauaucacuuacaacugagcucacccucaggccuuauuucuaaaauaaccugggugcacaggucuuauccugcuuugaaccugccuguccccuauauuggaggaagucaggaaguggggagacucauauguaucagaccauguguaagcucuggaacuacuguggugaccaagacaaauggagucccugaccgugaagaaaugaccacauaguggggagagaagccagaaccuacaaauaggcaggaagaagacauaucaggggcugggggugugagggaagggaaaaaagagugaguggaaggagcuuccacuggaggggaugccaggaagcucucugagaaggcacuguuucagcugaggaauaaggauaagaagggacagucaugugacuaacgagguggugggguugggcgggggcgugcuguugguagcugagauggagaaagugccauauacaguagcuucucacuuaacauuguggauagguucuuggauacuguggcuucaagcuaaacaugcauaacuaaaccgauuugacugucggguaauugacagaaacaacauuuaaguuccuauggcuuauuucuggucagaaacacaucaccaaacuucccaugaagcccaaaacacuucuaguauuaaacauugaaauaaauaaaugugagcucuacauacauuuaagaugaauaaaaacaaccaagauauuauuuacccaauuuuugaugaaucagugaauaauggaggucaugaugguaguggguucaaucagggaagaaauguuugcaaagcaacauugucaacacuucugacccacgaaguucaaaaacaaacaaucacaaauccggcagcuugccgaguacuuuuguugguguauaauucauuggugcauaauuuauuggugugauuacucguacuugauacauuuucauucugugaucauuuguauucauucauucauucauucauucauuuuccagcugcuuauuccaguucagagaggaggguggccagagcccaucccagcagcucagugugccaggcaggagccacccuggacagguugcuguccuaucacaagggggcucccacacacccacacucacucacagucggacaguuuagacaugccaguucacccgacuuuggcauagcuuugggauguggaaggaaaccagaguacucagagaaaagccaugcagacauggggagaacacggacaccccacacagacgguggcuccagcagggaauagauuuuuuuuuucucaucaacguuauaacaaaacaacguugaaugcaaugaaguuauuugaggaccugcuguaguuggagacaggacaugcagcguggguggugagaaagaggaaggaaccaggacccacuuccagguuuccuggcuucaccaacugagcgaauauuggugauggccugggcaucaguggucacaugggcccgaggacuccccggcccagugcccuuggggauugugccugagucugugccuccuccugccugagugccuguguccuuucccuuuuugcucccugcccuucugcuguugaauuguccaaugguacuuucaaaagauggagaaaaggaacaaggcugauaggagcaucgugcauuugacagacuuugcaaaaugagacuugcacccaaguggacgggaauauuuuucaucaacuuugcuauuaacuguuacuuccaggaaaaugaaguuuacaagggagaaguuuaaagcuaagaauccagugaaacuucuggcuguucugcacauuacauuuaucuuugaagucauccuucuucauuaucacagacgaucgagcugaauguucaguaaaauuagcugaaaaauaauuuuccaaugcaaauacuaaugaggguuauaugaccguuguccaaagcauuugcagugcugcaugacauuuguccuaaaaccugacucuuaaaacauuccuugugaaaauagaaauauucccaugccuagauuccaaauaauaaaagacacugagaguguuuucaaaauuaauggacugauuuaaauuucacuggaaagcagcuuuuuaaaacuaaauugucuggauguggccucccugugaucacuuccaacugcuuacugccaacuucuggcggcucgagagagugagccguuucccacgcucccacacggcagcucccugggaugcuugugcugggagauguuugggucccuggaagggagacagagggaccggcuggaagaagccccgugucugacucccuucuccacagccugccaguaucuucuagaaaagccuugcuggugccgggugaugauggaaaauaugucacccaaagaguuaauagcccauaacaugugguuaaaagagaaaguuuuguuaagucugcauuucacucccagagcccugguuccaauccucaccugggugccaaucgguucugcacauugaaccuuuuuauuaauagcaaguuuuuggcauguuuagaguuuggucuuuaguuccucucuuuuuuucugccccugcacucuccucuaguaaugaagugugaagugacugagggauaagacucugggaggaggaggagggaggggagggggaggggcagggggagggggagggaaauaaguggccuggaaaauccacuggccuucuaacaacugaggguugcuauucuggauucguguuuuuccaaucugcagcccuuaaagagcaaaauaaagugccauuugcaaaaucucucccuuuugauuagggaaucuucuucuuucucucuuuuuuuuucgagacacucuugcucuguugccuaggcuggagugcaucaucagugcaaucucggcucacugcagccucugccucuugggcucaagcaauucuccugccucagucucccaaguagcugggacugcaggcacuugccaccaugcccagcuaauuuuuuuuuuguauuuuuaguagagacgggguuuugccauaugggccaggcuggucucgaacuccuggccucaaaugauccacccaccuccgcuucccaaaguguugggauuacaggcgugagccucugcacccagcuaggggauuuuuuucuuucaauucacagauuaucuaaggaaaacuaucacuggcuuggucuuccaugucaucaguggauugugcacuaacaagaaagugagaggguguuagacuucacuggugagccugagugcccccacuccaaggggcuguuugccacaguaucucaggggcccucuucccauuuucucaaggagcauggguuuuagcugaguaagaacagugauaucuuuuuuuuuuuuuugaaauggaauuucucucuuguugcccaggcuggagugcaaugugcagucuuggcucacugcaauccccaccucccaggcucaagcgauucuccugccucagccuccugaguagcugggauuauaggcgugcaccaccauguccggcuaauuuuguauuuuuauuagagacaggguuucaccauguuggucaggcuggucucgaacuccugaccucaggugauccacccgccucagccucccaaaaugcugggauuacaggcgugagccaccacaccuggccagugauaucuuuuaauaagcaguuauaacugauuucaagaaggcaauucaugaaguaauuaaaaggacugauuuuggaaaaggaccaauuuuggagucggacuccguggguucaaaucccaguguugccacuuauuccuugguaacuuuggacacauugaugaauuugccuaauuuuccccaucagaaaaauauagauauuaguaguacuuagucuuuuuuuuuuuuuuuuccccugagaugaagucuugcucuguugcccaggcuggaaugcaguggugcaaucuuggcucauugcaaccuccgcuuccuggguucaagugauucuccugccucagccgcccgaguagcugggauuuggugcccgccaucacgcccggcuaauuuuugaauuuuuaguagagaugguguuucaccauguuggccaggcuggucuuaaacuccugaccucgcgaucugcccaccucggccucccaaagugcugagauuacaggugugagccaccacgcccggccaguaguaccuagucuuaagagguucuucugagcauuagacauuaguaaaaaugccuggaauauggugaguauucaguaaauauuagcuauuauccugacacauuaaacuuuaaaauaauuagugauaccauaaugccccauacagauuugcuucuugaugcuauauugugucaucaucucuuugugucaguccuuucccuuauccuucuggauuguggauuucuuaaaaggugggggcuggaccuuaaccauuuuucuuuucuuucuuuuucuuuuuugagacaaggguucacccugucacccaggcuggagugcacuggcgugaucauggcucacugcagcuuugaccucccggggcuuaagccauccucccagcucagccucccaaguagcuggaacuacaggcccgagcuaccaagccuggcuaauuuuugguauuuuuguguagagaugggaucucacuuugaugcccaggcuccuaaccauguuuguacgcacaccaauuagcaguccugguagggagugauuacucccuuuuucgaguaaauucacuaggauuugaauaaugacuccuguucucuuuccacacagcccauuuugccuagaaaugaaugcugggguaugcgguucaggcucguaucuuucucagauucuguuguauucuacacagcauggguacagcugacaguauucuaggagugggugcucagucuuacugagaaaggacccguuucugcauuccuuuuaaccacacuugguuuuguacaggucaccacaaauggcaucauugcuacgagugaacccccggccaaagaaucccaucccgggcucuucccaccaacauucggugcagucgccccuuuccuggcggacuuggacacgaccgauggccuggggaagguuuauuaucgagaagacuuaucccccuccaucacucagcgagcagcagaguguguccacagaggguucccggagaucucuuuccagccuaguagcgcggugguugucacuugggaauccguggcccccuaccaagggcccagcagggacccagaccagaaaggcaagguaagcuccccuccagguccaagugcagguaaucagacacauuggcuucauacacuuuggucucacgccuugugcugcuuugacauaaguuauacaccauugauaaagacaggaaauccaaagcaaaaucuaguaggcugguuauugcaggucccaaaccuccaaaagcuuaucugcaagguuguauaacucuacguuuuaaugacaaguagacauaaagcaaagcaauuccugguaagacugcuauguggcaaaaauaggguugauaaauggcauccccuggcugcucuuaccucagguggcagauaguggaaggauaauuuauuuauuuauuuauuuauuuuucuuuuuuuuugagauggagucucgcucugucgcccaggcuggagugcaguggcacgaucuuggcucacugcaagcuucgccuccccgguucacaccauucuccugucucagccucccgaguagcugggacuacaggcgaccaccaccacgcccggcugguuuuuuuuguauuuuuaguagagacaggguuucaccauguuagccaggauggucucuaucucuugaucucgugauccacccuucucagccucccaaagugcugggauuacaggcgugagccaccaugcccggccuuuuuuuuuuuuuuuuuuuuuuuuuugagauggagucuugcucuguugcccaggcuggaguacaguggcacaaucucagcucucugcagccuccaccucccagguucaagcaauuauugugccucagccucccgaguagcugggauuacaggcaugggccaccacacuggcuaauuuuuguauuuuuaguagagaugggguuucaccacauuggccaggcuggucuccaacugcugaccucaaaugauccacccaccucagccucccaaagugcugggauuacaggugugugccaccgagcccggcuggaaggauaguuucugacuagagaaauuauuaauaugaaacgauagguuaaaauaacaaaguacuccugagggaugcaaagauagaaagguaaagcccagacucuaguuggggagacaagaaucauuuggaccaugugagugguucaaaacccaaguauugucauaacccaggguuggccucuccgugggcgcagucaucagggacggcuggaaggaccaggcuguagagcacggacuugcccuugaaggaagcagggucuuugaguaggucaggaacucguuguuagaccugaagugacuuuuuaggacaggccucgauuuucccuuggaaaaauaauuucucucuaccauaacuucaccuuuauaggaaaaugaggaagaaagaaacuugaagggucccaaagcacuucauauaaaugggagguauuucaggcuggugguuccuaaaguguguaccacaaaacaccaguccuacaagauacaccuugaggaaaaggccuucuaguuugggaaaugcuaaaacuauaucucccucuuggugauucacccuguucacucugaaaaguccugcagucaggaaacuugcaacuugccuaauacuacuuuuuuuguuuuuguuuuuguuuuuguuuugagacagagucuugcucugucacccaggcuggagugcaguggugccaucuuggcucauugcaaucuccaccuccuggguucaagugauucuccugccucagccucccagguagcugggacuaagggcgugagccaccauuccagccuugccgaauauuguuuaacugagcagucuccaaaccugugaccauaccucuucccuucccccgcuccaaaaaagaugcauuacaucccacagagcacacuuugggaaagucuguuaggggccugcaugacacauuuugcuugccaacuguuaucugucugagugccaaacuugaaaacagcuuaaauguuaagugucucagcugccucccuuucacuugggugauaaaugccuaacccauugguauggaucccuugcuugccucuugggccuaaucuguuccaccuccgcauacccuuugcagccgcuauaccaaauuacauguaauucccugaccuugcccuugcucuuuuuuuuuuauccgcaguaucuugcacaggcuguccucucuguuugggacguccucucccugaccccccuacagguggcagcuuccuccugcuuguucauucagacugggcccucccgugaggccuugaccaaccacagccuccuggcaugggaugcacucccaccgcuccuggcaugggacgcuuccucuuacggcuccugcagcgcuuugcaaauguuucgauuacagaauccaaccucagguuuugcaauguuuucuucacaugucagccuucccaaagugcugggauuacaggcaugagccaccgcgcccggcaugugccugcucuuucauacgugaccucauguagucuuccucauuucugugaaggaggugguuuuaucuccauuuuacagaugcaaacaucgaggcuuagggaacucaaguaucacgcccaagucacauaauaaugaguagagcaaagauuuggauccaggucuguuuucucccaaaucucauguuuuguuuuguuuuuucuacuguacggugcuuggguucaauaaauguuuguuaaacgaugaaugcgguugaauauguuaacagccauggaaacaaagucuuuggguaagaauuuccuaaacugcgugagauuuuaggccaccaucuggagguaccaucuguauaauuuuugguuaaccuuagggccacaguuaugcagaagauauuuaugaauuaaucagaaaaugucauguugacauagccuuagggauauuucaguggaacuaucccagaauccuagguucuugcuacaaaaguccuucuuuuagaauaaggugagaauauugccaucgcucuauagcacuguacgcuuuauagauagucuggcgaauaacacauuuuaaaaucuaucgauauuuuuccgaguaacugaauuuuaacucaucuucacagagaaacacguuccaggcuguucuagccuccucugauuccagcuccuaugccauuuuccuuuauccugaggauggucugcaguuccauacgacauucucaaagaaggaaaacaaccaaguuccugccgugguugcauucagucaagguucagugggauucuuauggaagagcaacggagcuuauaacauauuugcuaaugacagggaaucaguugaaaauuuggccaaguaugcuuucuuuguucuucaguagauucuccucuuaauauuuuuuaauguggauaauguaauguguauuauagaucauuaccuaaaaauguuccuauggauuuaaguuuugcauauaguuuuuauauuaugagauacucuuuuucugaugaacuuaaggaaauguauuuuuagaaugaacagauauccuauuuuuuagauaucauccucauuuaaaauaguucuuuuuuuuuuuuuuuuuuuuuuuuuugagacagagccuuacucuguugcccaagcuggaaggcuggagugcaauggcacaaucucgacucacugcaaccucugccucccagguucaagugauucucucgccucagcuucccaaguagcugggauuacaggugugugccaccaugcccagcuaauucuuguauuuuuaguagagacgggguuucaccauguuggccaggcuggucuugaacuccugcccucgggugaucugcccaccucagccucccaaagugcugggauuacaggcaugaagugccgcgcccggccuuaagacaguuuuuaccauuuugucuauaaacacuguuagaaauaaggguuauucaaaccuaucuccuuugaucucaaggcugagaaaaccuuuuccuucacauugacuagggggaauauucuuacaacagaaauggugcucucagguuauguuguagaauuugacaaaagagggaaaagcccaaauuggauuuugaagauuaaaaccuuuccucucccauuauucuuuaaaaaccaagagugaauccccuaaaaccaccuuuuaauuuuauaucuucaaaucuagcuugaauuccucugcccuucacuuagugaugugcugguaaaugcuuaacaacugguuuuaugagggcagaggaaccugauuuauagcguuugccuguuucugugauguaaauacuccuacgauggccaaguucaaguuauuaacgucaugucacucauugaagaguucagaaaacaugcaccauuauauauauucucaccauaaagauaaaauagguuuaauauauauaauuucaagagcauggacaguagcaaaaggauuagaauaugaugaguuuugaauauuuuuuccuuuuaaaaaauauaacuuguuuaauuggaaguucauguaauuuaauuguuuagaauggcuguguuuaauaacuggcuugcaaaauuccuaaaacuuuaacagccagcucucacaagcuaguccauauaagcucccacacaccacugucuuuacuugaaucccaggcagacaaauugauuagacauccuauuuaugcaggacuuuugugauuuaucauccccaccccaccccauuguuuugcucaguauuuuccacugaguaauguauguccccucuguccaccguauaauauaauuauuucauguaauuucugauaggagcacuuccaaucacagacacagaagaaugguaaaaaugguggaggaagaaguagagauuagggauauucuacuauauuuuauaguuauaaaaugcuuuuggauuuuguaucucauuugcuuuucaccauauccuuuaagcaccaaagguaaacugagacuaguccaagaucucacagccaauggaguugggauuucuuuuuuuguuguuuuuguuguuguuuugagauggagucuugcucugucgcccaggcuggagugcaguggcacgaucuuggcucacugcaagcucugccucccggguucacgccauucuccugcuucagcgucccgagcagcugggacuacaggcgcccaccaccacgcccagcuaauuuuuuguauuuuuaguagagacgggguuucaccauguuagccaggauggucucgaucuccugaccucaugaucugcccuccucagccccccaaagugcugggauuacaggugugagccaccgcgcccggcccuggaguugggauuucuaaaaaaccacgucugcaauguuuucacucacacuucugacaccaaaugggugggguuuuuuuucccacaccaaccaauucucugcacaccagccggguguccuacacuucaguucaauucuagcacuggcguuacugcagaccccacagguuaagggcucagucccacaggacugcccccacuucagaugccagucccaaguccuguguuuccaccuguacuucugaccaaccagcuauaaauggaggguuuccauggcaugcuccucagauuugauaauuugcuagaauggcucacauaacacagaaaaaugcuucacuauuaccaguucauucuaaaggauacaacucuggaacaaccaaauggaagagaggcauaggacaagguauggguaagggggcaggguuucuaugccgucucugaguacaccagccuucccgcaccuugauguguucaacccagaagcucucugaaccccaucauuuuaggguuuuuauggugguguuauuucauaggcacaguugauuaaaucacugauccuuggugauugacucaaucuccagcccaucuccccucccuggaggcaguggggaaagcuggacauuccaaccuucuaaucaugccuuggucuuucuggccaccagcccccauccugaaacugucuaggagcucccagccaucagucaacucauuagccuacaaaagacacucuuaucacuucagaaauuccaaaggcuguaggagcucuuguuucagaaugugaggacagagaccaaacauguauuuucaauuguaucauaccaugucauggaaagagauaguggagagcaugaaugacuucaguccuaaagccacugucaguccuaugagccaccuuagcucauaagguagagcauguaaccagcaauuaggaugagcaaguugaauuuuaaguccugauagugucccuggagcacacuucuggaauggcugggacugagcuugugcuaguauugugcccauuuggacacagucucaccagacagcccuagacugccucagccacaugacgcccagacaugacggccagugcccuuccacucuccaguccuagcugcaggugauggcuugcagaccaacacagauccucagggcucccucugcuuggguagugguggcuguugguggguugcuggccuguuucuaagaagccuguccuuccuccuaggaguaguaacucugggcagcagggugucuggguguuugagauugggaguccagccaccaccaauggcguggugccugcagacgugauccucggaacugaagauggggcagaguaugaugaugaggaugaagauuaugaccuggcgaccacucgucugggccuggaggaugugggcaccacgcccuucuccuacaaggcucugagaaggggaggugcugacacauacagugugcccagcguccucuccccgcgccgggcagcuaccgaaaggccccuuggaccucccacagagagaaccaggucuuuccaguuggcaguggagacuuuucaccagcagcacccucaggucauagauguggaugaaguugaggaaacaggaguugguaagaccauuuaaguugcaguugguaacgaucuuggaugugugggcuuccagacaggcguacugcuggggagaugucaguugugagcauuacauggugguuuguaaagauaagagcuugggaaaguagaggcugaacucucacagccguggagccuugguguuauaugcccaguggcuucagagaugcucagugaucuuuugggauuaggaccaugguuuuggagacuguugagugugucuucuuucaaguuuccuaguauuccguucugucuguuuuaaagagaaaacguccguuagaauuguuuugaaagucagauuuucuugugauuucucagaucagaaauguauucauccaccugaaaaaacauuuuagaaguucuuuuggcugucuaugaagcuuaucuuugacauuuauuuccucuugguuuuggaauuagaauuguugauuauuuuucuucccaggucccgucaguuucagaguugguuugugaagauuaaaaaauauauauauaucaaaguagauacucuuuaaaaaaaaauagggucgggggugguggcucacaccuguaaucccagcacuuugggaggccgaggcagguggaucacaagcucaagagauugagaccauccuggccaacauggugaaaccccaucucuacuaaaaauacaaaaauuagcugggcguggugacacacgccuguaguccuagcuacuugggaggcugaggcaggaggauugcuugaaccugggaggcagagguugcagugagccgagaucaugccacugcacuccagccuggcaacagagugagucucugccucgaaaagaaaaaaaaaguuuuacaguacauuuucuggucaacuauguuauaucagauuuuugcuacauuuugagggaaaauagaacuccuggaugcuuucauuuuucuuauaaaagauguucuagccaggcacaguggcucaugccuguuaucccagcacuuugggaggccaaggcgggugcaucaccugaggucaggaguuggagaccagccuggacaacauggugaaauccugccucuacuaaaaaugcaaaacauuagccaggcgugguggcaggcaucuguaaucccagccaaucuggaggcugaggccagagaaucgcucgaaccugagagguggagguugcagugagccgagaucgcuccauugcccuccagccugguuggcaagagcaagacucugucucaagaaaaaaaaaaaaaaagauguuccaacuaaacuguccucauuauuuuuuuuucacauuaguuugauacggaauccacuaagacucauauaaaugggauaguccaagccuuuagauaagcuuauugcagcugucugcugcuuuucuacuaaggaaugaucauaaaacucuuagagaagucuggcccauuccacacuguucacucauuuuuauuugcccuuacuuguucugauuuaucucacagcaguagccauacacgcuuguucucacgaguaucccaaacuguggacgagauggggugcuuacuggcuggcgugcugacuuacuucugaggcacggaaauggagaagcugccauuugguggcaggacaaggacaggggcucaugucuuagguucuccuacugcacccuggguuccuggggugaugcuuacauugcucagcacaugccacucugccguggguuuuggagucaucucccccagauguguuggguguguuuccuugcauauguuggguuuugaguuccauccugucuccacccuuucuaggugucucugaaauucucauuugugaagccaucacauuugaaugagaccauauccagcccaacaacuuggggcaguguauuacuuaagacugaaaaaagccuagauuugaacgcagauugugucuaaaacagauguuuuccugucccucuaccccaguuauuucccuauguugaagagaaaggucagucuucuguggccaguagugcauuccugguguuauuugaauaguucacauguacacaggccauaaugaccccugagagcucugcccacagcuggaguuuaaguaaucagcggcaucacguguucaguucagggcucaagugugcucggcuccaaacgcugucuuuauaaagccagaaauucccuuccgaguauguaggacucauagagucuaccuggguuuaaacuuugcuuuucucuucacucguaacagucaauuaugaaugggaucauuaucuucucugaaaguuuaccccucuugugcuuuugaauuucauuccaaauuaauuugcucgggauuauuaaauauaaugagcuaguucaugauucuaauaaaacaaaguuggaauguggaaauuuaaaauagggagauguucuuuuucuuucuugggucaaaggcuuuuuagcccaggugugacuagggcauuauuuuuguucagcuuuugaguauaagugcuuccaaauuauuccucagggaaaaguguauguugggguggggugggaggugauuuaaaauuaaaaagaauauaagccaggcacaauggcacccgccugcagucccagcuacuugggaggcagaggaaggaggauaaaauauauguacauauuuuaagguuguuaaaauggcaaauuuuauguuauauauauuuuaccacaauaaaaaauuaaaaaaauuauaucauauaauuauauguaguauauacuguauuauauauuauuauauaacauauaaauauauuuuaucuguuauaauguauuauaauguaauauauuguauuuuauauaauguaauauaauguaaauauauauuauauaaauauuuauaauguaaauauauauaauguauauauaaauauauaauguaaauauauauuauauaauauaauguaaauauauauuauauauuuacauauauguauauguacauauuuacauauauaguuacacauauauguuauauauuuauauuuaauauauauuacauauauguaauauauuuauguuauauaugaccuauauaacauagguaauauauauuauauaugaccuauauaacauagguaauauuuauuauauaugaccuauauaacauagguaauauauauuauauaugaccuauauagcauagguaauauauauuauauaugaccuauauaacauagguaauauauauuauauaugaccuauauaacauagguaauauauauuauauaugaccuauauaacauagguaauauauauuauauauguuuuaauauauauuuuaagaguccccccaaacaugaagcucauuguucucacuaguuuggauggacaccauccugagauugcuauuggauagcacuaaucuaacauugaugccaaguacacuagauucuagcaguuuucaauaauuaauaaucaccuugugauuucucaacuccuuuuagaccuguuugccucagugaugugaguuucaccauguugcccaggcucacguaacuauuuaaguggcuaccuguaggggauuguaaucuucuguagugagccuggucccuugaauugcccaugcaggugugagucccugcagugcuugagggugccuagaugagagagcccaccgggcuagagcugcaugaaaugcuuacaggugugcaauuguuuucuuggaccaguuuucagcuauaacacggauucccgccagacgugugcuaacaacagacaccagugcucggugcacgcagagugcagggacuacgccacgggcuucugcugcagcugugucgcuggcuauacgggcaauggcaggcaauguguugcagaagguaauuugcuuuucuauguucguuucaugcgggagaaggaggagcggaguuuuuguuuuggugcucguuuuccauguugcuuuacccacaucuccguagguguguagaguuuuucuuauggcagccauacauggucucucuuuccucauuuuuucucguauucucuacaggcaucccccaggaaggcccauuuuucaaauauggcaaagucuuccuuuccugugcuauuucuccaucucaggggacagucacugggagcccaucuucacaacugcgugguguguggccacaaaggccguaguguuaaaauuaugcagccuggacaaagaauuguuuaugucccucacuuuccuucacuucuuugaaaucucuuucauguauuuuuuucuuagagucucucuaauuuuauguuguguugcucacagaccuauguuuuuuuuuuucuugagacagagucuuacucugucacccaggcuagagugcaguggugugaccuuggcucacugcagcuuucaucucccagguucaagugauucuccugccucagccuccugaguagcuggaauuacagaugugcgccaccaaacccagcuaauuuuuguauuuuucauagagaugggguuucuccauguuggccagacuggucucaaacuccugaccucaaauaaucugccugccucggccucccgaaauguugggauuacaggugugagccagcgcgcccagccagaccuaucuuaaugguugcuaagucccagcagggccacagaaggcuggcuuagaccaaagucuguggcaaguaaaguuuaucccaucauccucucccuccugucucucuuuccuggugcuccugaagucauagcgugguuacaguugagcaucagagaugcaccaugguuaaugcuggggugccaauuccaaauggauucggcuaugggccaauguccauucuaaacucugcccucaaaaggaucaacugguuuggaugcuugcagauggucaggagaauccuuucugugcaaaucuggggguccugguaauguucacucggugcaccaucugggaggcuggaauuugucuuaauuccagaauuaacacaaaaauggcaaaaccccaccauguuaaacguuccucccuucagaugcggucuuagucacuuuucugaugcuucuagcagaauaccugaaacugaguaauuuauaaagaaaaaaaauuuauuucuuacagugauggaggcugagaaguccaagaucagggggccacauuuggugauggccuuguuucuggugggggcucucugcagaggugguacaggaggcugagcauccugggucgggucucucuuccucuuccuguaaagccaucagucccauucccgugauaacacauucauccauuaauccaugacugcauuaauucauucuucagggcagagcccucaugacccaaucagcucagaaaggccccauuucuaaaugcuaucacauuggggauuaaguuucaauaugaguuuuggaggggacauucaagccauagcagaugccaacaaauugucucacuugucgugggucauuuuccuuguguguuuaauguggaacuucaauugcuuugcaaaaauugacuaaauaaaagucaacuggaggaaugguuucugcuuuucagaaccccuaccugccauaguuauaauuaaauucguuaucauuucaaguugcuaaaaacaaaaaaucauuuccuucuguguccccauuagauaaagugagguuuuaaaaaauacuaccuucagcaauggaagacaauugaguaugcuuuacuuauuaauuuuaggggauguuauuaacuucuaaacuguuuuugauuuucuuuuaaaucccaucaccccagggguggugugucuuugcuucuuuguuucaggcuuggcuuuuguaucuucuccaucccaggagaagcuuccaaaauccacaauaaaagcuuauucuuaaagagcaaccucuuagccuuuucuaccccaaauaucagagcuugaaaugcugaacaguuuguguuuggcagccagcucagauaugacaaacuguucagccacauauuuugacauuauauacacacccuggaauagauuugugguuuaaauauuuguuggauucuugcuacuuaaaaaaaaaauguuucuagcucaaaguuugguggaaaauuuuuuguuugguuucuuaacuuggccuucuugcuuguuuuccugauuguucuugggauaccuuuuugcgcuguuggccagcuaacuucacaguguuccccggaguaaugaugcaacgugugugcagaaugacucuguuggauauguccuggcugaucagagaaccuguugagccguuugggcguauggaacccaacgaaaagucaucagaacgcagcugauccccggauggcagccccugccuagggcuauucaacaacauucacugagagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacacguauguuuauugcggcauuauucacaauagcaaagacuuggaaccaacccaaauguccaacaaugauagacuggauuaagaaaauguggcacauauacaccauggaauacuaugcagccauaaaaaaugaugaguucauguccuuuguagggacauggaugaaauuggaaaucaucauucucaguaaacuaucgcaagaacaaaaaaccaaacaccgcauauucucacucauaggugggaauugaacaaugagaucacauggacacaggaaggggaauaucacacucuggggacuguggugggguggggggaggggggagggauagcacugggagauauaccuaaugcuagaugacgaguuagugggugcagcgcaccagcaugacacauguauacauauguaacuaaccugcacaaugugcacauguacccuaaaacuuaaaguauaauaaaaaaaaagaaagaaagaaagaaaaaaaaaagaaaacucugccgagaaccugugaggggcugggugugaaaguccugacccugugaugaucauaaucuaggaacagaaauaagauauguacaaucaauaacugaaaguaauaccacaucaaauauaaacaaugcaauguaaccuuuguuuucccucuuccuucaguuuuuguuuuccugagauauaauucacauaccuuuuuaaaguauacaauuugguggguuuuaauauauucacaaaguuguccaacuauuaccucuaucuaauucuagaacauuuucaucacccccaaaagaaacaccguguccauuaguagucacucuugauuucucaaaaugcccccagccgcugucaagcccucaccuacuuucugucuuuauagguguuccuauuccagacguuucaugcacauagaaucguacaauacaugaccuuuugugucugacuucuuucccuuagcaugaugaugauuucaagguucauggccuguuuuagcccauaucaguauuucaugccuuuuucuuuuucuuucuuucuuuuuuuuuuuuuuuugagauggaguuucgcucuuauugcccaggcuggagugcaauggugcaaucucagcucacugcaaccucugccuccuguguucaagcgauucuccugcuucagccuccugaguagcuaggauuauaggugaccgccaccaugccuagcuaauuuuuuguauuuuuaguagagacgggguuucaccauguugcccaggcuggucucgaacuccugaucucagaugauccaccugccuuggccucccaaagugcugggauuacagauaugagccaccaggcccagccucaugccuuuuucuaguuaaauaauaucuuaaugaauggagguaccguauuuuguuuauccauucaucaguuaauggacauuuggguuguuuuccuuuuggcucuggugaguaaugcugcuaagaacauuuguguucacguuuuuguguggacacaugugcuccuuucucuuggcuguauaccuaggaauuagaauugcugggccauacaguaaccuucaauguucuuauuugaauacaacaaacagcaauuuaauuucuuuaguucuuauuuuuuuccuguuuaaacaauaauaaauauaugcaaguuauaaauacucaaaaauuauaaaaauuuauaguauaggaaaugaauucaccacguuugcccugaguuaaccauuguuagcaguuuucccccagguauaugccaacauuuaucaugaauguaauuuuuuaagcaaaaaugguaucccagaucaauuuauuaucaagguauuaaggaggcuuuuaaauuugucauaguaggucucaauuccaucguucccaguugucuaaauggaacaagcagcaccagacacgccaagcugguucugguucagagggcaugacuguguagccugggcggugacucuguacuugucuguguggcuugugcuggcugaggcuccaagacucagacuggcagugcuaacgcuggguggugggacuguauaugagcucacaguguuuauuaaaguguguuauagaucaggcaggcaaaugucuauacucccagggccauucagguuagccuugcugucccaaugaaaugagcaauuccacacuccuuuuacucucucucucucuuuuuuugagacagucucgcucugucacccaggcuggagugcgguggcaugaucuuggcucacugcaaccuuagccucccggguucaagcgauuaucccaccucagccuccugaguagcugggacuacaggcacccgccaucaugcccagcuaauuuuuuuauuuuuaguagagacaggguuucgccguauuggccaggcuggucuugaacuccugaccucaggugaucugccugccucggccucccaaagugcugggauuacaggcaugagccaccaugcccauccuccuuuuacucucaaaugugauaaauucuauggucgccuuaguucuaggucaccccugauauucuucuucuucugaaauucuguuuuuaacuccugcaguuccucaauggcuguccguggagacagcuuucgugcuauccauuuucagucacaggaagagaggcaggggcauuggaauuuugaaggcccgcagcauacaguuguggguagucucaggaagaacagcugcuuuugcuuacccaaagccauugaccccagugcuguuuuguuucuuugcuuucuucaccaauagguacagguccuacauauuacucguguuugaaagacuggcuuggaagugaucucuauauucuuucuuuguuuucuugcucagguuccccccagcgagucaauggcaaggugaaaggaaggaucuuuguggggagcagccagguccccauugucuuugagaacacugaccuccacucuuacguaguaaugaaccacgggcgcuccuacacagccaucagcaccauucccgagaccguuggauauucucugcuuccacuggccccaguuggaggcaucauuggauggauguuugcaguggagcaggacggauucaagaauggguucagcaucaccgguaauuuauauccgacauuaaaauuagugggucacacaguagugccuagggggaggccuggggauggauggaaggagaacucugagucugcagacaacuuagaagcauguuguugcuccuuuuugucuguagacagggcauccuguaguucugucuuggaaauaagaugaugagguaaaaugaacauguaauauuaucauuaauauauagcaacugagacugccuagaauuggguuuugauugaggagcaauuucgugguggagauuuaggcguuucuggcagaacaagugauaucagcucguagaaccucacaacuucacaguuugccucauucuaucaagccugccucugaauuccaaaccaaccugaaacugaucucaagccugccucugaauuccaaaccaaccugaaacugaucuuugauauuuccucaggauuugcucagagagaaggaaccugccauuucuagcuaguuacuuaagcugcauaaacauaauccucagaagucuuaggaagccuagauauccuuggaguuuuuuagagacugugcccuauugaggaagguucagucuuuacuggacgcgugggcagauggcuugagggauguuuccuugguguugugguggccuuccccuugcccugccaagaccagcccaaccuuugcaugcuggagacccauucccgagaacagcuggguuggaggagucuguguccuucaucgcuggucacuuccaggaccuggaguuuguugugcuggggcacagguaccuagccacugccuccgacgaccuagaccugccuucucccccacugccugagccaaccuggagccuuagccaaggcuuuauuagaggaaacacugcuggaagcagggucuccauccaggcugcacgcugguaaccccuccaaaaguuauggcauauaaauacauaaaguguggccgucuuaagaaaggagaggcuaucuauuagaaaaggagugaggccgggcaugguggcucacgccaguaaucccagcacuuugggaggccgaggcacauggaucacaaggucaggagauugagaucauccuggauaacacagugaaacccugucucuaugaaaaauacaaaaaauuagccaggugugguggcgggcaccugcagucccagcuacucgggaggcugaggcaggagaauggugugaacccaggaggcggagguugcagugagccgagaucgugccauugcacuccagccugggcaacagagugagacucuguauuaaaaaaaaaagaaaaaaagaaaaaaagaaaaggauugaaccugcucaaaagauuugcuacuuuuuggccuaauguuuuuucuuccuaguccacaggcauauauauucugaguguuauaacaauauugaugcucucaugcaaaccagaugcccuuuucuuugcaaauaucauugagcugcagucaaacucacagaccccacuccuucccugcacagcuuuucacaguuuguuuuuuuaauaugaguuaauuuauauuggugcuauuuuguaauauacauggacuucagcugggcugagggagaggaagucuuugcaaauuccugacagcagcaaaucuguuuacuccaaugauccuucugaauuucuccugguccuguguuaucuuugagauacuugccugggacuuguuuaacuauaaagcugagguugucaaacuuuuucggcaaagggccagauaguaaauauuuaaagcuaugccuaauuauuuuaggccauauggucucuguugcgacggcucaacucugucauugcagagugaaaagcaaccacagacaauauauaaaugaaugagcauggcuguguuccaauacaacuuuuugacugggcacugaaauuuaaauuguauauaauuuucacauaccaugaaauacuguucuuuugauuuuuuuuuaaccauuaaaaaauguaaagaccuuucugagcucaaggguuguagaaaaauaggcagcuggcaagauuuagcccugaggccauaguuugucaaccccugcugucacggggcaggucauuguggaaaagggagaaguauuuuuccugccugucuggggcugccgccuugcacagaccaagaggaguuccuaagccaucaugguagcaggugauccuaggaugguuucugguacugggaaugguuugccacgagcaacucacccauccaaccaggacguagcuauuucaauauucaucaccguaacuggcauuauggagcacuugacaauuugcagaacauagauuguauccuuuuuuuaaucaucagggaaauggaggcucacaggaguuaaguagcuuacucaaguucacccagacagagccuagcacagcugggaguccaaccccuguccuccgcuauuuccagcacaacccuugagccaacccaacagaugcugggcuguggcuaggaagccucuucucuccucugcguguggcucaguugggccacagggaugucugagcucugucuucagugucaccaguucuauguucuacagccaaaccaaagcaccugcagaagcguucgcaccaaccccacuccacacugugagccuggggcgggcagaagggcgcgcuccccagucagcaaagugacagucucaucuuguuuuucagggggugaguucacucgccaggcugaggugaccuucguggggcacccgggcaaucuggucauuaagcagcgguucagcggcaucgaugagcaugggcaccugaccaucgacacggagcuggagggccgcgugccgcagauuccguucggcuccuccgugcacauugagcccuacacggagcuguaccacuacuccaccucaggugagccccagcugugucccagggccagccccagaccggccacuagccucgugcucuugacccaccacggcagccgugaacuggggcugucucugggaucuggagagggaaauacaccgggccuuacagucaccuuccccucaauuauagacauaggacgcacuacuccuuguagagaauuuugugcaaaaaagacaauacgcaugaguuagaguuguaaaaccuggacauaauuauuaugacauuuaaguguauuucuuuucagcuuuuucuccagcaucuaucuauuuacauguauaugaaauaucccaacauauaauuucaugauaaacuaauuuuauuauacaucuauuuguacuuuuuuuuuuuuuugagacaggguuucacuccuguugcccaggcuggagugcaguggugcgaucucagcucacuacaaccuccgccuccugggcuugagcaacccuccugccucagcuucccaaguagcugggccuacaggcacaugccaccacaccuggcuaauuuuuguauuuuuaguagagaugggcuuucauuauguaggccagggugaucuggaacuccugaccucaagugaucugccuggcucagccucccuaagugcugggauuacaggugugagcaacugcgcccggccacaucuguauguacuauuaaaaacuacauuuauucuccauuuggugccugguuuuaaauaauaucaaacuuacgugaaaacugaacaaagcccaaaaaacguucacauacuauuuaucuagcuucaccaauuguuaacauuuugccacauuuacuuuaccauucucucucugucucucugucucuccauauauauauauauauauauguauacugaccauuugagaauaaguuguauauaucaugauagaucguucuuuaaacacuucauuuguuuuuccuaagaacaaggacauucuuuuacaaggccacaguacaguuaucaaaauugagaaauuuaacauggauacacagugauauguauaguuuuuugguuguuguuuguuuugagacgagcccucacucugucgcccaagcuggagugcaguggugcagucucggcucacugcagccucaaccuccugggcucaagugagccucccaccucagccuccugaguaccugggacuacaggcacacuaccaugccuggcuaauuuuuaaauuuuuguacagaugggguuuugccauguuacccaugcuuauaguuuuuauuuaaauaaaauugcaaucauaccacauuguuauaucuucaccuuuucaguuaaugucaaaucgugaauguuuaguagucucauuaagcagucuuugaaaacacuuuuuaaggaaucugugugauucuacuggauggcuauuaauucaaaccauucuucuacuuucuaaagcuuggguugcuuccauuuucuccucuuauuaugaguugaaaugauugucuuaaucauaaaucuuggccaaauuucugauucuuuucuaagacucaauuccuagaaauagaagugccgagucaaacaauaggaauuuuuuauuuuuuuaauuuaauuuuauuuuauuuuugagauggugucuugcucauguagagacccacugaauaauauucaugaacaugaacucauaugugggucauuaaaccccagguuaagaaucccuucguuuuuuuuguuuuuguuuuuguuuucugguuguuguuuugagacagggucuugcucugucaccaaggcuguggugcaguggugugaucucagcucacugcaacgucugcuucccagguucaagugauucuccugccuccaccucugaaauagcugggauuauaggcgccuaccaccaggcauggcuaacuuuuguauuuuuaguagagacaggguuucuccauguugcccaggcuggucucgaacuccugaccuccagugauccucccgcuucagccucccaaagugccgugauuacaggcgugagccaucgugccuggccaccuuuuuaaaggcucuuauuaaauugcuguucggaaagguugaagcaauuacuggaguuuuguggcuugguugaguucuccuggggagcugggagacagugaagaagaggaggaaagagcaacaggaccacaguugcggccggcuuguagcugaauggccuuucuggcgugugggagcuggacaggaggcagcuuacacugaucuuuuauuuauccucuggcuuuuaugcuucuauuauggagcaaacugcagcagagcacaaagauauaaagagucuuuuaugcuuuuuuuuaaaaaaacaggaaguugaggguuuugucguaugggccauagcaggcccucuucugaguggggaggacugucucuccucuccucuguucaggcuugcucacagugcuuuaguaauuuuuccaaaccuggcuacugaaacucauuuaauaucucauuuuuuugguauugcaggauggcuuggucuagaccgguauguagaaaucaccauuuauuggccagaaguagugccucacaccuguaaucccagcacuuugggaggccgaggcaggcagaucacuugaggucaggaguucaagaccagccuggccaacauggugaaaccccgucucuacuaaaaauacaaaaaaaugagcugagcgugauagcacaugccuguagucccagcuacuugggaggcugaggugggagaaucgcuugaacccagggggcggagguugcagugagccaugaucgugccacugcucuccagccugggugacaaggcgagacucugugucaaaaaaaaaaaaaaaaaugaaaaagaaaucaccauuuauugaaucauaauugagauaaccuauauaaagcaguuagcacguugugacagaguaaaugcucaguaaaugguaguuuaucuuacuaauacuauuagucugcuugauuccagaaauugcacauacauuaccuggucugauccccaccuugaccuauuuugugugagaaacugagaccaaagauguugagucaucagccaguggccacacagcuugugagugguacugagugugaauucaggggcgucucuuuccaaguguguguccucucaaccugaccuucaucucuaguucugggcgucuucaaaacuuacagagaaccacuugagagaaaagcaacaaauacacauaauacgaauaauaccaaugaucauauggggaauccagguauuucauagaaugagucucaauacaaacaaauggucuuauuuaagcuguucugucuggucugucaucugguagccuuaugggcagggaauaccacuggugccuugaaagccguugauucagcuucuugcauccuuaaccaucuucccucugucucccugccuuguccccuccauccuucccacucugcagugaucacuuccuccuccacccgggaguacacggugacugagcccgagcgagauggggcaucuccuucacgcaucuacacuuaccaguggcgccagaccaucaccuuccaggaaugcguccacgaugacucccggccagcccugcccagcacccagcagcucucgguggacagcguguucguccuguacaaccaggaggagaagaucuugcgcuaugcucucagcaacuccauugggccugugagggguaaggggauacagcucaugcugggcacaggugcucaugcauuuuuaaaaccccacucuuugacauuguuuuuggucucuuacucucagucuguagaagaaaauuaugcuaaaguaucuucuggcaggaaaaaaagaaugucuuguuauuuuugauucuuggaaaagcugccugucuguucuucuaaccaaaggccuauucgugauucuaucuaaaguaaagugcagaaugcuaaccuguugaggugccuuacagaguggacccucuuaaggcuacugcuggcauuggcagggcuuuuaaaacccuuuaauauucaaccuugaaagaaauuguaggccagguccaguggcucaugccuguaaucccagcacuuugggaggcugaggcggguggaucacuugaggucaggaguuugagaccagccuggccaacauggugaaacccuguaucuacuaaaaauacaaaaauuagccaggcaugauggcacgugccugaaaucccagcuacuugggaggcugaggcaggagaaucgcuugaacccaggaggcagagguuguagucagccgagaucgcaccacugcacuccagccugggcgacagagugagacucugucucaaaaaaaaaaaaaaaagagaaauuguagggccgagcaugguggcucaugccuguaaucccaguacuuugggaggccaaagagggcggaucaccugaggccaggacuuugagaucagccuggccaacauggagaaacccugucucuacuaacaacacaaaauuuagcuggguguggugguguguggcuguaaucccagcuacucggggcggcugaggcaggaaaaucgcuugaaccugggaggcggagguugcagugagccaagaucauaucacugcacuccagccugggcagcagagaggggcugucucaaaaaaaaaaaaagaaaaagaaauugugugguuagugccugaggaaauugaauaaaauuagggagggagccuaaaagaaacgcuugcccugugacucugcaucacuggcgcugcggucuggucugugggcguucccagcugucgggaaggagcugagguuuagggagcuuuugugacauaccagugucagacuucacauuuguccauaucuuuaagccucagggguccuguguaauuggagucuggucugagccuuaaaaucuuucccuuuuuucgguugucuuugauucuuccuccauauccaaaucauugcucuagcuaauuaauuuguccucacuuuaacuuuaugaagcagaaagaaggcaggcauucucccuccuauagcaacuguggcuccaggcaucaggagucagugcauucuuggugaaggaccagauaguagguauuuuagguuuugcuggcuauacagucucuaucacgacaugucagcucugccgugguagcacaaaugcagccauagaccauacauaaauaaauggacguugcugguugcuaauaaaacuuuauuuacaagaacagggagggggccaugcugguccugccccagggcaacacaggaauuggcuggugucccauuccacucugcucuucugugaucaccuucuugcucaccaguugugguugacuuucuguggaaggaggaaaccugcaagagcuccugaagacucacuugguuccaaugucucugucuucacagaaggcuccccugaugcucuucagaaucccugcuacaucggcacucaugggugugacaccaacgcggccugucgcccuggucccaggacacaguucaccugcgagugcuccaucggcuuccgaggagacgggcgaaccugcuaugguacagccuuugauucugacuuguuggggcugggaaaucaggcgaggaggaggcauccacguucuguaaaccagagaacugggugcagcaaggaagcacggaugagauaaauacugguggacaugccaggccugaauuauuuaugcuucacauucacuguucccguggguaaacucgggaguacuggcccauucuuuugucugauuaagcagcagaguagaauuccuaaggccacacuccacuccgucuuaagaaugcacagguuuaaaaggaguuguaagucagagcuguuaaugauaacaccaguaauauaacaauagcuauaauuuacccaggcacuguuugaacuaagugcuucacaacaucaucucauuuaauucuccaacaacucuaacaagauggauuuuuuguuccuuuuuaaaaaaaaaaaauuguuugcgguaaaauauacauaauauaaaauauaccauuuuaacacuuuuuaaguguacaguucaguggcauugcaugcauucauuuuauuguguaaccaucaccacuguucaucuccagaacucuccaucuugcaaaacguacucuguacccauuaaacaacaacucacauuucccccuuccuucagucuuuggcaaucaccauuccacuuucugucucuaugcauuugauuauucuaacgauugcauauguggaaucauauuuguucuucugugauuggcuuauuucacauagcacaguguacucaagugucaccuauguugucacaugugucagaauuuuuuuuccuuuuuaagguuagauaauauugcauugcauguacauaucacauuuuguuuauccauccaucaguggacgcauggguugcuuccaccuuccagcuauugcaaauaaugcuguuaugaacguggguaugcaaauaucuguugaaguuccugcuuuccguucuuuugggcauauauucaaaagugggauugcugaaucauaugguaauucuaucuuuaauuuuuuuuuuuuuugagauggcgucuugcugugucgcucaggcuggagugcaguggcgugaucuuggcucacugcagccucugccuccugggcucaagugauucaccuacuugucuccuaguagcugggacuacaggugcuugccaucaugccaggcuaauuuuuguauuuuuaguaaagagggcuuucaccauguuggccaggcuggucuggaacuccugaccucaagugauccaccugccucggccucccaaagugcugggauuacaggugugagcugccacgccuggccuuuccaucuuuaauuuuuugaggaaccaccacaauguuuuccacaggggcugcaacauuuuauguucccaccuacagugcacaagcauuucaauuucuccaucuccuugaaaacacuuguuuucuguguuuuuuaaaauaggaggccaggcgcaguggcucacaccuguaaucccagcacuuugggaggccgagguggauggaucaugaggucgggaguuugagaccagccuggccaacauggugaaaccccgucucuacuaaaaugcaaaaauuagccaagcaugguggcaggugucuguagucccagcuacuugggaguaggagagacaggagaagugcuugagccugggagguagagauuucagugagccaagaucacaccacuccacuccagccugggugacagagugagacucugucucccaaaaaaaaaaaaaauaggggccauccuaaugggugugaguuucauucuccuauuuauuuauuuauuuuauuuuauuuuuauuguuuuugagacagggucucacucuguugcccaggcugaagugcaguggcacaaucuuggcucacuccagccucaaccuccugggcucaggugauccucccaccucagccuccugaauagcugggacuacaagugugccaccaugccuggcuaauuuuguauuuuuuguagagaugggguuuuuccauguugcccaggcuggucucaaacuccugggcucaagcaauccacuugccuuggccucgcaacgcucuuuucuuguagacaagaaaacugaggcucauuaaagugagccgugacaaauauaguauuugaacacaagucucugacucaagcaucguauuacuccaucuucuaguugcaguuauuuuauuauuuauaacuuaaguucaaauacuuucauguaggcagcuugauauuuguuuguuacuaaauuguaaucuacugccaaggggaagucaguccacuacuaagggcaagaaugccaagugcuucgagcagugcuguuuaagucugcaauuagugagagggcucacuaaugagcauaaggaaugcuagaaguaagcuucccuggugggaugaauaguguguucacauaugguuggccaggaaaaugaacagcucccucuaccccugcuugacagagauauaagaaucuggcaagcccagcagucucagaauucgggaaucaugccugaggucuggaauccagcagccgcagcuaauggcagauuuggugugcugauguaacaugaagguuagaagauccugcugucagggccucgcgguguuggcuucauagugaaccuuucaugcaaggugccugucagggugucugaaauacuggagggcaggaacuugugcgcauagugcaggcuguauguuuggccagcuugcugauagcuuuguauaugugguagaauucagucugggacuuaccuuccugguaacguaucgcuagggaggggacauagugccuacucaccugcaaucgucaguuucccaguauuuccugcaaagagccugacagccuugaauggcugaauuggcucuggccaguucaaagcagcaugaugcugugugugugugugugaacgggagcccucccaggcugugagacggcuggcaugcggggauggggcuccuucaccgauccaugccuccucauuacacagcucugcuucaacuucguaagccuccuggauaguaauaaggugcagaaguaacccagucugcugcuguugaacugugaccucguggcuaauucugcccuuggugccugagcuugccacagugggagugcuucacuucagaaggcacaaccagccauccuuuauguaaucugcaccauccuagaaaauccuccgauauccuuguccagaaagacagguggucgcauguagacuugcuuuuguccuguggugagugguuguucugacuuauuaccuccguggaaugcgaguguauucccagucaggacacuuauuguucugggucacuagaacaugccuugaaguguuaauguaucgagacaugaggcuuaaaauaggaaauugcauuaagcagaucacuucauguguuauuuggacuugggaagugcguuagaggagaaugaggaugagccuuugugauucagugugugcagcgcugauaugaugguauaugacaccccaaacaagggugguuuuggugagacgucgcacagugacucuccacaguaauuuggagacgauuucacagagcucugugauucacucugguccauggcaggauggcucccgcuguuucucaauuuagagcccguagagauaguuuuggcucaucucucauugaguaaucgucgaguauguagaaggcauuuagcaaauugguaaugagacucuucuccucuaagagccuggccuuuauaaaagggaaaaauuggagaaacuuagaguuguugaaaauaugugaaaaguagccacucugaaaaaagucaaaaaggaggcagcaaugacaagaaugauccaggauuuuccuauugaguuagaaagugauccugugaaaggaaaucucuuuccagagaagagguugaccagauguuaaauaauaagaauaaucauuuucuagcagauacugugguauguuaugagagacaguuauugccaguuuucaauaccacugaagaaaggguuaaggaccuggcuucaauuuauagaaaagaaguuuguuuuuguuuuuuuuuuuuuuuuuuuuuuaaggcagagucuugcucugucgcccaggcaggaguacaauggcgcaauuucggcucacugcaaccuccacccccuggguucaagcaauucuccugccucagccucccggauugccggaauuacaggcacaugcugccuggcuaauuuuuguauuuuuaguagagaugggguuucaccauguuggucaggcuggucucgaacuccuaaccucaggugaucugccugccucagccucccagagugcugggguuacaggccugagccaccgugccugguccuagaagagaagauuuaaauuauacauuaggaagaauuuccaaacugcaaagaccguggacuauuagcucagaaauugcuagggucuugucccuuaagaaaggguguugucuagucuggcguguauguguaagccggcauggagguggagguugugcuagggaaccauucccuccaucaucccagcagcccugagguccuauuugucaauagcuuuucagguagggcuagagagaagagccuggucacauagaagcuuuuccaaaacacagcuuccccuugcguaaauguucccagggaggaacagagcuugaagaagauccccugugauuuugcucugucuucuugauugaaaacugcugcucugugcucucgugcuuuggcaaugcagucuaagucacugagcccugcaauauguacaauguuuccagacaucugugcugggaguguccucugagaguugcagcacagaggcaguggacacaggaagccccuuuuuucucccauguugcagcggcagcugauggauggagcugugaaguccaaacgugcugggugcacuccucccccacagccuccccagcuccagcuugcauaacagccugcuuugggaggggcuuuguuccagaaccuucuggcagugccugguucaguccugagaccuugugucuuaaacacgucacagaacacgcacauaucaguauaaucucuaaaaguugaagagcauuugguuuggguauuugccuggguacaggacaaacuaugaggcugaugugaucaagaaugcuugucuugugcaauguugaccaauaggccaguaggacauuugucucaccaauaaaggccuggcuagacuggacauugaagguggacauaggaggcuuugacucccacaugucaacgauucauaugaaagcgcuggggaagagauuuaugagggggagaagagcuguguggucucggccauuaugagaaacaugucuuauuuguuuuaggucuaaaacaugucuaaauuuguuuuaggcuaggggcuguggcucacgccuguaaucccagcacuuugggaggcccuccucaugcacaucucaggguuuuagaaaugccagaaguagcugucuacacucugaguaugagguugacgugggaaggaccuuguguaacuguucauuucaacccaucaguggccacauaaccagggggaaugacagguuagcucaguuucuugccugggcccaccagccuuacacaagugguagccacagccuggcccccaaagccuggcggccaucugaggggcguguucccagaguuagccaaauucaucaccauggcugggguguuggaugaaucucuaguuaguauaaucauagcugggugucuggaacauuguugggugcuucucugaccuccauccauuuuccguaaucugcagaagaacccucaagaugaguaguaguauacuuauuuaccaaagggagaacugaggcugaguaguuggauaacuugcccaagaccacacaaguuaauagcuaaaggaagcaggauuugaaccuagcuauguccaacuccaaagccuauguuuguuugcuccacguuaccccaugaugguggcuguaguauugucauauaaaaggacaucacucucuuuguucauuuacaaucucaugagugaaugacuucccuuuuaguccauuaagcccuagauaauauucaaaaauucacaauuaagcuguaaauuguucaauuuuccuuuguaacaguaacagagaaaguaauauuuucgaauaauagcauauuuaaauauacucucaaguuuaggauuugaaaguauauuuaauauucagagacucucaguauucagaguccagagaugugucucuguguccuuguaacauguauuuggcaaucuaaugggaaagacucguguucaggggccccaggcucagaaauuaacucuaggagaggugggggaagcacacguuuccuuaggagaaaggcauggggaucacucucuccaguuaugcacagacaaaaauuguauuuaacacuacuuuugauacauagaaaauuuauuuuaggcuaggggcgguggcucacgccuguaaucccagcacuuugggaggccaaggcggguggaucacgaggucaggaguuugagaccagccuggccaacaugcugaaaccucaucucuacuaaaaauacaaaaauuggccaggcgugguggcacacacguguaaucccagcuacuggggaggcugaggcaggagaaucacuugaacccuggaggcagagguugcagugaaccgagauugcaccauugcacuccagcucugggcgacagagcaagacuccaucucggaaaaaaaaaaagaaaauuuuguuuuaaaauugaucuauucuuaggugacaaugcuauuuuauuauagucaguaauguuugaagagcuuuaaaaaaaagccugcaguaaaaaaaaauuuuugcugcagauauugaugaauguucagaacaacccucagugugugggagccacacaaucugcaauaaucacccaggaaccuuccgcugcgaguguguggagggcuaccaguuuucagaugagggaacguguguggguaaguucuccagguaacuuuucgaaacaguauucacauggugugcauuagcucuuaugcaaaaguucuggucccagguaaaaugagucuggucaaguuggaaggugcugggaagagcaauuuauaaagaugaaucagacuuagccucugcccuccaacuaucuggagagucacaaguguaaugaguaagcaacauuauugccuacacuaguaauaccaucgccucaccuguugccagcuuuugcauuacauuugccucuuauaaacuucuuuuaaucauuuucauuaugcuuuuaauaacuauaagcuauuagacauguuucuuccaguaauuaguagccuugggguucacauugagggagcaccuuauagguacuuuuggaucauuaccuaucuuagauugaauucuacuuuaguuacaccuaaaauuccaacuggggucauucuauuuauggauuuuaauuuuaccaaccacgagcagcagcauaauuucuuagccuuauagaaguaaguugcggcuauuaauuagguuaauuaugcucuugcugaaugaugauuugggugaugaugaggaugggucagccacgaacagccagauuguuuaaauucuuccucuuuuuccuccugcugcacuuugaccuggucguucaagauucuuguucccaggucuggagggugccaugucaaaugcgcaucugaacucaacaugucuucccaauuuaaaacagauuccucuuguaccaugucagcaaaccaucuucuugccucuuccucacuguucgcuaaacccuagaauguuuucuuuuugcucugucucaaagcuuggguaagccugccaaggucguggggugagguggugucuugagggugggagggaacaggcaguucucauauuuugagugugacccaaacaucugugagcucagggaggccaguccccucugcacaguugagauuuucacucugcugaaguuacuucuuuuuuuuuuuuccucaguagggaacaucaguuucuguguauuugaccugauuucuuucucugcuuuuugaggcuaagcagauucaaacguuuaauuuuaauggccauaccauuuacauuacacuucggcucaagcuugggcaguggauacuuuaucccuugggugcugaugugcacaguaacugagauccauccugggacaccuguguggagcauggugaccuggguuucuggauccagucauuccugauguccacacucacugaaggggcaggcugggaugcaagacaggugcugggcaaaugucugcuucagacauuuacuuuugaggaagacaaccucucuggggcucaguuccucgucuguaaaaugaagugauuagaccggaucauugguuuccugugacccauggagcucuuggaggugccucaggagcugucaaggaggacacaggccagcugugggcaggcucuuguccucuccccugagcucuagccucccuuuuuuuuuuuuuuuuuuuugagacaggguuuugcuauugucacccaggcuggagugcaauggcgcgaucuuggcucacugcaaccucugccuccuggguucaagagauucuccugccucagucucccaaguagcuggaauuacaggcaugcaccaccacucccagcuaaguuuuguauuuuuaguagagacgggguuucaccauguuggccaggcuggucuugaacuccuggccucaggugauuugccugccuuggccucccaaaaugcugggauuacagguguaagccaccacgcccggccuacauauuugagggagaacaucuucaccccuuuuaauuggcuccuuugagacucacugcgcagagagaaggcucacuguagaaccaagucugccuacacgcauucaaagaaauaacucuggcuugucacugaguaauugaguggucauuccaucucucuuggaauuccuuguugaaacaguguucuaggucggaagccugcacugggaagguuacccugcaggucagaauggggcaaggugaagaaauaaauggggcaaggugugcucugccaacugugaggggcugggggcucaggcagggccuguggacugaccaggaggaauucucuuuucaugaggauugguauccauuaucggggaagggauguuuguggacuuccaucuuuggcauuuucuguaaacucauaacucucuuuuccacugggaaccaacuuuugcaguuaauugaaaugugcaaaacauguuuuugugaaggaaaggugggccucagcuugcccauaagucagcuugaugugaagauguagauaccccucugaauggacauagcccugugacacugggcuggcauauggaguguggugaacuugagguccuacuucuccuccccuaggcaucuuggugcagggcaugauggcaugcaucagcucuucucuugagggaagaacagggcccaggcuuaggcaaaaagcuguagcaguuaacuuccaguaugccaagcacagagaggccaguagaugggacugugauucucuuaaggguccugaugauagaacucauggaaggagggcugaggaggaggugagugucacagaggcuagcugauaaugccccaucuugugcuguugccucaagauggaaggcaaagguugaggucuacagggugauuuucagcugguucaguuacucugggguuccuaaggcaccauugcauuuugcuucugauuuucuaaaagaacucagagccaggacagagucccauccucacaaugucagaacacaaaucauucccucccaucaggcuuuguguaguuggauuaucccagaugaaggaggacucauguuuuuccuccaugagucuucuuaagauugauuucaguuuguccuaccuuaagugcagacagacagagaaagagagagagagaguugaggggguggggggaagaacauaaggcaauuuaucuaaggccaugugguugacccaugguaccugguauauaccaaggcugccuacuccaaaggcucacagucuuccaaccauagcugucucccugccuuagaaacauuuauuuguccuuccuugguggcaagugggugacugacuugggcauuuguagugaauguuccaccuguacagggugggccaaggcugaagacaccacauggaagucucagcuccuuuccuccaagcagucucaacagaguugccaucagaaguguggcaucugcagaugucccacccccauauccagaugaagggaaaguuggguccuggggaccugugauggggaucuaguuuggagaguggccugagacagacccccagagugaaacugaggucaagccagguggaaugacaaaccacggugucagucagccaagacccaucagaggcagaacccaggugggaggaaacggugaaagcaguaguaccagcccagugaggaguggggugcaggugaagcuguggacaugccuagaggucuaggguccaggcauggucucucuuuauagagcugggaggggcauguggccugcucaggggacuuucuuccuaagacugugcaucaaccuuuuguucugaagcugucguggaccagcgccccaucaacuacugugaaacuggccuucauaacugcgacauaccccagcgggcccaguguaucuacacaggaggcuccuccuacaccuguuccugcuugccaggcuuuucuggggauggccaagccugccaaggugugugguugcucugaucuuccccuguguguaaccugagaaaguuuccuaggugguaccugucaugugccaaucaccaacucacucccaaauagaagaaagaauucuucugucaucuccacagaguaaauguguugcuuuuuauaucucucuaguaguuugaacuaugcauuuucuuuugggggcuauucucauugaugacuguuuuguucuaggugacuaguucauucaggugacaauuagacaccugcucucugcuaggaaccagggauauuuucugucuuucacaaagagacaaacuguccuuuuacauggaggacaugcauggagauuaaagucuauccuuuuauuuaauaagauguauuaacauguagccauucaacuggcuuguucuaaccuucuccuucaaaaaagcaaaguucucugauugaauaaaugacugcggagucaaaguauaaaugacucaauagaauccuucagacuugagcuucuuggcugccauuguucucuuacagguaauuuuagguaagauagcccaucaauagaguacccugaguuucuugguuugcacaauuacuuaauauuauaccauagaguauuucuaaaaagucccaacuaagauagaauuucugagauacuuucucuuuauuacugaacaugugaauauuuucuuuucacugaggguuuucugccuagcaguuaauaaucugucaguaaacacucagacaguuuugaagcucucauuuaugacaggagggagaauuuuauaauacaaauagauccuaucuuuuccccuguuguaagguugaugaaaacauucuuuucuuucuuuuuuuuuuuuuuuuuuuuuuugagauggcauuuagcucuuguugcccaagcuggagugcaauggcacgaucuuggcucacugcaaccuccaccucccggguucaagcaauucuccugccucagccuccagaauagcugggauuacaggcacgugucaccaugcccagcuaauuuuuuauauuuuuaguagaaacaggguuucaccguguuggccaggcuggucuugaacuccugaccucaggugaucugccugccucggccucccaaggugcuaggauuacaggcgugagccacggugccuggccaaaaacauuuuucaugaaaacauugcugccaaagugaaacacauuugcaaguacgacagauagauauuggggaguuagugacuugauaguuaauguuuagugaguuuuggauuacuguucccagaucagaagcagguucccauagauuugaguaaguggcuuaaauuauuggguaaacuacgaauuccagaagaaaucucauugucccugggccugguggcuguuuuacagauguagaugaaugccagccaagccgaugucacccugacgccuucugcuacaacacuccaggcucuuucacgugccagugcaaaccugguuaucagggagacggcuuccguugcgugcccggagguaagguggugggacaucuggagucgguagcccauugcccuguccaugaaugcagagcacauggcccauugcccuguccaugaauccagagcacauggcccguugcccuguccaugaauccagagcacauggcccguugcccuguccaugaauccagagcacauggcccauugccugcccuguccaugaauccagagcacauggcccugggagagaaggugaggcgggaaaguaggaggcuccauggagaguucuaaggguuguugaggugggagaucagagcauggacugcaauguagagcauucuuugaaaugguagaacaucaggugggaacauugccuauaaucccaauacuuuaggaggccgagguggguggaucacuugaggucaggaguucgagaucagccuggccaacauggcaaaacccccucucuacuaaaaauacaaaaauuagucaggcguaguggcuugugccuguaaucccagcuacuacggaggcugaggcaugagaaucacuugaaccugggaggcagagguugcagugagcugcaauugagccacuguaguccauccugggugacagagugggacugccucaaaaaaaaaaaaaaaagaaaaaaaaagaauauauuugacaccuuagacuggaguuaaccaguuguguuauuuauuuuuaauuacugcugcuguuguuggucagauauauucaugccacuauaaauguuuucaauuagagauaaguaaacauuuucaucccaucgcuuuuuaagcaguuaaaaacuuuaaauaaccauccccuucacuagccugugagcacauugaggaccugugagcucauugaggaccugugagcucauugaggguggugcagguacacuuuuuuuuuuguauguuuccaguacccaguggaguguuugguauaugguggggcucacagcuauuuacagcuguugaagaaauaaaugaaugcaucagcuccauuccuacaacagcauuugaaaauauuuguuuaucuucacucucacuaagacuaguuuuuagaguaguugucuaucaaaaaagagaaaauaucagauuaagauuuaaauuuugauguauaguagcauauaucguuagucuaaauuauuuucuucugcuuaaaauggggcuuagcaaacuauggcccaugggccaaaucuggcugucuguuuuuguaaauaaaguuuuauuggaacacagccaugcuuauguauagucuauggcugcuuucguguuacaaaggccgaguucaguaguugugacagagacuguaagcucugcacagccuaaaaagcauaaauaggcugggugccauggcucucgccuguaauccuagcauuuugggagaucgagguggacagauuacuugaguccaggaguuugagagaccggccugggcaacauagcgagacccuguuucuacaaaaaauagaaaaauuagcugggugugguguggcacaccuguaguccuagcuccucggggggcugagguaggaagauugagccagggagaucaaggcugcagugagccaagaucacucuacaccccauccugggugacagagugagauucugucucaaaaaaaaaaaaaaaaaaaaaaguauaaauagccuacuaugugggcucuugacagaaaaaguugcugacuccuggcuucgauaaaccuaggcaaggcaaccuuuuguuccugaaauuaugggaacaaauaccacuacucauagauuuuaauaggcagguuacauagagaagaguuuaugaucauuugagucaacacauuccagcuacuauuaacaaugacuaauauucauuauuuccucagucuugcuucacaucuccaguuuaaagagaagcagauguuuccaauuuuguuuuuuuguuuuuuuaaccugacuuuuuguccccucuugaaaacucuguugacuaaacagaaacagauccaggcguguaggcuggaaucuaaagaugggacaaaguuaaaaccaauaagggcugcuugccaggauuguuuagauauuggaucuuguucccuuaagaaguuuaacauuugguuauauacuggagagaguguucacuagaaacguguaagaauguucauugaguuuuguuuguaauagaaaaaaauauaaaugacugcaaacaagaggaacaaacagaugacuguugguauaauccauacaaugaaaugacauaaaacaguuaaaaugaaugaacuagaguucagggguaagucucaaaagcguaauguugagcaaaagaaauuauaaaaggauauguauagcauggccccauguguauaaaacauaagccuaugugaaaauauaccuacauguguuauguuauguacauacauaagaaagcuacaacaugcauagugaaugagaaaugaaaaguucagggcagagguuaccucuauaaugggagagagggaauugggacuggggaggguuacauggugugucuuagucuguuuggggcugcucuggcaaaauaccauagacugggaguuuauaaacaacagaaacuuguuucucauaguucugaaggcuggaaagucugagaucgacgugcugagaaguugagugucuggcgaaggcucacuuccuaguucacagacggccagacaucuuucugcaaaguccuuauaugguagaaagggcaagaggucucuuuggggacgcuauuauaagggcaccacuaaggccauucauuagggccccccuuucaugaccuagucaccugcugguggccucacccccaaugccaucaccuugggaguuaggauuucaguacguggauuugggagggacauaaacauucacauugcagcacaagagcugcgucugcguuucuaauguuuuauuucucagucggaauaugaauacacauauuuucaucauauuauucuaaauuguauaugacuaaaauacuuuaugaagacuggacacaguggcucaugccuguaaucccagcauuuugggaggccaagguggguggaucaccugagguggggaguucaagaccagccugaccaacacggagaaaccccgucucuacuaaaaauacaaaauuagccaggugugguggugcaugaauguaaucccagcuacuugggagccugaagcaggagaaucacuugaaccuggggggcagagguugcggugauccgagaucacgccguugcauuccagccugggcaacaagagcaaaaucccgucucaaaaaaaaaaaaaaaauuagcugggcgugguggugcaugccuguaaucccaguuacucaggagguugaggcaggagaauagcuugagcccaggaggcggaggucacaguaagccaagauugcaccacugcacuccagccugggugacagagaaagacuccaucucuaaauaauaaauaaauaaauaaauacuuuaugaaacauuacacagagaaaaauaaugcauagugucaucuggucuccuggugccuaucauaguaaaggacagggaucauacagcacuuauuugguacuuacuguauacagaaggggcuaguuuccaaaagaaaacuaaacuggcuuugaaggugagccagugaagaucauggcuacugaaaugucaacugaugacagacaaacuacgagaaauugcgauuuguuccucuuugucuucugcacgcugcuccacacccuguguauggauugugaaguuaguuuaguggcuugcuguucucacuuucuuuuaaauggcauguugaaauagcaaacaauaaucuagaaaauaucagagugaggagaauauauguaguaggaguaaguauuguuucaugaagcaauacuuguauguauguuuguguaugugcaugggugagugcaugccagcaugugugcgugugugugugcacauguguaugcgugucuaagugugcaugggcugguguacugggaugcugaguaaaaucuguuucuuucuaugggucaugguuagaaguuagaaagccaccauauuaguucucuauuguugcauaacaaaucauccccaaaguuagccacuuaaaacaaugaacauuuauuuucucacaguuucugugcgucaggaguucaggagcagcuuuccuggguggucccuggacccagggacucucaugagguugcugcugagacauuagucggggcuguggucuucugugauggcaaagaaggaucccugcugaaggacccgcaugguugucagcaggccucaguuccucgcgacaugggucucucuacagggauggcuaagugucuucaagaucuagcagcuggcccccuccacagcaagucaaaggagagagagagagagagaaagagagacugaccaagauggaagccacagucuuuuauaaacgaaucuuggaagugacaaguaucgcuucuguugauaccaucagucucgggccaucccucuugcagugugacaggggucugcccaaguauggaagaccaggcaguggggagaaugagggccaucuuggaggucggccaccauagccacugacccugaccuugccuggacaacaucugagggaauguaacuggcuagguuuuuguaacauaggggaguuuauuagaggaucaaagagaggcauuaaaugucuugggcuagaaauguaaaaccugguccaggaguuuaagaacacccuggacaacauagcaagaccccaucucuaucaaaaaauuuaaaacuucuaggcauggcauuuaaaaauuagcacacaccuguaguuccagcuauucacaaggccgaggcaagagcaucacuugagccugggaguucaaggcugcagugagcuaugaucgugccccugcacucuagccuggggugacagagcuagacccuuucuccaaaaaaauuuaaaaauaauaaacaaaaugaagcuuucccucaacccugcaucccucucucacugccauccccuccccauccuucccuuuauaguuuaacucuucaucaagguugucuggaauugcugccuccacuuccuccucucucaucuuccauuuuuuuuccuaucuuuauauuguaaaaauaaaacauagaugcaagcaauauguaguucaaggaguuacucuaaggugagccugguugucacuaccacucagaucuugaaguagagcuuuaccagcagccccaggagccccaccugccccaaucauagccuccucucucuccucaaaagcaaccacuaaccuggcaucuguaguugucucuuccuugcauuucuaauagcuuuaucacacuugagugcauuccuagucauuguagguuuggugcugcucauuuuucuaucuauaguuuucuucuccaucccuuuccuuuccuugcauuuggucuguugaagaacccaugccuuuagaucuguaguuucccacagucuggaucuugcugauugcacacucauuguacagcacuacacacuccuuuguccucuaaauugucugcagauugucagaugcuugaucagacuuagguucaauccuuuuggcaagacaauaggugguggugugaucuuucaucgggaguguaugucugcuugucucacuuuuugugauguuaggagcuauugaugauuacugccuagacccauuaauuucuagggagggucaaauggugauauucuaauuucaucauuacuuucucauuuauucauuggaauucaugcucauuauuaccuggguccacucauuucuaaugggggggagcaaaauggugauagucuaauucuauucacugcaaugaaauaacagcuaaaacuguauuuguaauuuggaaguagagagguagcuuuauucgguauauggguggagaagcagaggacagucagucucccaagagaaaaauaaagcaagugagugacaaggagacaggagcucuuaguuccugacaguugucuauuucugguuccagucccuuuucugauucacaugacauaacuauauuuucauaauaaauucuuccuuuggguuuagguuaagucagagugguuccuguuacuuuaguuaaagaacuuugacagugagggcacugugcacauuuaugaugauauuauuacuauuagaaagugcaggcuggauaauuagcuacuaugcucuguacagaaguuaguugauguuuauggauuuuuguucauuuuaaaauucagauaagcuauguuuuugaccacuuuuccuuucugaugugucuucauuaaagaaugccucccuaaaauaauaugaauagauaucuacuacaucaaacaguaguuuaaagaagugaaauuuuuaucuaguggaagggguaauacuaaaguaauaauagcuaacacuuauauagcacauaauuuuugcccaguauuguuuuaaaaauagcaaaauguaagguaaauuagaagaaaucuuuuuaguaaaagaaauuuucugucaaaguguauggcauaugaaucauuuugcaaucagaaaaaacagacaguugguucaaauaucuugagaguugugucuuacaaaauuacgaucguguguuauuuaugcuuuccaaaagcaguuguuuagguucuuguguuuagacugccaguaaauaugcuuucagcagaacaaaacacucuugcaucuucaaaaauaaaaaaaaaaagcauugcaauuugcuuuugagauuuccuggcucucuccccaccccccgccuauaucugggccuucucuuaccuggucucugcuuacauuuuuuuguuuguuugcuuuuguuuucuugagaugguguuacccaggcuggagugcagugguaugaucucagcucacugcaaccuccaccacccagguucaaacaauucuccugccucagccucccgaguagcugugacucaggcgcacgccaccauucccagcuaauuuuguauuuuuaguagagaugggguuucaccguguuggccaggcuggucucgaacucccaaccucacugauuugcccaccucagccucccaaaguguugggauuacaggcgugagccaccgugccgggcuccauccugcuuaaguuugaucccacucucagcacugucuucccagugugaugcccugacagcccggucaauuuccuagggucuagcucuucuagccccuuuaguuuuuaacuuuuuuuuuuuuuuuuuuuuugagacagagucucgcucuguugcccaggcuggagugcaguggcaugaucucggcucacugcaagcuccgccucccggguucacaccauucuccugccuuagccucccgaguagcugggacuacaggcgcccgccaccacgccuggcuaauuuuuuguauuuuuaguagagacaggguuucaccguguuagccaggauggucucuaucuccugaccuccugauccacucgccuuggcuucccaaagugcuggaauuauaggcaugagccaccgcgccuggcuuagucuuuaacuuaaaggaagaaaaacccucccaguuuugcugcuguuuuuacauuggccugcagugccuucuagagugccuguuagcgcuggggcuuuccuguucccacacugugagaugcucugccccuuuccucugcugucugccacacaaagaugacaaguugguggugugucccuucacccuuccuuaucaccguguugcuuuguaaaugcuacccaugggcuauggauuuuguuaccuaguuaauccaucuggaacuggacucuaaaaaguaagcuccugcauucuuccagagucucucauucucucucuaaccacugcagucagcuucuuuccccaccacaacacccaaacugcucucguaaaagucagcaacaacccucccuuuguuagaucugaggccucauuucuuuuucuuuucuucuuguuuuuuuuuuuuuuuuugagacagagucucacucugucauucaggcuggagugcaguggcgcaaucucugcucacugcaacaucugccuccaggguucaagcgauucuugugccuuggucuccugaguagcugggauuacaggugugugccaccacgcuuggcuauuguuguuguuguuugggacaggaucucacucuguugcccaggcuggagugcaguggcugcaucucagcucacugcagccuccaccucccggguucaagcaauccucccaccucagccuccugaguagcugggauuacaggugcuugccaucaagccaggcuaauuuuuguauuuuuaguagagacgggguuucaccauauuugccaggcuugucucgaaauccuggccucaagugaucugcccaccucugccucccaaaguucugggauuacaggugugagccaucgugccuggccugaggccucauuucuugauagcacuuggcacaauuggucucgcccuccuuccugaaacacuuucuucauuugguauccaggacaacacaccucaggguuuucugcauuucuggcuggugcacgucacugcugguacgauuagccccauugaaugcaugaagauauggggguuagagagacuagauaauuuguccaaggcauccaacuaacuaguagcauagccaggaccaauaguuaaauauuucuuaagcaucucuugugugccugucacugugcuugacacaugaacaguaaaacgucuccacccuggaggagucugcacuguaacugggcaggaaaagggaauacuugaaauuaguagugaauaacuaccggucguucacuaggagugacaacuaccagucguucacuaggagugacaacuaccagucguucacuaggagugacaacuaccagucguucacuaggagugacaacuaccagucguucacuaggagugacaacuaccacucguucacuaggagugauaaccagugauaacuagcagcaggaagcagagaugcaggugggcuaaaaaagcuggggagagugagagagggaggauuugcacucagccuugaaggacaggugagauuugaauaggagacagggaggaauaaugaggaggaggggcagucaggcaaaugggggaguugauguugaggaggguccaaaccaggccacccaaaggcuugacaagcucccggucuugaugucuguggccacgucugaccgccaccuccuucccuugugacucucacauggccucguuuccaaauccgcggagugaucgcugagccugugguuccuccaucccuucuuuuucuugaaguccucucuaaccuaaccccaggaagcacaaaggcaaccguccucaccaaugcuuggaauuucuugacuuccuauccgucugcacucucagccugcaaagcucuugucuuaaguccguucagccacugcgccuaggcugcuguggcuggguguauuggacacaccgcagauuuaucgucauuuuuuguuuguuuguuuguuuguuuguuuguuuuuagacagagucucgcucuguugcucagacuggagugcaguggugccaucucggcucacugcaaccuccgccucccggguucaagcgauucuccugccucaaucucccgaguagcugggauuacaggcaugugccacugcgccuggcuaauuuuuguguuuuuaguagauacgggguuucaccauguuagccaggcuggucucaaacuccuugccucaggugaucugccugccucaucuuuccagagugcugggauuacaggcgugagccaccgcgcccagccugauuuauugucuuuaaugucagccaagcccuugaccaaggcagguguggugcucuuccucucugucccauagcagccuguccagaccacagccagccgcuucucccacugugccacugaccagggcccucaucuuuugcacuagccuguacaaucaaggacucuccuauuuagcccuugcagggcgccuggcugauggcagcuuucacuaaaugcuuauaacacuagugaguaagugcuucacguguccauggggcucuugaccugaagcguaugaugacuacagugauuuuaaaagcccugcugugguagaauuuugggagaggaaggcagcugggagccaagagcugcuccaggaaacaggugugaugaaacucaacaaugcaguuucacacugugacagaagagacugcacacagaggaggagugcaagcucucuuccaugcugguuuacgaccuuucuguuuucccuucuuuguuugccuuuuccuaacugcgaguucagugccccucccuggccauucgucuuccucucuagcccugugagaauggggguaaauguugggaagggacaugaagagaguucauaaguaaagaaagcuguuaucaccguuauugcuguugcuaucacuauuauuaguaguguuguucuuaguggccccuaggaacaugaggaugaagaccaugucagauggacauugcccccuugacuuguaaauucuccuucuuggaaauuuggcagucuugcuuggacuaacaagugucuauuuggcagugaaugagauggggcuauaagccagcaaaaucucaaagccaggcugggcgugguggcucaagccuguaaucccagcacuuugggaggccgaggcgggugaaucacgaggucaggaguucgagaccagccuggccaacaucaugaaaccccgucucuacuaaaaauacagaaaauuagcugggcgcaguggcaggcgccuguaaucccagcuacuugggagacugaggcaggagaaucgcuugaacccgggaggcagagguugcgguaagcugagauugcaccacuucacuccaggccgggcgacagugauauucugucuccaaaaaaaaaaaaaaaaaaucucaaagccagcagagaccagggacuguucacugcaccugagugaccuuguccagagaugugugucccagaggugcaugcucagaacccguguaggcccugggaguagcugccucuguaguggggcguggacucugugcaggaagaugcugaauaaauagcaccuucccaaacaaguuccauucugaguagcccauggguucucccacgguugcaugucgucucuuuccagagagucuugacaucugugagcaccuccccucucuccacucuauugaguauaugagaggcuacaauugucauuuauuugaaugaacacagagaaaccaauuuaaucaagcaagggaauggaaugcaaauccaaggucaagaauguacuuucuucuuaguucuccuucuuguaaaccaaaaaguaucugagacaggucucaaucaauuuaacaauuuauuuugcccaaguuaaggagaugccugugacacagccucaggagguccugaugucguaugcccaagguggucaggcuacagcuugguuuuauagaucuuagggagacauaagacaucaaucaauacagguaagauguauguugguuugguccagaaaggugggacaacugggagccaaguguaggagggagagcuuccaggucauaggcagauucaaagauuuucugauugucaauugguugaguuauuaucuaaaaaccuggaaccaauagaaaggaaugucuggguuaugauaagggcuuguggagaccaagguuuagucaugcagaugaagccuccagguaggcggcuucagagagaacagauuguagauguuucuuaucagacuuaaagagucuguucugccagguuuuguuguugcuguuguuguuguuguuguuuuaauugagauagagucucgcucugucacccaggcuggagugcaguggcgcaaucucagcucacugcaaccuccacucccuggguucaagagauucucgugccucagccucccaaauagcuaggauuacaggcgcccaucaccacgcccagcuaauuuuuguauuuuuaguagagauggggucucaccacauuggccaggcuggucucaaacuccugaccucaagugauccacccgccucagccucccaaagcgcugggauuacaggcgagagccacagggcccggccuguucuuucagucuuaagguccauguugauguuaaugguaaugagacguggccaacccuccccuuccucucauggccugaaguaguuucauagguugacuuuggaaugcccucggcugagaggagggguccauuccgaugguaggcggacuuggaauuuuauuuuugguuuacacucuguuucauuuuccucucauucucuuuguccccccaccuugagaaaagucaccccagacuuccugccacuccucagauaaguaucaggucuugaaugcuuucuucccuagcagcucgaacuagaugaguaagaagacgcuugucugagucaucaauguaucaaccagaaacaagcucaggaaaugcgucuuuagcauccccacuacccccaccccauccaccaggccuuuaauggaaaguuucccaugggggccagggacacucagcaggggacucucccuagagccccugggcugcucccacugucugcuggcccagaaaguccaccgagaucacagcuuuuuauaaacucacuugagauucuauuuccugaguacaguugagguucccccuccuuuuuacaaguucaagauacaguacuucaaaguuccacuguaaauucuagagcccuugagauuuucuaugcugaccaaauacuuuguuaacacaacucugucggccacauaaaauggaacaacgcuuacugcaugaaaaguuuuguuugguugacagcacacaggacaccaguuuuguuuucuaacuggaaaagcaccaccacaugcagaugugauugguaggaaaauggggcucuggaugcacagguaauuuuggugaaugagcuaagguacuguguguacaucgcuguugucguaacagguucaaugugagggagccgucuaagcacuggcaauguggacgccagaugccagaccagaagggcggggcuagaccacaaacccagagaccuagguucucguuagaacugagccaccaaccagugcuguggccugaaggagucucugagccaccaaccagugcuguggccugaaggagucucaacuucucugaguuucaguuuucucauuugguguaaaaacugcaguugcuuaucacauaggauugcaaugagaaucaaaugaaacauaucugugaauggaaacagcuuauaugaaaacucuaaaacccuaugccaacguaaaauuuuguggaaguaaacacguuuuacauucaagagugaacaaaaccagauuuuuuuuuuuugagacagaguuuugcucuugucguccaggcuggagugcaaugucacaaucuuggcucacugcaaccucugccuccuggguucaaaugauucuccagccucagccucccgaguagcugggauuacaggcacccgccaccacacccagcuaguuuuuguacuuuuaguacagacgggguuucuccauguuggccaggcuggucucaaacuccugaccucaggugauccacccaccucggccucccaaagugcugggauuacaggcgugaaccaacgugcccagccagacauuuuuuauucuaaccagauggcuugcuuguaucuuuguuuggugcuuccuacuucaaauguuuuguuuuguuuuuuauauuaauuagccucugggacaaaagaaaagcaugcaugguuuugucuugcuggguucaacaaauacuuuucuggcaugcuaacugcuucucaccaagggagcaaccacguuaagcaaaccaacaugagaacuggcaacacagacaaagguacuucaaauauucacuggcaacacacuuauggaaugucacugugucugcuuugcgaggauccagucgcaaaugaacaucugggugcagagcucgaaaugucucugugugccuugucucgucaccucccacugacuccucaaacaguccugugagaucuguuauuacugccaucccuguuccacugcugcaggaggcacagcuuaaucuguaucauugacauguacaaggugacaccagaaguaauggaacugaggccaggcaugguggcucauaccuguaaucccagcacuuugggaggccgagguggguggaucaccugaggucaggaguucgagaccagccuggccaacauagugaaaccccgucucuaccaaaaaaauucaaaauuagccagacaugguggugggcaccuguagucucagcuacucaggaggcugagacaggagaacugcuugaacccaggaggcagagguugcagugagcugagaucaggccacuucacuccagccugugcaagacagagugagacucuaauuuaaaaaaaaaaaaaaaaaaaaaguaauggaacugagagucaaaaacauucccaggugcaaaauucugagaaauauauaauauucuagucuaugugauuacaguauauuuuuuauuauuaauuaacauuuuaguauauauuaauuaauguacacauguguaaacauauauacaaauaaguacauauuuccccuuaacauaacugguaaugccuagagcagggguuggcaacuacaguccccauaggccaaaucuggcccacuguuuguuuuuguaaaugaaguuuuauugggaaagccacacucauucauugagguaugaaacaugguugcuuucaugcuacaaccacagaguugcguagucguaacagagaccucauggcccacaaagccgaaaauauuuauucuuccucuuaacaggagaagucaguugagcccuacccuagaccuauucaaccacaaucuucuacucaucaaaaaaaagcagagaggaggccaggcaugguggcucaugccuauagucccagcacuuugggaggcugaggcgggcggaucaccugaagucaggaguucaagaccagccugaccaacauggugaaaccccauuucuacuaaaaauacaaaauuagccgggcaugguggcaagaaucuguaaucccggcuacucgggaggcugagguaggagaaucgcuugaacccgggaggcagaguuugcagugagccgagaucgcgccacugcacuccagcccaggcaacaagagcaaaacuccaucucagaaaaaaaagcacaggagucugagacaggaagaugacucgaguccaggagcuggaggccagccugggcaacauagcaagacccugccacuuaaaaaaauacaugaaguggccaggcuugguggcucacaccuguaaucccaguacuuugggaggucaagauggauggaucacuugagcucaguaguucgagaccagucugggcaaccuagugagacaccaccucuacuaaaaaugcaaaaaauuagccaaguguggugacgcaugccuguagauccaccuacucaggaggcugaggugggaggguugcuugagcugggagguuaagguugcagugaacugagauugcaccacugcacuccagccugggugacagagugaaauccugucuuaaaaaaaaaauacauggagugaaaauggacagaauuaaaaagagaaauacaaauuauauauuuuuuaaaaaagcaccuaggcauuccuuggcucuccaugccuuguggacggucucuucuguguagcugcuaucucccucugucaaggcagccacucacugaauugcaaaguguguguucagcuguuggcuucccuccagacugugagcucccugacagcaggugcuauggguuauuccugugugcaucccccagcacagucaaguagguacuucuugguuuuuuggguuuucguuuuguuuuuugggggacagggucuugcucugucacccaggcuggaguguaguggccugaacauggcucacugcagccucaaacuccugggcucuagagauccuccugccccacccucccagguagcugugaccacaggugcaugccaccacacccagcuaaguuuuuauuuuuuauagauauaggucuugcuguguugcccaguucuugaacuccuggacucaagugauccucccuccuuggucucccaaagugcuggaauuacaggugugagccacugugccuggccgaguagaugcuucuugacuaaauguuaaggagauuuuuuccagagagauaaacaaggaacagcuccuuagagucagugagauacagguauggugugggcaagcccagaucacccugagagcucacagaggggauuggacucagcccuggggagcugaacagacuuccugaagggaguuaagugccuaagcugauuucugaaggauuaaccagacagggagaaggacagucacaaaaagaauagcacguggaaaggccugggagggagaggcaacaagacauggaugaaguauagcucuuagcagacagugauguggagaauggguaccuccugccagugucuggacauugcuuuguguggucgauacugcagaggcuacaacucuggacuggugacugaacucuaaccaguguggaauccacuacggcuuggaaguuguuuacuagcaauuccacagcuuuagaaguacagcugucccucaguauccacggggcauugguuccugaagauaccaauccacagguacucaagucucugauauaaaaugguguaguauuugcauauaaccuaugcacacccucccauguacuuuaaaucaucucuagaucacuuauaauaccuaguacaaugugaacgccauguaagaaguuguuguauuguuuaggaaaugaugacaaaaaagaaaucuguucauguucaguacaaacacaacuauccuuuuuauuuuuccaaauauuuucaaucuguaguugguugaauccacaaauguggaacccguggauauggaguguucacuguauuucccugucuuaagaucugaguuguacaguuuagaggucaauuuccaugccaaaaagcaggacauaaauaaaggaaaacauacaaauguugguaaacgcacuuggugguaucuggugccugaaaucuuuggccuugacuugucgguuaucaagaagcuugagaugcuagcguggccaacauggugaaaccccgucucuacuaaaaauauaaaaaucagccagaggugguggugcuugccuguaaucccagcuaugcgggagccuagggcaggagaaucgcuugaaccugggaggcauagauugcagugagucgagaucaugccacugcacuccagccugggcaacagagcgagacuccgucucaaaaaaaaaaaaaagaagaagaagaaguuugagaugauaaaaaugacacauuuagaaaaaacaaacaaaaaaauuuucuuaaaauaaaacccagugauguucaucaauggauaagcaaaauaugaucugucccuacaaugcaauauuauucagccaugaauaugaagcagguucuaauacaugcuaccaccuggauaaagcuugacaacauucugcuaagugaaagaauuguuuacuuaaaaaugguucacuuggcagggcgcaguggcucaugccuguaaucccagcacuuugggaggcugaggcaggcggaucaccuaaggccagguauucgagaccagccuggcugacauggugaaacccugucucuacuaaaaauacaaaauuaccugggcuugguggcgggugccuguaaucccagcuacucaggaggcugaggcaggagaaucacuugaacccgagaggcagagguugcagugagccgagaucgugccacugcacuccagccugggcaacaggagcgaaacgccaucgcaaaaaaguaaaaaaagguucacuguauguucuaucaauuugcuucauuucuuuuugccucaauuuuuuaaaaguguuuuaaaaggaacuaccuaggaguauaaaggagauguaaauaucauuuucuugacaaaccuauucaauaauaaugauguuucugcauuuugaauaacugaugaaacaaaacccagugacacacaggcagcccucgugguucugagcgagcugcggggacuccugcagccccgccagggagcgcugacggaugacgcaccugacagcuuucuuguugccuguuucucugauagagguggagaaaacccggugccagcacgagcgagaacacauucucggggcagcgggggcgacagacccacagcgacccauuccuccggggcuguucguuccugagugcgaugcgcacgggcacuacgcgcccacccagugccacggcagcaccggcuacugcuggugcguggaucgcgacggccgcgagguggagggcaccaggaccaggcccgggaugacgcccccguguaagugggugcaggccgugcuugggcgugugccugagaaggaccucgggggaccggaauugcugaacacgcucuuugcucuucugcuggaccuaaagcuugaacuguuccacuggcuccagccccacccgcuccugcugcacccuucuucccucucacuuaccccgcuccuccccgugcuuccucuccuccucacccucucuguucucuuacccucuucuuucuccuuccccacccaacacacacacguguaggguguaaauacccaguggggccugccacagcgguaccuguaaugguagcagagcggcugugugugcuccaggccucccagaagaacucucugccaagggaggcguggagguggaauguuccugcacugggacauggcagggaugguggggaccaaccugaacccuuccccagggcucugugcccuaggcaguagggccuguucagaccguugcaccccuugccuccuucagucgugcccuagggccuuuaguuacuuggguugauuuuccaauccaaggagcaaacagccacaaagcuuucugcaugagcuggcucuaagaccaucaccggaggcagugggaagcugcuguccugggggccaggggcccugugugacucuggacagacacuuuccccagccucagcguccccagucucaaccuaaacaugaggcaaaauaaccccgagagugauucccagcucuaaaauucuccuuccguugcaaauguagaaauugguuauugucacaaacuaccaaaagcgaauauaaugaaucuuugaaucuccacucacaauuuagcuaauaaucauugauugauauccuaucaaauauuuccccgaagcugcuaagaaacaguaaaacaauuacucagaaacuucacucguucacacagccaacauucacugaggggccagugcuguggugggugcuaggaugcccagaggaaagucacggugcugggcccccaagaagcggaaaggacggugaauagacaggaacaguguagggagaugagcuuuaggagaagcagacagcgaccagggagccgaggcggaauccuggcuugcguggggcggugggcucaugggugaggcuuuccagaagcagcaccgugugagccacguuucuaagccugaguauuggucaugagggcaacgaggagccugggauggguuuggagcaggcgcccaugugaagcaggguuuaguuuuagaauaucacuggcuguggggguagaagcugagaggcaggcuugacagucccuggcggggggaggugaaggcuguugcacuacuuacgaugaauccaggugagaaacggauggauuucagagauaugaaagagguugaccagauugguuugugucaccgauuggguguaauaggcaagauagacaagagaaagugaccuuggggacaaccuuguccagcucucacuguagagagcaggagaccaggcucuggaagaugcaugcccugugcacacagcgagugaguagaggggccaggacagggcucaggucuccagacacccaaucagcccucuuagcccuccuugcuuugcagcacaguugugugucccuccugggacauugucucaucaagugaaucaaggagcccggcgagggguugaggucaggagauaggaaggcaagccugauucugagggaaaaggagccccuggccaugauuuuguucuuggaagcccauaaacgucauguucuugcuugucaggccccaggcucucccaucccuguggcacugggacagagugcacuguauggggcaacucauucugacaggcuccuccagcauggaaaagcucaauaguuugcacuagaaccuggcucccugugggcagggaguucagggaugcuguuuucgcuguugugcuaccgcuggugcugcuggugcugcucuuauuugguuccuuccucuagcaccagugccuaaagcagagcauggguagccaaagcuuuucuauuaagagggaggccggccgggcacaguggcucacaccuguaaucccagcacuuugggagaccuaggugggcagaccacuugaggucaggaguucgagaccagccuggccaacauggugaaaccccaucucugcuaaaaauacaaaaauuaacuggguaugguggugcaugccuguaaucccaguuacucaggaggcugaggcacaagaaucucuugaaccaggcaggcagagguugcagugagccaagaucgcaccauugcacucuggccugggugacagagcaagacuccgucucaaaaaaaagagggaggccaagccauuuuuuuucacgugacuuuuaaugcuguguauuaccuucuucaucagugcucuuugauugacugagggcuuucuaauucuggugcuuucagcuauaaaaugggcauuguguggcuguggcaguuuguggugccaugaaggugaugugaccugauguguggguguguguaugugugugcaugcgugcaugugugugggggugugugugugugcaucuguguguuccuggugcacacgggccucccucacugacccccucugccaugcaggucugaguacaguggcucccccgauucaccaaggaccugcggugccuaccgccgugauccccuugccuccugggacccauuuacucuuugcccagacugggaagauugagcgccugccccuggagggaaauaccaugaggaagacagaagcaaaggcguuccuucaugucccggugagugcuggcugauuauaccuggugacagcuccugcuucagugaccuggaaaaacaagcaggacgauaucagaccagaaccccaggcucaaccccuggaaccaugggugcucauuccauguaguccugggugaccaucucuagauggggccacuguauugcugagcugcucgugaucuuuccauuccccugccaaauucauagugauucaucuuucagcagcugcucaauuuaagagccucauaucugcucugacguagcaacaagcauuggaguuuuuagaggcuuucaaagcuucagagaugcauuuugugauuuagggacuucuuuucccauuagauagagguugggcaauucagaaaagccauucgguuuuaucugauccugaccccugccaagaaaccaaaccugagaccugcaggcuuccacuacaaggcugagucagaauugcuggagcagugggaggggcugugaggguccuaugaggagugaaggagaggggagggucugagaucauuggcucuuguaaaagaaagucuggcagaaagcccuaucauuccucacuggaggcacaaagucuacuugaagauucuugguaaagaugcuacuugggccaucuugccugccacaggaccaaccuccagcuuuucuucucuuccuccuuucucuacccauuguguuuucuucuuuuucuauuuacucuuccugaauugaucuccacuucauagaugccacacacagccacaucccuucuuugggaccagggaggaaacaucagcaaaaaaguauccaaaauaaaaauacuuuucaaaagccucuugcaaagaagucuuuaugagauucauguccuuuuccugcacaaagcucucaaauggguugccucuucacucagaauaaaauccaguccuuuuuauggcccucaaagcccuauaggaucuggccucuggcucccucucccacccuguucccuaccacucucaccucacuuaccaacuucaacccucuggcccucuggcugguccuggaacacaccaggcacauuucugucucagggccuuugcacuugcaguucccccugccugacaauugcacaguucacugccucacuucaugcaaauuucugccaaaacaucaucucucagagaggccuguccugaucccccuguccagacagcagccaccacugcucucuagcucuuuaugcugcuuuguauuucaucagcgcucuuggcacuaugugaugcauuaaauacccauauuuguguuguguaucugacauguaucuuccuauuaaaauaucagcaccacaagacaggaacuguucauuuguuucauggagguauugguuucaugugguauuucuagacccaaaacugcuuggcauauaggaagcacucaaaaaaauauuugcugaacaaaugcaugcaugaucauuguauucaucuauugccuugcugaaaauguaaaccuugaagaucaucugugucauuuccaucuccagcacaugcucucagguaauaggaauggguuaaauucccugugaaagacauucuuucccaagaccaaggggagaggcuaaaugucaugugaggcaauaaaaagcagauaauuuacagccugggcaacauggagaaaccccaucucuacuaaaaauacaaaaauuaucugcacaugguggugcguuccuguaaucccagcuacuugggagccugaggcacaagaauugcuugaaccugggaggcagagguugcagugagcugagauccugggcaacagaaugagacucuugucucaaaaaaaaaaaaaaaaaaaaaagcagauaauuuaagugggcuaggugguggaagggggaaugcugaaacaacgggauaaacauucaccaucuuuuaaaaaccuguugaaagugguauuaagaauauaaacaauguuaugcaacuaucaccuccauucaucuccagaacuuuuucaucaucccaaacugaagcuauuaaacaauaccuccccauucucccuccacccauguccuagccccuggcagccacgauucuacuuacugcccuuauacuuuugacuuuucuagguaccuccuagaagcagaaucauacaguauuugucauucgugucuggcauauuucacuuagcauaauguccucagguucauccacauuguagcaugugucauaauuuccuucuuucuuaaggcugaaaucccauuguacggaucugccguauuuuguguauuuauucaucuaucagcaguugcuuccaccuucuggcuuuugcaaauaaugcugcuaugaacauggguauacaaauaucuguucgagucccugcuuuaacuucuuuucgauacauauaccaaaguggaauugcuggaucauacaguaauucuauauuuaauuuuuugaggaacaaccauacuguuuuccacagugguuguaccauuuuaccuacucaccagcagagcacagggguuuaaacuccuccauauccuuaccaaaacuuguuggcuguuuuuguuuuuuaaugauagccauuguaacgggugugaagugguuuugauuugcauuuuccuaauaauuuaugacacugaacaucuuuucacguacuuauuggccgcuuguauaucuucuuuggagaaaugucuacuuaaauccuuuugccuauuuuuugaucaguucuuuuguuguuguugaguugugggaauucuuuauauauucuggauauuaacucuuuaaaagauacaugauucgcaauauuuucucccauuccauggguugucuuuucacucucuugauuguguccuaugaugcacagacauuuuuaauuuugauguaguccaauuuaccuuuuuuuuucuuuuguugccugugcuuuugguaucauauccaagaaauugucgccaaauccaaugucaugaggcuuucucccugguuuucuucuaagaguuugauaaguuugcucuuacauuuaggucuuugauucauuugaguuaauuuuuguauguggugugagguaagggucacuguccuuuuugacuugaccccuugaggaggaaguaugugcucauccuccugauuuucccaguaaaagaucauccugguccaccacuuccuugguccugagacccucccuccugagaccuucccuggcuucguaaugccuaguacuguguccacgaccaagaacccacucccaggguuucuuguaccugaacaauucaguguuucaauaguuuccaggcuauugacagaaucuaaccucaccacaugcugagaucauacagcccggcagcuucuuccugagccucucaugggcagcaucuaaagaaaggaacuccucacugucugaucaagggaaaaguuugugcuucuguuuuguuuuuaaguuuuuauuuugaaguaaucagagccacaggaaguuggaaagguauacagagagguccuguguaccuuucaccugguuucucccaauggcuaaauuuuacauaaguaugaauuccuauaguuuuaaaauauuuuaauuugcaaaagaucucgacaaggcuuugccaaaucaaccuaugggcagauggcuuguuuugaggugguugcuuuagagaaguuaagcaacucaguguucuuucuagguuggaguuuugucuauguaucaccauaguucgucauacauaaugagcaccuaauaaauacucauuaaugaguuacuggcagguaauugauuugccuugucugaggagaggcuggcuuacucagagcuaacucucaguggcuuuucaaaccaaacaauagcccaguagauuuucaugaaacucaaaucacauguaaaauguuacucaacuuugcuuccucugguccuuuucugucucacuuuuguaagaacuaauguguggaaaaggacucugggcguguuugcugaaggaaauguuuucuuuccuuaaagccauggagggccagagaaguugaugagcauguuugcugaaggaaauguucucuuuccuuaauaccacggaaggccagagaaguugauaggcaugggaugccgugaaggagguacccacaguugaggccugagcauuugguugugaugguuuaagagagugaauaucuuaaaagugcacagccuugucugggcgcacuggcuuacgucuguaaucucaggacuuugggaggcccaggcggcuggaucaguugagcucaggaguucgagaccagccugggcaacauagugagacgcugucucuacaaaaaaauagaaaaauuaacuaggugugcuggcacaugucuguagucccagcuacaauuuaaauguaaauuguuuacauuuaaccuuauuuaucccuucauuuauuugggucuuuuauaguuucaugcugcaauguuuuauaguauucauuguggaauccugcauauuuaaaaauguuuauccuuauauauuuucugguuuuuuuuuuugaugcugucacaauuauuaagguuuauuuucuauauuuugcuaguauauagaaaaauaauuuuauauugacuuuguaucuugcauccuugcuagauucacuuuugauuauagcaguuuuauagauuccccaugacuuucuacauaaauaaccauauuaucuuagaauagaguaauuuuacuucuucaauauguaugccuuuuauuucuuuuucuuuaucaccuucaaguaggcaaagauuucuuaguauucaaaaagcauuagccauaaagggaaaaaauaauaaauuagacuuacuaaacaucaaaaacuuuugcucuuccaaacacuauuaagaaaaugaaagagcaaacuacauacugagaagaaauaaugggugggugcaguggcuggugcugguaaucccagcacuuugggaggcugagucagauggcuugcuugagccaggaguuuaagaccagagugggcaagacagugagacucuguugccacaaaaaauuuuaagaaaugagcuaggcaugguggcacaugccuguagucccagcuacuugagagucugagggcgaggaucacucgaguucaggagguugaggcugcagugagcaguaaucacgccacuacacuccagccugggcaacagagacccugucucaaaaaauacauauuuaugcauauauauacacacacacacacacacacacacacacacaaauuccuauacauauagaugugcauauauguguauaugacaggaguuuuuucugaaauauacgaacaacuccuacaacucaauaauaaaaauuuuuaaaugaacaaaacacuugacacuucauuacaaaagauauccaaaugccuguaggcacgcaaaaagauucucacuaucagaugcuuguagauggaccauucuaaccacuggucuucacauccaggcuaaagucaucauuggacuggccuuugacugcguggacaagaugguuuacuggacggacaucacugagccuuccauugggagagcuagucuacaugguggagagccaaccaccaucauuagacaagguaaguaagcaaauaucauuuuuccuuuuugguuuugcuucuagcagccaaaguggccauguaugccagagaagaacagcaaaugaagccaaacuuucacaaacauuucucagucuuuuguugcauuacuacgauaaaguguguaaaguuuaggcacguucuacuuuuuuuuuucuuuuuuuuuuugagacagagucucacucugucacccaggcuggagugcaguggcgugaucuuggcucacugcaagcucugccuccuggguucacgccauucuccugccucagccucucgaguagcugggacuaaagucgcccgccaccaugccuggcuaauuuuuuguauuuuuuuuuaguagagacaggguuucaccguguuagccagaauggucucuaucuccugaccucgugauccgcccaccucggccucccaaagugcugggauuacaggugugagccacggcgcccggcaggcacaaucuacuuuucaguguucaaccucaauuccucaauugaggaaauuccucauuaaggaugccaauuucaaccaaugacucugugcuuuguuuuucaugccuaccuucaacaaaucaagacuguuuuacauggguaugauuuaucuaguugaaagaccauuacaacaaaaauccaaaggccucuaaaaauuccacugugcugaaauggucaaguauuacauguugcuuaauucagcgacucaucaacugacuugggaauauuuuugcuccuauggcauugucaugcugaugauauuuguucuguggagucaccuugcguucucugcaaaauauucacaucaaagauacaucuuuaaaauagagcagccucauuuuguauuucuuuuuacuuggcacugaauguaguuuuuucuauuuucaauggaauguuucccucacaauugauauucuagaagauuuccugugccuguggaacaacucccgaagcauuuuuucccuucuuuguugccuucaguaaagaugaugcggcaggaaugaagcugagguugaauuaacuaugucuggcuuuggacauagacccugaacccuuuucuggaagccaacaggcuauuuaaaucaugucuuccaguuuucaugcuuugguuuagugaaaaacaguuugaaaaugccuaucuccguguguuaaaaauguuauuguuauuaucuaugauuucauuuuaaaacccaguggaagaggggaauaggucauuguuugcuauuuccuguugcuuuuggagcucauaaccauccaagaacgcuguaagcacaguaagaagcauuccaagcaaaagccuaguuacugugaaaacacagaauuaaaccaaaaugugaucuuuguagaagaaagaucacugggaauaauuuucuuuuuuuuuuuuuuaagagagaaagaagcuuccaguuaucuccuuagcaugguacagguuggugcuucccuagugagugagagugacaguuagguaucauuuucauuucuuccuuauuucauaacagcccggaucccaggcuuucuuucuuuccuugaguuacagacccaaccaaguaucucuaaaaaguaucauaucuuugagguaagcaguaaggaauacuucuuccucggacugcacauugaaggauaagauuauccagaccuuucccuuggaagaguagcucauaaagaaguauuuugaguugagggagaggggguugguugcucuuggguuugagaucgggaccaaggcugguucuaaggagacaauaugcacggagcucauggagcuuccuccaggugccucgcaaagaugcucucacagagcagccuauauucucuguuuuauuugcguauaucugaguggcucuugucucucacacaggaugugcucauuccaaauauacuccagaaugacuuauucuguuucuaucugaaagccagaagggaccuuuggaggucagucucacugucccuguucaucuagggacaugggaaauauuuuaauauuuuaaaaaucucuacuuuguguuuagauaauaaagaucuuguucaagugggguuucuaauucucaauaaacuuccucuggcgggcuuucuuucugggggcucugauguguccagcauccaaggucaccaucauauuagggcucuggcgaaggcuaaugcaaagggggcugagggucugcacugcuuguauguccacagaagaacacaguauuggagccaggugugguggcucaugccuguaaucccaacacuuugggaggccaaggcgggggaucacuugaggucaggaguuugagaccagccuggccaacauggugaaacccugucucuacuaaaaauacaaaaauuagccgggcaugguggcacgcaccuguaaucccagcuacucgggaggcugaggcaaaagaaucauuugaacucaggagguggagguuugcagugagcugagauggcaccacugcacuccagccugagcaacagaaugagacucugucaaaaacaaaacaaaacaaaaaaacccacaguauuggaaugguugccucauaccccagaucccucagguaggguagccccuucuccuuccugcuuauacuccagucauacuaaaugaccuucauuccuuuaaucaguagaagggaaagaguccuaagugauaucaauaaaacacaaucguuauuauuaauuuaaaaaaacuauauaauaaaacaccaauguaaucuucagcuuccaguaaaguuagaugggugcugaggguuugcagugaagguucauguuacccaguggcaacuccuggcuugaaaaucaguugcuauaacccaguaaagacugggguguuauuuguaaucacugacaccccuucuuuguaccccuuauacuuguaugaaaguaauagcagcuaugguuucuugaaaguauuauuucaaugaccuuuauccccgauagcuaaugaacaagauagaacuauuuuuccauucccuaucuuaagaucuuccacugccuccccucugccuaaguucuaaguucauuaacauggccuccuaccuucaucucugaccacucccccacccucauagucuccagccacauacaaugacauccuguucacuuuaagccaccauccagccuuccuuuauaccuaugugccagucucgcuaccuaaaaagcccucauccaggauccuuguuugacaaacugcuauugguccuucaggugccagcuucaagcaaugucaccucccccaggaaccccucccuguucuccccaggcugggguuccuccuccaggcucccauaggaccuggaacucagucucaacugugguuggcugugggcucauggaaaacugggccucggcuuagucauuguuacuguccugguucccaacgugcagcaugauggauacccacagagugaguaaauggcauuuuugaauuugucacuuugaguguuguuuaucuuauaaacaacaagcauuucacauucccauuugguuucuuaaagugcagggauuggacaccaugugaaauaacauugaguauucagaaaaaccucaucucagcugcuuagaaaacaaaaaaaauuagaggagcucuguguuuacuucuagaucuuggaaguccagaagguaucgcuguugaucaccuuggccgcaacaucuucuggacagacucuaaccuggaucgaauagaaguggcgaagcuggacggcacgcagcgccgggugcucuuugagacugacuuggugaaucccagaggcauuguaacggauuccgugagaggguaucuuuguguaaauaugugugugcaucucuuugauuugcaucugcccuuuuagagauucucagaugugaggcuuuaacuccagcauuggucuccugaaauuaaugaguacgggacgaaagagucuacaguuuuggugacuuguagauauccacgguacaaugccagaacauguauuacaguguggacuugauaccaugucccacuuucaaaucuuuugccaggagacuuuacaaguuggcaugcucagaaauuggauauuuuccauauggcuucaauguggaucaacacucagguuauaucaacuccagaagaguagcagggcggcauaaauggacugcugaggcugcuuucaggggcagacccagacugaacacccuggagaucccuuccuguguguuucuucggcacauccaugcuuucucuuccuucuuacugcaagcucuaccucuuacacaacaggcucuuaguuccucgacacugauuccuucccuuugagaccacaucuccuauucuguggccacucagccuccuccuugaaggcagguacuuugaccacagccccugccaacaucugcuucuuguccuagucugguccccugggucugcugugcucuccuccaugugggccucaugcagggaauuccauauauuuaugccaguuauagcccuuuacuuuguuuucuuuugcuaacagcuucauugagauauuauaugucaguuauguuaaagggaaccaaauuuguuaguaacagaaucaccaaacucaaaugaggaaccaaauucaaguaucuuugcaaaagaaaauguguuuuaucaccucucgauccuuucagucauucuguuuucaugucugccaaucacuucauuguaauucuuuucaaguguuuuucauaaacuuuuucucaugcauccuuauuauuucuuuuccucuuuccccccuuuuuccuccuccaggaaccuuuacuggacagacuggaacagagauaaccccaagauugaaacuuccuacauggacggcacgaaccggaggauccuugugcaggaugaccugggcuugcccaauggacugaccuucgaugcguucucaucucagcucugcuggguggaugcaggugauggaaagcuggacacuguccagggcgggucucaaucuccuaagucaggggugggcaaacuagggcccuggggucaaaucuaaccagccaccuguuuuuauauaacccagaagcuaugaaugguuuuuacgguuuuaucugguacauuaaauauauacugguacaaaauuguauagauaccugcauacuguccuugguuuugccuccuggccugcaaaaccugaaauaauuuacuaucuggugcuuuaagaaaaaguuggccacccucguguuguaaguggcacugcacagagccuggagucacccugauaccgauaagcaauucacaacuuacauuagucugcccuggcucgugccuccccagcagaagcaacacgggaggaagagacaacuugccaguuuuuaagagcaagccucauguguucucugggacuugucauuguaaugcuuaauuucucccacucuugcccucauuacucuuguuuuuuuugcacaaaggggccauuucuugugugaacaaugaaugaauuguuuccacuccacacaggcaccaaucgggcggaaugccugaaccccagucagcccagcagacgcaaggcucucgaagggcuccaguauccuuuugcugugacgagcuacgggaagaaucuguauuucacagacuggaagauguacgucagcuguagccaugggggcugcgugggccugccccuccacccacugucucugggaggccaggcccuucccaucuggccucuuggcuugacuuuugagccuccagaaaugcccccucuagagauguccccucucccuuauccuucugguugucaggagccaagagaggagcaugaagaaggagggaggacaaggcccuaggggacaggaggugccauuuaucauccagaugcuccugacugugugguuucaagucuuuaaaccuggacuuccucagcacgucuguucuuuccccaggaguuggcccagggucacguggccggugggcuccauguccacuucaugucccugcuucauuauaguuguuaaacugcaauauucccacggccucuuccugacuaccccuuccugcaaaaggagggauuaaacugagaagacaacuggccaggggcaucugucuagaaagcucauuuccugccugggaucuagagugggaggggagagcuaacuggucuuuacccuuuuguaaaaagccagagaaaugcaggcuugacccaccccaggggaaggaagggaugucuaggaagaaggccaucaugucuguuuauggccuccaguuuauccucaaaaugacaaagaggcugccuuguuuagauacaaguucaagccaucagauguguuuucaccuucugcccuuuggugcuuuguaggaauuccgugguugcucucgaucuugcaauuuccaaggagacggaugcuuuccaaccccacaagcagacccggcuguauggcaucaccacggcccugucucaguguccgcaagguaacucuccugugcuguuacuguuggcauacugggggcacauggaggcucagagcccacacucuggcugcuacccguauggccacuaguagccuugauuaugccguaagagagauccaguccuuugcauccagggucuucauuagcaggugaaccaguuaaauaaacagaaaauauuaggucaugaaguugucaggaugaggaaaagcauugaguuuugggcuggauauaaaagcauagggucuucagguuccaaauagucagguuaggauauuacaauguuaggaucucugcuccuuuaaaaguccauccaucuggccuaacagcaauaacaauaauuaauaauaagaauugaaaacauauguguggcacuuacugugagcuaugaacuuuacauauaucaacucacuuagaguucuaaauacuuuguauuuguuaguucauguaauccucauagcaacccugugagguagguacuauuauuauguucauuucauaaauaagcaaacugaagcaacuugcuccaagucacacagcucacaggggcaaguccaggcagccuggcccuggagucuaugcuaugcugccucuugaaggccucuccccucacccacuuuccuucucagcuucccucaucuucuucugucagugugaagcuaggagugcaagcuacauaaaaagaacuuugcacuuuaaaauuccaauucuauguuauaaucagagcuggagaacuucccccugagaucuguuuaauagccuuaguagaaaaucugcauaacccccaaguugggaaucaguguuugugucugguuuaaugcugauaaaacaaacaauggaucagcucagcugacugccuagcacaguguccccauucuccugaagccuuccuagcauggcuucaaggaaacuaaaagggggaucacacacaagaaggagcccacuaucuuaaauggcuauggagucagaucagagagagggcuauugaacugauuucugccuuuuccaggccauaacuacugcucagugaacaauggcggcugcacccaccuaugcuuggccaccccagggagcaggaccugccguugcccugacaacaccuugggaguugacuguaucgaacagaaaugaagacaagagugccuuauuuccuuuccaaguauuucacagcaacacucuacuugaagcaacuugguccagauugaaaaguguccucuggcugaguggccacuaggcccagacccagcccagccugagccccaacaacuuuucccucacuguuccccaaaacaugcacccuggacuucucuaauagaaaagucuccaccccuacacaaggacagaacccuccaccccuacccccaacccucagacagacuuauacaccccugagugaggauuacaugcccaucccaguguccuaggaccuuuucccaauacuagccccccaguggugaacagaaccucccaaauuugaguugcacccuucccuguggccuuaugagcucagccucgcuuugagguacccaccguccugucagcuccuugaccuaugagccggggccugacuaggaaaaguugggaguuaaggaggaaauuagcauuccuuaauguuuuguuuuggugcucugaauuucuucuuuauuauaguccuauaguuuuacuccucaguuccucaccaucaucaucuugucuaagacccccauuauaauauucaugcgcugcuuuuucaucaaaaccuacccuguccuagagaucuaugggcauuugguggaugauaaugagcagccccucccagauagaaugucaauauuugagcaguaggauauuggcauuuguuaguuaaaggcuuaaaucaaaagaauguccaaugguaggaauuucaagguguaggucagauauuugagaauaggggauuuuuuugaugugccuuaaauuauaccaaagauuacuaauuauuccucuuugcccaaaauacuugcauccaagguucuagucucuguugcugugcuggucuuuagccccacugcuugcacugaugucccuccuuuucacggagaccuaucugagguacaggauggggcuggcaccagaugaugucccaccacagucccucaccuccggccuccacaugacagaaccaauuuacacucaaccaugaccucaccccuccuugguuucucccucgaucuguggcccuuuuuggauguauucuuaucuaacaacacaauccggaaagacugaauugaauauuuauacuaaugguucauauccuuuauugcucaaugaucuaauuaaagggaucauugccacauuucauguuuauauuucuacaauuuguuuagaaaacaucuccugaccauaucaguagcucguguuaucuuuuuaucaacugcuucccagaguccuaaaacaauagaaauuuuggauugaaaaguucagcauaaggaguuugagucaguaaaggaugggauaaaggagucgagaugauucaaugaaaaguaucacaaaaaagagauugaucaacaagagaaauaaaaaagcccaagaggaagugguaggggaaggaauuuaagaacagcaauaaguaaaacucuuaaguaacuccaaaaagaaaaugguacauuuugccaaagaccacuuauacuugagaacauggaagaauuugccugauacucucuuuggggaaaagagucucuccucuuuuccucaaaccccaguacacucagccucucugccccaccuucuccugacuuuguccucacuugcuucugcaguacauuggaaccugaauugaaagaaagucuuccuugaauaauuggaguuugucuugagaggcaaauauagccccaagaaucacaagauucgaggaccauguaggucuuuuacguagcccaaauccauaaauuagucucacuuuuuguauuuaucguuucauauuaaacccucuauaucaaauguucaucaugauuuuguaugauuuuuauaacuauuuuauucauuuuauuagauuuauucuaaaauuuuuuaaugguaaauucuuaaacuguggaaaccacugaaggugcuuauuaacuguucucccagauuuguacaaguauuggaugauuccuugaguuuacagcuguacaaauaguguggaaaauaaacuuuuuuuaaaaaagaa

SEQ ID NO: 192403 - RNA, 89350 nt, Homo sapiens
uucuuuuuuaaaaaaaguuuauuuuccacacuauuuguacagcuguaaacucaaggaaucauccaauacuuguacaaaucugggagaacaguuaauaagcaccuucagugguuuccacaguuuaagaauuuaccauuaaaaaauuuuagaauaaaucuaauaaaaugaauaaaauaguuauaaaaaucauacaaaaucaugaugaacauuugauauagaggguuuaauaugaaacgauaaauacaaaaagugagacuaauuuauggauuugggcuacguaaaagaccuacaugguccucgaaucuugugauucuuggggcuauauuugccucucaagacaaacuccaauuauucaaggaagacuuucuuucaauucagguuccaauguacugcagaagcaagugaggacaaagucaggagaagguggggcagagaggcugaguguacugggguuugaggaaaagaggagagacucuuuuccccaaagagaguaucaggcaaauucuuccauguucucaaguauaaguggucuuuggcaaaauguaccauuuucuuuuuggaguuacuuaagaguuuuacuuauugcuguucuuaaauuccuuccccuaccacuuccucuugggcuuuuuuauuucucuuguugaucaaucucuuuuuugugauacuuuucauugaaucaucucgacuccuuuaucccauccuuuacugacucaaacuccuuaugcugaacuuuucaauccaaaauuucuauuguuuuaggacucugggaagcaguugauaaaaagauaacacgagcuacugauauggucaggagauguuuucuaaacaaauuguagaaauauaaacaugaaauguggcaaugaucccuuuaauuagaucauugagcaauaaaggauaugaaccauuaguauaaauauucaauucagucuuuccggauuguguuguuagauaagaauacauccaaaaagggccacagaucgagggagaaaccaaggaggggugaggucaugguugaguguaaauugguucugucauguggaggccggaggugagggacuguggugggacaucaucuggugccagccccauccuguaccucagauaggucuccgugaaaaggagggacaucagugcaagcaguggggcuaaagaccagcacagcaacagagacuagaaccuuggaugcaaguauuuugggcaaagaggaauaauuaguaaucuuugguauaauuuaaggcacaucaaaaaaauccccuauucucaaauaucugaccuacaccuugaaauuccuaccauuggacauucuuuugauuuaagccuuuaacuaacaaaugccaauauccuacugcucaaauauugacauucuaucugggaggggcugcucauuaucauccaccaaaugcccauagaucucuaggacaggguagguuuugaugaaaaagcagcgcaugaauauuauaaugggggucuuagacaagaugaugauggugaggaacugaggaguaaaacuauaggacuauaauaaagaagaaauucagagcaccaaaacaaaacauuaaggaaugcuaauuuccuccuuaacucccaacuuuuccuagucaggccccggcucauaggucaaggagcugacaggacgguggguaccucaaagcgaggcugagcucauaaggccacagggaagggugcaacucaaauuugggagguucuguucaccacuggggggcuaguauugggaaaagguccuaggacacugggaugggcauguaauccucacucagggguguauaagucugucugaggguuggggguagggguggaggguucuguccuuguguagggguggagacuuuucuauuagagaaguccagggugcauguuuuggggaacagugagggaaaaguuguuggggcucaggcugggcugggucugggccuaguggccacucagccagaggacacuuuucaaucuggaccaaguugcuucaaguagaguguugcugugaaauacuuggaaaggaaauaaggcacucuugucuucauuucuguucgauacagucaacucccaagguguugucagggcaacggcagguccugcucccugggguggccaagcauaggugggugcagccgccauuguucacugagcaguaguuauggccuggaaaaggcagaaaucaguucaauagcccucucucugaucugacuccauagccauuuaagauagugggcuccuucuugugugugaucccccuuuuaguuuccuugaagccaugcuaggaaggcuucaggagaauggggacacugugcuaggcagucagcugagcugauccauuguuuguuuuaucagcauuaaaccagacacaaacacugauucccaacuuggggguuaugcagauuuucuacuaaggcuauuaaacagaucucagggggaaguucuccagcucugauuauaacauagaauuggaauuuuaaagugcaaaguucuuuuuauguagcuugcacuccuagcuucacacugacagaagaagaugagggaagcugagaaggaaagugggugaggggagaggccuucaagaggcagcauagcauagacuccagggccaggcugccuggacuugccccugugagcugugugacuuggagcaaguugcuucaguuugcuuauuuaugaaaugaacauaauaauaguaccuaccucacaggguugcuaugaggauuacaugaacuaacaaauacaaaguauuuagaacucuaagugaguugauauauguaaaguucauagcucacaguaagugccacacauauguuuucaauucuuauuauuaauuauuguuauugcuguuaggccagauggauggacuuuuaaaggagcagagauccuaacauuguaauauccuaaccugacuauuuggaaccugaagacccuaugcuuuuauauccagcccaaaacucaaugcuuuuccucauccugacaacuucaugaccuaauauuuucuguuuauuuaacugguucaccugcuaaugaagacccuggaugcaaaggacuggaucucucuuacggcauaaucaaggcuacuaguggccauacggguagcagccagagugugggcucugagccuccaugugcccccaguaugccaacaguaacagcacaggagaguuaccuugcggacacugagacagggccguggugaugccauacagccgggucugcuugugggguuggaaagcauccgucuccuuggaaauugcaagaucgagagcaaccacggaauuccuacaaagcaccaaagggcagaaggugaaaacacaucugauggcuugaacuuguaucuaaacaaggcagccucuuugucauuuugaggauaaacuggaggccauaaacagacaugauggccuucuuccuagacaucccuuccuuccccuggggugggucaagccugcauuucucuggcuuuuuacaaaaggguaaagaccaguuagcucuccccucccacucuagaucccaggcaggaaaugagcuuucuagacagaugccccuggccaguugucuucucaguuuaaucccuccuuuugcaggaagggguagucaggaagaggccgugggaauauugcaguuuaacaacuauaaugaagcagggacaugaaguggacauggagcccaccggccacgugacccugggccaacuccuggggaaagaacagacgugcugaggaaguccagguuuaaagacuugaaaccacacagucaggagcaucuggaugauaaauggcaccuccuguccccuagggccuuguccucccuccuucuucaugcuccucucuuggcuccugacaaccagaaggauaagggagaggggacaucucuagagggggcauuucuggaggcucaaaagucaagccaagaggccagaugggaagggccuggccucccagagacaguggguggaggggcaggcccacgcagcccccauggcuacagcugacguacaucuuccagucugugaaauacagauucuucccguagcucgucacagcaaaaggauacuggagcccuucgagagccuugcgucugcugggcugacugggguucaggcauuccgcccgauuggugccuguguggaguggaaacaauucauucauuguucacacaagaaauggccccuuugugcaaaaaaaacaagaguaaugagggcaagagugggagaaauuaagcauuacaaugacaagucccagagaacacaugaggcuugcucuuaaaaacuggcaaguugucucuuccucccguguugcuucugcuggggaggcacgagccagggcagacuaauguaaguugugaauugcuuaucgguaucagggugacuccaggcucugugcagugccacuuacaacacgaggguggccaacuuuuucuuaaagcaccagauaguaaauuauuucagguuuugcaggccaggaggcaaaaccaaggacaguaugcagguaucuauacaauuuuguaccaguauauauuuaauguaccagauaaaaccguaaaaaccauucauagcuucuggguuauauaaaaacagguggcugguuagauuugaccccagggcccuaguuugcccaccccugacuuaggagauugagacccgcccuggacaguguccagcuuuccaucaccugcauccacccagcagagcugagaugagaacgcaucgaaggucaguccauugggcaagcccaggucauccugcacaaggauccuccgguucgugccguccauguaggaaguuucaaucuugggguuaucucuguuccagucuguccaguaaagguuccuggaggaggaaaaaggggggaaagaggaaaagaaauaauaaggaugcaugagaaaaaguuuaugaaaaacacuugaaaagaauuacaaugaagugauuggcagacaugaaaacagaaugacugaaaggaucgagaggugauaaaacacauuuucuuuugcaaagauacuugaauuugguuccucauuugaguuuggugauucuguuacuaacaaauuugguucccuuuaacauaacugacauauaauaucucaaugaagcuguuagcaaaagaaaacaaaguaaagggcuauaacuggcauaaauauauggaauucccugcaugaggcccacauggaggagagcacagcagacccaggggaccagacuaggacaagaagcagauguuggcaggggcuguggucaaaguaccugccuucaaggaggaggcugaguggccacagaauaggagauguggucucaaagggaaggaaucagugucgaggaacuaagagccuguuguguaagagguagagcuugcaguaagaaggaagagaaagcauggaugugccgaagaaacacacaggaagggaucuccaggguguucagucugggucugccccugaaagcagccucagcaguccauuuaugccgcccugcuacucuucuggaguugauauaaccugaguguugauccacauugaagccauauggaaaauauccaauuucugagcaugccaacuuguaaagucuccuggcaaaagauuugaaagugggacaugguaucaaguccacacuguaauacauguucuggcauuguaccguggauaucuacaagucaccaaaacuguagacucuuucgucccguacucauuaauuucaggagaccaaugcuggaguuaaagccucacaucugagaaucucuaaaagggcagaugcaaaucaaagagaugcacacacauauuuacacaaagauacccucucacggaauccguuacaaugccucugggauucaccaagucagucucaaagagcacccggcgcugcgugccguccagcuucgccacuucuauucgauccagguuagagucuguccagaagauguugcggccaaggugaucaacagcgauaccuucuggacuuccaagaucuagaaguaaacacagagcuccucuaauuuuuuuuguuuucuaagcagcugagaugagguuuuucugaauacucaauguuauuucacaugguguccaaucccugcacuuuaagaaaccaaaugggaaugugaaaugcuuguuguuuauaagauaaacaacacucaaagugacaaauucaaaaaugccauuuacucacucuguggguauccaucaugcugcacguugggaaccaggacaguaacaaugacuaagccgaggcccaguuuuccaugagcccacagccaaccacaguugagacugaguuccagguccuaugggagccuggaggaggaaccccagccuggggagaacagggagggguuccugggggaggugacauugcuugaagcuggcaccugaaggaccaauagcaguuugucaaacaaggauccuggaugagggcuuuuuagguagcgagacuggcacauagguauaaaggaaggcuggaugguggcuuaaagugaacaggaugucauuguauguggcuggagacuaugagggugggggaguggucagagaugaagguaggaggccauguuaaugaacuuagaacuuaggcagaggggaggcaguggaagaucuuaagauagggaauggaaaaauaguucuaucuuguucauuagcuaucggggauaaaggucauugaaauaauacuuucaagaaaccauagcugcuauuacuuucauacaaguauaagggguacaaagaaggggugucagugauuacaaauaacaccccagucuuuacuggguuauagcaacugauuuucaagccaggaguugccacuggguaacaugaaccuucacugcaaacccucagcacccaucuaacuuuacuggaagcugaagauuacauugguguuuuauuauauaguuuuuuuaaauuaauaauaacgauuguguuuuauugauaucacuuaggacucuuucccuucuacugauuaaaggaaugaaggucauuuaguaugacuggaguauaagcaggaaggagaaggggcuacccuaccugagggaucugggguaugaggcaaccauuccaauacuguggguuuuuuuguuuuguuuuguuuuugacagagucucauucuguugcucaggcuggagugcaguggugccaucucagcucacugcaaaccuccaccuccugaguucaaaugauucuuuugccucagccucccgaguagcugggauuacaggugcgugccaccaugcccggcuaauuuuuguauuuuuaguagagacaggguuucaccauguuggccaggcuggucucaaacuccugaccucaagugaucccccgccuuggccucccaaaguguugggauuacaggcaugagccaccacaccuggcuccaauacuguguucuucuguggacauacaagcagugcagacccucagcccccuuugcauuagccuucgccagagcccuaauaugauggugaccuuggaugcuggacacaucagagcccccagaaagaaagcccgccagaggaaguuuauugagaauuagaaaccccacuugaacaagaucuuuauuaucuaaacacaaaguagagauuuuuaaaauauuaaaauauuucccaugucccuagaugaacagggacagugagacugaccuccaaaggucccuucuggcuuucagauagaaacagaauaagucauucuggaguauauuuggaaugagcacauccugugugagagacaagagccacucagauauacgcaaauaaaacagagaauauaggcugcucugugagagcaucuuugcgaggcaccuggaggaagcuccaugagcuccgugcauauugucuccuuagaaccagccuuggucccgaucucaaacccaagagcaaccaacccccucucccucaacucaaaauacuucuuuaugagcuacucuuccaagggaaaggucuggauaaucuuauccuucaaugugcaguccgaggaagaaguauuccuuacugcuuaccucaaagauaugauacuuuuuagagauacuugguugggucuguaacucaaggaaagaaagaaagccugggauccgggcuguuaugaaauaaggaagaaaugaaaaugauaccuaacugucacucucacucacuagggaagcaccaaccuguaccaugcuaaggagauaacuggaagcuucuuucucucuuaaaaaaaaaaaaaagaaaauuauucccagugaucuuucuucuacaaagaucacauuuugguuuaauucuguguuuucacaguaacuaggcuuuugcuuggaaugcuucuuacugugcuuacagcguucuuggaugguuaugagcuccaaaagcaacaggaaauagcaaacaaugaccuauuccccucuuccacuggguuuuaaaaugaaaucauagauaauaacaauaacauuuuuaacacacggagauaggcauuuucaaacuguuuuucacuaaaccaaagcaugaaaacuggaagacaugauuuaaauagccuguuggcuuccagaaaaggguucagggucuauguccaaagccagacauaguuaauucaaccucagcuucauuccugccgcaucaucuuuacugaaggcaacaaagaagggaaaaaaugcuucgggaguuguuccacaggcacaggaaaucuucuagaauaucaauugugagggaaacauuccauugaaaauagaaaaaacuacauucagugccaaguaaaaagaaauacaaaaugaggcugcucuauuuuaaagauguaucuuugaugugaauauuuugcagagaacgcaaggugacuccacagaacaaauaucaucagcaugacaaugccauaggagcaaaaauauucccaagucaguugaugagucgcugaauuaagcaacauguaauacuugaccauuucagcacaguggaauuuuuagaggccuuuggauuuuuguuguaauggucuuucaacuagauaaaucauacccauguaaaacagucuugauuuguugaagguaggcaugaaaaacaaagcacagagucauugguugaaauuggcauccuuaaugaggaauuuccucaauugaggaauugagguugaacacugaaaaguagauugugccugccgggcgccguggcucacaccuguaaucccagcacuuugggaggccgaggugggcggaucacgaggucaggagauagagaccauucuggcuaacacggugaaacccugucucuacuaaaaaaaaauacaaaaaauuagccaggcaugguggcgggcgacuuuagucccagcuacucgagaggcugaggcaggagaauggcgugaacccaggaggcagagcuugcagugagccaagaucacgccacugcacuccagccugggugacagagugagacucugucucaaaaaaaaaaagaaaaaaaaaaguagaacgugccuaaacuuuacacacuuuaucguaguaaugcaacaaaagacugagaaauguuugugaaaguuuggcuucauuugcuguucuucucuggcauacauggccacuuuggcugcuagaagcaaaaccaaaaaggaaaaaugauauuugcuuacuuaccuugucuaaugauggugguuggcucuccaccauguagacuagcucucccaauggaaggcucagugauguccguccaguaaaccaucuuguccacgcagucaaaggccaguccaaugaugacuuuagccuggaugugaagaccagugguuagaaugguccaucuacaagcaucugauagugagaaucuuuuugcgugccuacaggcauuuggauaucuuuuguaaugaagugucaaguguuuuguucauuuaaaaauuuuuauuauugaguuguaggaguuguucguauauuucagaaaaaacuccugucauauacacauauaugcacaucuauauguauaggaauuuguguguguguguguguguguguguguguguauauauaugcauaaauauguauuuuuugagacagggucucuguugcccaggcuggaguguaguggcgugauuacugcucacugcagccucaaccuccugaacucgagugauccucgcccucagacucucaaguagcugggacuacaggcaugugccaccaugccuagcucauuucuuaaaauuuuuuguggcaacagagucucacugucuugcccacucuggucuuaaacuccuggcucaagcaagccaucugacucagccucccaaagugcugggauuaccagcaccagccacugcacccacccauuauuucuucucaguauguaguuugcucuuucauuuucuuaauaguguuuggaagagcaaaaguuuuugauguuuaguaagucuaauuuauuauuuuuucccuuuauggcuaaugcuuuuugaauacuaagaaaucuuugccuacuugaaggugauaaagaaaaagaaauaaaaggcauacauauugaagaaguaaaauuacucuauucuaagauaauaugguuauuuauguagaaagucauggggaaucuauaaaacugcuauaaucaaaagugaaucuagcaaggaugcaagauacaaagucaauauaaaauuauuuuucuauauacuagcaaaauauagaaaauaaaccuuaauaauugugacagcaucaaaaaaaaaaaccagaaaauauauaaggauaaacauuuuuaaauaugcaggauuccacaaugaauacuauaaaacauugcagcaugaaacuauaaaagacccaaauaaaugaagggauaaauaagguuaaauguaaacaauuuacauuuaaauuguagcugggacuacagacaugugccagcacaccuaguuaauuuuucuauuuuuuuguagagacagcgucucacuauguugcccaggcuggucucgaacuccugagcucaacugauccagccgccugggccucccaaaguccugagauuacagacguaagccagugcgcccagacaaggcugugcacuuuuaagauauucacucucuuaaaccaucacaaccaaaugcucaggccucaacuguggguaccuccuucacggcaucccaugccuaucaacuucucuggccuuccgugguauuaaggaaagagaacauuuccuucagcaaacaugcucaucaacuucucuggcccuccauggcuuuaaggaaagaaaacauuuccuucagcaaacacgcccagaguccuuuuccacacauuaguucuuacaaaagugagacagaaaaggaccagaggaagcaaaguugaguaacauuuuacaugugauuugaguuucaugaaaaucuacugggcuauuguuugguuugaaaagccacugagaguuagcucugaguaagccagccucuccucagacaaggcaaaucaauuaccugccaguaacucauuaaugaguauuuauuaggugcucauuauguaugacgaacuauggugauacauagacaaaacuccaaccuagaaagaacacugaguugcuuaacuucucuaaagcaaccaccucaaaacaagccaucugcccauagguugauuuggcaaagccuugucgagaucuuuugcaaauuaaaauauuuuaaaacuauaggaauucauacuuauguaaaauuuagccauugggagaaaccaggugaaagguacacaggaccucucuguauaccuuuccaacuuccuguggcucugauuacuucaaaauaaaaacuuaaaaacaaaacagaagcacaaacuuuucccuugaucagacagugaggaguuccuuucuuuagaugcugcccaugagaggcucaggaagaagcugccgggcuguaugaucucagcauguggugagguuagauucugucaauagccuggaaacuauugaaacacugaauuguucagguacaagaaacccugggaguggguucuuggucguggacacaguacuaggcauuacgaagccagggaaggucucaggagggagggucucaggaccaaggaagugguggaccaggaugaucuuuuacugggaaaaucaggaggaugagcacauacuuccuccucaaggggucaagucaaaaaggacagugacccuuaccucacaccacauacaaaaauuaacucaaaugaaucaaagaccuaaauguaagagcaaacuuaucaaacucuuagaagaaaaccagggagaaagccucaugacauuggauuuggcgacaauuucuuggauaugauaccaaaagcacaggcaacaaaagaaaaaaaaagguaaauuggacuacaucaaaauuaaaaaugucugugcaucauaggacacaaucaagagagugaaaagacaacccauggaaugggagaaaauauugcgaaucauguaucuuuuaaagaguuaauauccagaauauauaaagaauucccacaacucaacaacaacaaaagaacugaucaaaaaauaggcaaaaggauuuaaguagacauuucuccaaagaagauauacaagcggccaauaaguacgugaaaagauguucagugucauaaauuauuaggaaaaugcaaaucaaaaccacuucacacccguuacaauggcuaucauuaaaaaacaaaaacagccaacaaguuuugguaaggauauggaggaguuuaaaccccugugcucugcuggugaguagguaaaaugguacaaccacuguggaaaacaguaugguuguuccucaaaaaauuaaauauagaauuacuguaugauccagcaauuccacuuugguauauguaucgaaaagaaguuaaagcagggacucgaacagauauuuguauacccauguucauagcagcauuauuugcaaaagccagaagguggaagcaacugcugauagaugaauaaauacacaaaauacggcagauccguacaaugggauuucagccuuaagaaagaaggaaauuaugacacaugcuacaauguggaugaaccugaggacauuaugcuaagugaaauaugccagacacgaaugacaaauacuguaugauucugcuucuaggagguaccuagaaaagucaaaaguauaagggcaguaaguagaaucguggcugccaggggcuaggacauggguggagggagaauggggagguauuguuuaauagcuucaguuugggaugaugaaaaaguucuggagaugaauggaggugauaguugcauaacauuguuuauauucuuaauaccacuuucaacagguuuuuaaaagauggugaauguuuaucccguuguuucagcauucccccuuccaccaccuagcccacuuaaauuaucugcuuuuuuuuuuuuuuuuuuuuuugagacaagagucucauucuguugcccaggaucucagcucacugcaaccucugccucccagguucaagcaauucuugugccucaggcucccaaguagcugggauuacaggaacgcaccaccaugugcagauaauuuuuguauuuuuaguagagaugggguuucuccauguugcccaggcuguaaauuaucugcuuuuuauugccucacaugacauuuagccucuccccuuggucuugggaaagaaugucuuucacagggaauuuaacccauuccuauuaccugagagcaugugcuggagauggaaaugacacagaugaucuucaagguuuacauuuucagcaaggcaauagaugaauacaaugaucaugcaugcauuuguucagcaaauauuuuuuugagugcuuccuauaugccaagcaguuuugggucuagaaauaccacaugaaaccaauaccuccaugaaacaaaugaacaguuccugucuuguggugcugauauuuuaauaggaagauacaugucagauacacaacacaaauauggguauuuaaugcaucacauagugccaagagcgcugaugaaauacaaagcagcauaaagagcuagagagcagugguggcugcugucuggacagggggaucaggacaggccucucugagagaugauguuuuggcagaaauuugcaugaagugaggcagugaacugugcaauugucaggcagggggaacugcaagugcaaaggcccugagacagaaaugugccugguguguuccaggaccagccagagggccagaggguugaaguugguaagugaggugagagugguagggaacagggugggagagggagccagaggccagauccuauagggcuuugagggccauaaaaaggacuggauuuuauucugagugaagaggcaacccauuugagagcuuugugcaggaaaaggacaugaaucucauaaagacuucuuugcaagaggcuuuugaaaaguauuuuuauuuuggauacuuuuuugcugauguuuccucccuggucccaaagaagggauguggcuguguguggcaucuaugaaguggagaucaauucaggaagaguaaauagaaaaagaagaaaacacaauggguagagaaaggaggaagagaagaaaagcuggagguugguccuguggcaggcaagauggcccaaguagcaucuuuaccaagaaucuucaaguagacuuugugccuccagugaggaaugauagggcuuucugccagacuuucuuuuacaagagccaaugaucucagacccuccccucuccuucacuccucauaggacccucacagccccucccacugcuccagcaauucugacucagccuuguaguggaagccugcaggucucagguuugguuucuuggcaggggucaggaucagauaaaaccgaauggcuuuucugaauugcccaaccucuaucuaaugggaaaagaagucccuaaaucacaaaaugcaucucugaagcuuugaaagccucuaaaaacuccaaugcuuguugcuacgucagagcagauaugaggcucuuaaauugagcagcugcugaaagaugaaucacuaugaauuuggcaggggaauggaaagaucacgagcagcucagcaauacaguggccccaucuagagauggucacccaggacuacauggaaugagcacccaugguuccagggguugagccugggguucuggucugauaucguccugcuuguuuuuccaggucacugaagcaggagcugucaccagguauaaucagccagcacucaccgggacaugaaggaacgccuuugcuucugucuuccucaugguauuucccuccaggggcaggcgcucaaucuucccagucugggcaaagaguaaaugggucccaggaggcaaggggaucacggcgguaggcaccgcagguccuuggugaaucgggggagccacuguacucagaccugcauggcagagggggucagugagggaggcccgugugcaccaggaacacacagaugcacacacacacacccccacacacaugcacgcaugcacacacauacacacacccacacaucaggucacaucaccuucauggcaccacaaacugccacagccacacaaugcccauuuuauagcugaaagcaccagaauuagaaagcccucagucaaucaaagagcacugaugaagaagguaauacacagcauuaaaagucacgugaaaaaaaauggcuuggccucccucuuuuuuuugagacggagucuugcucugucacccaggccagagugcaauggugcgaucuuggcucacugcaaccucugccugccugguucaagagauucuugugccucagccuccugaguaacugggauuacaggcaugcaccaccauacccaguuaauuuuuguauuuuuagcagagaugggguuucaccauguuggccaggcuggucucgaacuccugaccucaaguggucugcccaccuaggucucccaaagugcugggauuacaggugugagccacugugcccggccggccucccucuuaauagaaaagcuuuggcuacccaugcucugcuuuaggcacuggugcuagaggaaggaaccaaauaagagcagcaccagcagcaccagcgguagcacaacagcgaaaacagcaucccugaacucccugcccacagggagccagguucuagugcaaacuauugagcuuuuccaugcuggaggagccugucagaaugaguugccccauacagugcacucugucccagugccacagggaugggagagccuggggccugacaagcaagaacaugacguuuaugggcuuccaagaacaaaaucauggccaggggcuccuuuucccucagaaucaggcuugccuuccuaucuccugaccucaaccccucgccgggcuccuugauucacuugaugagacaaugucccaggagggacacacaacugugcugcaaagcaaggagggcuaagagggcugauugggugucuggagaccugagcccuguccuggccccucuacucacucgcugugugcacagggcaugcaucuuccagagccuggucuccugcucucuacagugagagcuggacaagguuguccccaaggucacuuucucuugucuaucuugccuauuacacccaaucggugacacaaaccaaucuggucaaccucuuucauaucucugaaauccauccguuucucaccuggauucaucguaaguagugcaacagccuucaccuccccccgccagggacugucaagccugccucucagcuucuacccccacagccagugauauucuaaaacuaaacccugcuucacaugggcgccugcuccaaacccaucccaggcuccucguugcccucaugaccaauacucaggcuuagaaacguggcucacacggugcugcuucuggaaagccucacccaugagcccaccgccccacgcaagccaggauuccgccucggcucccuggucgcugucugcuucuccuaaagcucaucucccuacacuguuccugucuauucaccguccuuuccgcuucuugggggcccagcaccgugacuuuccucugggcauccuagcacccaccacagcacuggccccucagugaauguuggcugugugaacgagugaaguuucugaguaauuguuuuacuguuucuuagcagcuucggggaaauauuugauaggauaucaaucaaugauuauuagcuaaauugugaguggagauucaaagauucauuauauucgcuuuugguaguuugugacaauaaccaauuucuacauuugcaacggaaggagaauuuuagagcugggaaucacucucgggguuauuuugccucauguuuagguugagacuggggacgcugaggcuggggaaagugucuguccagagucacacagggccccuggcccccaggacagcagcuucccacugccuccggugauggucuuagagccagcucaugcagaaagcuuuguggcuguuugcuccuuggauuggaaaaucaacccaaguaacuaaaggcccuagggcacgacugaaggaggcaaggggugcaacggucugaacaggcccuacugccuagggcacagagcccuggggaaggguucagguugguccccaccaucccugccaugucccagugcaggaacauuccaccuccacgccucccuuggcagagaguucuucugggaggccuggagcacacacagccgcucugcuaccauuacagguaccgcuguggcaggccccacuggguauuuacacccuacacguguguguguuggguggggaaggagaaagaagaggguaagagaacagagagggugaggaggagaggaagcacggggaggagcgggguaagugagagggaagaagggugcagcaggagcggguggggcuggagccaguggaacaguucaagcuuuagguccagcagaagagcaaagagcguguucagcaauuccggucccccgagguccuucucaggcacacgcccaagcacggccugcacccacuuacacgggggcgucaucccgggccugguccuggugcccuccaccucgcggccgucgcgauccacgcaccagcaguagccggugcugccguggcacugggugggcgcguagugcccgugcgcaucgcacucaggaacgaacagccccggaggaaugggucgcugugggucugucgcccccgcugccccgagaauguguucucgcucgugcuggcaccggguuuucuccaccucuaucagagaaacaggcaacaagaaagcugucaggugcgucauccgucagcgcucccuggcggggcugcaggaguccccgcagcucgcucagaaccacgagggcugccugugugucacuggguuuuguuucaucaguuauucaaaaugcagaaacaucauuauuauugaauagguuugucaagaaaaugauauuuacaucuccuuuauacuccuagguaguuccuuuuaaaacacuuuuaaaaaauugaggcaaaaagaaaugaagcaaauugauagaacauacagugaaccuuuuuuuacuuuuuugcgauggcguuucgcuccuguugcccaggcuggagugcaguggcacgaucucggcucacugcaaccucugccucucggguucaagugauucuccugccucagccuccugaguagcugggauuacaggcacccgccaccaagcccagguaauuuuguauuuuuaguagagacaggguuucaccaugucagccaggcuggucucgaauaccuggccuuaggugauccgccugccucagccucccaaagugcugggauuacaggcaugagccacugcgcccugccaagugaaccauuuuuaaguaaacaauucuuucacuuagcagaauguugucaagcuuuauccaggugguagcauguauuagaaccugcuucauauucauggcugaauaauauugcauuguagggacagaucauauuuugcuuauccauugaugaacaucacuggguuuuauuuuaagaaaauuuuuuuguuuguuuuuucuaaaugugucauuuuuaucaucucaaacuucuucuucuucuuuuuuuuuuuuuugagacggagucucgcucuguugcccaggcuggagugcaguggcaugaucucgacucacugcaaucuaugccucccagguucaagcgauucuccugcccuaggcucccgcauagcugggauuacaggcaagcaccaccaccucuggcugauuuuuauauuuuuaguagagacgggguuucaccauguuggccacgcuagcaucucaagcuucuugauaaccgacaagucaaggccaaagauuucaggcaccagauaccaccaagugcguuuaccaacauuuguauguuuuccuuuauuuauguccugcuuuuuggcauggaaauugaccucuaaacuguacaacucagaucuuaagacagggaaauacagugaacacuccauauccacggguuccacauuuguggauucaaccaacuacagauugaaaauauuuggaaaaauaaaaaggauaguuguguuuguacugaacaugaacagauuucuuuuuugucaucauuuccuaaacaauacaacaacuucuuacauggcguucacauuguacuagguauuauaagugaucuagagaugauuuaaaguacaugggagggugugcauagguuauaugcaaauacuacaccauuuuauaucagagacuugaguaccuguggauugguaucuucaggaaccaaugccccguggauacugagggacagcuguacuucuaaagcuguggaauugcuaguaaacaacuuccaagccguaguggauuccacacugguuagaguucagucaccaguccagaguuguagccucugcaguaucgaccacacaaagcaauguccagacacuggcaggagguacccauucuccacaucacugucugcuaagagcuauacuucauccaugucuuguugccucucccucccaggccuuuccacgugcuauucuuuuugugacuguccuucucccugucugguuaauccuucagaaaucagcuuaggcacuuaacucccuucaggaagucuguucagcuccccagggcugaguccaauccccucugugagcucucagggugaucugggcuugcccacaccauaccuguaucucacugacucuaaggagcuguuccuuguuuaucucucuggaaaaaaucuccuuaacauuuagucaagaagcaucuacucggccaggcacaguggcucacaccuguaauuccagcacuuugggagaccaaggagggaggaucacuugaguccaggaguucaagaacugggcaacacagcaagaccuauaucuauaaaaaauaaaaacuuagcugggugugguggcaugcaccuguggucacagcuaccugggaggguggggcaggaggaucucuagagcccaggaguuugaggcugcagugagccauguucaggccacuacacuccagccugggugacagagcaagacccugucccccaaaaaacaaaacgaaaacccaaaaaaccaagaaguaccuacuugacugugcugggggaugcacacaggaauaacccauagcaccugcugucagggagcucacagucuggagggaagccaacagcugaacacacacuuugcaauucagugaguggcugccuugacagagggagauagcagcuacacagaagagaccguccacaaggcauggagagccaaggaaugccuaggugcuuuuuuaaaaaauauauaauuuguauuucucuuuuuaauucuguccauuuucacuccauguauuuuuuuuuuaagacaggauuucacucugucacccaggcuggagugcaguggugcaaucucaguucacugcaaccuuaaccucccagcucaagcaacccucccaccucagccuccugaguagguggaucuacaggcaugcgucaccacacuuggcuaauuuuuugcauuuuuaguagagguggugucucacuagguugcccagacuggucucgaacuacugagcucaagugauccauccaucuugaccucccaaaguacugggauuacaggugugagccaccaagccuggccacuucauguauuuuuuuaaguggcagggucuugcuauguugcccaggcuggccuccagcuccuggacucgagucaucuuccugucucagacuccugugcuuuuuuuucugagauggaguuuugcucuuguugccugggcuggagugcaguggcgcgaucucggcucacugcaaacucugccucccggguucaagcgauucuccuaccucagccucccgaguagccgggauuacagauucuugccaccaugcccggcuaauuuuguauuuuuaguagaaaugggguuucaccauguuggucaggcuggucuugaacuccugacuucaggugauccgcccgccucagccucccaaagugcugggacuauaggcaugagccaccaugccuggccuccucucugcuuuuuuuugaugaguagaagauugugguugaauaggucuaggguagggcucaacugacuucuccuguuaagaggaagaauaaauauuuucggcuuugugggccaugaggucucuguuacgacuacgcaacucugugguuguagcaugaaagcaaccauguuucauaccucaaugaaugaguguggcuuucccaauaaaacuucauuuacaaaaacaaacagugggccagauuuggccuauggggacuguaguugccaaccccugcucuaggcauuaccaguuauguuaaggggaaauauguacuuauuuguauauauguuuacacauguguacauuaauuaauauauacuaaaauguuaauuaauaauaaaaaauauacuguaaucacauagacuagaauauuauauauuucucagaauuuugcaccugggaauguuuuugacucucaguuccauuacuuuuuuuuuuuuuuuuuuuuuaaauuagagucucacucugucuugcacaggcuggagugaaguggccugaucucagcucacugcaaccucugccuccuggguucaagcaguucuccugucucagccuccugaguagcugagacuacaggugcccaccaccaugucuggcuaauuuugaauuuuuuugguagagacgggguuucacuauguuggccaggcuggucucgaacuccugaccucaggugauccacccaccucggccucccaaagugcugggauuacagguaugagccaccaugccuggccucaguuccauuacuucuggugucaccuuguacaugucaaugauacagauuaagcugugccuccugcagcaguggaacagggauggcaguaauaacagaucucacaggacuguuugaggagucagugggaggugacgagacaaggcacacagagacauuucgagcucugcacccagauguucauuugcgacuggauccucgcaaagcagacacagugacauuccauaaguguguugccagugaauauuugaaguaccuuugucuguguugccaguucucauguugguuugcuuaacgugguugcucccuuggugagaagcaguuagcaugccagaaaaguauuuguugaacccagcaagacaaaaccaugcaugcuuuucuuuugucccagaggcuaauuaauauaaaaaacaaaacaaaacauuugaaguaggaagcaccaaacaaagauacaagcaagccaucugguuagaauaaaaaaugucuggcugggcacguugguucacgccuguaaucccagcacuuugggaggccgagguggguggaucaccugaggucaggaguuugagaccagccuggccaacauggagaaaccccgucuguacuaaaaguacaaaaacuagcugggugugguggcgggugccuguaaucccagcuacucgggaggcugaggcuggagaaucauuugaacccaggaggcagagguugcagugagccaagauugugacauugcacuccagccuggacgacaagagcaaaacucugucucaaaaaaaaaaaaucugguuuuguucacucuugaauguaaaacguguuuacuuccacaaaauuuuacguuggcauaggguuuuagaguuuucauauaagcuguuuccauucacagauauguuucauuugauucucauugcaauccuaugugauaagcaacugcaguuuuuacaccaaaugagaaaacugaaacucagagaaguugagacuccuucaggccacagcacugguugguggcucagagacuccuucaggccacagcacugguugguggcucaguucuaacgagaaccuaggucucuggguuuguggucuagccccgcccuucuggucuggcaucuggcguccacauugccagugcuuagacggcucccucacauugaaccuguuacgacaacagcgauguacacacaguaccuuagcucauucaccaaaauuaccugugcauccagagccccauuuuccuaccaaucacaucugcaugugguggugcuuuuccaguuagaaaacaaaacugguguccugugugcugucaaccaaacaaaacuuuucaugcaguaagcguuguuccauuuuauguggccgacagaguuguguuaacaaaguauuuggucagcauagaaaaucucaagggcucuagaauuuacaguggaacuuugaaguacuguaucuugaacuuguaaaaaggagggggaaccucaacuguacucaggaaauagaaucucaagugaguuuauaaaaagcugugaucucgguggacuuucugggccagcagacagugggagcagcccaggggcucuagggagaguccccugcugagugucccuggcccccaugggaaacuuuccauuaaaggccugguggaugggguggggguaguggggaugcuaaagacgcauuuccugagcuuguuucugguugauacauugaugacucagacaagcgucuucuuacucaucuaguucgagcugcuagggaagaaagcauucaagaccugauacuuaucugaggaguggcaggaagucuggggugacuuuucucaagguggggggacaaagagaaugagaggaaaaugaaacagaguguaaaccaaaaauaaaauuccaaguccgccuaccaucggaauggaccccuccucucagccgagggcauuccaaagucaaccuaugaaacuacuucaggccaugagaggaaggggaggguuggccacgucucauuaccauuaacaucaacauggaccuuaagacugaaagaacaggccgggcccuguggcucucgccuguaaucccagcgcuuugggaggcugaggcggguggaucacuugaggucaggaguuugagaccagccuggccaauguggugagaccccaucucuacuaaaaauacaaaaauuagcugggcguggugaugggcgccuguaauccuagcuauuugggaggcugaggcacgagaaucucuugaacccagggaguggagguugcagugagcugagauugcgccacugcacuccagccugggugacagagcgagacucuaucucaauuaaaacaacaacaacaacaacagcaacaacaaaaccuggcagaacagacucuuuaagucugauaagaaacaucuacaaucuguucucucugaagccgccuaccuggaggcuucaucugcaugacuaaaccuuggucuccacaagcccuuaucauaacccagacauuccuuucuauugguuccagguuuuuagauaauaacucaaccaauugacaaucagaaaaucuuugaaucugccuaugaccuggaagcucucccuccuacacuuggcucccaguugucccaccuuucuggaccaaaccaacauacaucuuaccuguauugauugaugucuuaugucucccuaagaucuauaaaaccaagcuguagccugaccaccuugggcauacgacaucaggaccuccugaggcugugucacaggcaucuccuuaacuugggcaaaauaaauuguuaaauugauugagaccugucucagauacuuuuugguuuacaagaaggagaacuaagaagaaaguacauucuugaccuuggauuugcauuccauucccuugcuugauuaaauugguuucucuguguucauucaaauaaaugacaauuguagccucucauauacucaauagaguggagagaggggaggugcucacagaugucaagacucucuggaaagagacgacaugcaaccgugggagaacccaugggcuacucagaauggaacuuguuugggaaggugcuauuuauucagcaucuuccugcacagaguccacgccccacuacagaggcagcuacucccagggccuacacggguucugagcaugcaccucugggacacacaucucuggacaaggucacucaggugcagugaacagucccuggucucugcuggcuuugagauuuuuuuuuuuuuuuuuuggagacagaauaucacugucgcccggccuggagugaaguggugcaaucucagcuuaccgcaaccucugccucccggguucaagcgauucuccugccucagucucccaaguagcugggauuacaggcgccugccacugcgcccagcuaauuuucuguauuuuuaguagagacgggguuucaugauguuggccaggcuggucucgaacuccugaccucgugauucacccgccucggccucccaaagugcugggauuacaggcuugagccaccacgcccagccuggcuuugagauuuugcuggcuuauagccccaucucauucacugccaaauagacacuuguuaguccaagcaagacugccaaauuuccaagaaggagaauuuacaagucaagggggcaauguccaucugacauggucuucauccucauguuccuaggggccacuaagaacaacacuacuaauaauagugauagcaacagcaauaacggugauaacagcuuucuuuacuuaugaacucucuucaugucccuucccaacauuuacccccauucucacagggcuagagaggaagacgaauggccagggaggggcacugaacucgcaguuaggaaaaggcaaacaaagaagggaaaacagaaaggucguaaaccagcauggaagagagcuugcacuccuccucugugugcagucucuucugucacagugugaaacugcauuguugaguuucaucacaccuguuuccuggagcagcucuuggcucccagcugccuuccucucccaaaauucuaccacagcagggcuuuuaaaaucacuguagucaucauacgcuucaggucaagagccccauggacacgugaagcacuuacucacuaguguuauaagcauuuagugaaagcugccaucagccaggcgcccugcaagggcuaaauaggagaguccuugauuguacaggcuagugcaaaagaugagggcccuggucaguggcacagugggagaagcggcuggcuguggucuggacaggcugcuaugggacagagaggaagagcaccacaccugccuuggucaagggcuuggcugacauuaaagacaauaaaucaggcugggcgcgguggcucacgccuguaaucccagcacucuggaaagaugaggcaggcagaucaccugaggcaaggaguuugagaccagccuggcuaacauggugaaaccccguaucuacuaaaaacacaaaaauuagccaggcgcaguggcacaugccuguaaucccagcuacucgggagauugaggcaggagaaucgcuugaacccgggaggcggagguugcagugagccgagauggcaccacugcacuccagucugagcaacagagcgagacucugucuaaaaacaaacaaacaaacaaacaaacaaacaaaaaaugacgauaaaucugcgguguguccaauacacccagccacagcagccuaggcgcaguggcugaacggacuuaagacaagagcuuugcaggcugagagugcagacggauaggaagucaagaaauuccaagcauuggugaggacgguugccuuugugcuuccugggguuagguuagagaggacuucaagaaaaagaagggauggaggaaccacaggcucagcgaucacuccgcggauuuggaaacgaggccaugugagagucacaagggaaggagguggcggucagacguggccacagacaucaagaccgggagcuugucaagccuuuggguggccugguuuggacccuccucaacaucaacucccccauuugccugacugccccuccuccucauuauuccucccugucuccuauucaaaucucaccuguccuucaaggcugagugcaaauccucccucucucacucuccccagcuuuuuuagcccaccugcaucucugcuuccugcugcuaguuaucacugguuaucacuccuagugaacgagugguaguugucacuccuagugaacgacugguaguugucacuccuagugaacgacugguaguugucacuccuagugaacgacugguaguugucacuccuagugaacgacugguaguugucacuccuagugaacgaccgguaguuauucacuacuaauuucaaguauucccuuuuccugcccaguuacagugcagacuccuccaggguggagacguuuuacuguucaugugucaagcacagugacaggcacacaagagaugcuuaagaaauauuuaacuauugguccuggcuaugcuacuaguuaguuggaugccuuggacaaauuaucuagucucucuaacccccauaucuucaugcauucaauggggcuaaucguaccagcagugacgugcaccagccagaaaugcagaaaacccugagguguguuguccuggauaccaaaugaagaaaguguuucaggaaggagggcgagaccaauugugccaagugcuaucaagaaaugaggccucaggccaggcacgauggcucacaccuguaaucccagaacuuugggaggcagaggugggcagaucacuugaggccaggauuucgagacaagccuggcaaauauggugaaaccccgucucuacuaaaaauacaaaaauuagccuggcuugauggcaagcaccuguaaucccagcuacucaggaggcugaggugggaggauugcuugaacccgggagguggaggcugcagugagcugagaugcagccacugcacuccagccugggcaacagagugagauccugucccaaacaacaacaacaauagccaagcgugguggcacacaccuguaaucccagcuacucaggagaccaaggcacaagaaucgcuugaacccuggaggcagauguugcagugagcagagauugcgccacugcacuccagccugaaugacagagugagacucugucucaaaaaaaaaaaaaaaaacaagaagaaaagaaaaagaaaugaggccucagaucuaacaaagggaggguuguugcugacuuuuacgagagcaguuuggguguugugguggggaaagaagcugacugcagugguuagagagagaaugagagacucuggaagaaugcaggagcuuacuuuuuagaguccaguuccagauggauuaacuagguaacaaaauccauagcccauggguagcauuuacaaagcaacacggugauaaggaagggugaagggacacaccaccaacuugucaucuuuguguggcagacagcagaggaaaggggcagagcaucucacagugugggaacaggaaagccccagcgcuaacaggcacucuagaaggcacugcaggccaauguaaaaacagcagcaaaacugggaggguuuuucuuccuuuaaguuaaagacuaagccaggcgcgguggcucaugccuauaauuccagcacuuugggaagccaaggcgaguggaucaggaggucaggagauagagaccauccuggcuaacacggugaaacccugucucuacuaaaaauacaaaaaauuagccaggcgugguggcgggcgccuguagucccagcuacucgggaggcuaaggcaggagaauggugugaacccgggaggcggagcuugcagugagccgagaucaugccacugcacuccagccugggcaacagagcgagacucugucucaaaaaaaaaaaaaaaaaaaaaguuaaaaacuaaaggggcuagaagagcuagacccuaggaaauugaccgggcugucagggcaucacacugggaagacagugcugagagugggaucaaacuuaagcaggauggagcccggcacgguggcucacgccuguaaucccaacacuuugggaggcugaggugggcaaaucagugagguugggaguucgagaccagccuggccaacacggugaaaccccaucucuacuaaaaauacaaaauuagcugggaaugguggcgugcgccugagucacagcuacucgggaggcugaggcaggagaauuguuugaaccugggugguggagguugcagugagcugagaucauaccacugcacuccagccuggguaacaccaucucaagaaaacaaaagcaaacaaacaaaaaaauguaagcagagaccagguaagagaaggcccagauauaggcgggggguggggagagagccaggaaaucucaaaagcaaauugcaaugcuuuuuuuuuuuauuuuugaagaugcaagaguguuuuguucugcugaaagcauauuuacuggcagucuaaacacaagaaccuaaacaacugcuuuuggaaagcauaaauaacacacgaucguaauuuuguaagacacaacucucaagauauuugaaccaacugucuguuuuuucugauugcaaaaugauucauaugccauacacuuugacagaaaauuucuuuuacuaaaaagauuucuucuaauuuaccuuacauuuugcuauuuuuaaaacaauacugggcaaaaauuaugugcuauauaaguguuagcuauuauuacuuuaguauuaccccuuccacuagauaaaaauuucacuucuuuaaacuacuguuugauguaguagauaucuauucauauuauuuuagggaggcauucuuuaaugaagacacaucagaaaggaaaaguggucaaaaacauagcuuaucugaauuuuaaaaugaacaaaaauccauaaacaucaacuaacuucuguacagagcauaguagcuaauuauccagccugcacuuucuaauaguaauaauaucaucauaaaugugcacagugcccucacugucaaaguucuuuaacuaaaguaacaggaaccacucugacuuaaccuaaacccaaaggaagaauuuauuaugaaaauauaguuaugucaugugaaucagaaaagggacuggaaccagaaauagacaacugucaggaacuaagagcuccugucuccuugucacucacuugcuuuauuuuucucuugggagacugacuguccucugcuucuccacccauauaccgaauaaagcuaccucucuacuuccaaauuacaaauacaguuuuagcuguuauuucauugcagugaauagaauuagacuaucaccauuuugcucccccccauuagaaaugaguggacccagguaauaaugagcaugaauuccaaugaauaaaugagaaaguaaugaugaaauuagaauaucaccauuugacccucccuagaaauuaaugggucuaggcaguaaucaucaauagcuccuaacaucacaaaaagugagacaagcagacauacacucccgaugaaagaucacaccaccaccuauugucuugccaaaaggauugaaccuaagucugaucaagcaucugacaaucugcagacaauuuagaggacaaaggaguguguagugcuguacaaugagugugcaaucagcaagauccagacugugggaaacuacagaucuaaaggcauggguucuucaacagaccaaaugcaaggaaaggaaagggauggagaagaaaacuauagauagaaaaaugagcagcaccaaaccuacaaugacuaggaaugcacucaagugugauaaagcuauuagaaaugcaaggaagagacaacuacagaugccagguuagugguugcuuuugaggagagagaggaggcuaugauuggggcagguggggcuccuggggcugcugguaaagcucuacuucaagaucugagugguagugacaaccaggcucaccuuagaguaacuccuugaacuacauauugcuugcaucuauguuuuauuuuuacaauauaaagauaggaaaaaaaauggaagaugagagaggaggaaguggaggcagcaauuccagacaaccuugaugaagaguuaaacuauaaagggaaggauggggaggggauggcagugagagagggaugcaggguugagggaaagcuucauuuuguuuauuauuuuuaaauuuuuuuggagaaagggucuagcucugucaccccaggcuagagugcaggggcacgaucauagcucacugcagccuugaacucccaggcucaagugaugcucuugccucggccuugugaauagcuggaacuacaggugugugcuaauuuuuaaaugccaugccuagaaguuuuaaauuuuuugauagagauggggucuugcuauguuguccaggguguucuuaaacuccuggaccagguuuuacauuucuagcccaagacauuuaaugccucucuuugauccucuaauaaacuccccuauguuacaaaaaccuagccaguuacauucccucagauguuguccaggcaaggucagggucaguggcuaugguggccgaccuccaagauggcccucauucuccccacugccuggucuuccauacuugggcagaccccugucacacugcaagagggauggcccgagacugaugguaucaacagaagcgauacuugucacuuccaagauucguuuauaaaagacuguggcuuccaucuuggucagucucucuuucucucucucucucucuccuuugacuugcuguggagggggccagcugcuagaucuugaagacacuuagccaucccuguagagagacccaugucgcgaggaacugaggccugcugacaaccaugcggguccuucagcagggauccuucuuugccaucacagaagaccacagccccgacuaaugucucagcagcaaccucaugagagucccuggguccagggaccacccaggaaagcugcuccugaacuccugacgcacagaaacugugagaaaauaaauguucauuguuuuaaguggcuaacuuuggggaugauuuguuaugcaacaauagagaacuaauaugguggcuuucuaacuucuaaccaugacccauagaaagaaacagauuuuacucagcaucccaguacaccagcccaugcacacuuagacacgcauacacaugugcacacacacacgcacacaugcuggcaugcacucacccaugcacauacacaaacauacauacaaguauugcuucaugaaacaauacuuacuccuacuacauauauucuccucacucugauauuuucuagauuauuguuugcuauuucaacaugccauuuaaaagaaagugagaacagcaagccacuaaacuaacuucacaauccauacacaggguguggagcagcgugcagaagacaaagaggaacaaaucgcaauuucucguaguuugucugucaucaguugacauuucaguagccaugaucuucacuggcucaccuucaaagccaguuuaguuuucuuuuggaaacuagccccuucuguauacaguaaguaccaaauaagugcuguaugaucccuguccuuuacuaugauaggcaccaggagaccagaugacacuaugcauuauuuuucucuguguaauguuucauaaaguauuuauuuauuuauuuauuauuuagagauggagucuuucucugucacccaggcuggagugcaguggugcaaucuuggcuuacugugaccuccgccuccugggcucaagcuauucuccugccucaaccuccugaguaacugggauuacaggcaugcaccaccacgcccagcuaauuuuuuuuuuuuuuuugagacgggauuuugcucuuguugcccaggcuggaaugcaacggcgugaucucggaucaccgcaaccucugccccccagguucaagugauucuccugcuucaggcucccaaguagcugggauuacauucaugcaccaccacaccuggcuaauuuuguauuuuuaguagagacgggguuucuccguguuggucaggcuggucuugaacuccccaccucaggugauccacccaccuuggccucccaaaaugcugggauuacaggcaugagccacuguguccagucuucauaaaguauuuuagucauauacaauuuagaauaauaugaugaaaauauguguauucauauuccgacugagaaauaaaacauuagaaacgcagacgcagcucuugugcugcaaugugaauguuuaugucccucccaaauccacguacugaaauccuaacucccaaggugauggcauugggggugaggccaccagcaggugacuaggucaugaaaggggggcccuaaugaauggccuuaguggugcccuuauaauagcguccccaaagagaccucuugcccuuucuaccauauaaggacuuugcagaaagaugucuggccgucugugaacuaggaagugagccuucgccagacacucaacuucucagcacgucgaucucagacuuuccagccuucagaacuaugagaaacaaguuucuguuguuuauaaacucccagucuaugguauuuugccagagcagccccaaacagacuaagacacaccauguaacccuccccagucccaauucccucucucccauuauagagguaaccucugcccugaacuuuucauuucucauucacuaugcauguuguagcuuucuuauguauguacauaacauaacacauguagguauauuuucacauaggcuuauguuuuauacacauggggccaugcuauacauauccuuuuauaauuucuuuugcucaacauuacgcuuuugagacuuaccccugaacucuaguucauucauuuuaacuguuuuaugucauuucauuguauggauuauaccaacagucaucuguuuguuccucuuguuugcagucauuuauauuuuuuucuauuacaaacaaaacucaaugaacauucuuacacguuucuagugaacacucucuccaguauauaaccaaauguuaaacuucuuaagggaacaagauccaauaucuaaacaauccuggcaagcagcccuuauugguuuuaacuuugucccaucuuuagauuccagccuacacgccuggaucuguuucuguuuagucaacagaguuuucaagaggggacaaaaagucagguuaaaaaaacaaaaaaacaaaauuggaaacaucugcuucucuuuaaacuggagaugugaagcaagacugaggaaauaaugaauauuagucauuguuaauaguagcuggaauguguugacucaaaugaucauaaacucuucucuauguaaccugccuauuaaaaucuaugaguagugguauuuguucccauaauuucaggaacaaaagguugccuugccuagguuuaucgaagccaggagucagcaacuuuuucugucaagagcccacauaguaggcuauuuauacuuuuuuuuuuuuuuuuuuuuuugagacagaaucucacucugucacccaggaugggguguagagugaucuuggcucacugcagccuugaucucccuggcucaaucuuccuaccucagccccccgaggagcuaggacuacaggugugccacaccacacccagcuaauuuuucuauuuuuuguagaaacagggucucgcuauguugcccaggccggucucucaaacuccuggacucaaguaaucuguccaccucgaucucccaaaaugcuaggauuacaggcgagagccauggcacccagccuauuuaugcuuuuuaggcugugcagagcuuacagucucugucacaacuacugaacucggccuuuguaacacgaaagcagccauagacuauacauaagcauggcuguguuccaauaaaacuuuauuuacaaaaacagacagccagauuuggcccaugggccauaguuugcuaagccccauuuuaagcagaagaaaauaauuuagacuaacgauauaugcuacuauacaucaaaauuuaaaucuuaaucugauauuuucucuuuuuugauagacaacuacucuaaaaacuagucuuagugagagugaagauaaacaaauauuuucaaaugcuguuguaggaauggagcugaugcauucauuuauuucuucaacagcuguaaauagcugugagccccaccauauaccaaacacuccacuggguacuggaaacauacaaaaaaaaaaguguaccugcaccacccucaaugagcucacagguccucaaugagcucacagguccucaaugugcucacaggcuagugaaggggaugguuauuuaaaguuuuuaacugcuuaaaaagcgaugggaugaaaauguuuacuuaucucuaauugaaaacauuuauaguggcaugaauauaucugaccaacaacagcagcaguaauuaaaaauaaauaacacaacugguuaacuccagucuaaggugucaaauauauucuuuuuuuuucuuuuuuuuuuuuuuuugaggcagucccacucugucacccaggauggacuacaguggcucaauugcagcucacugcaaccucugccucccagguucaagugauucucaugccucagccuccguaguagcugggauuacaggcacaagccacuacgccugacuaauuuuuguauuuuuaguagagaggggguuuugccauguuggccaggcugaucucgaacuccugaccucaagugauccacccaccucggccuccuaaaguauugggauuauaggcaauguucccaccugauguucuaccauuucaaagaaugcucuacauugcaguccaugcucugaucucccaccucaacaacccuuagaacucuccauggagccuccuacuuucccgccucaccuucucucccagggccaugugcucuggauucauggacagggcaggcaaugggccaugugcucuggauucauggacagggcaacgggccaugugcucuggauucauggacagggcaacgggccaugugcucuggauucauggacagggcaaugggccaugugcucugcauucauggacagggcaaugggcuaccgacuccagaugucccaccaccuuaccuccgggcacgcaacggaagccgucucccugauaaccagguuugcacuggcacgugaaagagccuggaguguuguagcagaaggcgucagggugacaucggcuuggcuggcauucaucuacaucuguaaaacagccaccaggcccagggacaaugagauuucuucuggaauucguaguuuacccaauaauuuaagccacuuacucaaaucuaugggaaccugcuucugaucugggaacaguaauccaaaacucacuaaacauuaacuaucaagucacuaacuccccaauaucuaucugucguacuugcaaauguguuucacuuuggcagcaauguuuucaugaaaaauguuuuuggccaggcaccguggcucacgccuguaauccuagcaccuugggaggccgaggcaggcagaucaccugaggucaggaguucaagaccagccuggccaacacggugaaacccuguuucuacuaaaaauauaaaaaauuagcugggcauggugacacgugccuguaaucccagcuauucuggaggcugaggcaggagaauugcuugaacccgggagguggagguugcagugagccaagaucgugccauugcacuccagcuugggcaacaagagcuaaaugccaucucaaaaaaaaaaaaaaaaaaaaaaagaaagaaaagaauguuuucaucaaccuuacaacaggggaaaagauaggaucuauuuguauuauaaaauucucccuccugucauaaaugagagcuucaaaacugucugaguguuuacugacagauuauuaacugcuaggcagaaaacccucagugaaaagaaaauauucacauguucaguaauaaagagaaaguaucucagaaauucuaucuuaguugggacuuuuuagaaauacucuaugguauaauauuaaguaauugugcaaaccaagaaacucaggguacucuauugaugggcuaucuuaccuaaaauuaccuguaagagaacaauggcagccaagaagcucaagucugaaggauucuauugagucauuuauacuuugacuccgcagucauuuauucaaucagagaacuuugcuuuuuugaaggagaagguuagaacaagccaguugaauggcuacauguuaauacaucuuauuaaauaaaaggauagacuuuaaucuccaugcauguccuccauguaaaaggacaguuugucucuuugugaaagacagaaaauaucccugguuccuagcagagagcaggugucuaauugucaccugaaugaacuagucaccuagaacaaaacagucaucaaugagaauagcccccaaaagaaaaugcauaguucaaacuacuagagagauauaaaaagcaacacauuuacucuguggagaugacagaagaauucuuucuucuauuugggagugaguuggugauuggcacaugacagguaccaccuaggaaacuuucucagguuacacacaggggaagaucagagcaaccacacaccuuggcaggcuuggccauccccagaaaagccuggcaagcaggaacagguguaggaggagccuccuguguagauacacugggcccgcugggguaugucgcaguuaugaaggccaguuucacaguaguugauggggcgcugguccacgacagcuucagaacaaaagguugaugcacagucuuaggaagaaaguccccugagcaggccacaugccccucccagcucuauaaagagagaccaugccuggacccuagaccucuaggcauguccacagcuucaccugcaccccacuccucacugggcugguacuacugcuuucaccguuuccucccaccuggguucugccucugaugggucuuggcugacugacaccgugguuugucauuccaccuggcuugaccucaguuucacucugggggucugucucaggccacucuccaaacuagauccccaucacagguccccaggacccaacuuucccuucaucuggauaugggggugggacaucugcagaugccacacuucugauggcaacucuguugagacugcuuggaggaaaggagcugagacuuccauguggugucuucagccuuggcccacccuguacagguggaacauucacuacaaaugcccaagucagucacccacuugccaccaaggaaggacaaauaaauguuucuaaggcagggagacagcuaugguuggaagacugugagccuuuggaguaggcagccuugguauauaccagguaccaugggucaaccacauggccuuagauaaauugccuuauguucuuccccccacccccucaacucucucucucucuuucucugucugucugcacuuaagguaggacaaacugaaaucaaucuuaagaagacucauggaggaaaaacaugaguccuccuucaucugggauaauccaacuacacaaagccugaugggagggaaugauuuguguucugacauugugaggaugggacucuguccuggcucugaguucuuuuagaaaaucagaagcaaaaugcaauggugccuuaggaaccccagaguaacugaaccagcugaaaaucacccuguagaccucaaccuuugccuuccaucuugaggcaacagcacaagauggggcauuaucagcuagccucugugacacucaccuccuccucagcccuccuuccaugaguucuaucaucaggacccuuaagagaaucacagucccaucuacuggccucucugugcuuggcauacuggaaguuaacugcuacagcuuuuugccuaagccugggcccuguucuucccucaagagaagagcugaugcaugccaucaugcccugcaccaagaugccuaggggaggagaaguaggaccucaaguucaccacacuccauaugccagcccagugucacagggcuauguccauucagagggguaucuacaucuucacaucaagcugacuuaugggcaagcugaggcccaccuuuccuucacaaaaacauguuuugcacauuucaauuaacugcaaaaguugguucccaguggaaaagagaguuaugaguuuacagaaaaugccaaagauggaaguccacaaacaucccuuccccgauaauggauaccaauccucaugaaaagagaauuccuccuggucaguccacaggcccugccugagcccccagccccucacaguuggcagagcacaccuugccccauuuauuucuucaccuugccccauucugaccugcaggguaaccuucccagugcaggcuuccgaccuagaacacuguuucaacaaggaauuccaagagagauggaaugaccacucaauuacucagugacaagccagaguuauuucuuugaaugcguguaggcagacuugguucuacagugagccuucucucugcgcagugagucucaaaggagccaauuaaaaggggugaagauguucucccucaaauauguaggccgggcgugguggcuuacaccuguaaucccagcauuuugggaggccaaggcaggcaaaucaccugaggccaggaguucaagaccagccuggccaacauggugaaaccccgucucuacuaaaaauacaaaacuuagcugggagugguggugcaugccuguaauuccagcuacuugggagacugaggcaggagaaucucuugaacccaggaggcagagguugcagugagccaagaucgcgccauugcacuccagccugggugacaauagcaaaacccugucucaaaaaaaaaaaaaaaaaaaagggaggcuagagcucaggggagaggacaagagccugcccacagcuggccuguguccuccuugacagcuccugaggcaccuccaagagcuccaugggucacaggaaaccaaugauccggucuaaucacuucauuuuacagacgaggaacugagccccagagagguugucuuccucaaaaguaaaugucugaagcagacauuugcccagcaccugucuugcaucccagccugccccuucagugaguguggacaucaggaaugacuggauccagaaacccaggucaccaugcuccacacaggugucccaggauggaucucaguuacugugcacaucagcacccaagggauaaaguauccacugcccaagcuugagccgaaguguaauguaaaugguauggccauuaaaauuaaacguuugaaucugcuuagccucaaaaagcagagaaagaaaucaggucaaauacacagaaacugauguucccuacugaggaaaaaaaaaaaagaaguaacuucagcagagugaaaaucucaacugugcagaggggacuggccucccugagcucacagauguuugggucacacucaaaauaugagaacugccuguucccucccacccucaagacaccaccucaccccacgaccuuggcaggcuuacccaagcuuugagacagagcaaaaagaaaacauucuaggguuuagcgaacagugaggaagaggcaagaagaugguuugcugacaugguacaagaggaaucuguuuuaaauugggaagacauguugaguucagaugcgcauuugacauggcacccuccagaccugggaacaagaaucuugaacgaccaggucaaagugcagcaggaggaaaaagaggaagaauuuaaacaaucuggcuguucguggcugacccauccucaucaucacccaaaucaucauucagcaagagcauaauuaaccuaauuaauagccgcaacuuacuucuauaaggcuaagaaauuaugcugcugcucgugguugguaaaauuaaaauccauaaauagaaugaccccaguuggaauuuuagguguaacuaaaguagaauucaaucuaagauagguaaugauccaaaaguaccuauaaggugcucccucaaugugaaccccaaggcuacuaauuacuggaagaaacaugucuaauagcuuauaguuauuaaaagcauaaugaaaaugauuaaaagaaguuuauaagaggcaaauguaaugcaaaagcuggcaacaggugaggcgaugguauuacuaguguaggcaauaauguugcuuacucauuacacuugugacucuccagauaguuggagggcagaggcuaagucugauucaucuuuauaaauugcucuucccagcaccuuccaacuugaccagacucauuuuaccugggaccagaacuuuugcauaagagcuaaugcacaccaugugaauacuguuucgaaaaguuaccuggagaacuuacccacacacguucccucaucugaaaacugguagcccuccacacacucgcagcggaagguuccugggugauuauugcagauuguguggcucccacacacugaggguuguucugaacauucaucaauaucugcagcaaaaauuuuuuuuuacugcaggcuuuuuuuuaaagcucuucaaacauuacugacuauaauaaaauagcauugucaccuaagaauagaucaauuuuaaaacaaaauuuucuuuuuuuuuuuccgagauggagucuugcucugucgcccagagcuggagugcaauggugcaaucucgguucacugcaaccucugccuccaggguucaagugauucuccugccucagccuccccaguagcugggauuacacgugugugccaccacgccuggccaauuuuuguauuuuuaguagagaugagguuucagcauguuggccaggcuggucucaaacuccugaccucgugauccacccgccuuggccucccaaagugcugggauuacaggcgugagccaccgccccuagccuaaaauaaauuuucuauguaucaaaaguaguguuaaauacaauuuuugucugugcauaacuggagagagugauccccaugccuuucuccuaaggaaacgugugcuucccccaccucuccuagaguuaauuucugagccuggggccccugaacacgagucuuucccauuagauugccaaauacauguuacaaggacacagagacacaucucuggacucugaauacugagagucucugaauauuaaauauacuuucaaauccuaaacuugagaguauauuuaaauaugcuauuauucgaaaauauuacuuucucuguuacuguuacaaaggaaaauugaacaauuuacagcuuaauugugaauuuuugaauauuaucuagggcuuaauggacuaaaagggaagucauucacucaugagauuguaaaugaacaaagagagugauguccuuuuauaugacaauacuacagccaccaucaugggguaacguggagcaaacaaacauaggcuuuggaguuggacauagcuagguucaaauccugcuuccuuuagcuauuaacuuguguggucuugggcaaguuauccaacuacucagccucaguucucccuuugguaaauaaguauacuacuacucaucuugaggguucuucugcagauuacggaaaauggauggaggucagagaagcacccaacaauguuccagacacccagcuaugauuauacuaacuagagauucauccaacaccccagccauggugaugaauuuggcuaacucugggaacacgccccucagauggccgccaggcuuugggggccaggcuguggcuaccacuuguguaaggcuggugggcccaggcaagaaacugagcuaaccugucauucccccugguuauguggccacugauggguugaaaugaacaguuacacaagguccuucccacgucaaccucauacucagaguguagacagcuacuucuggcauuucuaaaacccugagaugugcaugaggagggccucccaaagugcugggauuacaggcgugagccacagccccuagccuaaaacaaauuuagacauguuuuagaccuaaaacaaauaagacauguuucucauaauggccgagaccacacagcucuucucccccucauaaaucucuuccccagcgcuuucauaugaaucguugacaugugggagucaaagccuccuauguccaccuucaauguccagucuagccaggccuuuauuggugagacaaauguccuacuggccuauuggucaacauugcacaagacaagcauucuugaucacaucagccucauaguuuguccuguacccaggcaaauacccaaaccaaaugcucuucaacuuuuagagauuauacugauaugugcguguucugugacguguuuaagacacaaggucucaggacugaaccaggcacugccagaagguucuggaacaaagccccucccaaagcaggcuguuaugcaagcuggagcuggggaggcugugggggaggagugcacccagcacguuuggacuucacagcuccauccaucagcugccgcugcaacaugggagaaaaaaggggcuuccuguguccacugccucugugcugcaacucucagaggacacucccagcacagaugucuggaaacauuguacauauugcagggcucagugacuuagacugcauugccaaagcacgagagcacagagcagcaguuuucaaucaagaagacagagcaaaaucacaggggaucuucuucaagcucuguuccucccugggaacauuuacgcaaggggaagcuguguuuuggaaaagcuucuaugugaccaggcucuucucucuagcccuaccugaaaagcuauugacaaauaggaccucagggcugcugggaugauggagggaaugguucccuagcacaaccuccaccuccaugccggcuuacacauacacgccagacuagacaacacccuuucuuaagggacaagacccuagcaauuucugagcuaauaguccacggucuuugcaguuuggaaauucuuccuaauguauaauuuaaaucuucucuucuaggaccaggcacgguggcucaggccuguaaccccagcacucugggaggcugaggcaggcagaucaccugagguuaggaguucgagaccagccugaccaacauggugaaaccccaucucuacuaaaaauacaaaaauuagccaggcagcaugugccuguaauuccggcaauccgggaggcugaggcaggagaauugcuugaacccaggggguggagguugcagugagccgaaauugcgccauuguacuccugccugggcgacagagcaagacucugccuuaaaaaaaaaaaaaaaaaaaaaacaaaaacaaacuucuuuucuauaaauugaagccagguccuuaacccuuucuucagugguauugaaaacuggcaauaacugucucucauaacauaccacaguaucugcuagaaaaugauuauucuuauuauuuaacaucuggucaaccucuucucuggaaagagauuuccuuucacaggaucacuuucuaacucaauaggaaaauccuggaucauucuugucauugcugccuccuuuuugacuuuuuucagaguggcuacuuuucacauauuuucaacaacucuaaguuucuccaauuuuucccuuuuauaaaggccaggcucuuagaggagaagagucucauuaccaauuugcuaaaugccuucuacauacucgacgauuacucaaugagagaugagccaaaacuaucucuacgggcucuaaauugagaaacagcgggagccauccugccauggaccagagugaaucacagagcucugugaaaucgucuccaaauuacuguggagagucacugugcgacgucucaccaaaaccacccuuguuuggggugucauauaccaucauaucagcgcugcacacacugaaucacaaaggcucauccucauucuccucuaacgcacuucccaaguccaaauaacacaugaagugaucugcuuaaugcaauuuccuauuuuaagccucaugucucgauacauuaacacuucaaggcauguucuagugacccagaacaauaaguguccugacugggaauacacucgcauuccacggagguaauaagucagaacaaccacucaccacaggacaaaagcaagucuacaugcgaccaccugucuuucuggacaaggauaucggaggauuuucuaggauggugcagauuacauaaaggauggcugguugugccuucugaagugaagcacucccacuguggcaagcucaggcaccaagggcagaauuagccacgaggucacaguucaacagcagcagacuggguuacuucugcaccuuauuacuauccaggaggcuuacgaaguugaagcagagcuguguaaugaggaggcauggaucggugaaggagccccauccccgcaugccagccgucucacagccugggagggcucccguucacacacacacacacagcaucaugcugcuuugaacuggccagagccaauucagccauucaaggcugucaggcucuuugcaggaaauacugggaaacugacgauugcaggugaguaggcacuauguccccucccuagcgauacguuaccaggaagguaagucccagacugaauucuaccacauauacaaagcuaucagcaagcuggccaaacauacagccugcacuaugcgcacaaguuccugcccuccaguauuucagacacccugacaggcaccuugcaugaaagguucacuaugaagccaacaccgcgaggcccugacagcaggaucuucuaaccuucauguuacaucagcacaccaaaucugccauuagcugcggcugcuggauuccagaccucaggcaugauucccgaauucugagacugcugggcuugccagauucuuauaucucugucaagcagggguagagggagcuguucauuuuccuggccaaccauaugugaacacacuauucaucccaccagggaagcuuacuucuagcauuccuuaugcucauuagugagcccucucacuaauugcagacuuaaacagcacugcucgaagcacuuggcauucuugcccuuaguaguggacugacuuccccuuggcaguagauuacaauuuaguaacaaacaaauaucaagcugccuacaugaaaguauuugaacuuaaguuauaaauaauaaaauaacugcaacuagaagauggaguaauacgaugcuugagucagagacuuguguucaaauacuauauuugucacggcucacuuuaaugagccucaguuuucuugucuacaagaaaagagcguugcgaggccaaggcaaguggauugcuugagcccaggaguuugagaccagccugggcaacauggaaaaaccccaucucuacaaaaaauacaaaauuagccaggcaugguggcacacuuguagucccagcuauucaggaggcugaggugggaggaucaccugagcccaggagguugaggcuggagugagccaagauugugccacugcacuucagccugggcaacagagugagacccugucucaaaaacaauaaaaauaaaauaaaauaaauaaauaaauaggagaaugaaacucacacccauuaggauggccccuauuuuuuuuuuuuuugggagacagagucucacucugucacccaggcuggaguggaguggugugaucuuggcucacugaaaucucuaccucccaggcucaagcacuucuccugucucuccuacucccaaguagcugggacuacagacaccugccaccaugcuuggcuaauuuuugcauuuuaguagagacgggguuucaccauguuggccaggcuggucucaaacucccgaccucaugauccauccaccucggccucccaaagugcugggauuacaggugugagccacugcgccuggccuccuauuuuaaaaaacacagaaaacaaguguuuucaaggagauggagaaauugaaaugcuugugcacuguaggugggaacauaaaauguugcagccccuguggaaaacauuguggugguuccucaaaaaauuaaagauggaaaggccaggcguggcagcucacaccuguaaucccagcacuuugggaggccgaggcagguggaucacuugaggucaggaguuccagaccagccuggccaacauggugaaagcccucuuuacuaaaaauacaaaaauuagccuggcaugauggcaagcaccuguagucccagcuacuaggagacaaguaggugaaucacuugagcccaggaggcagaggcugcagugagccaagaucacgccacugcacuccagccugagcgacacagcaagacgccaucucaaaaaaaaaaaaaauuaaagauagaauuaccauaugauucagcaaucccacuuuugaauauaugcccaaaagaacggaaagcaggaacuucaacagauauuugcauacccacguucauaacagcauuauuugcaauagcuggaagguggaagcaacccaugcguccacugauggauggauaaacaaaaugugauauguacaugcaaugcaauauuaucuaaccuuaaaaaggaaaaaaaauucugacacaugugacaacauaggugacacuugaguacacugugcuaugugaaauaagccaaucacagaagaacaaauaugauuccacauaugcaaucguuagaauaaucaaaugcauagagacagaaaguggaauggugauugccaaagacugaaggaagggggaaaugugaguuguuguuuaauggguacagaguacguuuugcaagauggagaguucuggagaugaacaguggugaugguuacacaauaaaaugaaugcaugcaaugccacugaacuguacacuuaaaaaguguuaaaaugguauauuuuauauuauguauauuuuaccgcaaacaauuuuuuuuuuuuaaaaaggaacaaaaaauccaucuuguuagaguuguuggagaauuaaaugagaugauguugugaagcacuuaguucaaacagugccuggguaaauuauagcuauuguuauauuacugguguuaucauuaacagcucugacuuacaacuccuuuuaaaccugugcauucuuaagacggaguggaguguggccuuaggaauucuacucugcugcuuaaucagacaaaagaaugggccaguacucccgaguuuacccacgggaacagugaaugugaagcauaaauaauucaggccuggcauguccaccaguauuuaucucauccgugcuuccuugcugcacccaguucucugguuuacagaacguggaugccuccuccucgccugauuucccagccccaacaagucagaaucaaaggcuguaccauagcagguucgcccgucuccucggaagccgauggagcacucgcaggugaacuguguccugggaccagggcgacaggccgcguuggugucacacccaugagugccgauguagcagggauucugaagagcaucaggggagccuucugugaagacagagacauuggaaccaagugagucuucaggagcucuugcagguuuccuccuuccacagaaagucaaccacaacuggugagcaagaaggugaucacagaagagcagaguggaaugggacaccagccaauuccuguguugcccuggggcaggaccagcauggcccccucccuguucuuguaaauaaaguuuuauuagcaaccagcaacguccauuuauuuauguauggucuauggcugcauuugugcuaccacggcagagcugacaugucgugauagagacuguauagccagcaaaaccuaaaauaccuacuaucugguccuucaccaagaaugcacugacuccugaugccuggagccacaguugcuauaggagggagaaugccugccuucuuucugcuucauaaaguuaaagugaggacaaauuaauuagcuagagcaaugauuuggauauggaggaagaaucaaagacaaccgaaaaaagggaaagauuuuaaggcucagaccagacuccaauuacacaggaccccugaggcuuaaagauauggacaaaugugaagucugacacugguaugucacaaaagcucccuaaaccucagcuccuucccgacagcugggaacgcccacagaccagaccgcagcgccagugaugcagagucacagggcaagcguuucuuuuaggcucccucccuaauuuuauucaauuuccucaggcacuaaccacacaauuucuuuuucuuuuuuuuuuuuugagacagccccucucugcugcccaggcuggagugcagugauaugaucuuggcucacugcaaccuccgccucccagguucaagcgauuuuccugccucagccgccccgaguagcugggauuacagccacacaccaccacacccagcuaaauuuuguguuguuaguagagacaggguuucuccauguuggccaggcugaucucaaaguccuggccucaggugauccgcccucuuuggccucccaaaguacugggauuacaggcaugagccaccaugcucggcccuacaauuucucuuuuuuuuuuuuuuuugagacagagucucacucugucgcccaggcuggagugcaguggugcgaucucggcugacuacaaccucugccuccuggguucaagcgauucuccugccucagccucccaaguagcugggauuucaggcacgugccaucaugccuggcuaauuuuuguauuuuuaguagauacaggguuucaccauguuggccaggcuggucucaaacuccugaccucaagugauccacccgccucagccucccaaagugcugggauuacaggcaugagccacuggaccuggccuacaauuucuuucaagguugaauauuaaaggguuuuaaaagcccugccaaugccagcaguagccuuaagaggguccacucuguaaggcaccucaacagguuagcauucugcacuuuacuuuagauagaaucacgaauaggccuuugguuagaagaacagacaggcagcuuuuccaagaaucaaaaauaacaagacauucuuuuuuuccugccagaagauacuuuagcauaauuuucuucuacagacugagaguaagagaccaaaaacaaugucaaagagugggguuuuaaaaaugcaugagcaccugugcccagcaugagcuguauccccuuaccccucacaggcccaauggaguugcugagagcauagcgcaagaucuucuccuccugguuguacaggacgaacacgcuguccaccgagagcugcugggugcugggcagggcuggccgggagucaucguggacgcauuccuggaaggugauggucuggcgccacugguaaguguagaugcgugaaggagaugccccaucucgcucgggcucagucaccguguacucccggguggaggaggaagugaucacugcagagugggaaggauggaggggacaaggcagggagacagagggaagaugguuaaggaugcaagaagcugaaucaacggcuuucaaggcaccagugguauucccugcccauaaggcuaccagaugacagaccagacagaacagcuuaaauaagaccauuuguuuguauugagacucauucuaugaaauaccuggauuccccauaugaucauugguauuauucguauuauguguauuuguugcuuuucucucaagugguucucuguaaguuuugaagacgcccagaacuagagaugaaggucagguugagaggacacacacuuggaaagagacgccccugaauucacacucaguaccacucacaagcuguguggccacuggcugaugacucaacaucuuuggucucaguuucucacacaaaauaggucaagguggggaucagaccagguaauguaugugcaauuucuggaaucaagcagacuaauaguauuaguaagauaaacuaccauuuacugagcauuuacucugucacaacgugcuaacugcuuuauauagguuaucucaauuaugauucaauaaauggugauuucuuuuucauuuuuuuuuuuuuuuuugacacagagucucgccuugucacccaggcuggagagcaguggcacgaucauggcucacugcaaccuccgcccccuggguucaagcgauucucccaccucagccucccaaguagcugggacuacaggcaugugcuaucacgcucagcucauuuuuuuguauuuuuaguagagacgggguuucaccauguuggccaggcuggucuugaacuccugaccucaagugaucugccugccucggccucccaaagugcugggauuacaggugugaggcacuacuucuggccaauaaauggugauuucuacauaccggucuagaccaagccauccugcaauaccaaaaaaaugagauauuaaaugaguuucaguagccagguuuggaaaaauuacuaaagcacugugagcaagccugaacagaggagaggagagacaguccuccccacucagaagagggccugcuauggcccauacgacaaaacccucaacuuccuguuuuuuuaaaaaaaagcauaaaagacucuuuauaucuuugugcucugcugcaguuugcuccauaauagaagcauaaaagccagaggauaaauaaaagaucaguguaagcugccuccuguccagcucccacacgccagaaaggccauucagcuacaagccggccgcaacugugguccuguugcucuuuccuccucuucuucacugucucccagcuccccaggagaacucaaccaagccacaaaacuccaguaauugcuucaaccuuuccgaacagcaauuuaauaagagccuuuaaaaagguggccaggcacgauggcucacgccuguaaucacggcacuuugggaggcugaagcgggaggaucacuggaggucaggaguucgagaccagccugggcaacauggagaaacccugucucuacuaaaaauacaaaaguuagccaugccuggugguaggcgccuauaaucccagcuauuucagagguggaggcaggagaaucacuugaaccugggaagcagacguugcagugagcugagaucacaccacugcaccacagccuuggugacagagcaagacccugucucaaaacaacaaccagaaaacaaaaacaaaaacaaaaaaaacgaagggauucuuaaccugggguuuaaugacccacauaugaguucauguucaugaauauuauucagugggucucuacaugagcaagacaccaucucaaaaauaaaauaaaauuaaauuaaaaaaauaaaaaauuccuauuguuugacucggcacuucuauuucuaggaauugagucuuagaaaagaaucagaaauuuggccaagauuuaugauuaagacaaucauuucaacucauaauaagaggagaaaauggaagcaacccaagcuuuagaaaguagaagaaugguuugaauuaauagccauccaguagaaucacacagauuccuuaaaaaguguuuucaaagacugcuuaaugagacuacuaaacauucacgauuugacauuaacugaaaaggugaagauauaacaaugugguaugauugcaauuuuauuuaaauaaaaacuauaagcauggguaacauggcaaaaccccaucuguacaaaaauuuaaaaauuagccaggcaugguagugugccuguagucccagguacucaggaggcugaggugggaggcucacuugagcccaggagguugaggcugcagugagccgagacugcaccacugcacuccagcuugggcgacagagugagggcucgucucaaaacaaacaacaaccaaaaaacuauacauaucacuguguauccauguuaaauuucucaauuuugauaacuguacuguggccuuguaaaagaauguccuuguucuuaggaaaaacaaaugaaguguuuaaagaacgaucuaucaugauauauacaacuuauucucaaauggucaguauacauauauauauauauauauauggagagacagagagacagagagagaaugguaaaguaaauguggcaaaauguuaacaauuggugaagcuagauaaauaguaugugaacguuuuuugggcuuuguucaguuuucacguaaguuugauauuauuuaaaaccaggcaccaaauggagaauaaauguaguuuuuaauaguacauacagauguggccgggcgcaguugcucacaccuguaaucccagcacuuagggaggcugagccaggcagaucacuugaggucaggaguuccagaucacccuggccuacauaaugaaagcccaucucuacuaaaaauacaaaaauuagccaggugugguggcaugugccuguaggcccagcuacuugggaagcugaggcaggaggguugcucaagcccaggaggcggagguuguagugagcugagaucgcaccacugcacuccagccugggcaacaggagugaaacccugucucaaaaaaaaaaaaaaguacaaauagauguauaauaaaauuaguuuaucaugaaauuauauguugggauauuucauauacauguaaauagauagaugcuggagaaaaagcugaaaagaaauacacuuaaaugucauaauaauuauguccagguuuuacaacucuaacucaugcguauugucuuuuuugcacaaaauucucuacaaggaguagugcguccuaugucuauaauugaggggaaggugacuguaaggcccgguguauuucccucuccagaucccagagacagccccaguucacggcugccguggugggucaagagcacgaggcuaguggccggucuggggcuggcccugggacacagcuggggcucaccugagguggaguagugguacagcuccguguagggcucaaugugcacggaggagccgaacggaaucugcggcacgcggcccuccagcuccgugucgauggucaggugcccaugcucaucgaugccgcugaaccgcugcuuaaugaccagauugcccgggugccccacgaaggucaccucagccuggcgagugaacucacccccugaaaaacaagaugagacugucacuuugcugacuggggagcgcgcccuucugcccgccccaggcucacaguguggagugggguuggugcgaacgcuucugcaggugcuuugguuuggcuguagaacauagaacuggugacacugaagacagagcucagacaucccuguggcccaacugagccacacgcagaggagagaagaggcuuccuagccacagcccagcaucuguuggguuggcucaaggguugugcuggaaauagcggaggacagggguuggacucccagcugugcuaggcucugucugggugaacuugaguaagcuacuuaacuccugugagccuccauuucccugaugauuaaaaaaaggauacaaucuauguucugcaaauugucaagugcuccauaaugccaguuacggugaugaauauugaaauagcuacguccugguuggaugggugaguugcucguggcaaaccauucccaguaccagaaaccauccuaggaucaccugcuaccaugauggcuuaggaacuccucuuggucugugcaaggcggcagccccagacaggcaggaaaaauacuucucccuuuuccacaaugaccugccccgugacagcagggguugacaaacuauggccucagggcuaaaucuugccagcugccuauuuuucuacaacccuugagcucagaaaggucuuuacauuuuuuaaugguuaaaaaaaaaucaaaagaacaguauuucaugguaugugaaaauuauauacaauuuaaauuucagugcccagucaaaaaguuguauuggaacacagccaugcucauucauuuauauauugucugugguugcuuuucacucugcaaugacagaguugagccgucgcaacagagaccauauggccuaaaauaauuaggcauagcuuuaaauauuuacuaucuggcccuuugccgaaaaaguuugacaaccucagcuuuauaguuaaacaagucccaggcaaguaucucaaagauaacacaggaccaggagaaauucagaaggaucauuggaguaaacagauuugcugcugucaggaauuugcaaagacuuccucucccucagcccagcugaaguccauguauauuacaaaauagcaccaauauaaauuaacucauauuaaaaaaacaaacugugaaaagcugugcagggaaggaguggggucugugaguuugacugcagcucaaugauauuugcaaagaaaagggcaucugguuugcaugagagcaucaauauuguuauaacacucagaauauauaugccuguggacuaggaagaaaaaacauuaggccaaaaaguagcaaaucuuuugagcagguucaauccuuuucuuuuuuucuuuuuuucuuuuuuuuuuaauacagagucucacucuguugcccaggcuggagugcaauggcacgaucucggcucacugcaaccuccgccuccuggguucacaccauucuccugccucagccucccgaguagcugggacugcaggugcccgccaccacaccuggcuaauuuuuuguauuuuucauagagacaggguuucacuguguuauccaggaugaucucaaucuccugaccuugugauccaugugccucggccucccaaagugcugggauuacuggcgugagccaccaugcccggccucacuccuuuucuaauagauagccucuccuuucuuaagacggccacacuuuauguauuuauaugccauaacuuuuggagggguuaccagcgugcagccuggauggagacccugcuuccagcaguguuuccucuaauaaagccuuggcuaaggcuccagguuggcucaggcagugggggagaaggcaggucuaggucgucggaggcaguggcuagguaccugugccccagcacaacaaacuccagguccuggaagugaccagcgaugaaggacacagacuccuccaacccagcuguucucgggaaugggucuccagcaugcaaagguugggcuggucuuggcagggcaaggggaaggccaccacaacaccaaggaaacaucccucaagccaucugcccacgcguccaguaaagacugaaccuuccucaauagggcacagucucuaaaaaacuccaaggauaucuaggcuuccuaagacuucugaggauuauguuuaugcagcuuaaguaacuagcuagaaauggcagguuccuucucucugagcaaauccugaggaaauaucaaagaucaguuucagguugguuuggaauucagaggcaggcuugagaucaguuucagguugguuuggaauucagaggcaggcuugauagaaugaggcaaacugugaaguugugagguucuacgagcugauaucacuuguucugccagaaacgccuaaaucuccaccacgaaauugcuccucaaucaaaacccaauucuaggcagucucaguugcuauauauuaaugauaauauuacauguucauuuuaccucaucaucuuauuuccaagacagaacuacaggaugcccugucuacagacaaaaaggagcaacaacaugcuucuaaguugucugcagacucagaguucuccuuccauccauccccaggccucccccuaggcacuacugugugacccacuaauuuuaaugucggauauaaauuaccggugaugcugaacccauucuugaauccguccugcuccacugcaaacauccauccaaugaugccuccaacuggggccaguggaagcagagaauauccaacggucucgggaauggugcugauggcuguguaggagcgcccgugguucauuacuacguaagaguggaggucaguguucucaaagacaauggggaccuggcugcuccccacaaagauccuuccuuucaccuugccauugacucgcuggggggaaccugagcaagaaaacaaagaaagaauauagagaucacuuccaagccagucuuucaaacacgaguaauauguaggaccuguaccuauuggugaagaaagcaaagaaacaaaacagcacuggggucaauggcuuuggguaagcaaaagcagcuguucuuccugagacuacccacaacuguaugcugcgggccuucaaaauuccaaugccccugccucucuuccugugacugaaaauggauagcacgaaagcugucuccacggacagccauugaggaacugcaggaguuaaaaacagaauuucagaagaagaagaauaucaggggugaccuagaacuaaggcgaccauagaauuuaucacauuugagaguaaaaggaggaugggcaugguggcucaugccuguaaucccagcacuuugggaggccgaggcaggcagaucaccugaggucaggaguucaagaccagccuggccaauacggcgaaacccugucucuacuaaaaauaaaaaaauuagcugggcaugauggcgggugccuguagucccagcuacucaggaggcugaggugggauaaucgcuugaacccgggaggcuaagguugcagugagccaagaucaugccaccgcacuccagccugggugacagagcgagacugucucaaaaaaagagagagagagaguaaaaggaguguggaauugcucauuucauugggacagcaaggcuaaccugaauggcccugggaguauagacauuugccugccugaucuauaacacacuuuaauaaacacugugagcucauauacagucccaccacccagcguuagcacugccagucugagucuuggagccucagccagcacaagccacacagacaaguacagagucaccgcccaggcuacacagucaugcccucugaaccagaaccagcuuggcgugucuggugcugcuuguuccauuuagacaacugggaacgauggaauugagaccuacuaugacaaauuuaaaagccuccuuaauaccuugauaauaaauugaucugggauaccauuuuugcuuaaaaaauuacauucaugauaaauguuggcauauaccugggggaaaacugcuaacaaugguuaacucagggcaaacguggugaauucauuuccuauacuauaaauuuuuauaauuuuugaguauuuauaacuugcauauauuuauuauuguuuaaacaggaaaaaaauaagaacuaaagaaauuaaauugcuguuuguuguauucaaauaagaacauugaagguuacuguauggcccagcaauucuaauuccuagguauacagccaagagaaaggagcacauguguccacacaaaaacgugaacacaaauguucuuagcagcauuacucaccagagccaaaaggaaaacaacccaaauguccauuaacugaugaauggauaaacaaaauacgguaccuccauucauuaagauauuauuuaacuagaaaaaggcaugaggcugggccugguggcucauaucuguaaucccagcacuuugggaggccaaggcagguggaucaucugagaucaggaguucgagaccagccugggcaacauggugaaaccccgucucuacuaaaaauacaaaaaauuagcuaggcaugguggcggucaccuauaauccuagcuacucaggaggcugaagcaggagaaucgcuugaacacaggaggcagagguugcagugagcugagauugcaccauugcacuccagccugggcaauaagagcgaaacuccaucucaaaaaaaaaaaaaaaagaaagaaagaaaaagaaaaaggcaugaaauacugauaugggcuaaaacaggccaugaaccuugaaaucaucaucaugcuaagggaaagaagucagacacaaaaggucauguauuguacgauucuaugugcaugaaacgucuggaauaggaacaccuauaaagacagaaaguaggugagggcuugacagcggcugggggcauuuugagaaaucaagagugacuacuaauggacacgguguuucuuuugggggugaugaaaauguucuagaauuagauagagguaauaguuggacaacuuugugaauauauuaaaacccaccaaauuguauacuuuaaaaagguaugugaauuauaucucaggaaaacaaaaacugaaggaagagggaaaacaaagguuacauugcauuguuuauauuugaugugguauuacuuucaguuauugauuguacauaucuuauuucuguuccuagauuaugaucaucacagggucaggacuuucacacccagccccucacagguucucggcagaguuuucuuuuuuuuuucuuucuuucuuucuuuuuuuuuauuauacuuuaaguuuuaggguacaugugcacauugugcagguuaguuacauauguauacaugugucaugcuggugcgcugcacccacuaacucgucaucuagcauuagguauaucucccagugcuaucccuccccccuccccccaccccaccacaguccccagagugugauauuccccuuccuguguccaugugaucucauuguucaauucccaccuaugagugagaauaugcgguguuugguuuuuuguucuugcgauaguuuacugagaaugaugauuuccaauuucauccaugucccuacaaaggacaugaacucaucauuuuuuauggcugcauaguauuccaugguguauaugugccacauuuucuuaauccagucuaucauuguuggacauuuggguugguuccaagucuuugcuauugugaauaaugccgcaauaaacauacgugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucccaccaacaguguaaaaguguuccuauuucuccacauccucucucagugaauguuguugaauagcccuaggcaggggcugccauccggggaucagcugcguucugaugacuuuucguuggguuccauacgcccaaacggcucaacagguucucugaucagccaggacauauccaacagagucauucugcacacacguugcaucauuacuccggggaacacugugaaguuagcuggccaacagcgcaaaaagguaucccaagaacaaucaggaaaacaagcaagaaggccaaguuaagaaaccaaacaaaaaauuuuccaccaaacuuugagcuagaaacauuuuuuuuuuaaguagcaagaauccaacaaauauuuaaaccacaaaucuauuccaggguguguauauaaugucaaaauauguggcugaacaguuugucauaucugagcuggcugccaaacacaaacuguucagcauuucaagcucugauauuugggguagaaaaggcuaagagguugcucuuuaagaauaagcuuuuauuguggauuuuggaagcuucuccugggauggagaagauacaaaagccaagccugaaacaaagaagcaaagacacaccaccccuggggugaugggauuuaaaagaaaaucaaaaacaguuuagaaguuaauaacauccccuaaaauuaauaaguaaagcauacucaauugucuuccauugcugaagguaguauuuuuuaaaaccucacuuuaucuaauggggacacagaaggaaaugauuuuuuguuuuuagcaacuugaaaugauaacgaauuuaauuauaacuauggcagguagggguucugaaaagcagaaaccauuccuccaguugacuuuuauuuagucaauuuuugcaaagcaauugaaguuccacauuaaacacacaaggaaaaugacccacgacaagugagacaauuuguuggcaucugcuauggcuugaauguccccuccaaaacucauauugaaacuuaauccccaaugugauagcauuuagaaauggggccuuucugagcugauugggucaugagggcucugcccugaagaaugaauuaaugcagucauggauuaauggaugaauguguuaucacgggaaugggacugauggcuuuacaggaagaggaagagagacccgacccaggaugcucagccuccuguaccaccucugcagagagcccccaccagaaacaaggccaucaccaaauguggcccccugaucuuggacuucucagccuccaucacuguaagaaauaaauuuuuuuucuuuauaaauuacucaguuucagguauucugcuagaagcaucagaaaagugacuaagaccgcaucugaagggaggaacguuuaacauggugggguuuugccauuuuuguguuaauucuggaauuaagacaaauuccagccucccagauggugcaccgagugaacauuaccaggacccccagauuugcacagaaaggauucuccugaccaucugcaagcauccaaaccaguugauccuuuugagggcagaguuuagaauggacauuggcccauagccgaauccauuuggaauuggcaccccagcauuaaccauggugcaucucugaugcucaacuguaaccacgcuaugacuucaggagcaccaggaaagagagacaggagggagaggaugaugggauaaacuuuacuugccacagacuuuggucuaagccagccuucuguggcccugcugggacuuagcaaccauuaagauaggucuggcugggcgcgcuggcucacaccuguaaucccaacauuucgggaggccgaggcaggcagauuauuugaggucaggaguuugagaccagucuggccaacauggagaaaccccaucucuaugaaaaauacaaaaauuagcuggguuugguggcgcacaucuguaauuccagcuacucaggaggcugaggcaggagaaucacuugaaccugggagaugaaagcugcagugagccaaggucacaccacugcacucuagccugggugacagaguaagacucugucucaagaaaaaaaaaaacauaggucugugagcaacacaacauaaaauuagagagacucuaagaaaaaaauacaugaaagagauuucaaagaagugaaggaaagugagggacauaaacaauucuuuguccaggcugcauaauuuuaacacuacggccuuuguggccacacaccacgcaguugugaagaugggcucccagugacuguccccugagauggagaaauagcacaggaaaggaagacuuugccauauuugaaaaaugggccuuccugggggaugccuguagagaauacgagaaaaaaugaggaaagagagaccauguauggcugccauaagaaaaacucuacacaccuacggagauguggguaaagcaacauggaaaacgagcaccaaaacaaaaacuccgcuccuccuucucccgcaugaaacgaacauagaaaagcaaauuaccuucugcaacacauugccugccauugcccguauagccagcgacacagcugcagcagaagcccguggcguagucccugcacucugcgugcaccgagcacuggugucuguuguuagcacacgucuggcgggaauccguguuauagcugaaaacugguccaagaaaacaauugcacaccuguaagcauuucaugcagcucuagcccggugggcucucucaucuaggcacccucaagcacugcagggacucacaccugcaugggcaauucaagggaccaggcucacuacagaagauuacaauccccuacagguagccacuuaaauaguuacgugagccugggcaacauggugaaacucacaucacugaggcaaacaggucuaaaaggaguugagaaaucacaaggugauuauuaauuauugaaaacugcuagaaucuaguguacuuggcaucaauguuagauuagugcuauccaauagcaaucucaggaugguguccauccaaacuagugagaacaaugagcuucauguuuggggggacucuuaaaauauauauuaaaacauauauaauauauauuaccuauguuauauaggucauauauaauauauauuaccuauguuauauaggucauauauaauauauauuaccuauguuauauaggucauauauaauauauauuaccuaugcuauauaggucauauauaauauauauuaccuauguuauauaggucauauauaauaaauauuaccuauguuauauaggucauauauaauauauauuaccuauguuauauaggucauauauaacauaaauauauuacauauauguaauauauauuaaauauaaauauauaacauauauguguaacuauauauguaaauauguacauauacauauauguaaauauauaauauauauuuacauuauauuauauaauauauauuuacauuauauauuuauauauacauuauauauauuuacauuauaaauauuuauauaauauauauuuacauuauauuacauuauauaaaauacaauauauuacauuauaauacauuauaacagauaaaauauauuuauauguuauauaauaauauauaauacaguauauacuacauauaauuauaugauauaauuuuuuuaauuuuuuauugugguaaaauauauauaacauaaaauuugccauuuuaacaaccuuaaaauauguacauauauuuuauccuccuuccucugccucccaaguagcugggacugcaggcgggugccauugugccuggcuuauauucuuuuuaauuuuaaaucaccucccaccccaccccaacauacacuuuucccugaggaauaauuuggaagcacuuauacucaaaagcugaacaaaaauaaugcccuagucacaccugggcuaaaaagccuuugacccaagaaagaaaaagaacaucucccuauuuuaaauuuccacauuccaacuuuguuuuauuagaaucaugaacuagcucauuauauuuaauaaucccgagcaaauuaauuuggaaugaaauucaaaagcacaagagggguaaacuuucagagaagauaaugaucccauucauaauugacuguuacgagugaagagaaaagcaaaguuuaaacccagguagacucuaugaguccuacauacucggaagggaauuucuggcuuuauaaagacagcguuuggagccgagcacacuugagcccugaacugaacacgugaugccgcugauuacuuaaacuccagcugugggcagagcucucaggggucauuauggccuguguacaugugaacuauucaaauaacaccaggaaugcacuacuggccacagaagacugaccuuucucuucaacauagggaaauaacugggguagagggacaggaaaacaucuguuuuagacacaaucugcguucaaaucuaggcuuuuuucagucuuaaguaauacacugccccaaguuguugggcuggauauggucucauucaaaugugauggcuucacaaaugagaauuucagagacaccuagaaaggguggagacaggauggaacucaaaacccaacauaugcaaggaaacacacccaacacaucugggggagaugacuccaaaacccacggcagaguggcaugugcugagcaauguaagcaucaccccaggaacccagggugcaguaggagaaccuaagacaugagccccuguccuuguccugccaccaaauggcagcuucuccauuuccgugccucagaaguaagucagcacgccagccaguaagcaccccaucucguccacaguuugggauacucgugagaacaagcguguauggcuacugcugugagauaaaucagaacaaguaagggcaaauaaaaaugagugaacaguguggaaugggccagacuucucuaagaguuuuaugaucauuccuuaguagaaaagcagcagacagcugcaauaagcuuaucuaaaggcuuggacuaucccauuuauaugagucuuaguggauuccguaucaaacuaaugugaaaaaaaaauaaugaggacaguuuaguuggaacaucuuuuuuuuuuuuuuucuugagacagagucuugcucuugccaaccaggcuggagggcaauggagcgaucucggcucacugcaaccuccaccucucagguucgagcgauucucuggccucagccuccagauuggcugggauuacagaugccugccaccacgccuggcuaauguuuugcauuuuuaguagaggcaggauuucaccauguuguccaggcuggucuccaacuccugaccucaggugaugcacccgccuuggccucccaaagugcugggauaacaggcaugagccacugugccuggcuagaacaucuuuuauaagaaaaaugaaagcauccaggaguucuauuuucccucaaaauguagcaaaaaucugauauaacauaguugaccagaaaauguacuguaaaacuuuuuuuuucuuuucgaggcagagacucacucuguugccaggcuggagugcaguggcaugaucucggcucacugcaaccucugccucccagguucaagcaauccuccugccucagccucccaaguagcuaggacuacaggcgugugucaccacgcccagcuaauuuuuguauuuuuaguagagaugggguuucaccauguuggccaggauggucucaaucucuugagcuugugauccaccugccucggccucccaaagugcugggauuacaggugugagccaccacccccgacccuauuuuuuuuuaaagaguaucuacuuugauauauauauauuuuuuaaucuucacaaaccaacucugaaacugacgggaccugggaagaaaaauaaucaacaauucuaauuccaaaaccaagaggaaauaaaugucaaagauaagcuucauagacagccaaaagaacuucuaaaauguuuuuucagguggaugaauacauuucugaucugagaaaucacaagaaaaucugacuuucaaaacaauucuaacggacguuuucucuuuaaaacagacagaacggaauacuaggaaacuugaaagaagacacacucaacagucuccaaaaccaugguccuaaucccaaaagaucacugagcaucucugaagccacugggcauauaacaccaaggcuccacggcugugagaguucagccucuacuuucccaagcucuuaucuuuacaaaccaccauguaaugcucacaacugacaucuccccagcaguacgccugucuggaagcccacacauccaagaucguuaccaacugcaacuuaaauggucuuaccaacuccuguuuccucaacuucauccacaucuaugaccugagggugcugcuggugaaaagucuccacugccaacuggaaagaccugguucucucugugggagguccaaggggccuuucgguagcugcccggcgcggggagaggacgcugggcacacuguaugugucagcaccuccccuucucagagccuuguaggagaagggcguggugcccacauccuccaggcccagacgaguggucgccaggucauaaucuucauccucaucaucauacucugccccaucuucaguuccgaggaucacgucugcaggcaccacgccauuggugguggcuggacucccaaucucaaacacccagacacccugcugcccagaguuacuacuccuaggaggaaggacaggcuucuuagaaacaggccagcaacccaccaacagccaccacuacccaagcagagggagcccugaggaucuguguuggucugcaagccaucaccugcagcuaggacuggagaguggaagggcacuggccgucaugucugggcgucauguggcugaggcagucuagggcugucuggugagacuguguccaaaugggcacaauacuagcacaagcucagucccagccauuccagaagugugcuccagggacacuaucaggacuuaaaauucaacuugcucauccuaauugcugguuacaugcucuaccuuaugagcuaagguggcucauaggacugacaguggcuuuaggacugaagucauucaugcucuccacuaucucuuuccaugacaugguaugauacaauugaaaauacauguuuggucucuguccucacauucugaaacaagagcuccuacagccuuuggaauuucugaagugauaagagugucuuuuguaggcuaaugaguugacugauggcugggagcuccuagacaguuucaggaugggggcugguggccagaaagaccaaggcaugauuagaagguuggaauguccagcuuuccccacugccuccagggaggggagaugggcuggagauugagucaaucaccaaggaucagugauuuaaucaacugugccuaugaaauaacaccaccauaaaaacccuaaaaugaugggguucagagagcuucuggguugaacacaucaaggugcgggaaggcugguguacucagagacggcauagaaacccugcccccuuacccauaccuuguccuaugccucucuuccauuugguuguuccagaguuguauccuuuagaaugaacugguaauagugaagcauuuuucuguguuaugugagccauucuagcaaauuaucaaaucugaggagcaugccauggaaacccuccauuuauagcugguuggucagaaguacagguggaaacacaggacuugggacuggcaucugaagugggggcaguccugugggacugagcccuuaaccuguggggucugcaguaacgccagugcuagaauugaacugaaguguaggacacccggcuggugugcagagaauugguuggugugggaaaaaaaaccccacccauuuggugucagaagugugagugaaaacauugcagacgugguuuuuuagaaaucccaacuccagggccgggcgcgguggcucacaccuguaaucccagcacuuuggggggcugaggagggcagaucaugaggucaggagaucgagaccauccuggcuaacauggugaaaccccgucucuacuaaaaauacaaaaaauuagcugggcgugguggugggcgccuguagucccagcugcucgggacgcugaagcaggagaauggcgugaacccgggaggcagagcuugcagugagccaagaucgugccacugcacuccagccugggcgacagagcaagacuccaucucaaaacaacaacaaaaacaacaaaaaaagaaaucccaacuccauuggcugugagaucuuggacuagucucaguuuaccuuuggugcuuaaaggauauggugaaaagcaaaugagauacaaaauccaaaagcauuuuauaacuauaaaauauaguagaauaucccuaaucucuacuucuuccuccaccauuuuuaccauucuucugugucugugauuggaagugcuccuaucagaaauuacaugaaauaauuauauuauacgguggacagaggggacauacauuacucaguggaaaauacugagcaaaacaauggggugggguggggaugauaaaucacaaaaguccugcauaaauaggaugucuaaucaauuugucugccugggauucaaguaaagacaguggugugugggagcuuauauggacuagcuugugagagcuggcuguuaaaguuuuaggaauuuugcaagccaguuauuaaacacagccauucuaaacaauuaaauuacaugaacuuccaauuaaacaaguuauauuuuuuaaaaggaaaaaauauucaaaacucaucauauucuaauccuuuugcuacuguccaugcucuugaaauuauauauauuaaaccuauuuuaucuuuauggugagaauauauauaauggugcauguuuucugaacucuucaaugagugacaugacguuaauaacuugaacuuggccaucguaggaguauuuacaucacagaaacaggcaaacgcuauaaaucagguuccucugcccucauaaaaccaguuguuaagcauuuaccagcacaucacuaagugaagggcagaggaauucaagcuagauuugaagauauaaaauuaaaaggugguuuuaggggauucacucuugguuuuuaaagaauaaugggagaggaaagguuuuaaucuucaaaauccaauuugggcuuuucccucuuuugucaaauucuacaacauaaccugagagcaccauuucuguuguaagaauauucccccuagucaaugugaaggaaaagguuuucucagccuugagaucaaaggagauagguuugaauaacccuuauuucuaacaguguuuauagacaaaaugguaaaaacugucuuaaggccgggcgcggcacuucaugccuguaaucccagcacuuugggaggcugaggugggcagaucacccgagggcaggaguucaagaccagccuggccaacauggugaaaccccgucucuacuaaaaauacaagaauuagcugggcaugguggcacacaccuguaaucccagcuacuugggaagcugaggcgagagaaucacuugaaccugggaggcagagguugcagugagucgagauugugccauugcacuccagccuuccagcuugggcaacagaguaaggcucugucucaaaaaaaaaaaaaaaaaaaaaaaaaagaacuauuuuaaaugaggaugauaucuaaaaaauaggauaucuguucauucuaaaaauacauuuccuuaaguucaucagaaaaagaguaucucauaauauaaaaacuauaugcaaaacuuaaauccauaggaacauuuuuagguaaugaucuauaauacacauuacauuauccacauuaaaaaauauuaagaggagaaucuacugaagaacaaagaaagcauacuuggccaaauuuucaacugauucccugucauuagcaaauauguuauaagcuccguugcucuuccauaagaaucccacugaaccuugacugaaugcaaccacggcaggaacuugguuguuuuccuucuuugagaaugucguauggaacugcagaccauccucaggauaaaggaaaauggcauaggagcuggaaucagaggaggcuagaacagccuggaacguguuucucugugaagaugaguuaaaauucaguuacucggaaaaauaucgauagauuuuaaaauguguuauucgccagacuaucuauaaagcguacagugcuauagagcgauggcaauauucucaccuuauucuaaaagaaggacuuuuguagcaagaaccuaggauucugggauaguuccacugaaauaucccuaaggcuaugucaacaugacauuuucugauuaauucauaaauaucuucugcauaacuguggcccuaagguuaaccaaaaauuauacagaugguaccuccagaugguggccuaaaaucucacgcaguuuaggaaauucuuacccaaagacuuuguuuccauggcuguuaacauauucaaccgcauucaucguuuaacaaacauuuauugaacccaagcaccguacaguagaaaaaacaaaacaaaacaugagauuugggagaaaacagaccuggauccaaaucuuugcucuacucauuauuaugugacuugggcgugauacuugaguucccuaagccucgauguuugcaucuguaaaauggagauaaaaccaccuccuucacagaaaugaggaagacuacaugaggucacguaugaaagagcaggcacaugccgggcgcgguggcucaugccuguaaucccagcacuuugggaaggcugacaugugaagaaaacauugcaaaaccugagguuggauucuguaaucgaaacauuugcaaagcgcugcaggagccguaagaggaagcgucccaugccaggagcggugggagugcaucccaugccaggaggcugugguuggucaaggccucacgggagggcccagucugaaugaacaagcaggaggaagcugccaccuguaggggggucagggagaggacgucccaaacagagaggacagccugugcaagauacugcggauaaaaaaaaaagagcaagggcaaggucagggaauuacauguaauuugguauagcggcugcaaaggguaugcggagguggaacagauuaggcccaagaggcaagcaagggauccauaccaauggguuaggcauuuaucacccaagugaaagggaggcagcugagacacuuaacauuuaagcuguuuucaaguuuggcacucagacagauaacaguuggcaagcaaaaugugucaugcaggccccuaacagacuuucccaaagugugcucugugggauguaaugcaucuuuuuuggagcgggggaagggaagagguauggucacagguuuggagacugcucaguuaaacaauauucggcaaggcuggaaugguggcucacgcccuuagucccagcuaccugggaggcugaggcaggagaaucacuugaacccaggagguggagauugcaaugagccaagauggcaccacugcacuccagccugggugacagagcaagacucugucucaaaacaaaaacaaaaacaaaaacaaaaaaaguaguauuaggcaaguugcaaguuuccugacugcaggacuuuucagagugaacagggugaaucaccaagagggagauauaguuuuagcauuucccaaacuagaaggccuuuuccucaagguguaucuuguaggacugguguuuugugguacacacuuuaggaaccaccagccugaaauaccucccauuuauaugaagugcuuugggacccuucaaguuucuuucuuccucauuuuccuauaaaggugaaguuaugguagagagaaauuauuuuuccaagggaaaaucgaggccuguccuaaaaagucacuucaggucuaacaacgaguuccugaccuacucaaagacccugcuuccuucaagggcaaguccgugcucuacagccugguccuuccagccgucccugaugacugcgcccacggagaggccaacccuggguuaugacaauacuuggguuuugaaccacucacaugguccaaaugauucuugucuccccaacuagagucugggcuuuaccuuucuaucuuugcaucccucaggaguacuuuguuauuuuaaccuaucguuucauauuaauaauuucucuagucagaaacuauccuuccagccgggcucgguggcacacaccuguaaucccagcacuuugggaggcugagguggguggaucauuugaggucagcaguuggagaccagccuggccaauguggugaaaccccaucucuacuaaaaauacaaaaauuagccagugugguggcccaugccuguaaucccagcuacucgggaggcugaggcacaauaauugcuugaaccugggagguggaggcugcagagagcugagauugugccacuguacuccagccugggcaacagagcaagacuccaucucaaaaaaaaaaaaaaaaaaaaaaaaaaggccgggcaugguggcucacgccuguaaucccagcacuuugggaggcugagaaggguggaucacgagaucaagagauagagaccauccuggcuaacauggugaaacccugucucuacuaaaaauacaaaaaaaaccagccgggcguggugguggucgccuguagucccagcuacucgggaggcugagacaggagaauggugugaaccggggaggcgaagcuugcagugagccaagaucgugccacugcacuccagccugggcgacagagcgagacuccaucucaaaaaaaaagaaaaauaaauaaauaaauaaauaaauuauccuuccacuaucugccaccugagguaagagcagccaggggaugccauuuaucaacccuauuuuugccacauagcagucuuaccaggaauugcuuugcuuuaugucuacuugucauuaaaacguagaguuauacaaccuugcagauaagcuuuuggagguuugggaccugcaauaaccagccuacuagauuuugcuuuggauuuccugucuuuaucaaugguguauaacuuaugucaaagcagcacaaggcgugagaccaaaguguaugaagccaaugugucugauuaccugcacuuggaccuggaggggagcuuaccuugccuuucuggucugggucccugcugggcccuugguagggggccacggauucccaagugacaaccaccgcgcuacuaggcuggaaagagaucuccgggaacccucuguggacacacucugcugcucgcugagugauggagggggauaagucuucucgauaauaaaccuuccccaggccaucggucguguccaaguccgccaggaaaggggcgacugcaccgaauguuggugggaagagcccgggaugggauucuuuggccggggguucacucguagcaaugaugccauuuguggugaccuguacaaaaccaagugugguuaaaaggaaugcagaaacggguccuuucucaguaagacugagcacccacuccuagaauacugucagcuguacccaugcuguguagaauacaacagaaucugagaaagauacgagccugaaccgcauaccccagcauucauuucuaggcaaaaugggcuguguggaaagagaacaggagucauuauucaaauccuagugaauuuacucgaaaaagggaguaaucacucccuaccaggacugcuaauuggugugcguacaaacaugguuaggagccugggcaucaaagugagaucccaucucuacacaaaaauaccaaaaauuagccaggcuugguagcucgggccuguaguuccagcuacuugggaggcugagcugggaggauggcuuaagccccgggaggucaaagcugcagugagccaugaucacgccagugcacuccagccugggugacagggugaacccuugucucaaaaaagaaaaagaaagaaaagaaaaaugguuaagguccagcccccaccuuuuaagaaauccacaauccagaaggauaagggaaaggacugacacaaagagaugaugacacaauauagcaucaagaagcaaaucuguauggggcauuaugguaucacuaauuauuuuaaaguuuaaugugucaggauaauagcuaauauuuacugaauacucaccauauuccaggcauuuuuacuaaugucuaaugcucagaagaaccucuuaagacuagguacuacuggccgggcgugguggcucacaccuguaaucucagcacuuugggaggccgaggugggcagaucgcgaggucaggaguuuaagaccagccuggccaacauggugaaacaccaucucuacuaaaaauucaaaaauuagccgggcgugauggcgggcaccaaaucccagcuacucgggcggcugaggcaggagaaucacuugaacccaggaagcggagguugcaaugagccaagauugcaccacugcauuccagccugggcaacagagcaagacuucaucucaggggaaaaaaaaaaaaaaaagacuaaguacuacuaauaucuauauuuuucugauggggaaaauuaggcaaauucaucaauguguccaaaguuaccaaggaauaaguggcaacacugggauuugaacccacggaguccgacuccaaaauugguccuuuuccaaaaucaguccuuuuaauuacuucaugaauugccuucuugaaaucaguuauaacugcuuauuaaaagauaucacuggccaggugugguggcucacgccuguaaucccagcauuuugggaggcugaggcggguggaucaccugaggucaggaguucgagaccagccugaccaacauggugaaacccugucucuaauaaaaauacaaaauuagccggacaugguggugcacgccuauaaucccagcuacucaggaggcugaggcaggagaaucgcuugagccugggagguggggauugcagugagccaagacugcacauugcacuccagccugggcaacaagagagaaauuccauuucaaaaaaaaaaaaaagauaucacuguucuuacucagcuaaaacccaugcuccuugagaaaaugggaagagggccccugagauacuguggcaaacagccccuuggagugggggcacucaggcucaccagugaagucuaacacccucucacuuucuuguuagugcacaauccacugaugacauggaagaccaagccagugauaguuuuccuuagauaaucugugaauugaaagaaaaaaauccccuagcugggugcagaggcucacgccuguaaucccaacacuuugggaagcggagguggguggaucauuugaggccaggaguucgagaccagccuggcccauauggcaaaaccccgucucuacuaaaaauacaaaaaaaaaauuagcugggcaugguggcaagugccugcagucccagcuacuugggagacugaggcaggagaauugcuugagcccaagaggcagaggcugcagugagccgagauugcacugaugaugcacuccagccuaggcaacagagcaagagugucucgaaaaaaaaagagagaaagaagaagauucccuaaucaaaagggagagauuuugcaaauggcacuuuauuuugcucuuuaagggcugcagauuggaaaaacacgaauccagaauagcaacccucaguuguuagaaggccaguggauuuuccaggccacuuauuucccucccccucccccugccccucccccuccccucccuccuccuccucccagagucuuaucccucagucacuucacacuucauuacuagaggagagugcaggggcagaaaaaaagagaggaacuaaagaccaaacucuaaacaugccaaaaacuugcuauuaauaaaaagguucaaugugcagaaccgauuggcacccaggugaggauuggaaccagggcucugggagugaaaugcagacuuaacaaaacuuucucuuuuaaccacauguuaugggcuauuaacucuuugggugacauauuuuccaucaucacccggcaccagcaaggcuuuucuagaagauacuggcaggcuguggagaagggagucagacacggggcuucuuccagccggucccucugucucccuuccagggacccaaacaucucccagcacaagcaucccagggagcugccgugugggagcgugggaaacggcucacucucucgagccgccagaaguuggcaguaagcaguuggaagugaucacagggaggccacauccagacaauuuaguuuuaaaaagcugcuuuccagugaaauuuaaaucaguccauuaauuuugaaaacacucucagugucuuuuauuauuuggaaucuaggcaugggaauauuucuauuuucacaaggaauguuuuaagagucagguuuuaggacaaaugucaugcagcacugcaaaugcuuuggacaacggucauauaacccucauuaguauuugcauuggaaaauuauuuuucagcuaauuuuacugaacauucagcucgaucgucugugauaaugaagaaggaugacuucaaagauaaauguaaugugcagaacagccagaaguuucacuggauucuuagcuuuaaacuucucccuuguaaacuucauuuuccuggaaguaacaguuaauagcaaaguugaugaaaaauauucccguccacuugggugcaagucucauuuugcaaagucugucaaaugcacgaugcuccuaucagccuuguuccuuuucuccaucuuuugaaaguaccauuggacaauucaacagcagaagggcagggagcaaaaagggaaaggacacaggcacucaggcaggaggaggcacagacucaggcacaauccccaagggcacugggccggggaguccucgggcccaugugaccacugaugcccaggccaucaccaauauucgcucaguuggugaagccaggaaaccuggaaguggguccugguuccuuccucuuucucaccacccacgcugcauguccugucuccaacuacagcagguccucaaauaacuucauugcauucaacguuguuuuguuauaacguugaugagaaaaaaaaaaucuauucccugcuggagccaccgucugugugggguguccguguucuccccaugucugcauggcuuuucucugaguacucugguuuccuuccacaucccaaagcuaugccaaagucgggugaacuggcaugucuaaacuguccgacugugagugagugugggugugugggagcccccuugugauaggacagcaaccuguccaggguggcuccugccuggcacacugagcugcugggaugggcucuggccacccuccucucugaacuggaauaagcagcuggaaaaugaaugaaugaaugaaugaaugaauacaaaugaucacagaaugaaaauguaucaaguacgaguaaucacaccaauaaauuaugcaccaaugaauuauacaccaacaaaaguacucggcaagcugccggauuugugauuguuuguuuuugaacuucgugggucagaaguguugacaauguugcuuugcaaacauuucuucccugauugaacccacuaccaucaugaccuccauuauucacugauucaucaaaaauuggguaaauaauaucuugguuguuuuuauucaucuuaaauguauguagagcucacauuuauuuauuucaauguuuaauacuagaaguguuuugggcuucaugggaaguuuggugauguguuucugaccagaaauaagccauaggaacuuaaauguuguuucugucaauuacccgacagucaaaucgguuuaguuaugcauguuuagcuugaagccacaguauccaagaaccuauccacaauguuaagugagaagcuacuguauauggcacuuucuccaucucagcuaccaacagcacgcccccgcccaaccccaccaccucguuagucacaugacugucccuucuuauccuuauuccucagcugaaacagugccuucucagagagcuuccuggcauccccuccaguggaagcuccuuccacucacucuuuuuucccuucccucacacccccagccccugauaugucuucuuccugccuauuuguagguucuggcuucucuccccacuauguggucauuucuucacggucagggacuccauuugucuuggucaccacaguaguuccagagcuuacacauggucugauacauaugagucuccccacuuccugacuuccuccaauauaggggacaggcagguucaaagcaggauaagaccugugcacccagguuauuuuagaaauaaggccugagggugagcucaguuguaagugauaugaagggucagagaacugugcauuacugccguucuugccacuggaguaaaaugccaauuacuaaaauaaaauaaauaaaaagugcauaacuugaauucagucaugucuccagaucuaacugccaguuuacaggaaauacaggagacagaagaacaugcuaauggacacaaugggaugcaaucagcaaaauccagaauauaaagcacuaaaauggagaaauaucuaguuucuugaacaaauaaauuuuaaagaaaaaaaagagcugggguuaggggaggaccuauagauuuuaaaaauucuaagagauggcuaggcgagguggcuugcuccuauaaucccaguauuuugggaggcaaaggcuggcagaucaccuguggucaggaguuugagagcagcccggccaacauggugaaacccugugucuacuaaaaauacaaaaauuagcugggugagguagcaggugccuguaaucccagcuacuugggaggcugaggcaggagaaucgcuugaaccugggagguggagguuacagugagccgagacugcgucauugcacuccauacugggcuacaagagcaaaacuccaucucaaaacaaaaguccuaagagacacaucuaccaaauguaaugugugggcuuugucugggcccugauuuaaaccaaucaccugaaaagcaaaauaaaacauuucaugaaaccauuugcauauuggacaauauuaaggaauuauuaucauuucuuaaaguaugaucaugauuuuacuauuuuguuuuuuuaaagaauuuuuuuuuuugagacagagucucgcucugucacccaggcuggagugcaguggugcagucucggcucacugcaaccucuaucuccuggauucaagcaauucuccugccucagccucccgaguagcugggacuacaggugugugccaccacaucuggcuaauuuguauauuuuuaguggacacaggguuucaccauguuggccaggcuagucuggaacuccugagcucaagcuauccgcccgccucagccucccaaagugcugggauuacagguaugagccacugugcucggccuaaagagucuuuucuucugaggcacaucugaaacauuuacaaaacgauaaaauauuugggauuugcuuaaaaauaauucagggccgcgugcgguggcucacgccuguaaucccagcacuuugggaggccgagguggguggaucacgaggucaggagaucgagaccauccuggguaacacggugaaaccccgucucuacuaaaaauacaaaaaauuagccgggcgugguggcgggugucuguagucccagcuacucgggaggcugaggcaggagaauggcgggaacccgggagguggagcuugcaguaagccaagaccacaccacugcacuccaaccugggcgacagagcaagacuccaucucaaaaauaauaauaauaauaauaauaauucaguuuggggauggggagggaacauuaggaauaagugaggacaucaaugaaagaagauuagucucaaauugguacuuguuggagcugguaauggauacaugggaguucauuauauuuuugaguauauuugaaauuuuucauaauaaaaguuuauuuuuuaaaaacauauaacaggucuggugcaguggcuaaucacaccuguaauucuagccacuggggaggcugaggcaugagaaucacuugaauccgggggguggagguugcagugagucaagaucacgccacugcacuccagccuggguaacagagugagacuccaucucaaaaaauaaaaauagaaaaaaaaaacauacaacaaaccugauugaucugaaguucagcaaagaaaggcaaauggcucuaauagauaagccaagacuaacguucucugucaguagggccuguggcucauuguccuuguuuuuauuugguuuuguuuuuccagguuuauugagguauaacugauaaacaaaaguguauaaguuuaggguguacaacgcgauuugauacagguauauguugugaaaugaauagcacaaucaaguugguuagcaaagcuauuacagauagccgugauagaucaacgggacagaacugagagccuagaggugaacccacacauuuacggucaacuaguguuugacagggccaccaagaacacacaaugagacaagguagucucuccaauaaacagugcugggaaaauuggauauccuccugcaaaagaaugaaaauggaccccuauuuuauagcacucauagaaauuaacucgcaauggauugaagaauuaaauguaaaaccugaaacuauaaaacuccuagaagaaaacaauaaggaaaaacuccuugauauugaucuugacaauuacauuuuggacaugacaccaaaagcacaagcaacaaaagcaaaaauuaagaagagggacuccuucacugucuuuuuguguucgugaagacccacuuuauuauuuuauuuguauugaugcaucauauuuguacauauuuaugggguacacguggaguauauauuuugauacaugcauacauacaauguguaaugaucaaaucaggauaauuaggaaauucaccgucucaaacauuuaucuuucuuugcauugggaacauuucaaaucuucuuuucuaacuauuuugaaauauacaauauugguuaacuauagucacucuacucugcuaccaaacacuagaacuuauuccuucuaucgaacuguauguuuguacccauuaaccaaccucuuuucgucccauacccuacccuucccagccucugguaaccaccauuccacucucuacguccacccuucauggucuuugaauuucuuccuuccccagacuuuccuaccacugccacuccccucccagggacacaggaguguuaguugcacugggcacauuagaccacauuaaugagcagaagguggugcugguaaaagcagauuuuguaauuaaaacuaaucaaaaguuacagagccugaggcaccccauacagugcccugaguccaggaaaaaaaaaaacaaaaacaugaagcguaaguauugcacggcaguuaccaguaucacuuucuguucacuacauuuguacuaguuuaaaaaguacacgauggcucaugccuauaaucccagcacuuugggaggccaaggcagguggaucaccugaggucaggaguuugaggccagccugaccaauauggugaaaucccgucucuacuaaaaauacaaaaauuagccaggcgugguggugggugccuguaaucccagcuacucaggaggcugaggcaggagaaucgcuugaacccgggagguggagccugcagugagcugagacugugccacugcacuccggccugggagacagagagagaauccaucucaaaaaaguacauggauuaugggaucgcacuuuaguuuuuaugaauguuggugaguaaaaggcuagaggagaaaugugccagaaaaaaauuuuagauugcuuuuaauucuccaaacucuccauggugucucuccuaguuaacacuacaugcuuuuggaucuaugauucccuccuucuugaaaaccuccucagcugggcgugguggcucacaccuguaaucccagcacuuugggaggcugaggcgggcggaucaccugaggucgggaguuugagcccagccuggccaacaugcugaaacucugucucuacuaaaauuacaaaaauuagccgggcguggucaugcacaccuguaaucccagcuacucaggaggcugagggugcagugagccgaaaucucgccacugcacuccagccugggcaacagaguaagacugaaagaaagaaggaaagaaagaaagacggaaagaaagaaagaaaaagagagagagagaaaggaaaggaaaaaaaagaaaagaaaagaaaaaaagaaaaagaaaaccuccucaaaaaaccuucuugauaauucucagcucaugugcuuggcaaagucuuauuuucccuugugaaggcuuucugaccucccaaccaggguuuaucacauguuucuuucugucugccccucucucuaaguuugcaauuggcaucuugaccccucacuuagggauccugacucccaauggcagcagcacguuccuugcuguauugaucauaucgcaaaacccucauggggugaaugcauuucugagaaagcccaucugaaucacugagagugcugcugaugauaauaauguaauauuaucaucuuaagguaacuuaagguaaccaaauauugccuaggugagguucuuugugaauuugcauuaaggaguaaaaacuuguuuacugaaaaacagcuauuuccagcauguugagcaauguaaauauuucccugaaauacugcuuacaacaucaguucacacugagaaaaaguuccuuuagcaaaguuaaacuucagcucacuauguggcuaguaaaacuaaaugccccuuuacagaaccaugucuucccacucaccccaagaaacacaacaaacaauacggcuuuucauccagcugcccuagggcagagcaugucaauuagaucacaaaaaaacccagggugaaaaugccaagcaccacauggguaacagcuggaaccacuuauguacaauuguuucaacccaacugacaagaaggggauggacagagcaccuaacuuauaaugggaggguguuucccaucuuagaaagcacuuccugucucauuucaucuuuaacgugaacuuucagauagcaugaaucaccggagaaagucuauaugcagaugcucaauaaauuuaaaauuuauguuagauuucuuauguccaaauacucccugaaaaagugaaacaacagccacuuggccgggggcuuagaugagccuaguaacaggcugcuuucugcaauagucuagggggagccuucuccaaaacauguguguuuagagaauacuugagguagaaacaaauaagaaacaaacaggguccuuuuacaaauacaaaucgcuguacugagaagacagugagacuugcaaaagcaaacuccaugggugagaggcagcaggaacuuaaaauaauuuaacauaaagaguggaaaugcagcaaacaugggcugucaccuaauguugagguccuuuacuaaggcucuuuuuaucuuuuaaaauuucaugugacaggcauuuaguacaaccaucccucuuuucgcauacuugaaacagacaaggaaaugaugagagauuuuaauuuagcuuuaaugucacacagccaguaagugauagaaccaagaacggaacacacauuugcuggaguccguaacccgugcucuuucuguuacacuuggcugccuaguuuagagacacugggggcaaaagucaugcaaguugcaauguuuuuugggauggcuucaaaguuagugacuggguagcuacaaaaagcuggaaaacaaaaugaguccaaaaaaaaguaaaacacaaaaaggaaguccagaaaauaggcaaguccgggacacaaucaagguggagacugauuaauuucagccuagagcccacaaguggaccuggagccuaauccguuugcaaggugcuuuacaguuuacaaagcauuuuuacuuuaguuaucucauuaaaccuaguaaagauuaauaccauuuucauucuucauuugagaaaaaaugaguuuuaguuuauauaacuugccuaagaucaaacacuagaagugccagaacagaacuccaaguccaaauugcaagugauccccauuaaccccacagaagaaaugacucuggcaugaaauagaaauagaaacaaaaggauuaguaaauaaagcuuagggacaaucuaaggauuacuggaaaggggucccgauccagacccucagaaaggguucuuggaucuugcacaagaaagaauucagggcaaguccauaaagugaaagcaaguuuauuaagaaaguaaaggaauaaagaacagcagccgggcgugguggcucacgccuguaaucccagcacuuugggaggcugagaugggaggaucacgaggucaagagaucgagaccauccuggccaacauggugaaaccccgucucuacuaaaaauacaaaaauuagcugggcguguuggcaugugccuguagucccagcuacuugggaggcugagguaggaaaauugcuugaacccaggagguggagguugcagugagccgacaucgugccacugcacuccagccuggugacagagugagacucagucucaaaaaaaaaaaaaaaaaaaaagaauuguuacuccauagacagagcagccccaagggcugcuaguagcccauuuucauggcuauuucuugaugauaugcuaaacaagggguggauuauucaugccuccccuuuuuagaccauauaggguaacuuucugacauuuccauggcauuuguaaagugucauggugcuggugagaguguaguagugaggaugaccagaggucacucucaucgccgucuugguuuugauagguuuggccggcuucuuuacugcaaccuguuuuaucaggaaggucuucaugaccuguaucuugugcugaccuccuaucucauccuuugacuuagaaugccuuaaccaucagggaaugcaguccaguaggucucagccucauuuuacccagcgccuguucaagauggaauugcucaguucacaugccucugacauaaggguaauagagaugagucaauauuuucaacuuaauccaguuaauguccaagugacuuuggaucaguuaccccucucuucugcagaaaauuucuaccugagauuacuuuccaacauuuaaaaaugguuggggcuuuuccgaugguaguggguuaucugaacuuauuagcauuaguaucacuaaaguugauauacaaaccccccaggcuaaauuagacugggcaaaaaaaaaaaaaaucuguuggguucuuuaaauuuuaacuacgggugugucuaucaaagaaguagcccuugaggaugcaacaccaagggccuuggggugugagacccccaaucucuggggagacacauguuucuccuuaacaaccugaauauagauaucagaaguuuaccuguggcaauuggagccuaguacuguauuacacaaauuccuuaacuuaaacauaaaaaauuacaggagaagaguucagcauuuaucugccuuuccagaaugaacaguauaucaguguuacccaaaagucaugguugaugaggaaaaccucuuuacagaauaugccagcuaauaaaugcagaaagaaugacagaaacaagcaaccagcaaaauaaaauaaaacaucauccugcaaacuuuaauuuaauuacuguuucaggcaaagaucaucgauagaugcuaaaaccauuaggugaaagauuagugggcaggaaauagaugauaaggccaaaaugagugucaccccguagcucaguugcugcucaccuggggaaaaauauaacuucacaggcaugaucuggcuguaaucuccuuaacaccagguauuaaucuuagcguggcaagccaagcaauaaccagacaucacuugccggcuaauguuauccaaugugaaaaauacagcuucguuuaugaaggauucuucucuuuuuuuuguuuuuuuugagacaaagucucagucucacucuguuucccaggcugagugcaauggcgcgaucuuggcuuacugcaaccuccaccucccaggcucaagagauucuccugccucagccuccugaguagcugagauuacaggugcacgccaccacaccuggcuguuuuucguauuuuuaguagagaugagguuccaccauguuggccaggcuggucucauuuaugaaguauucuuguugaaagaugaggcccuucucaacaauuaaaaaaaaaacacgauuuuuuuuuaaugaccaaaggauuugaacaggcauuucuccaaagaagaaacacaaacggccaaugagcacaugaaaagauucucaacaucauuagccaucagagagaugcaaaucagauucacaacacagcacuucacacccacugggauggccauaaaucaaaaagucagaaauaagaaauguuggugaggacgucgagaaaucggaacccucauauauuguuggugggaaugucagauggugcugucgcuuuggaaaacacuuugacaguuccucaaaauauuaaacauagaguuaccauaugacccaggaauuccaguccuagguauauacccaagagaaaugaaacuuauaucuacacauuugcauguauaccucuucucgaaaugcaguuugucucaaagacaccuuuuuauggccgauuugucuuaaucaggcugaaacaaaguccucacuugcauuuggucagcaagccucugaagucucuuuugauccacaccaggucucccuccuucuuuuuccccaccaugccauuuauuuguugaagagaaugauaaucuuuuaaaguuaaaucgugucagccaucuacuuagaaaucucuaauggccgggcaugguggcucaugccuguaaucccaacacuuugggaggccaaggcgggcggaucaccugaggucaggaguuagagaccagccugaccaacauggagaaaccccgccucuacuaaaaauacaaaauuagccaggcaugguggugcgcgccuguaaucccagcuacucgggaggcugaggcaggagaaucucuugaaccugggaggcggagguuguggugagcuaagauugagccacuguacucuagccugggcaacagagcaagacucugucucaaaaaaaaaaaaaaaaaaaaaaagaauaaccaaaaacugauauuuagcauuuccuuuaauuaugaaugcaggcaacaaagcagucacuaauagaagucacagauauuuucauaucacaucauaguugcugcaugugucucagaauauugcucaugaucuucaaaguucaaucguuaccugaacugcccuuggauccacugcuacaccuuguuauuuaauguuguuaaaaguaagcauauaggccaggcgugguggcccacaccuguaaucccagcacuuugggaggcggaggugggugaaucacgaggucaggaguucaagaccagccuggucaacauggugaaaucccgucuauacuaaaaaugcaaaaauuagccaggcaugguggugcgugccuauagucccaccuacucaggaggcugaggcaggaaaaucgcuugaaccugggagguggagguuacagugagccaagaucucgccacugcacuccagcuugugcaacagagugagacuucaucucaaaaaaaaaaaaaaaaaaaaaaguaagcauauauugggccaggcaugguggcucaugccuguaaucccagcacuuugggaagcugaggugggcagaucaucugaggucaggaguucaagacuagccuggccaacauggugaaaccaugucucuacuuaaaauacaaaaauuagccaagugugguggcagucaucuguaaucccagcuacucaggaggcugaggcaggagaaucauuugaacccaggagguggagguugcagugagcugagauugugccacuaaacuccaggcugggggauagagagagacucugucucaaaaaaaaaaauaaauaaauaaauaaauaaauaaaguaagcauauaagcauauauaguacauaagagcauaagauguguguuuuuuuaauauuuugaucuguauuucaacauaauugccuuccuuggucaucuuguggauuuuauuuuaugcauuuaaaacuuuauacugcccagcauggugacacucgccuguggucccagcuacucaggaggcugaggccagaggacagcuugagccaaggaguuggaggcugcagugacccaagaucgcaccgcugcacccagccugggcaacagagcaagaccucgucucucuaaaaacuaaaauaaaagcguuauacugaaaagggauccacaggcuucaccagugugcaaaggggccagggcagucaaccaacaugggggagggcucuuuguggauccagacuugaagggcucauucguuuuaggcaaagccuacaaguuccacgugaguguugucuaaggcgcaguguucccaggccagaccgggagcacagccauuucacgggcaggacaggcugcagccgcugcguuugcaguuccaacccccuucccccggccaaccccccacacuucuggaaugcacacaagccuuauaugaaauccacauggugggcggccgaggaaggcagcggcacgaaaggacuucaacaaguugacagcgaccccaggcccggccagucacggggaggauccagggagcuguaggucaucuggucccgcuccucguuuggggccuccguggugacaaugccuggccacaggaaaugggaucacugggagcccuguguuucccgcucuggacucuggacucugaaacgagcccaacuggaaagcagcaucacugccaagacacauccggaguccacacacaaauacaggaggcugccggcgaaacucucccgcagccacaagagucccggggcccgcgcgcagacugcgauccagcuccggcucuugcccugcggaggcuccgcgcgagaaccuggcuccacccgggaccggccagguccuagccccgaagggacuggacagccgagggacgcggacugaccucccugcggcgaugcagcccacagccgccggggaggaagcuccgcgggguccaugggugccggggucacggcccggggcgcgcggagccacccagaccccgcgacccgcucuucggauagcagggaccgggucgggaagaccuucgcggacccugcagaggcgggagacccugcgccgugcccggugccccggcggccagcggguccggguccccgccugcuacgcccaaguccguccggcuccacgggcgcccccggcccgccgcgcccugcagccccucgcccgcccucccggggcucacucacguagacugcgucgaugucggaucugucguagaagcggagcgccccacucagcuccagggcaggagagacgaagucauccccguccuccagcuccaggucccccuguccggggccgaagggaaagagcuccuggcggcucaggcagcccacaggccccgccagcagcagcggcagcagcagcgcccgcguccacgcagcccggauccggcugcucgaggccaacauguucccgaacugcggucccgcaaacccggucccgcggccaggacagaggaaggcggggauguaaccggacgccccuggcagcccccucuccucccgccuccc

SEQ ID NO: 192404 - RNA, 5515 nt, Homo sapiens
caugcugaaagcaggggcgggaccggggcggucuuccagcagggaaaauggcgcuggccaugcuggucuuggugguuucgccguggucugcggcccggggagugcuucgaaacuacugggagcgacugcuacggaagcuuccgcagagccggccgggcuuucccaguccuccgugggguagguaaagaagggcuccgugggagagggggcugaugacgggaccucgggcagcguagcagacgcagcuuacacaguucgcccucagccccgguucugauccgcggccucaugucggggacguaguucgugacauucccauauuagcgagaacagaacgacuguuuuugcgcucccuccaccgcaaaaaaaaaaaaaaaaaaauuccucugcuuguuccauucguacacagaauguaacccaagcuugugucaaagauaaaucauagccagccaguaaguaaagcgcugaaaacagauuuuauucaguaacuacugcagguaaagagcugagcuccaucccgguuugugcagaggugacuuugggcguuuuaaagggagaaugagcgaggcgggaguguaggggcucuguagagucagagaaguguaguauagugaagucagugcaaaugugauuagccggcugugucugcuagcucgcaguugucuuagggagaauucuauccucccgcagagacugggagacaaaggcccuauccuuccuaaugauuagauuucgaaggaauggcucucagggccuugaaagaaaagcuuccgaguuaguugcaagggauacguauuuacaauuauaugcccuuuccaggaaaugcucuaagggaguucgggaccuacuaucgggguauguuggccaaaauaaauaggaaauuuuccaggcagcguugagcuuucucaggcaggcacuuuaaagggggggccgaggucauccuaggauacagccuuaugcugcuagaaacuaugcuagaguuuggucaagucuguggaguucagggauuuguacagaguuguccugagaggacaguucugcaggucucacuuggcaucaaggcucaccacucucuggaucugucuuuccuuuccagcccugcccucaccuccccucccgcuuccccucuccccccucuccucuucccuucccuucccucccuucuuuccucccuuccucccucccucccgcgcaguacauguuuucugugguguuugagcucugaggagcugaauucuguuucccauguuucacuuggaauuaauuuuaauuggaaguaucuuggauguugaaacugucauggcuuuggcauuuacauucuacucaauuucuaagcagccugaaagugauaauauccagaaauauaccaagaaaauauaugccacuauaugccaagcaaugugccaagcuuucuacauguacuuccugggauaaucuugacaacagucccauuagguguauacacuuuccaacugaaacaguaggcucacaauggucccaaguucacagacaguccugagccuguguuguuaaucaccggggcaugcuuggcaauacuuguggacauacugaaaauaaaugccaguuguuaaguguuagagaacuuuguguauuuuuaagaguucuuaagaucaaaagaaguaugugggcugggcgcgguggcucacaccuguaaucucagcacuuugggaggccaagguggguccaucaccuaaggucaggaguucaagaccagccuggccaacauugugaaacccugucucuacuaaaaauacaaaauuaaccaggcgugguggugcacaccuguaaucccagcuacuugggaggcugaggcaggagaaucacuugaaccagggaggcggagguugcagugagccgaggucacgccacugcacucuagccugagugacagagugagacucagucucaaaaaaaaaaaaaaaaaguauggcacgucuaagaaauagcaaggaaaggguaaaggaauguugauuuuauaagcaauucagaaaaagagaaacuuugauagucacauaaauaaggccauacagagaaauggugagcuggcucuuuucuuuagagagcagacaggaaucaagauuaaauguuaugaggaacuaagugacuuaagagguuguaucauaaaggaccugacucaguuugaauauaagaaaaggcaauuggcaguuacaucagugccggucagaaguguauucaggaaaucugucuagauuuacuuguaaauuaaucagguacuuacuacccgccaaguauuaauagaauguggacaguugagugauucuuugcuuguuuuguucaaguuaggugccuaucagaguccuguauuuuaugagauaagaaacuugauggaauuucacugaucuucuuuucagcaggauccgcuaagaaaaaauucuguguuccuuaaaauuguauaagcuuuaguguauuuuaauagcuaagguuucucauuauugaguuucacauucuaaauuuuauauauaguuuuuguguguguguauguuugaccauugauuguuaaggaaaaugauaucuguaaauaguaauuuagaagcuagaaacuaauucuguaucucuuauguuuuauuuccuaggaccagcauuagcaguacagggcccagccauguuuacagagccagcaaaugauaccaguggaaguaaagagaauuccagccuuuuggacaguaucuuuuggauggcagcucccaaaaauagacgcaccauugaaguuaaccgguguaggagaagaaauccgcagaagcuuauuaaaguuaagguaaugcauugauuuuugugggugugcuuuuccucaaguccuccauugaauaagcucaugguagauuccuauagccuaggaauaaauuauuaucagauuauaugugucuacuuuccucuggccuaaaugaaauacaguauucucauuauauacauaaugagaaggcuagagccugcuguccucuagccugaguauuagaaacacagucaaggaaggagugaguuuggagacugggcaaggaacgaggcugugaggugccuacaugacuucugaauugugagcugugucagucuugagcugugugaguuuugaacuacagaugaguaaacauccuaacuauggcagagccuagaauuaaagcuagaagcaguagguauacugaaucuuggguuuuacaagcccuuacauauuuguuuuauuuuuuuaucauuuccaacaaaauaccaugaaggaaaacccuaagauaaguaauauaauagcuaacaacaauuaagugucuaugauguaucucagugccuuauguuuauuauaucucaucaugucuuauagcccuccaaagcaaauaagauauucuucauuauuaggaugaaaaaacugaggcaaaaagaauuugccuguggucacacagcuaugaagcaguagauuuucgagcucugauuuuugaccucauguucuuuuaaagauuuucuuuguguucuccuauccucagacaauuucagauucuccucgcugacaacauggauguacugucuucauugaucuaguaaagaaaaauuacaguguguauuaccucugaucuguucauguaugguuuuaacaguuaggauuucaguuacuguuuacuucauggcguuccacaacagcagcaccauacagaugaaacucgagaacagaaagcugacuuucauaagcauccacauucuguuaagcaaaaccuuagaacuuaagccagaaaguauuauugagugaugguuggggcugaacuuaaauguagaacugaaaaacacuuuauuacuuaagacuuacaguaauucauaaauuugcucaagaggacguaagauuuuaggaaugagaucuugcacugaucuauuaugugacuucccugaucgcauuuauucugaaggaauaguucuuauccugugcauuuauuuucuuccuugaauuauuuucuguuacauacgguauauaguguguuauguuggguacuuugaucacgaaaggaagaccagcugacugugggugucuucauaccuucaguugugcaugcaauccaguuuccaguaguggagcaaaaugagaauaugguuaggcaaguaauauacaagccucuuucuuccuuucagaaaaggaaauucuuuuguuaucugccucacaaauguuaguauauuaaucuuaucaaguguuuaaagcuucuuuaaugauccuguuuaguauuuuucuuuguauuuucuuucaaaccuacaucuagaauaaguugauaaaucuuuuagagguuauaauguuucuauuuuauauuuaaaguuggagauauauauauaucuauaucuaucucuauauauauauauauacacacacauauauauaucauuaaaauacccuaagaauguaacauagaaaauaauuuuacauuaaggaauaaucaguguucauuuuuaaaaagaaaaauuauaccauauacgaaaccuguauucuguacaggaauuugaauuacacugugauaaaaagaggaagccaaggaagucaacuuguaauguucuuaucuuguuuucccuaagauagauugaaagacaaagggaauucacuuuuccuuggugucuuauuuaagaugcugauuguuugggucacuucauuauguugacaaauuccuuauuugauauuuaguauuuggaguuaggggaaaugaguauuucuuuuuucuuuuuuacauaacuacaacugcuguguuuaaguaaagauaccagauucagguuggcugaauucuaguucuaguuuuucucuaauucaaacucaguguugcuugucuucagucuuccuguuaaagugagguggaacuagaugguguaugaugaccucauguagccugaacauccuaagaaaguuaaaauguaagcauugcuccugucagugguuauuuguucguuauauugccucauguuaaaauacguuuuuguuuauuguuuuaaagaacaacauagacguuuguccugaauguggucaccugaaacagaaacauguccuuugugccuacugcuaugaaaaggugugcaaggagacugcagaaaucagacgacagauagggaagcaagaagggggcccuuuuaaggcucccaccauagagacuguggugcuguacacgggagagacaccgucugaacaagaucagggcaagaggaucauugaacgagacagaaagcgaccauccugguucacccagaauugacaccaaagauguuaaaaggguaacuucacaguaaaucauuucuccugaaauagaggaagauucuuuauguuguugugcuuguuuuuaaaucaucaguauaguuuaacacauucuuucuaagcaguuuugugugggauaauuugaagaauauauuaugaguaaacuccgaaaauuuuguuuauccaaaggcucaauggauuauguuucuauuauauacaagguuuuaaguaaacauaaaauuuccagaacaaaaauaaaaaauuuaaaauucauagcaa

SEQ ID NO: 192405 - RNA, 14106 nt, Homo sapiens
aguacaguauaaaacuucacagugccaauaccaugaagaggagcucagacagcucuuaccacaugauacaagagccggcugguggaagaguggggaccagaaagguaaugcuuuuuaacucuuacuucugagcucuuuacacauucaaagauaggaaagcuaggaggaauuuuacaacuaauuggcauuuccaaugugcauugugauguguaccuuuuuauauuauucaggcagguuaauacagcuuuuaauaguccuagagcaugcaaauagauuauauguuuauacaagccacucagcacauauauacaaguacauaugccaaagagaaagcuauuuuuaagaguuacauucgcaaacaguaaauucagggaacacacacauacucagaugcagagagaauccaaauauugauaaguugcacuuaucuaaaugcugcuauuaggacuccugaguuguuuagagccauuaaacuuuugguuguauuucagacuuucuuguaaaacuuaauugaacugcaaaacauuuuggguacuguauaugugacuccaaauagguggaugauguuaaguauuauagcacaaagauuuuuuauaaaaccauuguaacacaaauguccccugccucccccauucucuuucaccauccccguaaaaaauaugaggcuuuuuaggcaauguugacaaaguuuuaacaauaaugguggaguaauugauguuucuggagcugaaaccccaaagguguuagguuacuuguaacagaaaaagucuuacaaauaguuguuuuggaaaaggggacaguauauauaauucagaaagcauuguuaaccugugcaaacuguaauuauaacuuagugucacaauuuucuugcccucuuccccuugcacucagaucuuaucuuguaguaaugauauuuauuaacucuuuccaccuaaacugcauugcuugacuguaaugcuaugaacacacuaggugucagauauaagcugaguguaucuucagaaaccaagagggcuuaugugugggaaagaaaccgagagggaaggaacgcuuuaacagauggaccccuuaaagauucuucugcaagauaaaagcaauaagacagaaaaugaaaaagaggggagggggaagaauuuuuuuuaagccuuagaaaggcauuguuaaaaaauucacauuuuucuuuuucugugcacacuaaaauccaugaugauuucaucugcacuguuccuuugagggaaaaagaagcagucaaggaggcugucuaugaaugcacuggucgggacaggcuuggggcaagcugaaaaaacuaccacaugacagagaaaaauaauuugccaauauauuuuagagagucuuuucccauaggaccaguuauucaagucauacgagugcacucuuuuuauaaaaggaugugggaaaggccaagagaauuuugcauuuuaucugugaaguccggcgaguggugguaggcuguaaugugugagagugaguggguccccggcagaagggggcagcugaacgcgacggggagaaagcgcuucuggaacuugggcuugugacaggcugccugcccucugguccuucagugcccugcugcauuucacaguugggaagaguggaguguauuauaugaccccaaacaaaaguuccauugcgcucuccucagauugccugccaguguugaugaccugaacauuuaaauaugaaugaauugggggaaaggaccaucuccccuggaucccaucaggccagaacaauccucuguuaccccugagucccucuucccugaccuccacuaccuguccacuggaccucccugcacccucugccccaccacguggccaggugggcguucuaccaccuagggcuguggcuuggcuggguggaggggcggugggaacacuuuuucaaucaauucaucccuauugauugagacacuguguuuguuugggguuucuuuucuccccuccaaaaaaggaagaaggugaaaccaggagacugggcagagaaagaaaaaaaaauagugaacaaaauuaggauaauuuauuuuagaagagaaaguagaacccccgaaaauggugauauuugaagagaggugucugugaggaagcuaagagcagaaggagagcagccugucagaaaacgggcugucccucccucccuaaucacagcccuacucacagcaaacucccucccucuccauucacucacuuacuuagggccaauccuuucucucucucucucucucucucucucucucucucucuuccuuucccucucucccucucccccucccuucccucccucucucccucucucucccccuucuuucccucucucuucucucccccucucuccucucucucugucucugucucccucccauccucucucucugucucugucugucuccccgccacccugucucucccucccucccugucucccucccucccucccuccuuccuucucucuuacucggagacagucagaacucuccucccugacagccacaaaccuacagcacugacugcauucagagaggaaccugcaaacaaaacuucacagaaaacuuuuuguucuuguuccagagaauuugcugaagaggagaaggaaaaaaaaaacaccaaaaaaaaaaauaaaaaaauccacacacacaaaaaaaccugcgcgugaggggggaggaaaagcagggccuuuuaaaaaggcaaucacaacaacuuuugcugccaggaugcccuugcuuuggcugagaggauuucuguuggcaaguugcuggauuauagugaggaguucccccaccccaggauccgaggggcacagcgcggcccccgacuguccguccugugcgcuggccgcccucccaaaggauguacccaacucucagccagagaugguggaggccgucaagaagcacauuuuaaacaugcugcacuugaagaagagacccgaugucacccagccgguacccaaggcggcgcuucugaacgcgaucagaaagcuucaugugggcaaagucggggagaacggguauguggagauagaggaugacauuggaaggagggcagaaaugaaugaacuuauggagcagaccucggagaucaucacguuugccgagucagguuggugcuggcauuggcaggggguggggagggguggggggugggaggguaaaauauauuucuuugacagucccaggaggaacuucuuuucccuucagcuggaaacugccugggaagguuauuaguuauuaggugaugguagcggacuagccgacggagggcaggcaggggagggggagaggacuuuacagaaaaggaauucucggucgagcucugccuggagaugacuggcuuacacuuacuaaacccagcgggucacacagagaggaagcucggggccaauguugagcuggaaggcagacugugaggggcugccuugcccugccugugaaaccagaucugagcagccggaggaaagccgcggcauuuucgggugcuaggggagcagaggaggcuuccggaccccauccaaguuuuuauugaggguagaggggugaauguaccaggauuggaguggaauggcacagaugaagucacucucuuaaaacaaaccuuccccuuuaaaaguccaaucuggggccacauuggagaagcagggcauauuuaugagugacagucauuuuuaccuuuagaaaaugucuauaagugcacaggcaccacauucaagacagggaagagcuacuuugggggacaguugucauugaaccagcaguuacuuuugggacacugacuuuugcucucugaaagaaaaaaaaauaaauaaaacaaccaguuuuguucuuucuaaaguuacuaagagcucucugccaaggaacgcaaccuugacaaaguacucucagauacuacgcugaacucacucaauccuuaagaggaagaacuuuaauaaauagauucuaaucguuggcccaggaccacacuaaccuguugcugaauagcaauaccugucaaaaguaugggcccauggacuuggagccaggcuauuuuuauaguuaagugacacagauccuuugcaugccugcaagcccaugcacgucaggcacacagauguguuaauaccguguuacuuucaugguaaugccaggcuaaagaauugcauccuuugccaacuccauuugaaaggaaugccauuguuuuguuugguagagcauauggccaguaaaguaugugcagggacucccagcauuuuuguuuaaaaguuugccgcagcaguauaaacaauuaaggcaacacucagaauuuccaaucugaaaaccuguugacucagauguucuguuuucaagaaaaccaugaaagaccagggcaucuuuccgggggugcagauagccugcuggcuguguggcuuccccuugcaggagaagcccugguguccuacaagcuucccaguuuggcucucucaccagaagccucucucacuuagggaagauccuacuuucuuucccuaaagcucuuucuuaacccagccccaaaaggcaugaucauuaggacuuuaucuucuggagcuuuuugaggaagaaagcuagguuggaacuuuucaaguugacacccauuuuuuuuucucaacuuuucauggugggaaaagguaaaaaagaaaauauuuacaauauuuggcugugcaugugaaacagauuucaguggucuagaggguugcuuccugucuuuguauaccaaccuccacacaugauggauucaaugacagcucguauccaguugccuuuaaccaugucauaugacuaaguauaccuaugccuuugaccacuuuuaaccgcacuaccguuacuagcaauaugccccucuuucugacuuacuggacuuguauagcaaaucacucucuuagcauuuagagauuuggcagugaaaaaauuugaccauuuacauucuuucuuauguguggucuuccuuucugugacagucuucucucaguuguaugagaucuugucauuuuuuuacuucucaguuagguguuuaguuugaaaaaaaaugagcgacuuuugaaaaagcgauucguuggacguucacauugagucaaguuuaagauuuguaaugggaaacuccugguugacuuuacaacuugacuuuggauucuuagaaaacacuuauuacaauugcuuauuuuucucugagggauuucacacaucaacuucaaguugauuuaauguaauuucauguauuuaaugauugcuguauggacugucuacucuucaagcagaaaaccacgugagcauuuugcugcugauuuugcuaguccagaaaagacauuuaucauccaaaugauuguagcaaauauaugaacaugaauagaaaagaccuaugucuuguugcuuuuggaauaauucaacuuuaauaacauuccaacuauguggaaugucaagaguuuuuggagaauagaaaaaggaaugcauuuuucuuucccuuauaaccauuuugugcagcauagaauccagacauugucacccaugagcaugccacagaugcagacccauagcagccccuuucaaccucaagauucuucaauuugaggcuacguuuaauuuuugccuuuucucuccuugauuguuggauaaagccaaggccuggcuacagaaguagagagccuccaaaagcugaagugcugaggacucuuuuaacugaguuugucccauccuguuuagguagaaagugcucaauuuuuguaaaguugaugcgaguuguuauugacuaaacagcagggaaucacucuaaggcucucugaaauguaucccaacaaacaaaaauuauuuuauuuuuauauaugucacaucacccaagauuucucaccaagguuaguguguucuuugcauggcuggcacaaaacccucaauguuuuaccuuaaggccuacagaguucuucacaaggaaagauagaagggauggguaaagccaagcuaucacuauaaaugucaugaagcuaaauucaguggccuuuucagcugaugcagcuuauuuuuauuuuauuuugacucaugacaguagguggucaaucaaugcauaauaauaauguaccucuaagucuccauaugcugucaaaccuggauguggguucugguaauuagcuuagcaauugauagcacuuguuguagaaagaauagggaaagaaagacaaaugacacaccaagaaauggaugugcucacguagccuagguguuguuaagcgcaacacauaagucuaccccuuggaggauacuauguauggaagauuugaguuagaaguuugcacugcccagacagggauccaagaagcuuugcuuggaugaccauuuuccccaccccaagaaagccaucucaaaaugaagcugacucccaccauuccaaucccaccuuccgaacuuuucugugaaucaccccuccuuuagggaugccuuuagggguuacacgcucucuuccgugaauaauggggaagagcggccacaagagggcgcguuccaaagacuuuugcuccuugucaguguauccagggaaaggcaguugcgcguacuggaagccccugucuguagcgcccuaaucuuggugauuaucaguuaccgccugcucccucucauccugcagaaaaaguuaggaauuuaugagaugggagaagcaugacuaccuguaauacauuaaaugagacagaaggaaaggaaauggaaauucuagugauacaugugaacauuccggagcucuauggaaggcagacgagugauaaauuucaaaagcaaacaaagcggagcagggagaaaugugacuaugaaucaucagcgauacugauuugcucacaagucucucccuaauacggucucccgggucguaacaaaaacaucuuccaucuccccugauuuuguugccuaguuuuccugccuuaucaacaguuuccaccagcgacaaaugacaagugacuucaaacagggaggaaaaagguucuuucuguaaugccuugugggaacaugguguucggcuucugaggaugcguuuguuuccgaacugaggguguggagagaaauggugggaaagaugggaaaagagauuaauaguggucugcggccugugcaguggauggacugggcugggggugguggagaugccaggguggaaaguccguuguaauauuuaaagaacugcaguaauaccuucccaggcacuuuucuugaaaacacauauuugucuuggccccucuucugcuaaaaaauacuugcacgugaucuccuagcuguaguucugaauucuucguacucgacugguuccuaaguccaaaaugagaagugccaaaguucucaggaacuuuggaagaagucucugaaauuuuguggguuaaaccuuaagaauuuuugcuacuuguaggaaccuaaaaccccuuucucccaaaauauuuaaccuuuuucaucaccacuuuaauggaagaggcauggaugauggacguuugugccagggcauuuauaaaucaauaauggacccuaaggagggaaauuaaagcuaaaaaauuaaucaagauaauuuauggccaaaccuauaguucuacugcaggaaagauccucuacuguaggucaaaggaggaauaaccuuaagaccucacuugcugcuuucugcagaaaccccuggaagcaguccaaaugcaaaguuagggcuucagagaaugcacccuguaaaugguaguuguguauacccuuaccauugacuauaccauaucuaggcacagugaaaucuugaugaagaauggaaaauuaaaggaacagacgcuuuuuacagggaggcuucccccagcccccaucccaugguaaguuuaaauguguucuauaaacaacgaggcuuuccacauucacauuagagacauaacuauugcccauauguaaaagagcaacauauuuuaagcaggacccuggugaggaaaacaaaaccaaaucgaaacacugcauguguguguugcuuauuuaacugaaaauguucauagacccacaaaucugagaugcuggacuuuuggaugaguccagcauuuugcaucuuaguguagggggagggaacaacaaggggcuuaguugcuuaacccuugccaugccuucaugauugacuuauucaaaacauuuuuaaaauucugaaagcaaaggaaaaugugcugcaaacacccuuccagcuaucuuuccuuccagcuuacacagucucuccucuguccaauccuucccacccagcagcauuucagagguauucccugugagguacaaaauuucucuuugcccauuuuucugcaccucuuuuucucucucuuugguauguguccaccaagcucauagagguuuaagugaugaaauauuaucacccacauggguuugcgugggacuuucuuagugaauuacucaggcagagcaggcugugauacagccuugcucacaagccucgggagggaaaaaauagcacagaggaugaaaagaauauuauuagagagcagguaaugaaagguucgcaaagcaaccagcuauaucugguuagcuagguaauagugcaggaaccuaggucgcaccuguacaaacuaaugcagaaccugcucacggcgcacuaugggaagacauucauuucaagaguuuacagcaugagauauuugaguaaaaccugaaacugauuagaaauugauccugaacaucccagccuuagucaaccuucccuuuuucaaauuguuaugcauggagauuggaggauuggggcaucuugaaagugucacugcaguauagcaaucucucucagguaauauagagauaaagggaauauaauaaauugaccuguuauuuauuaucuuuuucauaccuaggacauuccgaggcuuaauauauuucugaagccuacagcccugauaaacaucaaucccacgucaguuuccagcagucucaucuccccacacccuucugcaaugaaagcuaauguaaaagaaagaaauaugcacugcuuaauaagucagaauacaauagaacuuguaaaauguaccugcauauaagguagacauuaggaagacuugaaucucucucuucccccuguucuccugagcauuauggcaacagcauuuucaugaaauuagaucuguuuuauauuuuuuccugauaaaauaucaugcaauauacaaauagcaguuccagaaauggacaccaggagaaggaggcgacaggcaugucaauuaguagggggaaaauccaaaugucagaaauaugggggagagagaaagcacgcaggcaguggaugcaaauacagggaacagagucuuucaauucagauaauuaaacggaugcauaaaucagcacccuugccucucuacaauacgcaggcgaugccaugcaguuaauuaucagccaagaccagcaugaaagucauuuuaugaugacucucugauccuaauauaacagcaccugacagauugagcccccucuaaugaguacucucuuuguacaauccucucucaggaacacuaaaucauuugcuuccaaguacagcugccugugaagaagggguggggcuagaucaugcaucagaaaccugcucuugugaaaucaggggcuguccuguaggcugugugacuggaagccagcagccucagccucucuggcccuaaaaaagcaauuugcacacggcugucccuaauucuagucagccaaguaacccucccucggcacccccaccuaaacaucuguagucagccuuggguguuauucauggaaaguccacugcaugcgggucagcacugcuguccaucggcuucacccugaccccuucuggcagguguggaugagaguagagcagagcucauggggaugaguuaccccaaaccuauuaagccucccuauccggggcacuagucagacacuccaguuuuacacucuuuccuagaaaaacaaaacccaaccuugugcccucuggguucucuaauuuagcagcuacuaucugucuguuuuuggagugacacccugugcaguuuaggauuucagaagcuguccugcauagaggcagaagggaaaacagcagguaucuuguuaacauucucuauggggcaaggcagaugugcccaagcuggaggaaaccugcacacccuccaggcuaguuauccaaggcuugggagguuucccucggccuucuccuaaggccuuggcaggacccugccacccuaaaaucaacugcugauugccuuuuuagauuuaaaugauuaagcucugcuuaugggaaucuucuucucuuuuauuuuguuaagaaacaaacaacaacaacaaaacccacaccaauucuuagcaaaggggaauaucgaauucagauuuugaaaaaauaagucaucaugcuuccuaaaauaagacagcuucucccucuaacugcucucucugcucugguauucuaucuaaucauaaacccagcuuuauuauucauuucaacuccugccaaagacaugaggucggagucagaggaacuccccuuaccaccgccaccaucaucauggccagcauccucguaaguuuauagaaagaugccagagaaccuuuccuauccaucugcagcccugcuuggcccuugccucagugaauuuaccacuaucauaaucacagugugcagaguguguuaaauuaagaacagaauccacaguacgcaaugcacagaaaagccugccuucugcugcagagaacuugaaacugugccuaaaauuuauaguaccguaaacaucucagggccucgagugauaaguauggcuggauuuccguuaacuauagaaauccaggcagggagauccucccagggaguugcaaguucuaagaugaacuucuugaagauuguucccagauuugugcaugggauacauguacagcagacaguuguaaggagguccacggucauggaaaagaggauauguuucuauaugccaccaagugggaaaaauggaagugagggaaaauauuugauuaaucaaaaaauuuuaguuuggauaccugcuuucauaguaauuguugcugugucauuaaacauacaguugcuuaggaaaagagaaggaaauaggugacuuucuaauuuuagaguuaggcuggaacugagugguugcuaaauucaacugcccugacaauguggggauuuccuguccauuagcagcgauugcuauuugacauauguuucuggugcccauuaaucugcccuguaaugggucagaggcaaaaaugggggauucagagguacuagguggcucucuuaauuuaauagaacucaaugcuaaggacgccucuauuuguuaauaaguaaucaagucauuggcuacuuucugcuaaacacuagacuaugauagugaccuuagaccccgggcauucuaaaccaggcuggcaggaggguggugguggaggugaugugagguaagccuccuagaggaacugucauccaaacaaucugaaaauugaaacauuauuaaaggcagcacuaagggugguauguuggaguuggggcaggagcacuuaaggcagaaggaacagcaggugucacugccugcaguugagaaaggggguggaauucucaaggccuuagaccccagagaacaggacugggcaagagcugacauucaagggaggaacagcauguacagagcccaaagucccagccacuuucuguuggauacugagcaauaggaauucaguaaaggacuuucaagaagaagugaugugaucagauccaccugugggaaagaugccuuuagcugcuucauggagaaaugacuggagaggaggccuuccuuaguguugcagaggcaaaguaaagaaaaugcugcugcagugacccagcaaagaggugauggcggaggaaucaggcugugacaagggaagaagaggcuggcucaagugugucucgacugcacagacuuacacagcgagguggggccaggggcugcauuuuugucugagaauaguauuuccuuagcuuucuagagcuuacagugucuuuuuguuuauguuaucucauuugaccuuccuaaaccugugagauaacaggucaaauguccuuaugucauucccauuuuuauagaagaugaaacugagguugagcaauuagucaacagacacagacucgcaggcccucuucauucuaaagcaaggguccaaaaccuuuuuucuauaaagggccagagaguaaauaauuuaggcuuugugagccaggcagucuguugcagcuacgcaguccuugguuauuauagugcaaaaacagccauaggcagcauguacagaaaugagcauaaccaugcuccaacaaaacuuuauuuacaggcacuaauguuuaaauuucagguaauuuucacaugucacaaaauaucacuuuucuuuaaccacuuaaaaguauaaaagccauucuuaguuugcaggcaguacagaaacaguuucagcccaugggcugucauuuguugaccccuauucaagagggucugucacagaagacuccugcuugccugaaauuuacgagugcauguaaauguuggaauuaacaggugugccuguuuucucuuaugcugucuuucaucuucaggaacagccaggaagacgcugcacuucgagauuuccaaggaaggcagugaccugucagugguggagcgugcagaagucuggcucuuccuaaaaguccccaaggccaacaggaccaggaccaaagucaccauccgccucuuccagcagcagaagcacccgcagggcagcuuggacacaggggaagaggccgaggaagugggcuuaaagggggagaggagugaacuguugcucucugaaaaaguaguagacgcucggaagagcaccuggcaugucuucccugucuccagcagcauccagcgguugcuggaccagggcaagagcucccuggacguucggauugccugugagcagugccaggagaguggcgccagcuugguucuccugggcaagaagaagaagaaagaagaggagggggaagggaaaaagaagggcggaggugaagguggggcaggagcagaugaggaaaaggagcagucgcacagaccuuuccucaugcugcaggcccggcagucugaagaccacccucaucgccggcgucggcggggcuuggagugugauggcaaggucaacaucugcuguaagaaacaguucuuugucaguuucaaggacaucggcuggaaugacuggaucauugcucccucuggcuaucaugccaacuacugcgagggugagugcccgagccauauagcaggcacguccggguccucacuguccuuccacucaacagucaucaaccacuaccgcaugcggggccauagccccuuugccaaccucaaaucgugcugugugcccaccaagcugagacccauguccauguuguacuaugaugauggucaaaacaucaucaaaaaggacauucagaacaugaucguggaggagugugggugcucauagaguugcccagcccagggggaaagggagcaagaguuguccagagaagacaguggcaaaaugaagaaauuuuuaagguuucugaguuaaccagaaaaauagaaauuaaaaacaaaacaaaaaaaaaaacaaaaaaaaacaaaaguaaauuaaaaacaaaaccugaugaaacagaugaaggaagauguggaaaaaauccuuagccagggcucagagaugaagcagugaaagagacaggaauugggagggaaagggagaaugguguacccuuuauuucuucugaaaucacacugaugacaucaguuguuuaaacgggguauuguccuuuccccccuugagguucccuugugagccuugaaucaaccaaucuagucugcaguaguguggacuagaacaacccaaauagcaucuagaaagccaugaguuugaaagggcccaucacaggcacuuuccuacccaauuacccaggucauaagguaugucugugugacacuuaucucuguguauaucagcauacacacacacacacacacacacacacacacacacaggcauuuccacacauuacauauauacacauacugguaaaagaacaaucgugugcagguggucacacuuccuuuuucuguaccacuuuugcaacaaaacaa

SEQ ID NO: 192406 - RNA, 725792 nt, Homo sapiens
ugcauuuuuccaggaaaaaaauuaaaacuuuauuuuuaaaaaucccacaaauccauaaugaaaucaucaucugaaaaaaaagaugguagggaacaaaacgugggauacauuuaaaaggcacuagauucauuaauaccagagccauucuggagaugccauguaagaaaucuggaguuacucuaaaucuucuuuuuagugguaucagaacuggggagaaggguccaagcaaaguguugccuuugccaguguauucggaucgagguuaugaggaagagcccuuuuccuuugucagugaguuucauguugguccaccacuccagcgcugagcagcuccccgauggcccugucaucguaucucaggaccuccuucaggaugugcguugugugcugcccgagcagcgggggcggccuggccucugacaucuugaacuuacuguaucucacagcugggccugccaaaggagaaggaaagcaggaagccuguuaaugacuaacccuacgaaauuaauuaccuaagcagccugggguguuuuccaugaaugccaaaaauaucaaugagugccaguuacacccuuccagaugcaucaacguuuuggaaauaaacguguuuucacauguggcuuuucuugacucagguucauccaaaugugcagugcucaucugacucgcucaucaccaugcaguggggcugcauggaugaagcuaauuugugccgggccuauuuggaagcugguguucccgucaugaagacucagagguagggcacucaacugagugaacucuagguaggaaagaacagugaccacagaaacguagugucucucugaagcuggaaauuugaucccaggugaaagcaacccagcagcugacuacucaaugucuacuguguaguuccaagguuuaguucaacugacugcagaucaccgaaaccucagcuagacccugguucaaggcuuuuggugguagaagaaguuaugugugcaggcuucacugucagagagacuuaggcuuugcucuccgcucuuaugcucucuagcagagccaucuuggaugaauugcugaacuucacaccauaaucuggaugugauaauguuuacuauacagacuucagguaaggauuuaauugagaucauagacagaaagcacuaaguaagcauucccuaacccaugcuaaugcacaaaacuuguugguuacuaugauuacaaaagcugccacaacaucucucuugaagcuuauaguguaaggggaaaaggggugccgggcacaaaguuccucuaaacagaguugagcaaugcuuuuaagaacuguuggaaauagauuuuacuauccccauucuucccaugaggacaugaaaaccccuaaaaccuaaaguuuugcucaaggccacauagcuaaucauagggccuggaugaaaaucuguguccgcuggaacugucucccauuaaaggccaugaacuuuccauaacaucagcagccacuucugacuucucacucuuccacggagaggcuggacacuggggaacauguuguuucaacuaauuuuaccuuuguuaucacauucaguaagugguauuuauguuggcuguccuuuaugucucauuugauuaggcuucaggagaacaaaugauauaguagucacaagaagacuugauaaaacaggauauuccuaucucaauuuuuuuuucuggcuuucucuugauuugaggagcccauaggaagaacaaauaaaaccaaagcaugaguggguaaaagaaugcccaucaguaaagcagcaaacgagcuuugagcucuuuggagaauuccauuaauaaaaguacuuuugcacuugccacuguugacagagauggaggacuugggucuccuaacaccgucaagcugcaccuuuguguaacacaucuaauccacuacagagggacaacuuucaacugaugccuacaguuuuuccuucucugaagcuuagugacauucaucguuuucuucucacauuuucuuuuaaaugccccagugcaugacuaccuuuucaaggguuugucccuuuucaguaagagagaaaucaacuauagcagacacugggaggcaggguccacagcucucccaagaaugacaauaaugugaugguuuaggcaucugacccuuacucauugcucucuccaacucuguuccauuuugauauuaauuaaaaacaguuuuaaucuaaaacccgucuaucaaaagaagaacugcuugaagcaauauaugccuccugaagucaaugucaugugacuuuacuccacuugaauuaccugaagcaagacaguaguaguaauagcuaucauaguccagcuaccauuucuuuucuuuuuuuuuuuuuuuuuuuuuuuuuugagauggaauuuugcucuuguugcccaggcuggagugcaauggcaugaucuuggcucaccacaaccuccgccucccagauucaaggaauucuccugccucagccuccccaguagcugggauuacaggcaugcaccaccaugcccggcuaauuuuguauuuuuaguagagacgggguuucuccacguuggucaggcuggcccagcuaccauuucuuaagaacuugugaugcgucaaccacugcaccaaaggcuuuauguauuaauacaacauugcauacaguucucacaacgguccugucguuuggguagacugucagucaucuuuauuuccagauuaggacauugaaggaaauggagguuuaaauguuaaaguuaggauuaagguuaggaaauuaaaauaacuugcccaaauucacacagcuagaaaaugauagaguuagauuccaauuucacgucuguuggguucaacaacuuggauuaaaaaauaauaauaauuuauugagauaaaacuuaacauaacauaaaauuaaccauuuuaaagugaucaagcagcuucuccucauuccucccaaauccaggcaaccauuaaucuacuuuuugucccuauggauuuaucuauucuggcuacuccuuauaaauagcaucauauauaauuugugacuuuuugugucuggcuucuuucacuuaacauaauauuuuugagauucauccauauugugcauaucaguacuaagcgccuggacuuuuaaccuccacacagugaucgaaugagggaauucuucagguccagccaaacuaaagggcaguucaacuuguguuccucccacuguaugccauacuuuucugguagcuuccagaucuacacugaagacuaugcuaccaguuuagaaugaagaguauuuaaccuuuugcauaaaauaucuucaagaauuuagguugguaaaaugguauuaccuggcaacuuuuucacacuugcuaggaugaagacauagacugcaacgggacaaauaaagugaugucaagaucucagagaaagcuaaauucccaugagccauuugaaaucuguucuugcaacccugugcaauaauaauaauagcagggacaucccucucugaauaagguuugcaugaagaaaacaaagggcucaaaaaacacauuuguuucaaaaaguagaaaaugacagaauuauuuauaucgaagguccaaagaaaaugacuaaucugaucuuucaucuaaaaaauuaugagcaagguaagucacauguucuuaaauuuuuuggcaaacuaacaucuauguucccaucuguuuuuaaauacguacaagcugugugaacuucagaacucuuaaggucucagagccucagucuacacauuucuaaaacgaagucagcaauaccuauugaagggugguuugggcacugaguaauauuauauagauaucaaucaauauuaguaauaaucuaagaaauguauguaaaaauaacaagauaaaauuucgcuuauaaaauuagcaaauaaugugggaauuuuguuugauuuuaagagguugguggcugauaggaguguaaauuggugcaauccuucuggaggaaaaauuugucaacuaaauaucaagacuuuuaaguguucgcauacuuggauggagaaaucccacuuuaaaaauuuuuuccuauggacauaauuaggaauguucacaauuuucauaggcaaagauccauauagauuuuuaagucugcucaauacuguuaagagcucuugacuuccuacauggcauucuaaccuacagcccauaaaaauucuuugcaugggaucccaacuuugguuuaacuuaaauuuucugucugcucauugcuuccaaggguuaccucuguuaggacuagguguucagcuucucauuauuucauguacuguccugcacaccuaucuucaaccucucucuuccagauaaaaaggucaaauaguuaucaugcugaaaaauauuagaaagauuuauccaaaaguugggcacugguuaaauaaauuauagggaaauuguacaguaauuucaaguuauaauuuaacuuuuggcuuugaguauauauauugccuucacacucuccugaaaccccacugaaauaaaaguauaaaaauuaaacaaaaaaacuucauaugaaugaaaagaauggaagggaucaucacuaaugaaugggauauuuccaacaaauuuacagcccacauggaugagaucauguugauggauaaaagagauagagaaagcugaagccuaaaauauuguagaaggagaauaagagcaagcggaugccaguuggucuguuuugccucccaagagccuuugaucuuaaagucagugauuaugagagacacagaacagggacuagaaauaggacuaagaagaaggauugaaugucugaauauagaacaaggguccaguuuggaucugcaauaacauuuaaacaagcuuuguaaaaguagaguacaagcagcuagcauuuagcuagcaucaaccauuucuuuaaaaagaagcucaagaaagcuauaaagggaaaguuaaaaauuuuuaauauggauuuuugugccccagugcaaagcccucgauacuccaacauuugaggggcccauagccugucuauggcucugaauccaugucguaaagacugucagugaaacuaccuugacccacacuuccaagcauucucauucagaguagauccaguaaaaguggaaaacauccucaacaacaaagaaaaaucaaugccaggcauccagaucuuuuuucuauaaaagauugaucaaccagggaugacuagaaauaugagaaccaaauaaaagauguuaaaaguggaaacaaugaagauaacucaaaacagaacaagaacagaaugcuaugcaaaaaaaaaaugcaauuuaaacaagauuuagcacuuacauuuuccaguauuauuguuaaaauuaggaauuuagaaaauaaaguaaaagaugcucccaaggauuuagggacaaaaauauagcuugucuaaaaaaugugagaaagaagcuaagaguucucauaaagcagacaagaaccccaggaaaaaagaggcaaaaagaguagaagaggauaaauuuuucuuuucuuuucuuuucuuuuuuuuuuuugaggagaaauuuuucaacaaagaauaugaggaauagagaagagagcauuuuuucagauuaaaagagucaacugagaauccaacaguauagauggaaaaaagauuuacaucuugacaucacauaaaauuucagaauaucagcauuaaaaauaucugagaaacuuccuggaaauggaggaggggugaacaauucaagaccuaagcacuaggacaggaggguggaaacuagucuuuuuuuuuuuuuuaaagaauaaaauuagacugcaccaaacuccucacuagugucuacuaaaaacuacaaguagagcuuguuuucaacuuuuuguuuuuuuuaagacacaggguuucgugcugucugccaggcuggagugcaaaggcacuaucauagcucacugcggccucgagcuccugggcucacgggaucuugucacuuuagcuucaaaaguagguaggacuucaggaguguaccaccacagcaggcuaauuuaaaaaaaaaucuagagauggggacuggcuauguugcccaggcuggucucaaacuccuggccucaucguccuaccucagccucccaaguagcuaagaauacaggagcauccauguccaccuuucaacuuucucaagggacauacuguuaaaccuagaaugguauggccaguuaaaugauuaaucaaauaugaaguuauuugcaaacucucaaagacuaaguaaguguacugaaauaaguuucuugaguaugacugcaguaaaauauagaagccaauggacaagaaagaaagaaagaaagagagaaagagaaagaaagaaagaaagaaagaaagaaagaaagaaagaaagaaagaaagaaagaaaggaaagaaagaaagaaagaaagaaaaaaauuuugauacacaauaaggaccugcuaaggagcauagggaaagaaggucccaggaugacagcucagaccuggagagccaauaaaagcagagauggagaaggaggacagaggccuucaaaaggaaagucuaagaagacaaaaagccuuaauuguguaacuucuguaacugaaaaguuggaaaaauauaauaauaaguuacaucauacaagaaaaaauaauaauuagauacucuaugaaaaaaagugcauggaaaaaucaagauccaaauagguagcaaauccaaaauauggcaagauuuuaaguaauugauggaauaucugcaaagaaaauucauuugaccuugaugcuaagaacauucauuugaguagcacauauaaccuugugcauucucuucaacagcucuuagcauuaaauugucuauuuagaugccuguauccccuaugggggcaggaauaaugucaauuguguuugcuaaugggccuucaaugcuuuucauggucgcuauaaaaugaaaauaucaauggcaagcauucuuucuuagauauucgcuaugacuguggacuauggcuuuuuguuucauuauuucauuggacuuuucaauuuauauaaggaagaaauuauuauagcucucauuuuacagaucagaaaacugaggcucuuuaaaggguuaauuaauuugucuaagauuauccaacuaagugauagaaccaguacaagagcuuauaucaggcugggugugguggcucaugccuguaaucccagcacuuuaggaagccaagggaggcagauugccugagcucaggaguucgagaccagccugggcgacaugguaaaauccugucucuacuaaaauacaaaaaauuagcggggugugguggagugcacugguaguuccagcuacucgggaggcugaggcaggagaauuucuugagcccgggaggcggagguugcagugagccaagauugcgccacugcacuccagccugggagacagagugagacucugucucaaaaacaaaaagagcuucuaucuauuagacuccauggcucaugcucugucaaucaauacaaauuuguugaacaaauaauugcuaacaauaaaagaaaguuuaauaaauacugugauauuauuacacauaguaauacauaucauauuaauuaauguauguauacacuaauuuauucuacauauaauuuuggaguaucuaucccggugccaagaucugggcuguaugaucuacauauauauuagcaaacaaaacauagaccuggacccuacucuucuggaauuuacuuucuuucuuuuuuuuuuuuuugaaguguugugcugagugguugugggaauaaacaaaacacaauuuuauugucaucaucaaacucaucaauuaguaacauuucuuagcucuugaaacccuuugaaaggcugauaaaagcuguugguccuccccucaaaauaagcacuuauuaaacccaaugcucuggaauuuacuuucugaugugggaggcaaacaaugaacaaacaaaagcaaauaaauugcuaaaauuugcuaaaaauuauaaaauuauuaaaaaccaaguugaaaauggaauaauauugcaaucacaguggggaggggcugaagugggagaaagggcauuucuaaaugggacgugcagaggaggccaagcugauuagaugauccuuaagcuaagucggaagcugagcuaucaauacgaacagugggggaaagaagauuccaggcagcaugaacaagacugauguucaaggaauugaaaaaaaaaaaugaucuaguguggcuagcauguaauuuaacagaagagagguacuagauaaaguugcaggaaguggcaggggauaguaugcacaggguauagacuauaguagugacaguggaucuuauucuagguucagugggaagcuacuggagcuuuaagaaaagcaguggcaggacuuacaauaaggaauacuuuugugcuaggcagagaauguaaugaguuuggagguuguuguggguagaucauaagagaugauggcagccuugacuggaaugguacauuagaguuuuaagaaaaguggauguguuuuugagagguauccuagugauagaaugagaggacacacugauuaauacaugggccaggguaguucaggagaaaaagaaaaggaucaaagaagaauacugaguuucuggguucauuuaccagauagggaagauugaauggauugcauggacaaguuuggcacaagccaaggauuauuuuuuuggacacgccaaguuugagaugccuaugaaauauccaaagagagaugucagugggucuuuagcuaugcaagucugaaauuaaaggaagaguuuuggccagcauguguaaaaucagaagucauuuaccaucuaaauguccucauucuaaaaugacauauuuccacagcaauuguauuuauuccaacaucucugaugcugagguuuuaaaaauaaguuguuuaugugccuuuucucuacuaucuaaggucucuaccaaaauacauugcaucaaaaacauuuuauguccacaaggggcaaauaaaauaaauaaauaauuaucucuaaagcucauaauuuuggagauaagugcauuucuuuaaaagaaaguccauauucuuguccuucaacagacaaauaucuauggacuucauggguauaaauuaagguacuuuuacuuuuacuuuaagccaugcuuacagguuaugcccgucucuaagcaagggcugugggugaacugccugugguccucuaagggaugguucuagagcgguguaggauaaugacaaaggcuuuuugcuucaacugcuucauaugcccauaccugggaggcugaacugaucaacuucauggaagccagaauuacagagcuggcaguagacaaaaugcagagguagguguggaaggauccugucacaguuucuaaauuauauauuauaacaucuaaaacuacuauuuaaugaacgcuuacugcauaccucacccgacaugagaugcuauguguuuguuaucuaauuugauccucacaacaacauuaaacauuuuuuuuuuacauuuacaaaugcauuuaaugccuaaaucacaaaggaggaacauggagcucagagagguuaagaaauguguacaagggcacacgacagaugcaaauauagaucuguugacuucauagcuguuguuuuugagaagugauacaacaaggcgguuaagacuguggguucuagagcuggagugucuagguucacauccuggcucugccauuuacugacuccaucuccuuggguaauuuacuuacugaaccugugccucaguaucuuuacauguaaaaugggcaugacacugguauaaagugucauauaaagcugugagaauuaaaaaccuugcuucuuaugaaucccugagaacaguaccaggcacacaguaaauacucaauguauguuauccuuucuucucugcuacagugaugaccuuagcaacuuagauaccucucauugagcuuugaucaccugcuaauuucagaccuagacuucccagaacauuagcaaguuagcugcauuuuagauuugugagagcaggcuaaagauaaaaguuuuaacuuguagaaaucuuuaauugucagggacaagguuuuuuaaagugaagggaaaaggaaggaaggaaucaaccauuucuuaaccacguguuacauaaaaagcacuuuucaaauauuuauuuugcuuauucuucauuacaacccuuugagauagguauguuuccccuuccuacagagaauaaaaaagaggcacgggagguuggaugauuacccaagccacacucuuuauaaguacauacuuagugucucuaacagcaucaggacguguaccagaaauucauuuuauacccuuuuaccuuuuaacuaguuaaguggaaggaacaaugaaaacacaggacuucuuucacucauuuaacaugcacuuacuacagacacuauuaugugugcuucacucauucauuuugcucaguccuuaugauaaccccagauggcccuauuaucauccccacuuuacaaaugggggagacugagagaccgaagggaagccacuugcucagggucacagagcuggugaggagcagggcuaugauucacacucagacaguccuguggcagaaucccagcucuuuggcacuggaccacacugcuuucuggugaaagaaagagagcaaaggaaggagagaaugaucucagcuugaaacugaacucagggguccagaaguagaacgcgaagagagccacuugaggccccauccucugaccaguauguccucuccaucuuucuagaucagaguccacuagauuccuugugcaauaaauacuuguuauuaccuccuguuuucaaaugaauuugucaaaugccaccuaaacccuuguaggaagucccggacucacggcacugucaauacaugccaauuucucaugccucugagucaggggaugcucugcaauaccucccuccacccacccugaaaggaaugaagccuucacuaucuccucugucgaaaguuaccugagucaaagcacaaggagggccuagugccuggcgcccccugagaaucccucaagcuagcucugugguguuuuccgucuguguuuugagaucccuccguaacacggucccggugguuuugucucaccuccuuuuagaaaccucccaugauucuucuagggugaaaaggaaaucuaaccaaucuaugcaaacaccccaagcuacucuagcuauauacagguucaagcuacauuucuauaaaccaaaccaacuuaauaauguaaacacuugcaggaaacagagguagccaaaaacaugggggaaaccauaaugaauauucaaguaaugggaacauaauaucacaucaucaugagggaagggaccuaaacagucccuuuuuccagagcuccacgcaccuuccauccuaaugaugcauuucuacagcaaugaaacaaacuauugcucaacuucacaggucacuggcaauugaucagcacuaaggguuaaaguaauuaacauagcuggccagucugaucacaauggaaauaagaauuaauaaaauuuaauaaauggaaaauacccuaaauguguggauuuuuuucauuugauuuuuuucuuaauuucugacauggguaucaucaacuucuuaaaguaucaagaauacauaaaagugaacaucuguuuuauaauauaugaaauguuuguuauaacaaacauuuuuucuuuggacuucuuuggcucauugcuaagauacaugcuguagauaccauuuaaucuucaaggcuuaguaguguaguaagaagccaaacuucauuuugcugaaaauaaugauagcuccaguacuaaguuauugcacaauuucccuuccagugcuugaacucaucaucauaacaauaacaauauuuuuauauggcaccucucagccauagcauccaaugcaccaaauggagccauacacuuagaacacauuaaacccauuagaugugauauaaaaacagagaaagcuauuuaacuagcauggaauggugagauaaggccauagagaaaaaauguggcuuuggauauuuuuaacagaagaacucaauccauggcacugcuuacgggaccaggcgucccagaaacucaaggcauccugugguauguaccaccaacauagauaugucuccagucucacucagaguucagaaacgccauauaucacuacugcuugaaucaauuuuggcucauuguuuuuuaacuuaauaaggagggccucaagugccaguaucuauagguugucuauuuuuaaccacaucaaugacccuuugauagucaucaguguuauccaccaaauuuccaguuucugcagauaacggaaaugaggcacugaggaaaaagucucaaucauggagguuuauuaagccagcuuuaggguacauccaggaaaaacacgagccauagacacagcuguggcuauuuuucccaagaguuuucaggcuguccaguauauauacauuuccuuaagggggagagaaagcauguaggaagagggccagguacaagguagaguggaugguuacauuccugugagacuuuaguuagugccagguaaaucuacauuuuacauguaauaaggugaauguuugaagagaaaaagaaguaaaggaaguguaaauuaugcaaguuucucuggguagguggaaauaauuggucuccucuuaucuuuguucugcaccuggaaagauaagcuuguaaucuacaccaucgguguggaauccaacagacuuuagauuuaggagcuagacuuacauugcaggccuaaaguuauaauuggcacgcccuuguuucugggaggccagcaaaagauuugcccaugauugaucugugggagcagucuuucauagaugcccaaggccuuuuaccuuguggggaucuggcuaauguauaaugccaguaacagcuucauuuggaaaagggcauugcacgacucagccuccaggcuuaacuuucccuuuugcaaaggaguuuggggguccugagauuuuuuuuuacuuuccuuuauacuaguuuccaggaauaugacaguauuacacacccuugucccuucgggguuggguaaaacugugugagcccaaugaauugugaaugaaagaaaugugggccggaugugguggcucaugccuguaaucccagcacuuugggaggcugaggugggcagaucaugaggucaggaguuugaaaccagccuggccaacauggugaaacacugucucuacuaaaaauacaaaaauuagccaggcguggugaugcacgccuauaaugccagcuacucaggaggcuaaagcaggagaaucgcuugaacccggaagguggagguugcagugagcugagaucgcaccacugcacuccagcaugggugauaaagugagacuccaucucaaaaaaaaaaaaaaaaaaaaaaagaaagaaagaaaagaaauguauaugucaucuccaggacagaacccucaauuguugauuuaagacccugucggucucccugucucuuuggcagugugugagaauggugacuguuccaccagccuggguaccugucaacccaugauggacagguaguguaagaaauacauuuguguuguuuuaagacacuguuauuugggaauuguuuguuaucccaccacaaacuagccuauuaagauugacacaugccucaguuucaguguagagacccacuugccuggacuagaggagaaacucauuaaucuaguuccucaguacuccuuuaaaaagcauucacuccagacauuccaaauacuuugaaauggcucauuuuguguguagccaauuuuggccaguggaaugaugauacuagcuauuauuuauugaguacuuacacguguuaagcacuuggcauaaugcuuucuauauauuaccuucuuugaugcacuaaaugaauuuaaaagguaggaucauuaugacaccauuuucucaaugaagaaagugggguuaaguaacuguaucaaaauuacacagcuugucaacugaagaauuucauuagaacuuaggcugguuaaauacaaagugcgugcucguuaacacugggauguacuuccucccugcauaauguggaagaaaaucugcucucauaucaguggcuggauaaauaccauucuuuagcagaugguguuauaaagcaguacuguauuauaaauacuuauauauuucaugauugcuaauccauuaaggcauuuaucuuucauuugaaaaagaaacagggcaacuuguauuugauuuaucuaucuuguuccaacccacugaaaugucauaguagauuauccauuuccuacuggaaaaauauauggcccauaaggaaauacuauucauauucauuaguaaacaugcugucuccccucaaagugugcuacccaaaccuuccgcugaggucucugaaaaaugugggacuggaagaagcucucuccugacuguuuuuuuuuuuuuuccaacacuaguguuugcgugucauuauuuuagacacucacgaauacucaaaagggugaagaaacaccuugcugacaacgugcucuuugccaaaauaaucaauucuuccucuucuuugccuucuagaauucaaauauucaauacaagcucuuugggcgcauucccaagacuuuguuugguuagauuucaccauggaaaacaaaauugguucagcugaagucuauagccagaauauuuuaagcuccauaguccuucaaaguagugaccuucuccucaccuccucugccucugugcuccauuaaggaaaaaaccggaaauuuccagucagagaagccagaucacguuucgauucaauuuuaaaaggagcaacuaaacagagcuauaguaggugcuuaucuguggcucuuaccucaaaugagcuuugaaaaguuuuucuguaaacuugaugauacuagucuuucagaauuuaauaaauuuuuucugaacguuuuagucacuauaguaaaagaauuagucuuauaucaaccaucuucuauuccuuccccagagucuuuaagaucacacaaaugacgguuauauuccaagcaaagagagaaucaagaaaauuaggccccccaaaccugcugcuaagaaaaagggaauauguuaauuauuugucgaacaauugaucuuaguuuuucccuuucaccuugccuuugcaguccagauggaaauguuuuaggagaaaguccuuucucucuaugccccuauuugaauuuuggcaugaccauccucucaauaacagcacucuaaucccuggccuuacuuauaccuugcuagccccacaguccuaucucugaaaaugucuuucacacacacccacacuucugaucuuuucugucauccccuugguucaaagcacugugcaauaugaggacaacuuguucaauccuucuccccugcuguuucuuccagccaaacugcacuuacucuccgcuggaccugaggcuguguggguauaugugccaaaauggaaugcaucucagcuuggcaauccucaagucuacaauauucucaaagcucuguuuaggcuaacuuaauguuggaccuuccccuuuucccauaguccaaagaaacaucucccuucuuugacucccuauaacauuugaucugcuucuccucaguguuguaccucacuuucuaauugcauuaucucuugugaucuuugcugacaacaaaauuaauguuuuguucauuguguauccuccacagcaucuaccauaugaguauuccaucaguaagugcugaaaauguuagacaaaaauaaaaaauaaaaaauaaaccaccaaaaaccaaaacccacuagauuccuagaauagaaaacaaggccacuagaaauaugugaaauauagaacuaaagggaggucaaggcuuacagauugguacauuuugcacuacauuucuaagugaagucaucuugacucuucucuuucucuuacaugucauauccaauccaucagcaaauucuauugauucuggcuucuaaacacauacaaaauccaaucacuuuuuacagccagccuaaugcuagcuaccaucaucucuugcuggauuucugugagagcuuccuauugauacagacaggaggcagggaaguacuggguagaagagggcggucccuggcgagggccccacccucaagccuggaccugcgguccaaaaugagaacuuuaacaucccuguuuucccacccgaaauguugccuuuuccaaaaccacccuggcccacccugcccccaacccuguacccauaaaaaccccaagcuccacuggcaggagagcagaguggagcagcagagaugagaagagaagcagcagccagaugucagagaaaagcagguugacuucagaggggugacuugauggcgggacuuccgagaagaguucggucauucaggagaaaauuaucuucccacucugucccccuuccagcuccccuucccacugagagccacuuccaccucuaaauaaaauccucugcauacaccagccuucaauucauuugggugaccugauucuuccuggacacuggacaaaaacuuggauaccaagagggcaggguguaaaaggcugucacccugacccuccacugagcugguuuacacuuagccaucugcagauggaaaaugcuaaaagagcacugauuguaacacaugccuucuggggcuccgggaguugcagacaccccuucccagacagcagagcuaaaaaagcauuguaacaugcuuggaugcugccgugguuccuguacaaagccugcucccaccagagaggagcaacuggcugguuccaguguugauuugcccugguuccugcacccacucaccugaguacuccccuucccgugauggguuuagagcugcgggccgaguaaaugagccaccccuucacaagucuugcaaagaggucaagggaaauaucacuaccagcucucccugccugcaggcuuuccuucaguguauucucaacaaagcagcuggagucacccuuuaaaaacaaguccagucaugucauuccucugcucaaaacacugugaggcuuucccuugcucuucacaauaggcgaugggguucuacauaauccacuccucuucccaccaagccacccugugccuuccucucuugcacugcucccucuggcucagucugccccacccacacuggccuccuugcuguucaccaagcauguuccuccuugggaacuuugcuccagccauucuucucugcugggaacauucuuccuccuaaaaucuacucacaucauucccucacguccuucacauuucugcucagugaggccuacacugacucacuucaacuuuuuuuuuuugagacagagucucucucuguugcuaggcuggagugcaguggcgugaucucagcucauugcaaccucugacugccugguucaagcaauucuccugccucacccucccgaguagcugggauuacaggcaugcgccaccaugcccagcuaauuuugguauuuuuaguagagacgggguuucaccauguuggccgggauggucucuaucuccugaccucgugaucugcccgccucggccucccaaagagcugagauuacaggcgugagccaccacgcccagcuucacuucuacuuuuuuucauccugccacccugacugcuacuuuccaucgccccuuuggccaguuuaccuccuuucuuccagaguccuuuucauguacaucuaccauucuuuaucugucuuucucugcuagaauguacauguuauaaugguagagaucuuuguauuuccucaagagggagugaaugagggacugauugaguuuaaccaagcuuugaauucaguccucagguuucuaaaacaaggaaacucaaagugcucacaaccucaaaaaacaaauucugucaaacagaucuaaaagcaaggugaggcauuuucacugaacaugaaccaaaauagucucauguagacaagaaaauguuaaaugcaaugugucuguucucacugcaccugacuuuacagaauugugcaacuugcauguauguuacccacaagaaagaggcccugcaauauuccaaaaaugaaacauucuaacagcugugugaaaucuuugaguauaaagauccacuuuauaaguuggauaaaaacagguguucaagaacaauuuuaaguucugugagggcaggaaucuuaucuguuuucuuugcauuguguguccagagucuaguaaauuaacaugcucaauaaauauuuguuaaaugaacaaauaaaugaagaggaagaguuucuacauuuucagaaauaaacaagaaugcaaaagguaauuuaacuuuucacuuaaagguuuuaucaucuggguguugguaugauaccaaauuuaccuuaauuuaauuuguuuagauguuaagcuuuuaguaugacaguaauagguaagacuccaugaaccaugcaaaaugagucaggaaaacacugucagacuuuaaaaaaaugcuuauuauuucuucuuggaagaacauauuuuuuguuauuuuuuuaaaugauuauuuguuuuccuacuuggaaaacauaagucuuauuucuuauuucuaugagacuguaauuuguacaauuguacaauaaacuuauuuuguuucccauguuucucuuugguaguggguguugcaaauuucauauaauaauaauaauaaugauaugugucuguugugguacacaaacauuuuccuauuuauuguuucuuccccuucugcauauucuccuuauuaacuauuuagacugaugcuuacaaaaugcccuccaauguuccuaauauuaauucugugguuauucuuucccaguauauuuugaauuauuuaaaaguauuuaacacacaaggugaaaagggcuaauuaguacugaaaaucugaaauguuuuuauuuucacaguuucauuguggaucugaguauggucauuuauuuuuuauguacuaauuaaauacacgaguaauauucacucuccccaaagggcccucugcacaguuuccaacaaacaaaauuggcucucuucucacacuaaggguagagauggccauugucuaugaaauguuuaggauauccucagcccaugcugagugggaagacauuucuuuccacauugaaacuucauuaauuuugccugaaucacaauccagcauagguaaugaaaaauaugaaauguaucauuucuuauaaauaaaugaaacuaugucagagaugucuuacaaaccuguaagaaaacuuacucuaguaaaauacacaaguggauuauaacuaguaaaucaauucuuugucuacaacagguacuuguucuguguuugagcaugcuuauuuuuaagaguaacugaaacauucccuguguaaucauaauuaaaccaacaauuuguuuaggaaugucuuuaacaagauagcacaaagauaaacaucaauuuaguugucgucaucuauaauagaugaucauauauucaaaauuaaugagaaccaaauuugaaauauaaauacucuuaggucucuaagucuaaaggucuguaaaacaggaagauguagucucagauaaugauuuauaaauuauugucuguaaaaaaguuauugaugaaugaauaaaagaauaauuugucauuuguguuaauacauuuuguugucugugucagcaaaauuuuauuuuguuuauuaggaaaaauaaauaaguaaaaaggaaguacucucaugagaagguucccacaugacauuuugaaucucauaaaagaaaaaaaaaagucuaaguaauauaacaaugaugaguuauaaauuuaagaguccuccuuggauuacacugguuuaaaaguuuuuguaccuugaaauuauaaaauaguuuaugugaggaaagugacuauuuucauauacuauaaaaggauuagguaguuggcagucucuaaaaauaguuguuguaacauaaaaaaaaacacccaaauacaugucuguguuuuaaagagacuuagcaggaguuauuugauauuuguaauuuauguuuucucuauuuuuauuuugucagacuuagcaggaguuuaucaauauuauuaacuuuuuuuuaagaaccagcuuuuguuucauugauucuauucuccuauuuucaauuuauugauguuugaucauacauuuaucaauaccuuccuuuuacuugcuuggguuuauuuuuuacuuuuuuucccccuaguuucuugagguagaaacuuagaugauugauuugagacguuuugucuccgcugauguaaacauuuagugcuauaaauuuuccucacaguacugcuuuaacuguguccuacaaauuuugacauguuauauuuucauuuucauuuaguugauugaauguuuuuucuuuuuuuuuuuuugagucuuccucaaccuacgcaucauuuagaaguauguuguuuaauuuccaaguguuuggagguuauccuguugucuugcaguuauugauuucuugucugagaacauauucuaugauuuugugguggucacccugcaggacugaccuccacccaaaacuucauuuggauguugagacuuaggauuacaagcauauaccaagaggguaugaaaggauuauuauucacauaaugagacuuucugaggagugcaggaugacucccauggaguucacaaaguggcucaaauuuagauaacgagcccuacucacagagauuccgcuuuaguauguguaaggccaggcucagcaauaugcauuuuugaguuggcaugcuagaaaacugagguggaaaaccucaguuucacacuuugauaaauaccuaaggcacugagucaucuguuuuuucuuugauaagcuggcucucacccauaaaggaagcagaaaaugagaaaaccucuuuuuuuuuugaaaacagauuugggaugcucuccucuucuggguuuugcccaagaggcuuccagcauuuccuguagcacacucggugggcauuacugcacauucacuggcacaucacuggucuggggagucaaacuuacuguagaauagucacuuggauguuuauugaauguucuguuucauuggaaacaaaauugugguuaacaaaauaaaaauagagaaaacauaaauuacaaauaucaagaaugaaacaagggacaucacuccagauccugcagucauuaaaaguuuacucuuaaaaauuuaacucagaaaaugaccuuuuacucaguaaccacugacuaccaaaacucaaaaaauauuaaaauagguaaguugaacaguucuauaaucauuaaugauacugaauucauaauuuaaaauuuucuaaaaaagaaauuucuagguuucuaugguuucacuguagaauuauaccaaacauuuaaaaaagaauuuacacaaucacuuccagaauauagaagagggaggaauauuucccaacucauuuuaugaucucaaaaccaauaaaaauuagcugggcagggugauacaugcuuacagugucagcuacuugggaggcuaaggugggaagauuaguugaacccaggaguuugaagcugcagugagcuaugauugugccaguacacuccagccugagcaacagagcaagauccugucucuaaaaaauaaaaauauggucucaaaacuagacagacaguacaucaaaagaaaacuaggggucaacauaucucauaaucuuaugucuaaaaaucucaauauggcaaauaaaauccaguaauguauaaaaaagaaguauucaccaugaacaaguagaauuuauuccaguaaugccaaguugguuuaauauuugaaaaucaaucaaugcaauucaccauaugaacaggcuaaaggagaaaaaucaugugaucauaucaauugaugcagaaaagguauuagauguaauacaacaccuacaugugaaaaaaaaaaaaaaaacucucaccaaaggaagaauagagggcacuucuucaacuucauaaaaaacuaaaaagcauuuacaaaacccaauagcuaccuucauacuuaaugauaaaagacuauauacuuuaagauuagaaacaaggcaaggauguccccuuucaucgcucuuauucaacaaaguacuguaaguucuagcccaguaauaaggcaauaaaaagaaauaaagggcauauaguuuggaaaggaagaaauaaaauuguccuuauuugcagauagcaugguugucuauguaggaaaucuucaguaaucuauaaagcaaacaaacaaaacgcuagauguaaugaaggccuuaggauacaagauaaaagacgcaaaaagcaaucacauuucuauguaguaauaaggaaaauguggaaacugaaauuaaaaacacaacacuccuuccaauuacuccaaacaaaaugaaauagguauaaaauuaacaaagcuuuuaaguaugcugaacauuacaaaaugcugauaaaagaaaucauagaagaccuaaguaaauggagagacauacuguguucauaaauuugaaaauacaacauauuaaagaugucaauucuccucaaauugauacacauguuggauguaaugccuaucaaaaucccugaaagaacuguuguuuucuccuguaaacacagauaagccuauucuaaauuuuaucugaaaagacauaggauuuguaauagcuaaaauaauuuugaaaaaagggguaaaguaggaagauucauucuauucuauuuuaacuauuauuauacaguuacaaucaucaagaccauguaguaccaguggagcgauagaaaucucagucaauggaacagaaauagagaguccagaaauagacucacaaaacauauccaguugauguuuagcagaggugcaaaggcgauuaaauagaggaaagauaguuuuuucagcaaauggugcuagagcgacugaccauccauaggcaacagaccucauccuaauuuucauaucccauaaaaaauuaacucaaaauaggccaggccugguggcucacgcuuguaaucccagcacuuugggaggccaaggcggguggaucuccugaggucaggaggucgggaccagccuggccaacauggugaaaccccaccuuuacuaaaaauacaaaaauuagccaggcaugguggugggugccuguaauuucagcuacucgggaggaggaggcaugagaaucgcuugaacccaggaggcaaccuggguucaaucgcucaaccaggaggcagagguugcaguaagcugagauugugccauugcacuccagccugggugaaagagcaaaacucugucucaaaaauaauaauaauaauaaaauaacucaaaauggucacagaauuaaaaguguaaaaugcuuagaauaaaaacauaggagaaaaaucuuuaucuaagacuaggugaagaauucuuagacuugauaccaaaagcaaaaucuaaaaugaaaauugauaaauuggaccucaucagaauggaaacuauuuguucugugaaagaucauguuaaggagaugaagagacaagcuacaaauuugaagaaaauauuugcagaccacauagcuaacaaagaacuaguaccuagaauuuauauauuucucaaaacucgaguaaaaauuuuuaaaagccaguuagaaaaugagcaaaaaacaugaacagacauuucacugagauaauauggagguggcuaaaagcauauauaaagacguucaauauuagccauucaggaauuauaauaaaaaucacaauuagcuguugaaacacaucuacagaaugacuaaaauaaggaauauugauagcaccauaugcugaugaugaugcagagaaauuggaucacucauacauugcuguuggggauauaaaauuuuucuagucacucuggaaaagaguacgacaauuccuuucaaaaauauacaggcauugacuauacgauauagcaacuguacaccuaaacauguauccccgagaaauaaaaacuugaauuuacucagaaaucugcucaugaauguucauauguaaugcaaaaucuggaaacaaauaucuuucaguaggugaacaguuaaacaaagguguuguauucuauaucaaagaauacuauccagcaaugaaaggaaugaacuauugacacaagcaacaacuuggaugaaucucaaggaaauuaugcuaagugaaaaaagccaaaauaaagaaguuacgugcaguauaaaucaauuuauacaacauucuugaaauaagaaaauuauagagaugaagaacaauuagugguugacaggaauuauagaaggagggagagagggaagugguggucccucuaaaagggcagaaugagggauccuugugauggaaucguucuauacauugaucacggguauauucacaaggaucuacguguaugauaaaauuccauaguacuaaacacacacgcucaccacacaaugagucgcauaaaacugguaaaaucugcauauggucagucaacuguaucacugacaguuuccugucugauauaguuacgcaagguguuaccacugaagcaaaucaagugaacagauaauuucuuacaacuccauguaaaucuacaaauaugucaaaauaaaaagguuuuaaaagcuaugaaaagacaacaaaaacaaaagcaaaaccuuacaucugauuaaugcuuuucauuuuguaucuaacaucccauuucaagaaaaugaaaaauaugccugagcacagggcucacaucuguaauaccagaguuuuaggaggcugaguugagaggauuguuugagcucaggaguuugagaccagacuggacaacacagugagacuucaucucuacuaaaaaaaaaaaauuaaaaaauuaguaggcauagugacauaaaccuguagucccagcuacuccagcugcugagaugggaggauugcuugagcuugggaaaucaaggcugcagugagccaugaucacuccacugcauuccagccugggugacagagugagacccugucucaccaaaaaaaaaaaaaaaaagaaaaaaaagaaaauggaagauacuaaugauuuccuccaaauggaaaguacuaaauauuuuccuaaccaauuggauggaucuggcaauugggggauagaaaaguuaagugauuuaccugaaccagaggacuuaauaauggguucaugaagcuuaacauuaaacuaaaacuaaacuuuacuucaaauccauaaauauguuuauguuuuuaaaagcuuugaaacaaaguaagaauauacaauaaagccaucaaauacguucuuccaaauuguuuguaagccuugggagauugccugcugugucauacaaaucagguuuuauguagauccuuuacagaaaacaguuucuggagauuggcauagaauggaauguagguauugccagaaggagagcacuagcagaacuuaauuucuguagucaauauuucaacauguaagaaauaggggaaagugcuuguaggagccaucauagguaagaagaaauuugaagaauuugggcauaaaauuuaggauauaccuggaaggaaucuaaaacaaacaaaaaacaguccacaucuaguucuuuggaaauuagauuuuaauucuguuguucuuaugcuuuuauguuuucaggugaaucucaaagagacaaaagaccaaauuccaagcugucaguaaggugaaauggaagaggaaggcagugucuugaacugcauuguccugguccagagccaccagccucauguggguguuugaauuaaacuuaaauaaaacuaaaauucaguuccucaguuggacuagcacauuuccaaggcuugacagccacauguggcuagcggcuaucauauuggacaguaaagaaagacauuucuaucaucucaauaaagcauuggacagcuccaaucuauauaaugaaugaaaacacuaaaaagucccaauuuuuuuuuuuaauuuaaaaaggacaccauuuuacaaaugacacaucgauggauucauauccauagccuccuagaagagcaggguggagaagaccccgaauacuauccugucaaaacacuuguuacaggcuugaaucuuucuuguuacugaugucuaaacagccauggcaaauaauuuuuauuuucuucauucuuuugccgguuaaaagaaacauuucuuuuauuugaaacuguucuauagcuauaagucuuucaucauucuggcugcuuacugcugaauuccagucuggguuccaauuuaucuauaucucuagucaaauaacuugugccaaaauuaagugccauguuccaggugcgcagaauauaggagguuuaucuuuuuccuuagucuagauauuaugcaucuacuuuuacagacuaaaaucacaaguugacuuuuaguaaccccaccaauaaauuuauuugcaauuaguuuuuaguuaaauaaaacccugcaaucugguuaauguggcccauugcuccaucuaauugaaacguuguguguccuauuuauaaccagucuacuuuugaauacuucugguggaaaaaucauuaacccugauuuuauaucagaugcaaaagcguggccuccaacaucuuucuccauguaacuauuaaaaguguuaauaaugggguccaagcguaugucuuugggaaacucuacuccccacccaccccccagccuaagaaucaucacaguuuggacccaaccauucacaagucaguucaacuauuuagcuguccaguccaugcuucuccauuuugcccacaaagacauaccuagucacccagcuuuuauugaaucuccugcaauacgcuucaccuuucccagaaaguuaaaaaagcagaacugagauuuuuuguuuaagaugacuagggagguuuuuacagcacagaagagaacucaccaacccuggagaagggaugaugcacuugaaguauuggcaccccacagugggcaacucuagcauuucacguuaaaacaaugcugaaaacaauuucuaaugguucuauugauuuucaaacaauaauaaaggguaggguccuacuuaauugaauccuaaugaguuugguauuuaccacaguccgucaccaaaugcacuucuuguacaaaacucuuugaacuugcugugggagaggagaacucucuguucuaaaugcugccuucaccacuguccagcugggauguuuuagaaccaagucucucacugacucauucaguccagaaacaaauagaggaaaauuugcagcaccugaucccaaagcagguggcuaugcauuaaugauguagcacgugccaagauccugaaaggaaugguucuagagaaauauugcaggaccuaauuauuuuuaaugucucuccuaacuugaaagugguuuguguacaugacuucaauuuucaaaagauacaaugcagccugggacuuuaaaacagggaaucuggcaaauuaacuaauaaguguaugaacacauguugaaauggcaaggcacuaaauaggcuggcuucuccuacagaaaagagucauuuaacaggagucaguuaagucaauguuuacuuuccacguaaggaacuuuacaucacaaaugggagaaauaauucagcagguagaaaaaaagggaaaaaacuuuccaagcagggaaacuuccuuggguuguuaauguuucuuguuaagaugggucuuggaaaacaacccaucucagaucaacauuccuacauguggaguuuggauucuuuuuuucuuccaguaaucuucaacuacaaugggaucuaucugacuauuauugcaauguuuaaaaacaguacugaucagauuccuuuccagugggacaaccaagaaaaaauggacugcugaaaaaaaaaaucuagagguaaaauaugcagaccugucaagggaugauggcccgagcagaggucuauggaccgaggggauggcagcaugcagaauagaaguaggaguggaagaggcccggcacagugacucacgccuguaaucccagcacuuugggaggcugaggcaggcuggucacaaggucaggagaucgagaccauccugguuaacauggugacaccccgucucuacuaaaaacacaaaaaauuagccgggcauaguagcgggugccuguagucccagcuacuugggagggugaggcaagagaauggcgugaaccugggaggcggagcuugcagugagccaagauugggccacugcacuccagccugggugacagagugagacucugucucaaaaaaaaaaaaaaaguaggaguggaagaaacaaagaaggccugaagcaauagguauaucuggccugaaaucuuccucucuagcuaauucuuuguggcuaggagugcucacauccgggaaaaaaaaaaaacaaaaaaaacccuggaaaacaaaaaaccaaccaaacagaaaacccagaguggauguaugaaccauuauagcuauccuucucuuaacuguuuggugcagaacacuaaaaaauauaaaguuugggagaacauguguccuauuacguaauucuugguauaauauuaauacuaccacaacauuaaaugggacacaguguuuucacaacaauaugauauuagaugauacucacaaugacccuguaggauggaggauaauuauuuuucccacuuaacauuaaaggaaaauaaggcccugagagguuucauguugccuagaaucccccaaauaaggaagcggagcaagaaccagaacuguuggaugccugcucuggguuacuuuucaggacucugugucaccaccuaucucaugagugcucuccagagauacccggacgcacacagggacagccacacauuugcaugcacggccccuugugaauggagacaggcuccauacugcucacuuucuuucauuccccugcacacuuaaguuacuguaccacaacacccaagaccccccaacaugugcuguugcccugaaacuggaguuacuacuauauaaguguucuaaacauaggcuauuguccugccagaagacuccuccucugggagucccuggagcccccucuaggcuguccugccagugugugagccuguacucucuuccuccuuaauaugccugguagccuucaucacacuacaggccuauagccagcccugcugaauucaggcugggguuggggugaauaguaagaagaguaucacacagagauaggaucuagagguguaacauguaaacagaaguguucuuaguguucacagucggaacucaagguuauauuuucccacagaauccaugugacugaugcugacuugcuaaugagauucaauaauucugggaguauuuaguagcaucuugguuaaacaucugcauuauauagggcuucaaggaugacugcaagacccuaaccaucauugauaauauuguuucuauggggaaauguguuugaaguuucguaugacagcccuccaaagaaauucuagcaaacaaacccauuugaaaguugggcacugccugucuuccagcacuggcuguucucccucucacucucuccaaccuaaccuguuuucuuauauccaacuucuggguggcccaugaaggcuauugcuccucugaggccacagcagguguaagcaaugaggagaaggugaaagugcuggggaacagucccagcaguagagggaggggggcaggagagggaagaagacagaguuggaaucaucaccagacagcaaacauugggugagccuacacuguugauaggacacaggcuuuuuacgggaaucuaaaaugcaacuuuuaggcaggaugaaugucauuaagaaagcacaggccguggcaugaggcaggccugggguacauucuguuucuuauuaaaaaugaugaucuuaagcuaaauacuuaaccucuuagaagguucagcuuucucaucuccaaaauugagacgacauuacuucucaggguguuugugaagaucaaauuguguaaaugugauuauuacaaucuucagcagcauuuaccagacaguugaauguugcuuuuucuuacuuuccuccuuugagagaugcaaggugguacaggggaaagauuagaguaaaaauaaguggauuugaauucuagucucagaaucaaccccauggaggggcugggcacacucuccgaguuacugucuucugugcuguccucugaggacuuuugcugguagcaaugaaucaacauaugugugaauggcugcaaugagcuggucaauaauuaucauucacuguuuugacaaauguguguugagugccuacuauaggccuggcgccaccuuagaaacaugaauccagccaaggagaaauaaucaaggcaggccuguucuguuagauggagugaucagggaaguuucucugaauagaugagauuugagcagagaccucagugaggagugggagugagccacagaaauauccagaaagaggcaucuaagaagagggaauaaucagaguaaaggccaggcugucagggucugcuagggccugauugagacauugcaaggagguccucaggggucuucaugacuagugcagggagcaaaaaguaugggcacggggcauggacaggggagggcaggaccaauggucuguugauaugugcucugcaaaccgcuggaaggacuuucuccuaacuucuagguacucaagcccuuggaaggucuugagugaaggaguuuacauugugaaaagccacauggagaagaaacugguagcccaagggugaaggcaggcaagcacugggaggugacuguggucagcagagcagaccugagaugaggcucugggccuggggugguggcaguuggggacacagauguauucugacucaauguguguguggugaaguagagccaauugggugugcucaugacguggugguggaaugugggagaaagaaggaagcagagaaagaaucaaauuguuguccuuuuuacucuaaagaugaugcuaguuacugcaaugggagaauacugggggagaaaugguuuuugaaggaaagucagcauucuauuuuggauugaguuugccacaugcuacaugaauugaguuuucuauaugcuuuuggugucuguguggaaaugugaugcaggcccuggagcuagggaagggugcaggccuagagagagacacuggggaggccuccacagagugauaugggugaaagcacagggccggacauggucaucuguggaguaggaauggaggaaagggaggagaacccaccaugacacugcacagcauuuuagaggucugaggaaggagaugccacuccaugcauggaaagugacaugacaaaagaggcccuuucuuacaaaaauucuuuguguccuuuuuuuuguuacugcuuuuguuuuucuuuuuauuaaaauaauuaugaaauauuucaaaacaugcugaauacugaaaauaaaauaacugacacuccacccagauuucuaacuugugaacauuuugccacuuugcaauugauggcaggcaaaucccaaaauuggggcucagcccaggaggguucuugacuuugcucaggaaagaacugaagaaugagcuggcaaugaaagaaggcaaguuuauuagagcaacaguguauggcaaaguggcugcuccccagagcaggguucuuucauaggcagagcugcccagagcagcagcagcagcagcagcagcaguccuuauggauugcuggcuagcuauauuuauacacagucuucguuauaugcuauuuaaggaguagguuauucagaauuuucuagaaaaggggugggggaguuccuggaaccauauaaggaaacuucuggguuguugccauggcauuuguaaacugucauggcacuggugggacugucuuuaugcuuauuagcagugagggcaagagggucacuuuuguugcuauccgcugguuucggcuggugucuuugcugcauccugcuuugauuaguagggucaugaucggugcucggaauauaaguccugcuggucucccaucucacuauauucauuucaaagacaacuaaagucaugcccccaaaccgcuaaagucaugcgguccaaaccgcuucuuuuuccuucuccaggaggcuuuagugagcaaugagaacagugccuggugugugggaaguucucagugaaggucaggaacuguggcgccgcuggagguggucuuuaccauuaugaugauauugaggucagucuuucccaugcauuuucuagcucuuacugcauaaagguaucuccauaacaaugcacaguacaauuuuguauguuuuucaaauuaauguaaaggguaaauuuuuguauucuuuuguaucuuuuuuuaauucaacauuguguucuugaguuuuuuuuuuuuuuuuuuacuguagcaagucagacacaguuuagaauauaacgguaauaggaggaggaaacaaaaucuuugcagagagagcaacaugaaggugcuuuggaagccccaauaugccagcucuccagaugccuuuucuccauccccugcucuuuuucauuccuuaacugcaaagcuauuggagagaaaggagaggaucauucaauguugugacaauauuaaaugcuagcuucacagacccucaggacaagaaagaccaugugcccuauagcccccaacuggaacaugcuugcuccccuucccugauaggagcccucccauggguuggggauagagguucugacccuggggcagccccacuugacucaugaacugaugagcauauucacuucugcaagcaaaguaaaacugaacauaggagcuaugcuugcugguuacuguuacuguucuauccucucauguuccaauuaccucuuuuauuuuuauuucagagccuucaccgaacaggcaauguuuggauuuaagcucuaaagaaaugcagguagacagagggcacauuccacauaagaauccaggcauggauuuugaaguagcagcuugaccacugucauugcagagcuuaggcuagaggacaggauugguuuucaagacucugauacccaucugugacagacgggcaacuucugugcuggcaguaucaaagcaaccccaccaagagacacgcuggccucucuguggcuggaugguuuccauggugugggggaguuuuguuauuguugcuuuugugaaguuuaaguucuuguggcuuuuucccuuugccagccuugcuuaagaccaaaggagagcuggaugguaaagacuccccugagaaugggcaaacgaguugcagaucaaguauccuggccacaaagacaaggagaggaucaggcccgaagcuccaggccuggacacgccccggaggagaaaugagccucgugguuaguaacagagccaagcuuccuuugucuaaccuuucgcuggaauuaagagcuuuucacauuucaguugacuugagaacagacagggagccccaaaucagaagcagauuggagcuggugagcagggaaaugacacuucagccucuaaaacgcagcagcucuguuugucccuugcuucugaccccagcagccucuuugcucccucucuucucccuacuccauagaaggcuucucuccccuucucugagacucugcucuuaaagcagcaggugcccgauuccaguggacucucuccacuguggaauguaucagagcaggggcagcaccuuccccagcaacacacccuaucaccuuugauccuuugccauuugcacuauggguuuucauuugacccagcggucugaguuugcuccaguauuuguguuuuuguguuuuucuuuccuaugcuucucuuucccucccugccccuccuuuaugcuguggccuaaguacacugagcuucuuccuuuguuuguaugacagaggauuccuuuucauucgucaggauguuaacuaugcauaccacaaaaaaauugaagcacaaagcaccaaaagaaaaugaagauagaaaaaucuaguggauuuggaggugaaagaaagcaaacuugcacccaguuuuccaaaccuuaaacagauuuauuuucuuggccaaguucucaguuacucaccacagugcucuuauuuugugccucaagggauaggcaaaaagcucuuuccugcucagcacuuacuuaauacuuaaaagaaauacccuuucuuucucuagcaaugcacuuguuuuaacaguggaaauacagggcacccaagaggucaaacucucuagaaaccuggggccaauacuuacaaagacugaugcccugugggugacucaaaaacaacccuggagucagaauuaacaacauucuccacauacuguuuaaauggucacucuuugucaggagcuggguacuuucugaaaacuguuucuguagccugcggcaagccugggcuuugguugugaggcccagaggcuuagcuucuucacccaaugcuugcaaaauguuuauagcaaacucaaauaccuuccacagauuacucccauucuccaucugauuucuucaccagcuguucucugccugauucauugugcagauuucuuucuaguguuguggauauucccuaguuaccuaccauaaugcuuggucuuacagguguauagcauguuugcaaugcuuguucauaugcucccagggaaaaaaaaaucauaaaauauaaucuuauguguaauuuuccugaauacuaaaugcuuugcccuaaacuugaagauaguguaucaguugaaggaugccaggaauuacuucaccucauguauauguaccuguuacagauuauauucauuuucaaauuaauuucaaagccagcuguuauuuuugcuaaaagucauccuugaugguaugcuuuagcaacuaccauuuaaaacuuagagacaacuagccgugcaauaugaggauuuaaaaaugcaguacuugaguuguuuauuguggguuuuacauuuugagcuuaagucuccuucuuaauauauugucuguaggcacuuaauaaaauagaucuuuaaggaaaaauaaaauagcuuuacuauauauguaacaugcauauuauaaauaaaguguuggaacuuuuuggugauuuaguuuuccuuuauaaauacgggcauguagguauuccuacagcaauacuaacauugaaauacgaguuucuaugccaugggggcuuuuuuagaaguucuagcugggaauguaagcaucuauguaaccuuaauccaaaaagagggcuccucuaacugggaagguugccuguuuggaccgucggauggcugaggagaaugggucgccugccuggccuacuuaaugagcugaguccacucugacagucagagcugggagaaagcaucuucuucaaagugagcacacaucagauucccccuccauuuuuucccuuacucauguggagggguuaggacuuugaagaagucagguuuuucuuuuucuuuauuucauggaauacguuaaaaaacagaaagaaguaucgaaccuaugccauguacuucaaaugaagcuuccacagaaaauuugaaacccuaaaaagguucuucauuuaagccacagagagacacaaauauucaaacucuccuaaguaaugcuaaaaacaaggcagcuaguguuccaacaagggcaagaccucacuuguuuguuauguaggacccuuaucacugucaauuuuagcuugaugaaaguacuaccaugugucacagacaaugccauauguucaucaaaaaaacaauuuauuuucccucugggcauacagaaagacuacauuucccaguuucuuuuguaauuaauuuugggcuaugagucugaauucuauccaaagaaaugcaagugaagguuguguauacuacuuccaggucugccagaauccucccaccuccugcacaaccuuuaacaucucucuucccccuuuacacuaacccugggaccacauagugaagaugguggcauugcaagacaggaagagcuuggguuccugaaagacugcaugaagcaguccccuuuuuuccaugacuaucuuggucugugacaggcugcaaugguuugaagguuuguccccucuaaaacucaugcugauauuuaauugccauugugaugguauugggagguggggccuuaagagggcucugcccucauaaguggacuaaugccaguuaucaggaguaggcucacucacuucugcucucucuuuuucuugcucucacuuuuguuggcccuucugcuuuccacuaugggaugacagaacaagaugucccacauaagauacuggcaccuugaucugggacuucccagccacuaggcuacaaaccaauaaaacucuguuuauuauauauuacucauucuuugguguucuguuauagcagcacgaaacaaagacacaggaagaagcaagaaaucauuacuugagauuuagcgguuguuguagcagcuugcaucauguaccccaacgaaugcauaccauauuauaucauguauguucucuguguugcuuauuuccuaccucaaccauagccaucauuuuaagacaacaauuaagaaaacuccuuuaucugcacaagugcucugucucucuaccugauguuuuuccccuccucccucuguucuugccuccccaacacacacacauacccauuuaccuuuauauaauccuuuuccagcuuugaaauggcaagcgggccuaacaggaaagauucuuuggauuuuaagaacauccaucagcuuuacugcuauagacaaauuucuuuccuuaaugaguuuuguuuuuuguuuuuuuuuuugagcaaggaauaugguuugcccucugaagucauagagugaauuaauuugaggauuuagcuagcuacuugucaugaaccugaaugagagaaagggagaaauuuuucauccacugcucacugucauuuucucuccuucugacuuccacuuucccuaaauuguugcauuaaucuagccacuccccagucaucaccacuacagugugaguucuuuuaggaaaagaaccagugcuuauucauuuuuuaucccugauacuuggaaccuacuagguaaucauuaaacguuagcuauuauuuagcaauaagauuaaaaccaggagacaaauggccuuaacucugucaagaggcaguaggacaauuucgugggacuaggagugaugccaggcccuucucuuaagucugucgcuauuugaaucccagauuugaaacuuaagggaaauaaaaauuuaaguauacaugccaccucuuaauuucuuuucaaauacuuuuuuucauuuuuccuucucaaaaaaggagaaggaagaggaaaggaaagaaaaguaaaugaaaauuuuuaagagguccauuuucuacucaaggaugaaaaugcacaucccaaaugcuuauaaaaucuaccccuuccaacuacuguuuauaauaagcaguguaguagaguuagguggaggaaaaggaaaacuaugguaguagaaauugcauuugcugaguacacaugugaaacgacaguuaccaccuucauucuccaguguuagguuuugaaaucgccauaguaggaaauccacuuuaaauauguuugccuuuggaucuauuuuuaaaugaaaaaaaaaaucucagugcuucugguguauguauguaguagagacagucuuaaccuaagauguuaagagaggagucuggggacaauuuaucagugucagaacccaacaccagaagagaaaucggagugaccuuuuaacaaagguucuauuuuuaagaucuaauugacuuagccacugggauuaucucugguauuaaaaguuauuuaaggggguugcuccaugaaauucaaauaggauguaugguaaaucauuacuaagaugauacaauggcagcaaauauuuacugaugcaaaacaaaaagcucuagaauaccugaggguuugccugcuaugguagugaguuaugagggacaucacaaucaaggcaugcuuguggcuuuuuccuugcagcaaaauaaauaagcagcccuuggagucaucagaacacccaggaggacuuauaaccuaucccuucggaauauuuagucaaacucuugcuuacugauucuucacuuucucugaauuucccacucuuuccuuuccuaacuuguguuucuagcugccaacucccauaguauuuccccauuuccuuaacacucucauuuucaauuuauuccuuccccauaucucuuucaggauuucuccacguucaacaauaugagauuaccucagauaggagaguccacugaugaguguacgugugaguaagguaaaaaacagugcucuacaagguucccuugcagcuccucagggaccucagucuaucaaucauuuucuccccuacauaugcaauuucucuuuccuauuacaauauaacuagggugaaguaucuucuaucuuaaaagacaauguuacccagacuuuaaaccaacaaaagaucaaaagggacaaagaaggccauuacauaaugguaaagggaucaacucaacaagaagagcuaacuauacuaaauauauaugcacccaacacaggagcacccagauucauaaagcaaguccuuagagaccuacaaagagacuuagacucccacacaauaauaaugggagacuuuaacaccccacugucaauauuagacagaucaacgagacagaaaguuaacaaggauauccaggaauugaacucagcucugcaccaagcggaccuaauagacaucuauagaacucuccacccaaaaucaacagaauauacauucuucucagcaccacaucgcacuuauuacaaaauugaccacauagucggaaguaaaguacuccucagcaaauguaaaagaacagaaauuauaacaaacugucucucagaccacagugcaaucaaacuauaacucaggaugaagaaacucacucaaaaccgcucaacuacauggaaacugaacaaucugcuccugaaugacuacuggguacauaaugaaaugaaggcagaaauaaagauguucuuugaaaccaaugagaacacagacacaacauaccagaaucucugggacacauuuaaagcaguguguagaggaaauuuauagcacuaaaugcccacaagacaaagcaggaaagaucuaaaauugacacccuaacaucacaucaaaagaacuagagaagcaagagcaaacacauucaaaagcuagcagaaggcaagaaguaacuaaaaucagagcagaacugaaggagauagagacacaaaaaacccuucaaaaaaaucaaugaauccaggagcugguuuuuugaaaagaucaacaaaauugacagaccgcuagcaagacuaguaaagaagaaaagagagaagaaucaaacagaugcaauaaaaaaugauacaggggauaucaccaccgaucccacagaaauacaaauuaccaucaaagaauauuauaaacaccucuacgcaaauaaacuagaaaaucuagaagaaauggauaacuuccuggacacauacacccucccaagacuaaaccaggaagaaguugaaucccugaauagacaaauaacaggcucuaaaauugaggcaauaauuaauagccuaccaaccaaaaaaaguccaggaccagacggauucacagcugaauucuaccagagguacgaggaggagcugguaccauuccuucugaaacuauuccaaucaauagaaaaagagggaauccucccuacucauuuuaugaggccagcaucauccugauaccaaagccuggcagagacacaacaaaaaaaagauaauuuuagacaaacaucccugaugaacauugaugcaaaaauccucaauaaaauacuggcaaacugaauccagcagcacaucaaaaagcuuaucaaccaugaucaagugggcuucaucccugggaugcaagguuggcucaacauaugcaaaucaauaaacauaauccagcauauaaacagaaccaaagacaaaaaccacaugauuaucucaauagaugcagaaaaggccuuugacaaaaaucaacagcccuucaugcuaaaaacucucaauaaacuagguauugaugggacguaucucaaaauaauaagagcuauuuaugacaaacccagagccaaugucauacugaaugggcgaaaaugggaagcauucccuuugaaaacuggcacaagacagggaugcccuuucucaccacuccuauucaacauaguguuggaaguucuggccgggugucaggcaggagaaagaaauaaaggguauucaguuaggaaaagaggaagucaaauugucccuguuugcagaugacaugauuguauauuuagaaaaccccauugucucagcccaaaaucuccuuaagcugauaagcaacuucagcaaagucucaggauacaaaaucaaucugcaaaaaucacaagcauuccuauacaccaauaacagacaaacagagagccaaaucaugagugaacucccauucacuauugcuucaaagagaauaaaguaccuaggaauccaacuuacaagggaugugaaggaccucuucaaggagaacuacaaaccacugcucaacgaaauaaaagaggacacaaacaaauggaagaacauuccaugcucauggauaggaagaaucaauaucgugaaaauggccauacugcccaagguaauuuauagauucagugccauccccaucaagcuaccaaugacuuucuucacagaauuggaaaaaaacuacuuuaaaguucauauggaaccaaaaaagagcccacauugucaagacgauccuaagccaaaagaacaaagcuggaggcaucacgcuaccugacuucaaacuauacuacaaggcuacaguaaccaaaacagcaugguacugguaccaaaacagagauauaggccaauggaacagaacagaacagagcccucagaaauaauaccacacaucuacaacaauauguucuuugacaaaccugacaaaaacaagaaaugggggaaggauucccuauuuaauaaauggugcugggaaaacuggcuagccauauguagaaagcugaaacuggaucccuuccuuacaccuuauacaaaaauuaauucaagauagauuaaagacuuaaauguuagaccuaaaaccauaaaaacccuagaagaaaaccuaggcaauaccauucaggcuguaggcaugugcaaggacuucaugacuaaaacaccaaaagcaacagcaacaaaagccaaaauugacaaaugggaucuaauuaaacuaaagagcuucugcacagcaaaagaaacuaccaucagagugaacaggcaaccuaaagaaugggagaaaauuuuuacaaucuacccaucugacaaagggcuaauauccagaaucuacaaagaacuuaaacaaauuuacaagaaaaaaucaaacaaccccaucaaaaagugggugaaggauaugaacagacacuucucaaaagaagacauuuaugcagccaaaagacacaugaaaaaaugcucagcaucacuggccaucagagaaaugcaaaucaaaaccacaaugagauaccaucucacaccagucagaauggcgaucauuaaaaaaucaggaaacaacaggugcuggagaggauguggagaaauaggaacaccuuuacacuguuggugggacuguaaacugguucaaccauuguggaagacaguguggugauuucucaaggaucuagaacuagaaauaccauuugacccagccaaaccauuacuggguauauacccaaaggauuauaaaucaugccgcuauaaagacacaugcacauauauguuuauugcggcacuauucacaauagcaaagaccaauggaaccaacccaaauguccaucaacaauagacuggauuaagaaaauguggcacauauacaccauggaauacuaugcagccauaaaaaaggauuucauguccuuuguagggacauggacgaagcuggaaaccaucauucucggcaaacuauugcaaggacagaaaaccaaacaccacauguucucgcucauaggugggaagugaacaaugagaacacuuggacacaggauggggaacaucacacacuggggccuguugugggguggggggaggggggagggauagcauuaggagauauaccuaauguaaaugaugaguuaauaggugcggcacaccaacauggcacauguaugcauauguaacaaaccugcauguugugcacauguacccuagaacuuaaaguauauuuaaaaaaagauaauguuaccuuggaaacaaauuuccuauuugcugugguacuguaucucuuacccuccuuccugcaaagauucaucuauauucccugccuccacuggcucacuucccauuuacucuucaauccauuaagaucccaauuccaguguuuaucuccaguguugaagauacucucacagguacacauauacuucuacauuauuaauguccaugauacaggcuuuaaaacaugaagcaucuuccacagccacugccccuuuuugaggaaagcaguccuuaccaguucuuuaugaagaaguagucauguucuggguaccauauuacuuuguuucccuggcuacagcugacugggccccaggggggugaggcaacacaagugauucaauagcuaccaaucuauggacuaugaggucccucucuaauuagaaacauggggauaaacuaggccaaucagauucucucuugaaagagcuggucuagagaugguaauauggaagugcauccaagguguguagaccuccauagaguaacaaagaauuagguugauggcagacugccuguagacagaccagggugcaccuccuauugaggauguaacaaaauauccugauugcaagaguugcguuauauccugagcuccuaguuucugaacugcaguccauucuuuaugaggccuggcauuccuugguuccuauucucucagaaccugguugcaugaguagaguuucugucuacuucauuuucugaguguauaguuauaauuaagcaaauugauuucuugauuucuuugucaagagaaccugaaugaacauuucuuagcuagcaaaaagcccaccuagcaaccauuauauuacauguguaauauuugacucugcagaucacuaccuccuucuagaaguucucucucucggcuuauguaauacaacucuuccagauguuccuucuacuaaugaagcuauuucuucucuuccuuccugccaucucuauuuacucauuucaacccuuaaaaaugguucuuccucaggcaucccauugccuacuuuuguucagucuauauacucugucugaagaacuauauauauguucauggcuccaaccuccauuugaauccuaaugacaguuguuugcuggauaccuuaucuucuuuuggauguaccacaagauccucaaauuccacaugguuaagacaaaaauuaucauuauuuugcauaaaauagcucuuugucuuguauuccuuccaucaauaguugauauaauuguuauccuaaaucccccagugaguaaccugauucuaaguccagucacuauucuuacuuacuccaugauuuaacuucucuccaguaugucuucacuacucccggccucuaucacugcuuauucaggguuuuuucccccgacuccccagugacuuggguguuccugcucuguguucucauaguaucuacugaauaccucuuucaaagaaccaccuauuguacugagaggguugacuuucucaucugucuccuccaaaaauguaaguuccccauggguagaggaccaguuuuaaaaucuaacacaaugcuggccaacuauagguacuuacuacuauuuuuugaguggauaaauaaguaaaaagucagaauugccuguaccauacacaaaaaugaagaagauccagccuucaaauuauaucaaaaccaacucaacuaagaaugggaaaugugauauuggacaauagaaguguugguuuguaaucuccaaacuucuccccaaagacacuacagacaaacacuuuuaacuuaacucuauucucaucaucuucuuauacucuuucuuuacaauaucuucaugcaacucuuauuugacuucucacuuguauacuccuaccaaaccaagcccugguucuggaguuaauggccauagcuaauauugcagaguugugauaacuucaccuauuaagauucuguucauuccauauguacagaggccuuuacuuugcauacaaugggcuugcuaaagaauaaccuuaguaaccucuuuagccuuaaaauugaccaacuaccccaccccaucccagauggcagaugagaggcuuuuaguuugccucagccacuuggagauagcaagacaaugcauaaagaucaacucugugaacuuucauucaagaaggaaaauaggaaucuacuggaaucuugaagaacaaaccagaauccagggagaaaaaugccagcaaacagccccugugauggugucuggcugauaaaaaugaguaaaaccccaguacaugagagaggcagaaagccucccucugaagcucaccuuuccaguggagauccaagcaacccaggccaagggggaacacuuuguuucucccaagcccuagugcuaacuuggggaaaggauugaagauguuguaagagaaagacaccacaaaaagcucaauacauuuuccccaggcuagccuaggaccaagagcagggugccauuuuuaaugcaggaccacauaaagucaagaauucuuugcugaccuagcagcaugacuguguugguauuuuagucuuggaccagaggcuggagcaagacuugcuuuggagugggguaggggccuccacagcccgaacuguagaaggcaccucagcaguaggugcuagaauugugcuccucacauugcaagccucaggcagaaggagagcugcuacagcuguaguuucucuugggcagugagacuugccagcuuggcaacguggaacuggucugcaucuaccauugcugggugccccagcuugcuccucugagauugugguauagcagggcacucuccauuucacccucaggcagaaauccaggcauuuggagcacccacuugugugguuucgcagccugagccgcaccacccuuccugggcauagacugugguacagcagagcucuugccgcuccauucacaggcagacauccaggcauucagagcacccacucaccuguaucagcagccugacaugccccauccuuccugugcagagauccugguacagggaggcccucucugcuucacaugcaggcaaaucuccaggcauuuagagcacccacucauuuaguucagcagccugaacuaccccacccuuccuaugcagagauccagaugcagagaggcccuuucugcuccaugcccaggcaaaucuccaggaugcuugccuuagucauccugccccucccgagcagagaacuugguguagggagaccuucucugcuccacacucaggcacaucuccaggcauucacaucacccacccaacuggaacaguggccuaaacuuccccagccuucuugugcagagauccugggugcaaggggcccucucuaccccauaaccaggcagaccuccaggcaucuggaguaccuauucuccuaggaguuuaaacuaccccucagucccacauagagaacuuaggccaaggagguuucccagcaccaugccuaggcacaccucugggugcucaguggcugcucacuguacccacccucagcacuggugcucaugccugccaucggggccccuggaggaggaccugccuggucuagcccugcccaucuuggcccccaaccccacagggcugaggagggagcucagaccacugugcacuccacagcuuagcccauugccugaggaaacagagggcuucuccuaguaagcaaggaucaaguauauauccaaccauguuggcugcagcuggcucuuaccuauaagcgccaucuacaagcuuguaggucaaacugcagagcccaauauaaaaccugccaucagaagugcauggggcuauagaaacaaagccaaaagacccuacccagcauucucuacagucacaucaccuaggaagggagggaaugguaaagaaaaaaauaauauuauaggcaagaaagaaaaagaaaaauccuacccacacuaaaauaauuauaaaaauuagaagugcuagcaucuccagaugagaaggaaccacugcaagaauucuggcaccaugaggaauuugaauguggugacagcaucaaaggaucacacuagcucuccagcaauggcuccugacaaaaauggaaacucagaaaugacagauuugaaagcauggauugcaaggaagcucaaccuccaagacaagguugaacaucaacacaaagaaacuucuaaagcaaucaaggaaaugaaggaagagguaaacaucuuuaaaaaaaaaaucaaacagagcuucuggaauuuaaaaccucacuuaaggaauuucaaaauauaauugacagauuuaucaauagacuggaccaagcagaagaaagaauuucagagccugaagacuggucuuucaaacuaaccaagucagacaaaaauaaagaaaaaaauaauuuuaaaaaaugaauaaaguugucaagaaauauuauguaaagugaccaaacuuacaaaugauuggcauuccugagacagaaggagaaagaguaaauaaccuggaaaaaaaaauuugaggaaaucauucaagaaaauuucccuuaucuugcuagagagguacacauccagauacaagaaauccagagaacaccugccagauacuacacaaaaugacugucaucaaggcauacagucacuaggcuauccgaggucgacacuaaagaaaaaaaucuuaaaagcagcucacuuacaaagggagccccaucaggcuaacaguggacuucucagcauaaaccuuauaagccaggagagauugggggccuauuuucagcauuccuaaggaaaaagaguuccaaccaagaauuucauaucccaccaaacuaagcuucauaagugaagggaaaaucuuuuccgggcaagcaaaugcuaaaggaauucauuaccacuagacaagucuuacaacaguuccuuaagagaguucuaaacauagaaaugaaauaaugaaaacugcuaccacaaaaacacacuuaaggacauagcccacagacccuaucaagcagccucacaauagaaacuacaaagcaaccaacuaacaauuucucgauaggaucaaaaccucaucuaucaauauuaaccuagaauguaaauggucuaaaugcuucacuuaaaaggcaaagaguggcaaguuggauaaauaauacccauccaucuauugucaucaagagaccuaucuuacacauaaggcuaucuuacacacccauaggcucaaaguaaagacuuggaggaagauccaccacacaaaagaaggcaaaaagagagcacaaguugcuucccaucuuuauaucagccacaauauacuuuaaaccaacaacaguaaaaaaggacaaagacaggcauuacauaaugauaaagaguucaauucuauaagaagauuuaacuauccuaaauauauauacauccaacauuggaccacccagauucauaaaacaaguacuuuuagacauaugaaaagauguacacagccacacaauaauaguggggaacuucaacaucucacugacagcauuagacaaauaaucaaggcagaaaacuaacaaagaaauucuggacuuaaauuucacaguugaccaaauggacccaaaagacaucuacaaaauaugccauucauuaccacagaugauacauucuucucaucuauacauggaacuuaccuaagauugaccacaugcuuguccauaaagcaagucucaauaauuuuuuuaaaaaaucaaaaucaaaccaaccacacucugggacuacaguggaacaaaauuagaaaucaguacgaagaagaccucucaaagccaagggcaaaugaaagaacuugccccugaaugacuucugauuaaauaaugaaauuaaggcagaaaucaaaaaauuauuugaaauaaaugaaaauagagucacaaccuaccaaaaucucugggacauagcaaaaacagugauaagaggaaaguuuauagcacuaaaaaccuaccucaaaagguuagaaagaucucaaauuaacaaucuaaucucacaccuagaggaaguagagaaacaggaacaaacuaaccccuaaucuagcagauaaauaacuaaaaucaaggcagaaccaaacaaaacugagaccccaaaauccaaacaaagaauuaguaaaauccaaaguugguucuuugaaaggauaaacaagaucaauagacugcuagcuagauuaacaaaaaaaagagagaagauccaaauauguacaaucagaaaugacaaaggugacauuacaacugaucucauagaaauacaaaagauccucagagacuaauaugcacaccucuaugcgugcaaacuagaaaaaaacuagagaaaaugaauaaauuucuggaaacacauaaccucccaaaaucgaaucaggaagaaguugaaaccccaaacagaccaauaucaaguucugaaauugaagcaauaauuuuaaaaacuaccaaucagaaaaagccccagaccagaugaauucacagcugaauucuaccugauguacaaagaagagaugguaccaauucuacugaaacuauccccaaaaaaucaaugacuguggucccauucuaugaaucuaacaucacccugauaccaaaaccuggcaaagacacaacaaaaaaugaaaccacaggccaaucaucaacaaaauauuagcaaaccagauccaacaggacacaaaaaaaguuaauuugccaugaucaaguaggcuucauugcuaggaugcaagguugacucaacauacacaaaucaauaaaugugcuucaccacauaaacauaaaaucaaaaccaaaaaccauaugaucuccauggaaaaagcuuucaaaaaaauccaacaucccuucaugacaaaaacccucaagaaacuuggcauugaaugaacauacaucaaaauagucauagccaucuaugacaaaccuacagccaaccucauacugaacaagcaaaaacuggaagcauuccccuugagaacuggaacaagaccaggaugucuacucucaccacuccuauucaauacaguacuggaaaugcuagccagagcaaucaggcaagacaaagaaauaaaauauauccaaauaagaaaaguagucaaacuaucucucuuuaaggacgguaugauucuacaccuagaaaacccaaaaaacuccaucacaggcuccugaaacugauaaacaaguucacuaaaguuucaggacacaaaauccauguacaaaaaucagcagcauuucuauacaccaauaauguucaagcugagagccaaaucaagaaaauaaucccauuuacaaaaaccaccacacacaaacaaaauacccaagacuacaucuaaccaaggacaaaaaagagcucuacaaggagaacuauaaaacagugcuaaaagaaaucauacauuaaacaaacaaaugaaaaaauauuccauacucacggauucuaagaaucaguaucauuuaaaugaccauagagcccaaagcaaucuacauauucaaugccauuccuaucaaacuaucaacaucauuuuucacagaagagaagaaaaaacuauucuaaaguucauauggaaccaaaaaagagcccaaauagccaaaguaagccaagcaaaaggaacaaagcuggaggcaucacauuacgugacuucaaacuauauuauaaggcuacaguaacuaacaaaaacagcaugguauugguacaaaaacagaaauauagaacaauggaacagaauacagaaugcagaaauaaaguugcauaccuauagccaucugaucuuccucaaaguuaacuaaaauaagcaauggggaaaggauucccuauucaauaccuggaacugggauaguugucuagccauauacagaagaaugaaacuggaacccuaccuuucacgauauacaaaaauuaacucaagauggauuaaagauuuaaauguaagaccucauacuauaacaauccuacaagaaaacaggaaaugccauucuagacauugcauuugggaaauaauuuauaauuaaguccucaaaagcaauugcaacacaaacaaaaauugaaaagugggaccuaauuaaaauaagagcuucugcacagcaaaagaaauaucaacagaauaaacagaugaccuauggaaugggagaaaauauucacauacuacacauccaacaaaggucuaauaccuagaaucuauaaggaacauaaacauuugagcaaguaaaauacaaauaaccccauuaaaaaaugggcaaaagacagcaacagacacaucuguugaagacauacaaguggccaacaaacauaugaaaaaaugcuccacaucacuaaucaucagugaaaggcaaaucaaaaccacaauaagauacuaucucacaccagucagaauggcuauuauuagagucaaaaaacaacagaugcuggugaggcugcagagaagaaggaacauuuauacauuguuggcgggaauguaaauuaguucagccacuguggaaagcaguuuggagauuucucaaagaccuaaaaccagagcuuccauuugaccuagcaaucccauuacuagguauguauccaaaagaaaauaaaucuacuugggaggcugaggugggaggauugcuugggccugggagguugaggcuacagugagccaugauugugccauugcacuccagccugggugaccaaaccagacccugucucaaagaaaaaaaaaaagaaaagaaaucauucuaccaaaaagacagaugugcucauauguucaucacagaacuauucacaauagcaaagucauggaaucaaccuaggugccuaugaaagauggauuagaucaagaaaaugugguauauauacaccauggaauacuacauagacauaaaaaagaaugaaaucauguacuucgcagcaacauggaugcagcuggaggcuauuaugcuaggcaaauuaaugucaggacaaaaaaaccaaauaccauauguucucacauauaaauaagugggagccaaacauuggguacucaggaacauauggcaacaauagaaacugggggcuacuagagaggguagggagguugacaagggcuaaaaaacuaacuguugaguacuaugcucaguaccugggugaugggaucauucauaucccaaaccucagcaucacacaacauacccagauaacaaaccugcacauauacccccugaaucuaaaauacaaguugaaaaaaacauugaccuacuaucuucaugagcuguugacucaaaaggaaggauuugugaaagagcuugaggaaccaaaaccuaguaugguacuucuuuaaccauacuagguuaaaguaaccucuuuaaguuaauucuagauucugcugaugguagaaaaauaaguuacuuuuuuggguguguguacgugugugugaaagagagagcacacacacacacuuguauauauagaauaaaauauaguguuaccauugcccauuuugauuugcccacacuaauagaaaauaucauuggcauauaugguaaaaaauaacagauauuguaaaguuuacuucagaaggaaaaaucauagauggaaacaccaaauaugagcuaaagcugacuuagcacuuacaauauucagguaguauuaagcacuucacaagcauuauuuuauguaaucuucauaacaaccuuguuuauaagagaaaacugaggcucugcugcauuugagucaucuuugcaaguaacagaacuaggguugaaaaucagguauguuaauuugcaaaauccauguuuuugauagcaauaacccacuaccugccaaauuuaucuuguccaguccaacuucccaaguuuccagaugagaaaaccgaggcccaacaguauaaaauguuugaccaagguccacaguucguuagguacagagucaggaacaggcaugaauugucuggggguauuuugccuugucauugaaauauaugacuccuggagacaaauauuaacaaguaaaaggacaagucugggaagugagcaagauaaagucauaugcuuuccucuucugccuaacucuggaauggccugaauucuguuucucauaaaaucuccaagagacaacaauuacauucaugggaaggaaaacaaucugucugaaugacacacacaagagauauuuuuguauaaaagcagggaauggggcaacuuauugccucuuaaagaucaaaaggcccuuggaggaauguucuuccuuaccaccaaccaguuccuuaucccaacccacagcugacugacuuccuuauuagguuuggacaauggaaggacaaagaauuuaaaccaacugggcuuugugaaacugcagaagaguaagucuuggggaauggaggcaauguccccagggagcauggcuggaaguggaccaguugggcugugagggaggagacagugcccaagcauaugcauaccucuuugcagauaauccagccuuggcugaauacaguucuugcaaauccaagcauucuucauuuuccagaaggcuauucccauuuauucagacuguccaggcuuccgcugcugggaugucugauggccucugucuucaggugaggccaggggccagucucaagggcagaguccuucagguuauccuugaaauuaagcagcuuucucaggccugaaauccacugccaagucucuuggcugcccucaccugcucuugugcuuuccuuauugacaaacaggguaaggguggaguagccaugugugauaguuaauacugagugucaacuugauuggauuuaaugaugcaaaguauuguuccucggugugucuauguggguguugccaaaggagauuaauauuugagucaguagauugggaaaggcagacccacccacccucaaucuggguagacacacaagugaggccagaauaaaagcaggcaaaagaacauaaaaaggcuagacugguuuagucuucuggccugcaucuuucuccugugcuggaugcuucuugcucucaaacauuggacucccaaguucuucagcuuugggaaucggacuggcuuccuugccccucaguuugcagaugaccuauugugggaccucaccuugugaucgugugagucaguacaccuuauaaacuccccuuuauauauacaucuauccucuuaguucugugccucuagagaacccuaacuaauacaccaugggacauguccaguguagucagauagcccuuccaucauaacucagacuguccccaaguuagccucaucaugguucugagccucuguuuguccagcuucuuccuguagaugcuuugucaagggccaucauccuuuccuaaaucucagcuuuuugacugcuuuauuuguacagccuaggccuuggacacuuucaccuguuucugcggagaaacugaguaauugccuccagacucuacgggcuguggaaaccucuucucuacccaucccccuucucacuugucuuaguuuauugcaguuuuauccugugagaccucacgucaaaauuucuuguucuagaacauuaagcaugaugguuugacaggugcaacaaaccaccauggcaccuguuuaccuaugugacaaaccuguacauccugcacaugcaccccagaacucaaaauaaaaauaaaaaaauaauauaaauguucucugaaaaauguaaauaacauuggacuauaacuucuuaaugauucucucuaacuucugggacuguaaagaaauaaagcuacugcaacugcuacugcuacuacuaccacuacuaacacuacugcuauuaccaauuagcaucuuuugaguaaugaacauuguguuaagugcuuuacaugcaugaacucacucaaucguacaacuuuagaagguggguagugaauauccuccuuauuuuaauuuuauaggucuggaaacuuauauauaaagaggugaagccagagacugccaagugcugugcacauggagcugcauggagaccaugcugcauccucugagauacagauucccucauccucagggcagcuggguagagccuaguugaaacccccagccucuaccucagcugaccccauuuguucauuccaagguuccgaucccagcauuuguaccaauauuauugauuuuaauauauucuauuacauugaauauauugugaaggaccaguuaaagaaauuugguugaaugguagagucacucugaauacaaauauguggaaauuagaaccugauuucagaaucaauauucaugaugauguuuuuccuaacaaaacaaauaaaagggggaagagaggaaaaccaaggauggguauaagacaacaagaucauucagaaccaccauaauuccucuaauguuauaaaauguagggaaaaaaguaaaaaagauaagcaaagagaggaaaaucagguugacagggaagauuacaaugauaaugguugagaagggaacacuaaggcugacuugaaucucaauguucaaaaaauuccuaaugaggauuucacucuaaacauucauauaaauaugaacaagauaaaagagauuuaaagcaggguggauuuaggguugaacaucuguaagucuugcccaugucaggguuugauaaaacccugaaaugggcuacucaggaccaccugggaaccuuugagaacaaaacuccaccaacguuacagaguuuagacaucgccccuuuuuaaaagcaggaacuuauuacagaauaucuagcccuagguacuugaaaauuugaaauuucuauaagcuuuuaguuuucuuuuacaaacagaguaacucaucaaacuuaauggguuucacuuggaugcuugauauuugaggauuugaaaguauaucuagccaucccuucucagcagauuccccagguggcuuucuaagaugcacgcacuauuucaaggagccuuuccuccucacuguuucauauuccuggcauuugucucuaacgugccauagauggcauuccacauacacacaaacaaaugauuuuaguccaagucagagcaacacccuauucuaugcuacuaccauaguuuagccccaaauguuuuacaggaacgugaaauuuguaggaaaccuugagggagguucaaggcaaucucaaugucuuugucauacccucauggccacaauugccugccucuuugcaagaaagcaagucaucuugcuuuaagaugcugucagcuugggaaugucagcuuggguugaaguggagagccccaaacauauuuuggcuuccagacagugaaacagcaaaugcuuugcuuucuaacuaaacucaaggaacaaaauuuuucaugucugcuuugaugaaugaauuauucagaagcagugaguucaucucuuuuagaguccagaaauuggugaagacccauauaaauaguaaacaaugcuuuuuuggccucaugccccaacccaaacauuauguuacauguagccagccagauucugcccuuggacacacccagaugaguccuacuauagucaaugaaaauugcaugagaacuuccggggggcagaauuuggcuggggugguaugcauaaggcucaacuucugagggugggcagaauuuggcuggggugcuaugcaugaggcucaaagggcauggcguacacccagaacccagcucaaugguuggauucaugugccuuuagagacaaugccuuuucucuuugcaguauauuaacuagcaugccuuaagcaggcaugggaaaauugauccaggaaccagugcauccuaaacuguccaacugucugaagucauacuguaaaaagacagagucauuuuacuucugaagugugcuuucguguagacauaucgaagcugaccacaaauaaaagugaaaacagauccagaauaaguacaguaaacaagggaaaacgcaggauccuggaguucagaugaaacaaggcugguuuugcacguucccauauucugccuuucccucccccaaauguuuucuuaacauuucuagcauuauuaacagaauuaaaucauuccacaugggugcagaaucagcccuaugaugccaacauuuuuucuuuuucugcacucaagauaguagaaacacagugcauuuuaauggcaauggcacugaucuuuuauuauggcaauuuaggucucaguguuuaccuaugggaagcuaggcaucauucagaacauauaaaugacaaggacuuugucucugaguaccuuaucauguuuuccaacagaugcuuucacuuaagauauuccaucuuuaaaucauccacaaaugcugauugcauugaaaguauuuuuuuuuuuuucugagaaggguaauggcccggacagugauauucuuacaaagacaaagguagaugaccucacuacuucaacucguagauauaaacagaugcaggaugagguguggcauccccaugauuccuccucuuaaagcucauauuaucuaagagauauuuauuaagcaucuauuaugugucagguacuuuucuaaauguuagagagacugcaguuaauuaacaagucccaaguaucugcccucaugaaacuugcauucuauuauaccugaagagggaaaaauaaaagaacuagaucaaugcuguauugcucaaguaagcauugauuuaaaucuuuuguaagcauuucuucucuuaguuuuaugcccaauguuauauuuaugcacaagauguacaaaguugccaaaacuuguaagcuuuuggaaggcaagaagaaguuuacacacacuuuucuuuguaaggcgauaaucaauuccuagaugauuaugauuagccccuuugcgacaaagaauaauaaaauacuaucaucucaaaaccccaugcuccauuuagucaacauacuaccauagacugcuuuucauguggaaagugaauuuucuuggguuuugaaguugaucuuucuagaugaccagguagaaaaguaauauaaaucguuuccuccucuuccaaaaguaauguaaucaacacacuguccuucccacuguagauuguaacaauauauuuuacagucuucaauaaaacuagcauuugaaaagacaaaugcaacagcacaaaugugcuggaaaugguuuucaauuaucugauuuuaagaacccuaaagaaauuuaaauuuaaauuuugauuucuuuagguuacucaaagaauuugugucuaguugcaugaucauauuacuuuugugaucauuuuaaucacugguaaaauuaauaguaguugugucuauuauuuuuaauuguucaaaaauauuauuuuggguggugaacucuuguuuccuucaugaggauggaauaagaagaugcaauaugagggaagagagggcauaggaaauacaauaauucccuuaagacuuaaggaauuugaggcacauggcagguaauuaaaggcacaggcuuuggagucagaaaaaaaugggcuugaaucuggcucugccacaugcucacaugauuuuaggcacaguugaaccucucuuaagaucaagcugcccaucgguaagauaagaauauuuuacuuagagagcuguugugagcauaaaauggaacaauauccaugaaggacuuggugcaaggccugacauaucugugaggauauaucacagaucuauaaaagguugcuacuuuucauuauuacuauuacuaguauuuuauuuuuuauuacauugcauaagacaagagggaaaauuuaguuuuaucuugcccaugagcaacaagaaaaggaaugaaguauaauagaaaagccuugucuuccaaauaaaauuauaguugauaaaaauugguguuauuauuuuccauuaucaucaacuacuuguaauagguaaacagcuuuuuuuaagaaacaugcaaccgauugcuaauuuccuauaaucugggaaucaaaaauaguguguuuaaauggauagccacaguaaucuuuaaauuucauuugaauuucuuauuguagcuagugauagaaaauggaacaaacggugaauaaaaucuggucauuuauauauuuucuggugcaggcuacacucuauagaauaagaaacacuggggauggucauacuucaaauccccacuuuuagcuccaaauaugcaaguaauugacuuuucaauauugugauuucuaccagcuaucuauagaaagcacaugugacucaagggauggaaggaaggcucagugguuuuuagguuggguaaguuaaaugagccugcugaagugaacagcuucuguaaaccaccauuugaacagaauuggguuguccucuuccaucuccauuggguuucaguucuaccgcucacuacuugcaaucacuaggcuuugcuggggaagguguuuacauggcuuuaaagaugacgaaguggaaaccguaaggcuuuuauaaucuuaacagaaaaucuuauccauaaugaacaagacaggggaucagaauacacaguaaauguagacccagaaauagaaagaggcuuugggggguuuuaaaugccauuuuggugaugaucacauuguaaagucagcaagaagacaacuugaaggugacuguguguguguguguggugugugcgugugugugugugucugagugcugacaccacuggggaaauuuccacagggggauagagaaaaaaaauucauuuaucccuucccuaugacauuguuucuugcagcauaucuucaauucauuugucuggucuaguuuguaaugacuaagugaugaggcuuccauaauguucccagugagacuauuccauagucuacaaaauuucacuguuuccucuuauuuagcuuaauuguacuccauuucaagucacuguuuccauucaggaaaaaaaagagucuguucuuuaaauucacaucauaggaaauaguuuuuguuuuauuuucauuuuuaaugacuggguuucucgguggccaugcuuaacauuugcuagaagagaauguaagacuagaugcagauuuuuuuucuuguucacaagagcuauauaagcuggucuauggggucagauccucauccaaugcacuuaugagggcauuuuuagauguauacauccugacccagagggccugagcacaugugauaaaccauauauuacauaaacaucuuuaggguuguuauuuuccccccauuccuauguccaagguauauaaacaugaguucaaaguucagcccaauuugaaaugucccacaagauuucaauucugaacuuauuucuagaaaauacacacugccaucugcuguaccucccagaagaaggggcauccuccugugaaaaaacucagucuucauuuuuaugguuaagauucuagacuggcucacuauugccagcuucucccaaccccuucuucauuguccacgugaaaucuaccccucaagaugaaguacuuugaauacuguaaaguuucuuaccaagauacauccacaacauccugguuggcaagauguuaggguaacauuuucucucuauccuuuuugaaauaacccaagccuaugagaauaaggcacaaaucucuaacaagauacaucucagaccucccccccacaagauguucugaauuguuugggauugcuuacauaaauguagcuuccaaaucccacuaagacuugcugaaucagacauuucugcaggugggggaaaaguuaaauaccccggauggcucauguguaugcugaaguagaaguaacgaaggucuucaucccuuucacucuauucuggagaguguucacacacuuucacuaucaagccacuugcuggcaggaaucuucuucuuucuaccuauuaguacucacaauggaacuauugcugugugaacaaguugaucugguucacauuaaacacauugucugccaccauugcaugacugcuugagaucagugucaggaugugccugggaacacaaacccuggcaguggcacuuccuggcucugugaccucagccaaggcacuuaacugugucugucucaaguuuccauaucucugaaaugguggcaauaauagcuacuaccucauagggcuaggauacaaauugugugauuaaguuaauuaauaugugugaaguguuuaaaauaaugccugaaguauaguagacacuuuaugauuauuauuauuaaaucaagaacacuauagcuucaacuucuguacacaauauagaacccucuguaugcccuguacaccuuccuggguagaaaacaaagaaauaaagcaacuugagucuacaguaagugguagcagaaaauaacaggaaucuucuuucugugguauccagaaugaauaacaaagaccuuaaaaggccaugagggccaggcgcgguggcucacgccuguaaucccaguacuuuggaaggcugaggcagguggaucaccugaggucaggaguuugagaccagccuggccaacacgguaaaaccccgucucuacuaaaaauacaaaaaaaauuagccaggcgugauggcgggugccuguaaucccagcuacucgagaggcugaggcaggagaaucacuugaacccaggaggcggagguugcagugagcugagauugcgccauugcacuccagccugggugacaagacugaaacuuugucucaaaaaaaaaaaaaaaaaaagucaugaauacgacaccccaacccugcccccacuccugccucagaccacagccacucucaaacaaggccacacccaucauccaaggcauggagcaucagcaagaugaccucagagugcugcagcccccaacguuauguaaagggaaaagaguaaguccugcuuuuuggcuggguaggcaagaauaaaucuuuacacauugaugacaaugacuuuugaaugucagaaaugaaaacaaacgucugcuuggagcacagugucauuuuccaggcccacagugaguggagccacuguagcacuugugcuaagaaaggauuuuccuuucuacaaaaagauucugaauaaaaucucgcaguuuuucaggaaucuagcccuuccaaaauuuguuaccuggcuucaucugggacagguuugcuauacuaaugacuuuuucacuguagguauucagcauucugcuuguuucacaaacuuucuucucugcauuuuccaggcuagugccaaggauaaggcuuuuccaugccagguuuucugaaaaauuaauaaaucuacugccauaauccuaacugccucaacugacaaauuuaauaaacgacaggaugcaaaguccagguugccuaaugggauugcuuucuuuucuuuuucuuuuuuccucuuugacaaguuuuacagaguagcacuucugagacauggucaagugcuauaaaccuaauccuuagcaauuuccuccuuagcucaaauaaccuaaauauuuuaugaaugguaaagcguuucacaugucaaccaucaaccaacccuugucuauccuuuuacucugccucacuuuucuucugguuguuuggguaacuuucuuuaggaaaacauacuuuugucaaucuuucacacaaaaugcacaggauauuuuuauaugcuuucuuuagaagcuuucaaaaggaguaugcuauucccaagcaaaauaugcuacauaaaagcuaucaaaauuuuccaauaaccuugauguuaguuaaaaaagaaaaagaaaaggaaagaaaggucugguuugaguguuuggguaaauaagagcaccaauucuagggaacugaagagccucuuggugcacaaaaaggaggcaucagcuccaggaucucuucauggaagagguagcucuggugcccuuuuggggcauucuugaucugacuggaaauguguuugggcccagaguccauccugucucauaagaguuccuuugcucaagggggcugugggcuaccauccagcggagcaaagugauucacccguuaagucuacagcaaucuuccuaaagcaaaaauccgcagggauuugcaauggcacugggguaguuuagcuuguaaugagaaaugacaaguuauaaugcauuugugaaccuaacacuuugggguacaguccaucuaacaaaaaugauuuuuaaaaauauaaaaaagaaagaaaaaaauguacuguuaagugcuaagucagcuauuauuuuaguaacuuagguauuuugcuuccuuggauccuuaugauaguucugagagguaaauauaucacuuccugcacuuacaguagggauuauaaugcucagaaaguuaaguagcaugcgcaaagcauaaaggaaacagacaaaauaaguggugguauuugaaccuuauggcaauaaagaaaacaagauuuauuuaaacccaagacaccaauguguuuugaaauauuacucacuagcaccaggauguauuauuggcuaacaugaguuaaaauucacuuauuuugacuaaagcuucugacuuuuucuuucacugcugucaacaaaaaaauucuuauaaaaauuucucaauauauugauguucuaccucagcaauucaaaacacauauuuucccuuuuaaaaaguauucuauacaguucucaaaggaucucacaaaaaggagugcaccauagaaccaacagaauuuguaucaaaagagccagaguuauucuuuugucauaauuaaucaaucuuagcacaaucauuuauucaacaaguacauuuauugaaccaaguuuuugcaaggggcugaggauaaaagauaaauaugagccuacagucaagaagaucacugggaagggaaaagacauaauaucaaauuauuacuauaauacaguuugauaaaugcuaggaaauauacauaugcagaagaguaaggaagguuggagaaucuguguguggcugaggauucaaucagaguugcugaaucuugaauucuaaaggagggauuggagaucuccuggugggcauuauauaaggggaugcacguuugaagcacaggaaauaacauaggucaugcaacuguauaaagcugccaauauaucugaguggcuaaucaauacagcaugaguuggccauagggcaagacaagcagggaaggugaaugggguccugggaaagaaguccuuguauuccagucuauagaauuugaauucugaccuauaagcaaagggcauacagaguauguaccuaauacugugaagcacuaaauccuaaaaguaccuacaacuugcaucagcucuucuaagcaaagcagcccaccauuuauuugggggggguucaugcuuuucaucaggugacccuguaaguuugauaacaauaaagugggcugagaaucaguggcugguccaaagguuggacaugagaaagcccauuggccuguaagguacaugggauagaaaauguaggaauggagaggaagggauaaaucuaagagauauaugacauggaacugagaguucuguugaccagauggauguggggaauaagagcagaagcagccuaggaugacugucauuuccaacuacggggacugaugugaccgauaauccagacagugaauacaagagaaggaacggacuucagaauauagaaaaacaguguaguuucggaggucuugaguuaagaaauugaaaugacuuauagagugaucauauuuuccaaauuaaaaaaaacaguuuuauaaggacaucccaauaugcaguuuuugugagaaaauaaggcagguauuucaacuuggagcuauugcuauaacuaugaaaugcuggguacuuuaaguuaaauacugauauugaaggucaguuuaauauuccuggaaagaaacucugcaucaucucaucuuuucucuauccuauugaacaaauaaaaauuuaucccaagacuuacugagccccucaguaugcaaugcaugcuguagacugaggaaacuuggucaugagcacuagaaaauccuuugucagaauugcccugacccacuuuauacuuuguucauaucccagucaacccuggccuuacccugccuugcucuuuggacauucagcuuucagauugugccuggcuucuccucagggaccugccuugucucaucucgggcugaccuucacuaacugucauccacucuuuugggcacugccucagggccaaauuucuggagcuaucaguuggcuccaaacuuucacuggucuagauuaacagcauaaagucaaauauuuucuccacaauaucuaagacauaaaaagaugcaaccuguagccacaccugauauagaaggcaauauagcuuagugaugaagaccagggugugauaucagaaaaaguuggguucaaaucucuggucugcuauguaugauauaaaaucucaaacaaguuacuuuaguucucuaagccucacuuauaaaacaggaaugaugauggaagcugccuccuagcuuucggggucccgaugugauaauacaaucauauauggccagugcuuaaccugguaccuaacagagaauaaaagcucaauauuccuccuucuucucuuccuucuccuuuuccucaucaucguuaauucucuaauaugcuucuuguuaguaugaagucuaccaaguugccauccucccaagcaucuucucagaaauguccaggucacucucuagcuuucagucagaaguucucuccuuaccauaucaguguucucaucccuuuugaauaccuuugcauauaaucacuuguuuucauggauugaugacuaaaugggacaccaacacucagauccccaacccaauacucaucucguuuccuacuucuagaugcuauuagacaucuuuuacugacuauuuagugggcucaacacacugugugguuuuuuuuuccugaaagguauuuguuguacacagacaaacagagaaaaggaaauucugaaaggaaagaacuuugaggucuaggauccaaauggguuauuauaaacaauugagaguguuuaaaaagaaagaaagaaaaagaaacauuuaaaagaggucaagaaaguaccuccacagaacccuuuucauuuauauuauuucaaguaaaagaucacauauucaaaauguuccuauuaauuuucauaugcugcauucucucagcauguuugaccauuucacuucauaauguuuuggcacaaaaauguaaauaacauugcacuucaccuucccaaguucccauaguccauuuuccguaauagggggaagaauacacuaacagucagaaacuaugcacauucugcugguugaaauccaaaaguaguuuuuuuuuaguuuucugucacaacuuguucuugggaguuugcuccuugccaacuagaaacuaugauuuucaagagaauacaagcccucuuaacaaucagacaggauuauuauaucucugugucgaugcggauugaagccccacaaaagcaucaauuuuugacuucaguucaagauauggaaccccugcuuuucuacuuaagauuuuauuuuucuugaagaacuucuagaaguucuuuuucgugaagauuuuauuuugaagaacuucuggaacauuccuauuuagcuguuuuuaggagagaagccaacuuucauuuauuuggugaaagaagaugggcuuuaaacacauuucaauuugaggaugggguccuacuggaaauaguuuugcaaguagcuauuuacaaaauguuucauugugguaauaaagagaaagggagugugaggagaacuggguucuugucuuggcucucugcuaacuaccucuauggcuuuggggaagucauuuuaugucuaagccagcuuucuuucagugcaccucugggaagacagggguauaaguuauccuacucucaaagaugcuugagcccacugguguauuauacaucaugcaauuuauucaagaaggaaaucuguaaguuugcuuaacccaguguuucccaagcuuauuuuaucauguaacuacaauuaguguucuauggaacauuuacuuugggaagcgcuauuccagguguauauuuacucaccagaaauauauuagcauauugaaaaagauguuuauuaaaauucccauaaauucuuguauuaucugauugcucaaaaugucuguggcaugaaauaaaaauugaagaaugaaguuguuuuucuuaaguuuuaaaaagaacacaaaacuucuauuuauggaaauaugguggacuaacuauccugaaaauaucuucucgacgcaggacauuaaaaaaauguuaggauacagauuuaaaauauuuuaaauguauggcuacauugauaaaaaauaaauaaaaaaucuuuccggaaggcaggaggagaguggggaggauccaguacacacagcaaaugguaaaauauuaaaugaguuccgaagcuagcagcuuccccaggagcaucugucaauacuuucugacuuauagcugugguauaaaugaccacaggaagaacagaaaaccuagcuuaaggguuguacaagaugaggagucauauuugugaucccuccauaaagcugggcuucccaaaauguuauaaccucagugaaauggugaacuauaaauaaaauacaucucauggaacaauggcaagaacccugacacagcauggagggugauaaaauaauuuccuugagaauuuaaccauaagucagaccucauacagauuuauagccugaauucacaccacuuugagaguaacaaacauuauaaggugaaauguagcuaaaaaaguuguuaguuugaaguaucauaggugucuaucagaaacaaacacgaaggaauaugcucuugagcuggaccucaaagaauucugacagguaaaguuccaaggaacaaaacauauuaaacauaccuggaaauaaauuaccaugaacuagagaaagcaaaacaaauaaaugaaagaaucagauccuuaaauaguucagcuauuagauuaucaaauccaacauauaaacguuuuaaaaaggaagaaucaaaguuauaagaaaaaaaaucacucuauaagaauaacaugugaaaacauaacuuuuagaaauaaguaaaucauuaauuuaaaaacucaauggaaagguuaaacaguauagauacagaugaagagacauuuagcaaacugcaaacagcagauuagauacagcugaagagacauuaagugaacugccaaacagaacugaagauaauaaucagacuuuaaaaauaugaaaguuaaaagacaugaaagauaaaguaaucaggguuaacauacagcuaacuggaguucuagaaggagaaaagagacuaucaacauuugaagaaucuuccagaacuguugacagacaugacuucucagauucaaaaagucaaacaaauuauaaacaagauaauaaaaauauaaauaaauccauaccuagauacaucuuacauuuuuaguaaaacugcaaaaacaaaacuaacaaguaaacaauaacagcaaaaaauaaaguccaagacaaaaauuuaaauuuaaaagucgaaggagaaagagaaaagauuaccuaugaaguaacaacaguuagaacgcugacuucucaacagcaagaaugcagccacaagcauagauguuacuagucaaugcaaauagucuuguauaauauccuauaacuaugaaaacaaaguaaaaaguaucagaagcugaccaaugaaaugacuaacuagagaaagaaugucauuaaaauuaagaguaaucacucaucauuucugaagugcagucucuagggacaggaguagugagcuuggcugacuauuuaccacaucaaagacgcaaauuccaauuuuuguugccaccccuccauuccaccucuucugcaaacccagagaugugugccuuagaaaaucaaccagaaauuccaucuagaaucaaauuuauaaguauaaugcaggcaaauccaguaacucaugaaaucuaauuauggcuuuaaaaaucagcuaaaacaaggcauauaugaauguuguauggagauagucuaagacaaugcguccuaaauauggauaugcauuauaacuaucuaaggaguguucuuaaauaauacaaauagcuggacugugccugaucuacugaauagaaucuccagcacaggaauuuguacuuuuaaaagccuuccuaagcaauucugauacauggaaaaauuugggaacaacuugucuaagggaacuccaacuagaucuaaccuugugcuccaaaggcccaguaccugauucuuauuaguucucagucccaugaaagcugacauacucaaaaucaaacugucuuuaaaacuaauauggguaccaaauuaccacuccuuaauguauacugcugucacaugaagcacugcuauucguguucccaugauuggcccauucuccaccuacagucaacuacauggaagcauuauuucaagaagagacuuuguuugcaucagaaaccauugucacauggaccagauagcuacaaguccagcauauuucaucagcauauuuucuucauggcaauuaauagguugcuggucaauacggaaucagaacaagggaguaagacaaauuggagaucccuugaaauauccuucucaucaaaggaaugguuuuuaacacaagaccagaaaauguagggcuuuugacaauaacccugugagcaauguaaucuaccuuaguauccucuugauaauggaacucugaguaugugaacaagauugggaugugcacagaugacacugcucccauaaaacuccuuaauuaacugcuguacccugcuuuagaguaauacuuuaaaaauauacacucuuccuuccuguucuacgacacaggcgcauguucauauuucuaaaguccagaaaugucuuaagacagauauauagauuuaaugugacuuuguuuuuauuaaaucaaugcagcuuugcccaucagagcauaaaaaauuguuucuuccauuauaacugcaaauuuucuguggcaaugcuucauauuuacucaucuuaggccaacccuugacaaaucauguguggccagaggacaggauuaaaaucuuugcucaugaucuccaugugugugggaggaguuaccccagaagaaagaggggcuagaccaacaaaagagggaaauaagauguguaaggccaaauaguuacuguauuuguaguauuccugauuaauuccaaagggagcuugugucacaaacaaaccaauucacuuaaguaacauguuuauaagagcaugguggcagcccaggugacagcuucaguacauuuuuggauuauuucagcauuaggaauuuggacugaaauaagacaaaauguaaauccagaaauaauauuuccauuuuuuacuccuuccugucuuuauuaaacauuggccuugauuguaaaaacuugccagcauucgacuauuuguuuacaugggaccuauggaaacagcauuaagcaauuuguuccucaaacuaucaucuuucuccuaaaauucuaaugugcaacauuaugguuauucuuucaagcauaccaaguugaccuaccuagguaggccuacagaccucugaucacuagaauacauccacagccucugaauuugcugaauaaaauaucuagcguuagcaguuccuggaaaugcaaaucaguuagaaaacuguuuaggcaaaauggcaacugaaaacauucuuugauuuuaaauuauuuuguugcuaucuuuaagcaaaauuauuugucucuauugcauugacaguaaagugcuacaaagauagagcuuacaguaaugguucuuuugaaaucugaugaagacaaauuuguguuacacuaauuuuaauccaguggucuuaccuuuaucauaacaacuuuaauuuuuuuaauugaaaagggaaaagauacauucuauauaaacagcaaaugcuuuuucugucaaagauaauuaaugucugauagagaaaguuuaugaauuuuguaaaagaaaggauuuuuguuugcuuuuugaacaaucuuugcaaaauagcucucucugcucuuuugacaucuguuagcuccuccauauccuggaaguauuaaguguauuaugcuuucagcugcaagcaaauaagaacaaaucucagccaccucauuuuauaaauccuuucaaucauuugcaauauucuuugacuagaaaauaaaaggacugcaucaaaaaaguaauuuaguucauugcuuacagaugaaaaugcacaccagucagugucuacagacagaguacauuacuaaaacagauaacacucaaauauuuauucaucacuugauaaguuagaguuucuaaaaaaucauugauaauaucucaaauguuuauuuucucaagguuaucagaauuuaaauuaugugcauauaaguaaacgugaugacuuaauauuuuugaauuauuucaagauugcauuuaaauuaauguuauuugucugcaaauaauuucuguaguccauacuguuauuuauucuauuaucuguuggaauuauuucuuugaucugaguuaggccuucagagaaaagacauuuuaagaaaucucuccucuguaucauggcucacuaaguacuuagaauacacucaaagcuauauuaguccauucucacacugcuaugaagaaauauucgagacuggauaauuuaauaaggaaaaaaguuuaauugagucacaguuccacagggcuugggaggccucaggaaacuuauaaucaugguggaaggggaggcaaacauguccuucuucacauggcagcagcaaggagaagugccaagcaaaaugggggaaagccccuuauaaaacauucagaucuggugagaacucacucacuagcaugagaacaguagcuggggguaacugcccccaugauucaauuaccucccacugggucccucccaugacacauggggauuaugggaacuacgauuaauucaaaaugagauuuggguggugacacagccaaaccaugucgaaguuuuacuauagcagugaaaauucauugauauagaaguuauuauuuguaacacauucuuaucuuccucaaauauuuacagauaaaucuuauuuugaaggcagcuuuugggagcagccacuucuggccuugaauuuuuccuggggcauuacuagucaaggugacuuggacacauuuucuaacccuucugagacucccccuccacacauuuguuaacuguggaaaucacacucaccacacuggguuuuaggaggaguagaugaacugaugaguacaaaaccuaaugcagugcuuuauaaacaaaagguacacaauaaaagucuacauuuuaauccaaagaauaauauaaaguaggcuuuuacucuuuaggacucuauuucuugggacucuuucauaaggcuuuuucucucucaagagcccaauucaaaauccagcuaucccacuccuggguauuuauccaaaagaacugaaaucaagaucucaaaagacauuagcaccccaauguucacugcagcacuaugcauaguaacuaagaaacaaacuaaauguccaucaauagaugaauggauuaauaaaauguauauauauacaauggaauauuauugaccuuaaaaaagaagaucauccuaccaccugcuauuuugauggaugggaaaauccaugccauauggaugaaccuuuaagacauuauacuaagugaaauaaaccagucacaggauaaagacugccugauuucacuuacuugagguaucuaaaauagucaaauucacaaaaucagagaguagaauggugguuaccaggaccuaagagggaggggaaugggaaauugcuaaucaaugggcauaaaguuucaauuaugcaagaugaaaacuuucuagagaugugcuguacaauauuguucuauaguuaacaacacuguauuguacacucaaaaauuugagagaguaaaucucacgguaaguuuucuuacaauaaaauaaaauaauauuuuaaaaagaaaagcuuaacucaagaaagccuagauggaucccagugaugaaacccugucaccaggauccuaauacugaucaugucuuaaucccugucuccuggcucacuugaagcaggcuccaacugaguagugacaaauauggcagccaggagccugugcucuaauaauucuaauaauuauucaaacaauuaagugacaaacugaaaaagagauaguuuucccaauaauuacagauagaauccaagaauuuucucagguucuguacuugguuaugugccuagcccuggacugaaaucucuggccaggaggaugcaguagauucauguucccucauugcccaggggaggcuguagcaggccugccugaacuaccaugaguaggagccaugacagggucauguggaaagcaaaggcugagacagacuugagaaaugucuggacuuugaaugcagaccccaacccacacagagauccaucugaagagaacaguaacuuuauaggcucaacauguucuaucauuuccauuugguccuucuuuauaucuucuguuucuuugcagagauguucuauuuucuuguuaaaacuuccuacuuucaccuuuguuuuauguguguuuguaacugcuuuugaagcuuuuauaugauggcugccuuaaaacuuuugccagguaauuccaacgucugugcagucucaucguuggcauccauugauuuuucuucucccauucaagcugagauuuucuugauaugaagacugauuuacaauuguauuccuggacauuuugaguguuaugagacucuggaucucauuucaaucuucugucuuaggaagccuccuuugacugcaugcuggccggggaagggguccugccucauuauggcaagcugcagguggaagcccaggcccccauuuggucuccacgauacccugcugcagggagaaugacuccucaauacuacugggcagggguggaacuucagggucccccugggucucuggugguaucagggaccuucuugcuccuacccauguggcuuucauggauacagcaggugguagagugaguggcuuauuacugcuggaagauaacaguccaggcuuuccccccuggucucuaacaccucgccagcaaagaaggggaggcaugccuguuaccaccgggcaggggaggaagugccuucuccccaugggucuccacuuuugaugcggggaugggcaucauuacugccagguagaaauguaagucuaggcuucucacuuugccuuugcugacagagguggaaguggggcugccguuuuuuccugugguguuucgcugaaguagggagguuacugucuaaacauuuucuaucaugcuagccugccccuuuccugguucuuuggcuagagagagcaggcauuucuugaggcuuuuuuuuuuuuuuuuuuuuuuuuggucaaaauuucuugguuaccaguuucuccaauaccuagcuugaaauaugugaagcaaaaagaaaucccagaaucuuauugucauguugauccuuagaucccaagauugcuagcugguuugccuucuucucucugucuuucagucuuacauuuaucuccaauaucuacuuuucucugagaucuuacuuuucucugagaucuuggccccguaugugcugacugcuuuagugucccuaaacccagacccagcaaaacuggugcgagcuuuaagucaccauuucuaguaggucauuaugccaugcaccaagaaaugguaaugcccuaaguggggaaagggaaagaguacacagggcuuacuccaguguguuuccuuucucuuugggauauuggcccugaagcccuaacucucuugguaguucccuggugauuuugaacagauuuuugaaaacuuauccaguuuuucuuacuguucuugcuggaaggguuagugugcuacacacuggucuuccuuauuagaaaugaaacucucagauaccuccuuaggauuugcauacaauauuguaaugaguauucucuucuuucauaucugcccaggacuuacaauucaauucugacagcggaggacugagagucaagacagacugcauuugugaaauuuaauaaaaaaugaaucaaacaguuacuaaugaauuauuagguuuucaccagggcugacauuaagcuugugugcacugguacauucauacugguuacuagaaucugaucuauuucauauuaauuaguaaauaacugcuguccugcaucaccugugcccaaccugggaucccacugaaauucuuaaugauccaaaacauuaaggcuaacauccaauucaggaugcagccucagugacaccauuccaaugccuuggccagcauucuauuauuuuuagugaggggguaugauuaauuauuguuaagguauuuugaauaccacuccuguauacuuaccucagcuuauuuuucauuuauuauagaaauuaauuauauuuuucuuuugguuauuuccacagauaauugcuuaauauggcucuuuacuuauuugaauaauaugcaacaauauaauuagcaagaauauuuggaauuguuucugcuaguauacucuuaauuucuagucuaugaauaucuuuaccuuacauuaacauaauugaaaucagacgugauugccaguuuaagccaaguaacuaugguaaggccaaccucacagcugagauaauaaguaauuccugcuaaucaaaaguguuacauugaauauaugacacuaagaacauccuauaacacauaucuuauagaaaauaaucauuagcaaauuaguuaauaguggccaucuuuauucuucuauuaccuccugaaucauuuucuucuugaacugugguaucaguguauuauugucaacacacaugucugaaaucacaugcucaaauuucacaagccuucaucaauauuucacuuacugaccuuccauaggaaaauucaaggcauuaugcaagcuaagauuuuuucuuucuuuuuucuucuuauuuggagauagggucuccuucgguugcccaggcuaaagugcaguagggcaaucauagcucacugcagccucagaucccuggguucaagcaauccucuugccucaauuuccugaguagcuaggacugcagacaugcauuaccaccauuagcuaauuaaauuuuuuuaauuuuuuguuuuuuggugacaaggucucacuauguugcccaggccggucuugaacugcugggcucaagugauccucccacuuuggccuuccaaagugcugggauuacuggcaugagcuaccauaccuggcccuaaaauuauuuuucuuuaaaccaaauuacaaacagaagccuaauuaaugauuuugccuaacuguaauacaauuacaauucuucacucugaaacccaccaauuuagaagacguuacaugcauuuuuaauaccuuaacuuuuuuucuuuauaugcuacauugaaaauggaaccgugugcugcaaauaaaagaaaaagugaggggcaagaaugccagcugugagccacugugucuugcugcccccagaaaaagaaaaaaagugcuuauagauguauucauauuucccagugauugugaccaagccuuggaggcuuuuccuggauuuaccuuaaguuccugguuacuaauuugguccaaagaaaucucaguaucaaauguauauucuccaacugggacuaagcuuucuuuaauaggacuuaugagacauacuuaucuuugaagauacuguaaggauuggguuacugaagauugaagacugccacauugucaaaauucauuucacugagcuaauuuaguccugguucuuaucccuaaagaauuaguaaaaauacagguaggcagaucaaguuaaucugagaacagccaucuucuccaggaguggacaauccagcagcuuauucucccuaauagaagaaaugguugauaucaauuuuguguauauuuuaguucacuuugagaggcuguuuuccauugauaaaauuuauguaaaaaauaugaaauguauaaauguuggagggguguaggaggaaaugaugguggcagaggcugugacaguuuugaccagguaaaacuaauuauugaggcugcuuagaagguaaauguccccuguuaagggguuucuucaaaaauauuuuugcuguccaucaaucacaugcaauauuaccuugcauuuaugggcuccuauagauguauauguuaauauuauuaauuuuagacaguagguaaaguuacuuauuucaaagugaagacauggaggcucagcaugauuaagugacuugcuacagguaacaaaacauauaaggacaaaagccagauucuaacucuuuuuucaguauuuucucuuuccaguucuccacaguccagguaguaccugcaucuacuauaaucaugucaaauaacauuguuuaacauucucaaggcauguuaggguaauuuuagcauuguacucauaauuguuuuaaaguuauuucuuccccagucccugcuacagaaaagaugaacuggaaagggaucaaaggggacauucucuggcccaagaggucaagaauucacguguauuaauaagggauuagucuacaagaguuccucccacaagcaagugaaucuuguccucagaauguaauccccaguaauguagaauuuuaaugacauaaaaguguuauaagucgcuaugagaagaggaugaccuaagcaguucugaguggcccacuugaaacacugaaaaugagaaugaaaagaaugcucuuagcccuguccaagggagacaccaucauaggagcuuaaguuucagaugaugguaaaagcaugcugaugaguggagcagaacuaaguuuugauaaagcuaugaaacucacuaccccccucacccccaacacacacaaaauggcuccaaacuaccugcuucucuuugcccggaagccaugcucaaaccaucuugugaguaucaaugugccacauuagguucuuauuagacuaagaagaagguaucauacucagggauagaaagauccagaagcuguaaaaggcuuuucccacaaaaaaauuuaauagacacuaauucaacaagucauugauugagucauacacucaugcuuagcacugaagaaucuaaaacgauagagacaccauugcccuuuaggaggucagaauucaacuggcuuuuugguggaaauuaguuuuaugagugaguuuaaaggguauaaaccaauuucaucaaggccugcaaccuacuggaagaguaaaccauaguaauucaggucaaauaacugagaaaugucuaaaguuuagaggugagagcaaaucuaggaucccagccuaaauaaaccugcaugaaguuguaagcacaucuacauugguauauuuucucaguaauucaucaaugggacuauuuccuuuaauaaaacauagggaucuucagaauuuagcauuggacagcaaaucaguggcuggaaaggggugucugaaccaacccccaggcucuccaccugggcuuugccuaccuuuucuccuucuccccucugacucuuaugccuucuccuaugggccucuuaccaccacuccuguuagugcucuaaaauaaacaggaacaaaauuaguuuuacuuacuaguuuucacugaaauugguugaaauuuucagaagaguuucuuuuacuaaauauuaaacgagaagaaaggggaaauaagaaugcuacacacauaggcaaacuaauuaagaaaagcuuucugaaccugucaaagcuaauuugccuguggggccugaaaguucuaucucauucuguaugggauucccugaaaaagagguggccacccucuuagcuccaggacuaaaauaauuccuagcaagaggaaaaaguaguccgauguccucuggcuggcaucaguuggucuccacagggcaagcuuuuggauguugugacuacccagaguuugucacaaaagacacagauuucauugcauuucuggcugggugucucacuagugacugacgccaggaagaagcuuaugcucaaagucagccuuccucagcacagaaucaacuggacuccaauaucuucccaccagaucauaaccacagcacccacagaggcagagucacauggaaguuuuucucucacugauuccuguuaacugaguccccuuugcagaaaaucauaguaacucagcaaaaggcaaccagugguuagaaggguuaaaggaccauagugaaaagacuagaaucuauuggacaucccaagauacugugauaaaaagaaucuuuauuauugaaauaaccguguuccucuaugcuccuguuguuuuugcuaaacaagaacauggcaauuucaugagaugaauucaaucugaaaagggguaaggaaugaggcccccucacaccacuuuuuuccuugacaggaaugaugauauuucucuggauucucuucuuauauuuaggcucaaaggaugcaugugccaauccaaauacacacugcccucaaacuuuucuagacaaucuuuuggucugaaauuaaagacaaugaccuaaaugugguggcuagaagaacacuucugcuaaugauuuugcuagaaaucuuugguuaggagcagaagaaacuuacaaagcccaaguguuuacuaccuaacuuccuuauaucauagaccacagauaauaauagaaauaaacuggcauaugcuuguauuaauagacagccugaaaaaugaaaagaaagaaaacaaaggaaaacuacuuauauuggcaagaaaaguguaagaaaacuagaaaauuaaaaguuacugaugaauuggucagggauauuuaaaaauuauagauauguaauaauaaggauaaacagaauauaauaugacuguguagagcauuaauucucaaugcacauggagaaagaaauaauggacacaauuuuaacuuucuagaaaaaaauauucuauuaauuaacacuguacuucuaaaaaaauaagguuuaugccuuuuucccauuguucuguaaagauuuuucuaaauauuagaguaaauuauuuaaaaauacugaagaaagauaaagaagauaaaaauuacccaaaaucuuaucacccaggaagaauuauuauuaauauaauaacauugucuuuaacauuuugauauauuuccuucuagacuuuuuuuuugguagggggaggcuuacgucucauacuaucaauuaugcaaaagcuugaauauuacaaaacaaucuaacaguugaauuuuagacgaauaacaagcucuaagguccagauaggaaagaagaugaaaacagggauaaccauuugauguuaaaaagucaguuaaagaaguugccugagaagcugguagagucugcuaauucagugauaagaaaacacuugccaauuuuuuccuguaaguuucacuuagcccauguuaccccuuuugagugugacucaaccaucaguagaccccugaacuuuuuaaaaacucuauucauucucagaaaacauuuauucuuucuguuuuggucugaacuacacaaccuacuagcaagucugaaucucaacacaugcuguaacuuauauagcuucauuauuauaaaaauauaucuaauauacaggggugugugguuacaaguguguguguguguauguguguguguaucuucccugcacugcagcauuuugugaguuuggcucucaggccagccgcauucccagugcuggcagagggcuaaugcaguuuuccugagacugcagauucgauuguuacuuaucuuuuauuaugauuuccaucgcuaucauuuuauucaggagaaaagcuuaucaauccuggugauguccuuuuaauuccaagggaauguaagauggaaauuuauugucagaggcccaaggcuaagaauacagagauaauaagaaagccuugagaauaacuaucuuggguauacauaaacaacacugauacauuacgugcauaacuaaggagaagcagcgagcugauacagacuccaaggagaaggagauuguaacuguacauggagaagaaaaaggaaaaugagcauucuucaaaagcccaugugacaucaaaaauagguaaaguuaaccacaugaggaacccaauaccugaagaaugaagaaagauaaaaucagaugcauuguacuuaauuuuucuuuugguaaacuuugucauuggaaauauuuccugucuuccauuuugcagauuuauaaugccauucuuuaugccuuaaugaacuucaagcuggccucugaaaacuguuuccucaaaauauuuaaaaguuuucaaugcugguguuuuuaaauuuguuaaaggcaacaaaauuaaaaaaaaaaaaaaagaagaagaagaagaaagaaaaagaaaaaaaaaacccacacuaggaacuccaaguccugccaauuuuuucuuccugccaaguccuauuaguauaaaugaacgguuuauuuuaagaaaugccugauaaauuacucuacacaaucaguaaugaggguacugucagcaaaggagaaucauuuccaaaauuuacuuggcauuaaggagcuagugccuucuaagcucaaacuggguuauguggcccuagccccuguggauuccauaaaucucuuccuucuucucagaggacagagggaucagcagauauggguaacugcugggauuucuguaugucugcuuacaguuuuugaaaacugaaauaaaacauggucauuugcaaacuucccuugucaacaauuucuaucacucuuuagagaguuuauuuuccucuuggacuuugccccagaggaaaauauuaaagaccucaggguauuauagcaaaauuuaaaaacacaagucagggcaaaaacagaaaacagcacgauuauaaaaaggaaauaguuaaagagcuccacauuucuuuuaggacacaaaccuucacccagcaccugauucccauccagaguggcuuuagagaacuacacuuguagggaugcagaggcuacaaaucaccagccgaagacaaaagcaaaggagggcaacagaugaccacuucuagaaagaggaagaaagaaaacuccauaauuuaaagaaugcuuagguaaauaaaaccauuagaguuucaauuaaacaacaggagaguaugaugaucgucaauggcuuccacacaguuugccgacagcacuguaccuuacagagccaucagguaaaacccuuuguguguuuauuaaugaacacccagaagccagaucucagaaauaaaagacaugugguggugucgucuauccccaagccacuaauagaaaacugccuuguccugaagcuuuauuuuucuaaagggagacauaggugacauuccuuuugauuaauuauggcagcaaaccccagcaaagcuauugugggaaugaagaguuuaaaacuugaagucuguuaucugugaagcucucuucugcucuuuagagaaauaguaucacaaaaguuaauggucaaauaaaauaaacaaauaccucaaauccuugcccacccucaauuucccuuggccuacuuauaaaucccccagugaugggcuucgacuacuuuugcuguaagacuauuuuccaaccacugucuacaagacguccacuuacucuuagcagugucuguauaauguuugugcugaccccgcaucaaaaucuuguuaagccuccaaguaggagacaaaaguguuucauacaauuuauacuacucauauuuuguauuuaauauguuuaaacacuaggaucagaguucagcguuuaaugcaaugcaguauguacacaagcugacuaaauuacagaugaacagagagaugcugcauaccuccuccaaucuuauagcaagaggaaagauaucagcucugcuuaggaaauauuuauaagucccaagcauucuuagcaucauuaauaagcagcuccuuaaugguccuuagaggucauugaggggaguugauucccauuuugcagaugaggaaacugagaccugaaaagaaguugggugaauuuuucuggggcaaagacaucaacggagacagaaccagcaccacccaguguagaacaucagaccccagacuccugagccauucugccugaucuguuuccccagggucucugcucagaacacuaccugcauccucuacaaaaggcugggguguuguggucaauguccaugcuaacauuccugagguggcugaaagggagccaaagggcuggagaaauggacucuaauauugguuugauuuguacuugguaaaagccauacagaaaauaaugggguggaaaaucuccuuacccaaaagacucucagcuucaucucaccuaccacagaaauauguuucuacacaaaaauuauacuccaagggucucaggucuaaucccaaguaacauuaagugggacggucaggguaagaaagguguaaguuuuacgccaagcagaucacucauaucaaaccagcuuccuuggccuccaggccugugauccacuuugauuauuuucugaucacuuaugagugcagggcaggaugccaggguuccuuucuuuguagccucaccucaccacugggugacguggggcauucuuagauaauuaaauuaugaaauaacccaaugacaacaauuacagaaaaaaugagugcuucugaaauaauuuuacuucugccaggaaaaaaauaaauggguagacaaauguaaauuuuaaaugagcuaaauaucauauuuaauuucuaaacauaacuuuaauccuauugugagcucucugaagcuagcuuuggaaauggcuaccgcacuguuaugauauuccccagguaaaucaaguagauugucacgauucuaaucuagccaucaucauuauauucucacaccccaagggugcuaaaagcacagguauacuagagucuguagaaggcagcuaugauuuauaaaguacaauucuacaaccucuggccacagcugaguaaaacaauagggucuugacucaaaagugguuaaccacuggcuuucaguccaugugacacuaugaucagagaugcugugucccaguccucucuguggaauugagaacuggcaaacuaagucgcugagcuagacagcaggggccacuagaguggaaagguggugggaggcguugcugggguggccgcugugggcuaggcuaagcauaugcugaggaggggagugacuaugaauacacagaggaagccagcugggaaagaaagggaagagucaggcagaggaacugugauucaaacaaggaugugagggugguacagugcagccccugcccuugcugcagcuggucguuuggcuucucccaggcacaaacuuucaaucaauccuccuucacaggaggcaacuuaaguacaugucuguuucugguaaccaagaaugccuugagaagaaaaaaaaggcccccaaaggaaagauuaaagaucuucugggguaguccaaccauggcgcugcccagucccaagcagacccagcuuuccccagacccacagcaaugccaggacucccagaagaggcuggcuccuaguguagcuccugguucaugugaguacuucaagcaauuuggacauucuucuuccaaaaucauuaugaaguaucacugaaauuuaauacuaacaacauucagauuaaaagaugacccaaaaaagugaacugauuuuaaaaaaaaaaacccaccauggaaacauaaauaggaauguggccauucacaucagaauguggcucugaugucuuuuuacccuacuacaauagaaacucauggccucuccacuaguugaucccgaugcccauggaaaagguaagagugcccagucugaugcauaccuccaucauguggcuuuccauucaaguuaaguagaaaaaaaagcaaguaggaucaaaaccuagaaacuaauaucugggucuaggaagaagaauaugcauuucauuaguguuugguuaacaugaaucugaacaaccacuaucuaugaagauagauaagaggcucucuagagaagagaagaaaauucucucucaucucuaccccugguaguaggauuuugaguucaaaacuucauagaggagauccccguuacaccauaauagagcuucuaagauugucagcaucuucucaugcuucaccgcucuacugcauuaauguuucaaacagcuuccugaggagaaaaaccaaccuuuggcuugauauuuacuacauggggcauuguucuauagauggcaaauggauuucauccuacuugcugacuccaaaugacugguagggcccugucccaggaaggguucuccaaagccaagugcacucuaagcuugguaggaaagagccugggauugaugagcaaugucugucacuggcaugggagggaaaagagccagaaugcuagguaccagccagcuuuagcucacaccuuuaaugugcaagagagugauuuagaggacugcauuugugagccuagagcacaaagagauucagcuucaaauaucucuuugagauagagguguugacauuuaaaacugaaauaauacguagaaaguaacauugaugaaacuuauagccucuagguucagaaaaaguaagagcaacuaauuaauaacuauggaacuuccagaagaauaugaaaacucaaauccaagaaguagaguuuuucucaugaugcaaaaggaccauuugaugucaaucaaagagaaacaaccauuaaaaugaauacaaauagugauguaaucaguuuggguuuauguccuaaaauacaaacaaaaaaagacaccaacaaaaccccacaaaacucaaaaagucuuucagucuaaauaaggcuggagucucccuucugaacacacgugcuuuuguguucuuuuuccuauuuugauaguugagaaacugaggcagcgugggaaagagaaaacuaauucaaaggccccagugugaaucaacagcagauucuggguuuagaaauagaagagcugauuuggaguugacuuguuuuaguucucagacacguggauucccuggcugacuuucacagcggcaggauggggacaaccgcugggcaccucacugcaaacugcaauauggcucagcaggaacuuggccaagguguauaaaaguggcaggcacaauggggaagggcucaggugaguggccaggaggucaucugacauugaaagauaauaugucuuaacagaauagauucuuuagaacacaaacuuuggaaaaaggaaaagaacuaaaguaacaauuccagaggcagaaccauucugaaagccuuaucuguguucaaaaccuauauggagcuccuccuucucacacccuaggcugacgugauuuuauguugcugcugcuuaauaggaauuucaaagauugcaccuauauugacuuacauauacuuccacggaaggagauaagaugcagaaauaauccacucaccuuacacuuaaauccagagacaguuuaguaucuuggguuugugcucuaaaaggcauaagguauguccaucuaaaacuaggccaaauuuucucccauggagaagcaaagcuccacaucuuuaauugaccugaaccuuaauuuucuaaucuguaaaacacagaaaauaguaucaaccugccaagaugaaauaauguuucuaaaacaguguauguuaggcaucuuaucugacagaguuagcacucaaugcauauuaauuauuaguuugcagauauaccucuuagcauuguuaacugagaaugcuuguagguauuugccuuuccaguagagaaacugggacucuauguccugccaaagaccuuguguauguauaagcuagugguugagagcagaaggaaaauauauuuacuuguaagucaggguacguaauuggaaaaaggauaucacacucauuuugggcacagcucauuagugugcaugggcccuucaggccaccuccuucugauguaagccacauuaguguuuacagaugguaaagcacauuuaucuuucaaaaccuucagagauguucaagcaacucugaaugacucucaaauaaaagcuuuugcauuuguuauguggcaucucuucuguguagaaaccccaauaacaccacaguugaaauuccauagcaugguaagcaguuccaaaaauaaguauagauugcuacugugaaauacauauauuuuccaauaacaagaauugcagucucauuuagagguuuuuuuggucacuguuguuucacaauuaaaaagaugugaauaauuuuauuuaacuuuuuuaucuuuuuauuaccaacuaaauguuacuaaugggacaguacacauggccaugaaaacucaagacccauuauuucuugauguucacaccaaauuuguggguuuuuuuuuuuuuuuauuugccaaaaugccuuagucguuauauuucacaguuacaguauuugggguaaauugaaaauaugaaacuuauggaaaaagccaacauauaaucaaaaucuguaagucuuugcaaggcuuuauaaucuguagacaaguaucaacaacagaaauaacucuguuaggaaauuauaacugcauuucggcaagacaguguuuuuggccuacagauucuacuugagcaucuaaaaaucaaaauguagcaaaaauuaacacaaucagcaaucucccaucuccacaaugaguaaugagaacauuauagaucaauuucaugggacacugggaacuuuucaagauuaauuaauaacaucuauucuaaagagaaagcaacagacacauuuaucucauuauacuuauuugcaguaauuacauaaaagagagcauuuauguaaauuacagcaaauauuucaguuuucauuuugccugcugcuucugaaggcauucuuuuggcaagaauaacuucugggcuuucaugagauacauuaaaucuauuuaauagaauuuccuaucuucccugugacuuucagagggauggcuauucaaucucuucuaaaagggaaagaaggcugauuuccaaaacuuggaaauaaucauaagcuuuacacaaucuuggugaaucuuaaauuagggaaagaaaaaaauguaacaaaggaaagcuuuggguugaauucggaaguauugugagauucuaaaauuugauguaguguauuugcccucauaacacauuucuguagaaaauagauuuauagcauccauuuccacucugauuuccuguuucucuguccauucaacaaguauuuagaagccuaaaauggcuauguggaguguuuuaagaguuaaccuaggaagugagcaccccucugggagcaauuugauugguuaauacuaguucugagcucggcaugugaaucuuuaugacugcacagcuucgggaaugaauugcuugaccucaacuuucuccaugggggugcacaccuuaauuuuccacacuaauuuucaaacggaaugacaaaaacacuuuacuuaucuagaggucaacuauucuacaaacucaacuacuuggaacucagacaaaaagcaagcaaaaaaaguaucucugcaggcaaagugaugucaucaaaucacauagauuuucccaucggagagcugcucaucauuugaagcaaauguacauugauuuuauucacaauucccaucacuaugcugauguuguuuuugagccuagagcagauuagaggaaacaaaucguaugugagaaagacagacuaauagaggcaauacacucaaaauaauaugauauaaaaagauacggccgggcacaguggcucacgccuguaaucacagcauuuugggaggccaaggugggcuggucaccuaagguaaggaguuugagaccagccuggccaacauggugaaaccccuucucuacuaaacauacaaaaauuacgugggcgugguggcaggugccuguaaucccagcuacuugggaggcugaggcaggagaaucgcuugaacccaggagguggaaguugcagugagccgagaucacaccauugcacuccagccugggugacaagagcaaaacuccaucucaaaaaaagaaagauacuaauucaaaaauuauuaauaaaaaggucaaaugauuccaugugccccuguaguccauaaggaaucacuuacuauaaaaaauuaauauucauaaugauuauaaaaacaaaaguuuucauuuuauucaaucuacauuaguuaagaaagugaggaaguuguuuuauaaaguaauuuuauaaagaauuucauggaauacaaaauauuucaagcuggugcaguggcuuacaccuguaaucucagcacugugggaggccguggcgggcagauugcuugagcccaggaguucgagaccagccugggcuacauggugaaacucugccucuacugaaaaaaucagcugguuguggugguguacaccuguagucccagauacuaagggggcugaggugggaggaucccuugagcccagggagguugcggcugcagugagccaugauugcacugcugcacuccagccugggcaacagagugagacccugucucaaaaguaaaugauagagauagauagauagauagauagauagauagauagauagauagauagauagauagcagauagauaacaccagauagauagauagauagauagauagauagauagauagauagauagauagauagauagauagauagauauuucaaaagaauugacacauaaggauaugcucuggagaucuagcgucuaucacgaugaaugcuggaaaaucucauaguuauuuaaagaauugcuugugagcucaaacauggaacucugucuuuuuauuuuuuuuuaaccagaagcauguucuccuccaaagaauaaaggcuuuuaucuguaaccacaggaacuugaaacaaucugcaagacuuacguaugggcugauauucagcaggugguaacaggaauaugggaaccaaagccagaaacugagcuuucaaugagaauguuacucucuccccuacuccuacagacuuuugguguggaaagugaagaagaagggaggaggaagggaaaguucauccugcugaggauggaggagcaggcugcaagcuggcuuacuccuucagggagcuugagggggcacuauuaauaauuaugcuuggacaacaggcauacaccaagacaguucuaggcaaauggaacauauggucacccuaguuuuaaggagcaagaugaaaaauacuaugcuaauuaacuauccucuaacaauucuugagguagaggacagugggaaaauauaaaggaguaauucacaaaaguauuccaucgaauacccugaagaaauaacuuccccaauuuaugugcucauucauucaguuagucucagugaauagcuacuguaauacauuacaauuuccaauauaaucucucuuuccuauuagauuacauguuuuuaagagccagaaugucuuuuaaaauuauauuuccuuucaagucucauuuauuucacuucuucaguagaugauaaauaucuguuaacaaucaaaauaguauccguaagaaaaauggaagaccuacauauugaaaaauaauaugaauaauaauuacacuuuuauucccccaucgaaucuugaauuaaucuuacaaggauaaaaucagucacuugaacuuagugcuauacgauccuggauugcucugaaccacaguauuuaccuuuccagcacugacaaccucauggcauuguuaagauacauuacaggaaaggggcacauuagaaaaaaaaugcuagaaaauaaauuguauauuguguuacuugauagacuuuauaauucaauuugacuaucagucuacuugauaacuauaguguuauaguuacugauauaauuugguuacaucgauacagauugugauccacacacaaucugcugcauuuuaauagauuaaacuacaccuuucuaaacuguauuuauagagaaagaugugggugaguguugggggggaaaucuaaguauguuuugcuauguguagaauuauaacuuuugaaacaaaacauacacacacagcuacauuuguuauacuuuuggauauacaaucuuaacuuccugggaauuucuagaaaacuuuuaaaagcauaaaauauuguauacaugaaauuaaauuaucugcucauauuucaaaauuuuagagacauuggcaucuggaaauuuuucaggguuaauuaguucauucauucacuauaaauacauuuuaauagcuacugugcuaggccauaaagugaucacagagcuccugccucaaauugcucauaguccagugagcaauuugucuccaagguuauaaaggcauuugacacagugagugaagguauucacaggauguggggagcauacaggagggacaccagugcauuggggauuaggaaaaagucuuccuagagcaggaauuauauaaacugaguuaaaugaugaugugacagauaugguuuguuguccauuaauaucccuucucuucuuccauagaaauagggcaucuguuuuccaguagggaagaugccacucuucaucaccaggauaaaaacuacauuucccagccccugugcaggugacuaaguacuuguuaauauaugugaguauagguauaauuugacagcuuccaggaaccuucucccgaaauaguugggguaugcucuuuguuccuuuuuccucuuugugcuuuccucuaacccucugucuggaacauagauaugaugacccaagcucgaaaugccaucuuguacugcaaagacaaggaccaccuuccagggaagguggagcaaugagcuaaaaggagccugauuuccugaagacaucccagggcagagaugucauaccagcgcugaacugcccgccuccagacuaucaugggagagaggauuaaccucucuuuaaucugugcuauuuggggguuucuguuauagcuaaagauaauccugaugcagcagaauagaaguuaucuaggcaaaacauaauauaaaagccacucaccacagaggaaacaauacaugcaaaauaacagagacaaaacagcaugguguuuucaagaaacuugacaaguucagcaugacagggguucagggaggaaguagauggaaaaguaucaagcuuaaucaugaaggggcuagcaggucaugcaaagaaaauucgauuuaauuagaaaugcauaaaaaucaaaugcauauuuaaauaaaggagaaauaauguuauaagaaaugagugaguuaauauacaggcucaauccaagaaucaacaacuaaguguugagggaaagaagucagacagcuaugcuuccugcauugguguguacauuuggggccuuggcuaccuuguuuagggaucaaauaaaauuuaagauagaguuuagagaaaggcagguguauucauuuccuguggccauuguuacaaaucgucacaaaguugguggcuuaaaacaacgugcauuuguuucuguagagcucuggaggucagaaguuugaaaugcguuucauuaggcuaaagcuaaagcccugacagaacuacaguccuuuuggaagaucuagggcacaauccauuuccuugccuuuuucaguuucuagugauggccugcauuucuuggccuguggccccuuucuccaucuucaaagcuuaucacccugcucucugcuuccauuaucacaucauauucuccucugauucugacuacuccugugucccucuuauaaaaugauggugauuacacgaggcccuccuggauaauuaaguuaacauccuugaauuaaucgcaucugcaaaguuccuuuugucauauaugauagcauucacaaguuccagggauuaagacaugacauauuuagagggcauuguucagccaccaccucaaggaaucagguaaaaaucccggauuaggaaaugagaaauuugaauuuugcuucuaacucagucacugaccuuaaaagccacuuaagucaauucccuacucuacacuuaaauauaaaauuccugcuaagugcucauccacucucuucuuuuaacucuacuauuacugcuauguucgauuccuugccaggaaggucaauacucucccccuuguuuuuuuuuacugcuccccauguaagaaagcuugucuaugccuugagcuugaauccuuucccucuaacaucuaauuauuagcccuaguucugcccucucaaggaauaucccucucuacauucaccacuguagucaagacuucuccuaauagacacacucagcacaggacacgauuucaagcugccucgcccugcaggcugcacucucccuaaagaacaacguggcacucacaugugccuccccaucaaacuucugugugcaccugccuuccaauacaggguacugguguuuggaggucugguuagguauuuacaagaaaaaggaauggcauaaacaaauuaaguguuuuauaaaugugacaccaagcaucaaccaugauacgaaaacauuuggauugcaauauggcaaacacaacauuauuugaaagaaaaugaacggccuauagggcucaguuuuuaagcauccagccugaucuucacagcaaguauucuuuuaugaagcaacguuugcuauuggucauguugaacauaauucuaccuagaaauggucauagaaagauagagugggucucggugcuguuuaaaacauuuagggguuguuggcauuaaacacacugaacagauuccugggugaccuugccuccuggucaaaaggugccucccacgaaguggccaaggcgaguugaaacaucauucuuauauccuuuauggagaacaagaguccauggugccauugaggacucuaggaaacucccaagaacuuuuccagggacacaggaagcagccgaggcuuccugcagauugcugcugugaacccuccuugagcagccacugccucuuccacuaaagcugugcagaguucuaagaaauagguagugaagcagccugaggccccugacuauggaaucuuaccugcugaauggaggagaagaagcccaagacugagcugaaaaccuuaucuggauaauaugcugcuugguuuucugcccuuuaauucuccuccccaauuucuacagagccugggacccugagggaguauggggcauucuugguccaagcucagaugacccauggccaguccucacuaugucuucagacgcagucauggugcucaaauguguccugaaaugaauuccuaccuuuuguucaaguuuugaaaagucugccuucuucccuuggucucaguuccacccuuaaaacuauucugguaacuguguccuuccaggauaugggaaaaucaaugauuccaucucguucuuggcuuuuucuuucuuaaaugucaggaauugaauucugcuuuugaauacuggccuuguggcugaggcccugcuauccagaaggauuuaccugaagccucugucuuaccuauuugcuaggauucugugauguuucuugaaccuacgaucucuguguguuuuguccacugccuaucagggcaccuuuucaucucuugcuaaaucuucugacaccauauuuaccaguuacugugccccaccugaugggucagcauucuuuccauugcccagagguaggccauccucugccaccacucugacccacaccaguuggccugcccaguuccaaguucucacauccaugggcugcuccauccuaauuaggcaacuaacccugucacucuccucugugguuucauaucagaucugggucccaugagagacccuuuggaccaauagcauuuugaaaaaugccccauucagauagguuugggaauguuagggcuuaggaauaccauauaguuuucuuuuauaucaugugauuuacauucuaugggcauauauuuuggguacaaaacucuauacagauggcuuuuuuaaguuacaggaauuaauauuacacccuuuugagaaaaauucuaugaagacgccaccuauguuuuuuguuuuucuuuaaugcagggggucaauuccuguaagccaacuuguuuuuaguguugugguuuaaguagacuuuucucuuccuuugcaaaagauagauucaaaagucuuaagucacuggaacauuuucaaaagcauguaauaaguaaauaauccagacaguacauaucuaaacauuucuuagguuagauguggagauauugcuguuauguaaucaucaucaucaauauaaggccuccuuaagugugggcaccaguuuucaugccuuuacuacuauauccaggcuaucgcuuucauccaauauuguuaaauuccccauagugcaaauuaaaugucacauacacaguaauaauaccaguaacuuacauuuguauaacacuuaaaguauuugacuuggaauuucaaaauaugucacgugaacacauauccaccucaaacugcauauauaggccaggaggauaggauuggauugcuuauaugaaaaauauguguauuugcuaaaaucuacaacugacuacugguuaauuuucaaauacuccagcaguucucuauacauacccuaagagaauauggcaggaaaaaauuauuugcuucaaagcuuaauucuuaguaacauauugaaguuuacaauuucuauuaggaaaaauacuaaauugacaggauuugcaggaauuuagauuugcaggaacaaagaaaaaaugacaggaauauccauauauuaaauaaagauuuucccagcacuuugggaggccgaggcagguggaucaccugaggucaggaguucgagaccagccuggucaacauggugaaaccucaucucuacuaaaaauacaaaauuagcugggugugguggcaugugucuguaaucccagcuacucaggaggcugaggugggagaauugcuugaacccgggaggcagagguuccagcgagcagagaucacgccacugcacuccagcugggacaacagugugagacccugucucuaaauagauaaauaacuaaagauuuaagguugaauuuaguuauaccaggacugacaacaggauuuguauauagaugauauguaucacuuuuucuacacuuuugagggcuucaugguuucaacuauauuauguuggaauucaaguauaaaaaauuauauuacaacagaguucuguugucuuuaaauaggagagcaccgaaauaaacuuuugccuuuucccaccucacacgaaagguugaauguugacauuuccuuucauauaugugaagcauuuaauaaagguaaaaaagaguaguccaaagaaaauacauggcugaaaacuuagagggugaugcuugauauucaagaaaagaacaggaaggggccuuguggucagaggguuucccugcaucugagagaaggcgcccugguugacugggugaaagauuuagacuacuucagaaacugcucaaauaugaguaucuccucuacuucuuuuuaacucaugaauuccaguuucuucccccuguaugggccuucccuuggucuuuauuauuaccuccuaaacccuuuacauaaggacaaaggaaacuuaaaagauaaagaagaacauaauuggcaauuuauauugguuuagaaaccucuuuuucuaaauagcucauuuuucuuucagcuccaugaauacccaaaucguuaaaguagaugacuuuauaauaguucguuauuuuuuauuuuuuauuuuuuauuucaggagaaaaacacaguuuuuaggguuuuuuuuuuucuuuaauggcaugucccugaaagcauuuguaucaggcucuucagauuccaggaaggaguuugaauguaaagagaccaagaagcauuuucaagccauuuuuuuuguuuauuuaguuuacuuuuuuugaaaugaagagaauccaauuccauagaaaauaccuugguauuucaacuggaaugagaaccucugguuuggagaguccacaguucuaaucugauuuaagaccaaauguauuuacaugacaguuguuuguauuugucuuacuggaaaauuucacaacuaaagauuuagaaaaaaggaucagaaagaaaauuaucuguaauucacuacaaaugaagagaaauuaacuaauaaaaacuauuguuaaaucucauugaaucuaaaaugccaaauaugaaauaagcugucacuuacacauucugagaauguagggacucuacugcuauaagcuggcaaaggagauuaugaaaccccacuauaccauucugauuauaacuugagauaccauaagcacaaagaaccucuaggauuggaauacuagagaaagaggagccuccacaccacagaaagaacacugcagccccaaccuguggcaugcuuggaagaacugugugugagucccagcugugaucuuacuccucuccaagaaauugacagcucaccuuguacagaagguagcagagggaugaaauaggauuggaacuaccucuaucaggaagguugacagggaaaacuccuuagccaguucaaugcaguaaaacagccccaauuaagcuucauuuaacaaauauaaucuuugggauuauauuguuugguuucagacucuacuccacccuacucucuugaauugauuccagaauaauuguuuaagucacuuauuuuuuuuuaaccuuccugucaggucuguuuuuuccaucaguacuaauauaccauuuauauuuuuuuugaagaaaagaagaaagccuuauaaagauagccaaauaagaugauauauaucaucucugcuuaaauccugcuauggaacugaauuccucauauuugaaaugugucccaugaauguaaaagacauaagcagucaguccugauggcuaaaaaaggugaaugagguaacaguaacacugaugggcuguuugucucaaaugucccauaaauagaaaugugaaauuaauuuuuuucaaucuacauucucucuacucaaggaacaaacuccucaguggugagcugagguaaggcauuuaacagggaaugguuggaauuugaguugucauuuccaugcucauauuugggaacuucuugcagaaauaaaaaguauacuuaagugcuuauuuccaaaguuugcugugcaacucaagaacacaggaccacacuuuuuuuuggugggggugcuuucuguuuuccacuuucuaauugagccuauugaaaagaccucccucugcuguauauaugcugcaggacaguuggggaagagcuuuacccuaggccugcuguugcaacagcugguggcuuuggcauuuucauauaaacacgcaagccgaagaagaauuucuccuuucuaauuggccccauuccccccuuccugggacauuccacaaugccaccaacaaugaagugcucagaaaggaggaaucguuucuguuuaugugaaaauagauccuaacuccacgagugaagggaagaaauaacacaaagcuucaaagaccacaaagagaaguuauaaucaaaucuggaugcuguuucugagaucuggcaguucuccuccauauaccauaugaaugcccggugagcuggagccaaccgcccuuccuucuagccuggccaaucucauucucugugcaaccuugggcaagcugcuugcugaagccaugccacaggauuaucugugucaagccugaguaacaccccuggugaccacccacucucaaacaugagcgaaccauuucacucucaggagugcuucauauaaacuaagccuaaaguuuauaaaagugauaaucaaaaaaugccuucaggaggcaguagagcaucgcaauaaaagggcauggauuucugaguaacucagaagugaaugcaaauucugacucugugacuuucuaguuaugugaccuuccucgggcuauuuaauuuaucugaggcucaguuugcucaccugugaaaugaggauucuaaugccacaccccgagaguccaugugcugauuaaauacuccuguauaaagcaccuaauucauauucaggcucacuaaguguuagcgaguguuaucaggugugcccuacaacuagccuuauuguggcuuacacuaucagguguagcuccacauacaguauaauacaaugcauaaaauuuuuuaugcuggcugggagggguggcucaugccuguaaucccagcacuuugggaggcagaggugggaggaucaccugaggucaggaguucaugaccagccucgccaacauggugaaaccccaucucuacuaaaaaaaaauacaaaaauuagcugggcaugacggugggcaccuguaaucccagcuacucaggaggcugaggcaggagaauaacuugaaccugggagggauagguugcagugagcugagaucaugccagugcacugcacuccagccugggcaacagagugagauuccgucucaaaaaaaaaaaaagagaguuguuuuaugcuucuuaccgucaaagauauuacuauaauucagcuugggggaaaacauguuuggaggcuucaggcaaccugaauuauagcaaauuaaauaguuuucucuauuuuucaaucucugcuccuaagaaauaugaaaauguaugcauccuuuuuaaagaaaaauaaucuguugacaccaggauguuaucaggaagaaaaguaccuuuccaagucuuuauccaaauaacacaacugauuucuccguaucauggcagccaaaucaccccuacuguuaaauacuguuucccuaauauacuucaaguuucccuuuuggugguaaaagccuguuucuucucauuugccacauuaggcaauuaauuggguauuuauaggcagcuaucauaaaccucacugucaccgcuacuagucauacaucuuaaauuccccacaucuugcuacuuaaaaccuaccccuuaaucaccucaucaucuuugucacauuuuuaaaguuuccuuccacuuaaucaacuccauuuucuaagcuagaguacgaacaauugugcagaauucuccucaugcagcuuuacugaggcucaaugaagaggaaauguuuucuucuuaagugauuucuuuagaucccaggauaguuucugcuucuagugcaagagcaucaccgugugagcuauuccugaucugcacgucaguguuaccuucaauccauuuccauuauuaaugccuuuccuugucaaaugaagcucuucuggugggggcugagcccacuaggagugaaaucaccgccccccacuggaggucucuuaccacacagguuccccggggcgugcuccuggccaacccucucccgcccaguguucauggguauuccgcugucauagcagaaagaacccacuuugacgcuccccgggaacauuggacccuugagcuaaaaaaacaaaagaaaauccugacccucggaggacggucaguuuucuuauuugguuuccucucccuuuguuagcacaauccagccaauuucuccaguaaaugaccauuacaacuugucucauguggcuccaagggacacauguuccuaguggggugacccaaaaaucacuuuuccacaggauguuaauaagcgcucugagggaaaaagggcucugcugucaaauaacugcaggaaagauggucuucgauaucucccucuuaggcaaacacauuucagacuaucaaugcuucugagaaaugucaaaguaaagaaaauucacugaccuuugccuaaugcagguuucccaaaguuguuugacaaaagggucauuuuguggugggacaacuauuacuauuucagaaaacuaggguccucuaggcaaggaacauuuaggaaaugcugugcucuaucaugggccccucucuaauuucccauaauuaagcuguuacaguguuaucuaugaccucugcauuauuuucaccugcaugaacugucugaaaauaaugauuuuggaggaggcuuucacacugcguggucuccauugacuuuauacacaaaauauuuauccaagagcuccuacuuggaaaacaaacaaaggggccaguuuagccucacguccaucuggcaguggcagccucaggaucucccaguccucacugugucuuauuugacuggucacugucacaugccccauuacacagugcuucuugucagccaggacuuggcacagaguaaacacuggauaaacauuuguuaaacgaaaggaugauuuguuuuauguuauuucuuagagaaacaugcgugauuguuucaagguuuaaugguugaaaaauuaaugauguggcuaguuuuauuuuuccccaagacuacuuguuacuguagaugaagcuacgaguuuauuaacuaucuauacuguguuuccacuuaauccuucuaugugcugagcacuggacauuuauuauuauuuaauuauuauaaguugcagugaguauuuggucuuccugucacagauaagaaagcugccacugaaauacgugagacagccugucaaugaucuccaaacauaaauugcaaaaccaggcuuugagcucaggucucggugacuaagccuacaugcucuccauucuagccuauuuuguaugcacaccacacaugcauucuacauguacacaugaaaacaucauagaaguuaauuaauauuuuuaugaaucauauuuuuguuguagcugaaaauguauauagcaugaaauuuaccauuuugaccauuuuuaagcguacacuuuaguggcacuaaguacauucacauuguugugcaacuauuaugccauccaucuccagaacuuugucaucuucccaaagugaaacucuguauucuguaaacacuaacuggccauaccccucucccuccagccccugacaaucacuauucuacuuucugugucuaugaccuugacuacucuaaguaccuuauauggaaucacgcaguauuugucacuaauuuacuuuuaaacuuuucuggccauaguaucaaccacaugcuuggggaagaaaaaucaucuuaacucuauuauaccaacacaacauuguuugcaguuuaauuaaugcugcucugaggaaucaggcuguaacuuugaaauaaaaccagccccaggucagcaagaggaaauuugcccacacagcaccauggccacagagaucacuggaaagacaaaaauucugggugauuccaggaggcagcuuaauaucuugggucuuuugaugauugaaaucugcauauauaucccaaacauaucuccuuuauuccccuuccaaacagcauuucuguuaaugugugaaaacaguacaacuagcgggaaauguaguccacauguuuuggugcauuuacacuuauauacucuugagaauauuaaaauggccuaacaauacauuuucugauggcugcugcugcuuuuuuuuuuaauagaaacacaauuacagacuuuguuaaaaaaacaaaaacaacaacaacaaaaaaacccacguaaucccaaaauagguaaucccaaaacagguaaucccaaaauaggcugaaucuaacuuuaaauucuuaaaauguaaauauuauuuaaauaaaugucaacugaucuucaaauaaaacauuuaaaauauauccagcagucuuuaaauuagagacuaauguaaguaagguaaaaaaaaaaacucaauaguugguucaacuucccuuuuuggcucaacuuuaggagauaauaguaaauagagaaaagaggacagauuaaagauacacccagagcuggguuugaauugcaacacuaacauugguugguauagcaacauuaagcaaaucucuauuuucuuaucuguaaaauggacauaguaauaugguuuacugaauugucccagagaagaaacaaaugguguauauaaaguauucauauauauaccauauauagacaaguauuaagcagauguuuauuuacuuacauucccuccucucaaauuugaaugcuccacagcaauuaugccauuaaaaccuauucacaaaauauaguuaaaugcagcacagugaauugcauuuuuccauuaaauuaaaaggaugaaaagacuaaucccauuagaacaagaaaacaaggcacuagaagcugaggucaguuauuuaaggucacacaugaacuugaaggcccagcaacaaagagaaagcagaauuagucucuguugcagauauucuuuaagucuacggaggguagugcuucuuuaguuuuuguggcugcagcaucuucuugguacuuuuauuugaccacauccacgccucaaaugcccaaaauguccugcuauuaauuuuuuucauuuuuaauuugauuaaaauuugguuuuugcuuaacuguuugaaaugcuuacggcuucuugaaauaacccaggauuuagagcucuuaggaacauuucaaacagacacaaggguuguaagcagauuagacuaauuggcaacccacuccaagaggcacacagcccauucugacuuacacaauguucagauaaagggcaaauuagggaagcauuucaaggucccucgggccccccuuccuaugugguauuagaacaucuuacucaaaggaggaacacugagacaugcugacuguuaaugccauacccagauaaagauaugacaacaugaagaugugguuucauuaaagcugauacauacaggacaaauaagauucgcuccagcugaggagagaagcaauaaggcccacauaccuagcucagugcccccaaauccugaagguuuggggaugauaugaaaaaugggauaugauacauuuccuauugauuauaguaagguaucugaagguuuuucuuuaaccccuuuacuaccauuucuuuaucuccaccaacaucuuuuuaauauuaucauaacauuguaugcuuagucaaaauuaaacuacaaucauuuuaaauaaaaagguggcuugcuccaucuggcuuaguaaagauaaauauuuuaucuaagucuucuuaaucagaauacuucuugacaucuuaaagacugaucauuaaaaaaaaaauuccaugaaauucagcccaauuuaucucuucaugcaccaagaagucccuucuugguaaugcugaaggaaagcaaagccacuccucuuugagaaaggauuaaaaugacucccuguccaaccaugaauaaacccaaccauaaagccaagcaacucacuccuagcugaagccacuuggaggcaaagauaaugucacuucuugauucuccaaguuaacgccaugauacugaaguccaaacugguagauaauuuuaaaacuuuuguauuuagcuauuguaagauauuuguuuuuacuucucuaaucaguuuacaugucuaauuaaauuugauuaauuuauucccuaaaugcuuaucguaaagucaguacuuaaaguugauccagaaagacuuuuuugugcacucagugaagguuggcugcagcuaauauaccaggaacgcaaucaagaacugaugaaaauuucugauacaucuucugacacaauagcaaaaacgguauaccaucauuuagccuuuuacucuuccuguggcuuuuuauuuuucuuuugauuucuauauucagguuaacauucaaugguccacucggauuauuuaaaacauaccucuaaucucaaggaucauucugcauagagauacuggaaaaaaucccaaagaauguaugaguccaguuaaauauucccccaggaaaauucuugagcauaaauaucacuuccuaguagugaaaacuuacucugcaccccaggaauucauugauaacuuagggcugauuugcaauaagaguuucuugucuguuagacacauucacuuaucgggaagcccacuagggucuacguugaugaggauauguugcaaaagaacaacugagcucuuggcagcuuuccaagucccaacuaacagaaauaagaauucccagaguaugaaagcccaggucucacaaaauauuucuuccucaugccacagauaagcauaguugauggagaucccugaguuguaucagcgacaguaacuuggcuccugaugcuucucuggugccugauggaaagacauuccuggggaugcaauucacgccuccuuuguuuccucccugcucuccuaggaaggaaaaucacugugcuauucauuucucacagaacaguaacaaugucuacuaccccaccuuauuguuauagggacuuccagagaagacuccaggcacucaauggcaagucaccugagaauacacugauugauuucacucaguacccugccauggguuaaggauuuaauaacgguaaaaaaauaauugaggacuuugggaaguacccuagcuagucuauuugaaaauucacuuuccugccaacuuucucucauuuuguugacagacucuagaaacuuccuuucaucucuuuccucuuuuugcagcuuaaccuggucccuuaaggaguaugcucuuucuagaagauagauuaugcacuacgcacaacaugaaaacuuuacacacuuuuccuguugucaucugaaaggccuuucuaccuggaagaaauaacuuaucucaccuuucauuuucacauugguuuuacacagaauuccuuaugagcaccaacauacuuaaacuuuauggagagauauaugcugaaacuuugguuccucuuaauuuuucuuuuuccccagugagauuugugacagcuuuccccacugcuguuauccauuauagaaauuuaacugcacuuugaggacaugugauuucagaaacaugaucuaauuuucuaccuaaagagaagaaaaaagcuaaaaguaacaggggaaggcaaagucuuguguagcauagaaaaggcagaguuguaaugcauggaaaauacaaggcaguuacuccauuuaauguauaggcuucaaauugaaaacuaacuaaauaaguaaaauaaauuguuaucagagagcuucugcagguagccaguccauuaauaaaaaaugcauacugaauaaauggaucauaaaucaaguuuuugauuaucuaauaguuuuccauuguaaucaucauccagaaaauguucuuaaguuccuaguuggcauacagggugcugguuagacuucaaauuaugacauuuuugcccucugggagcuuaugaagguauacugucucaaacccagagaaguguuuuagaucauuacuuacaaaacaucuugcaaaacauucagaaauauaauguguccgauaauaaaauagaggaguacauucaacuuuauacaaauucaccuuaaaauccaaacaucaauauucuaauaauuugauucaaacuacacuaaugcaugguggugacuacugucucugcauccaacacccacuaguuaaaaacugcugcaaguuccaaaugugaguauuaaaauacuauggauaaaguauauugaagaaccuggagcugcuuucugaaaaacacagaucaggggaccagcaggcagaagcaauucaauuucgaauccuuuugcauguauagaagacugcuuccccuucacagcacagacacacucaccacugaaacacuucccagaagugcaacuagaaucaaaugacugcaaugcacauucacaggaaguaucugaaaaagguuauggugagaaacugcagagcuacacaucaaacucuauuccaaugacauccuuugaaguuuggcacucagcaccaaugcuaacuuggcaccuccacaguacaugcaaggacagcaugcuccacucuggcucaaaggccaaagaccggugugauugcaagaagaugcaaauagugaauggcuugguggaaauuggccaaccuuuggaaugugauaacuuaugcaagaucuucccacuaaagucacaaauaaggugaaauuuacauaauggcccaucuccugucgcagaaaugcugugauguaaacuuuaaugugcuuuuuaaauuucuguaauuaacaaauacaaauuucuaucaauuucacaguuuaaaauuuaggacacuguaaguuuuacaaaagucuucaacagagauagaaauuaccccuaaaaucaauccaugagaacaucugcuaaaccggugguuucuauccaagcuccacucgcaaguccuaccuucacuccucagacaguaggaaucucagggaccccagcauagauaucuuugaauuuuuuuugauuuguauuuaaugugauuauuagcucuauuuuagaacuuauuccucuggccucuggaucccucuucggggucacugugagccugcccccucccuguuucuccacuggagugcuuucucugcuccuccagggugccaggcacucacauuguucauguaucugauugcauuuuuuuacauuauauaauuucauugaagaaucauuggcauuguugaugaaucacuggaucauuacaucuauuaaaaagcuauuuguucaaauuuuaucauaaaaacgugaaaacauuuuauccuauguacaaugauguacacaaauuuaaauaggucaucaaagauaccugaaguaauuaaagagguauauuuacaguagcacaucacaguagguggaaaaccacucacagauucaacauugauacuguuuuuguacuuaguuacacacugaaagugaagcauacauuucacuucucagagaaaccuuuccucagccuacacacuaagugaggucucccugguaugugcacccagagccuugagcuguagccccugauucuccaaggaaacacucaaccuacuuuuccauguucauuguucaugccuguuucccuggccaagcauaagcuccacgagggacugguccuauccaguuuucuccccagagcuuaaauaguguaccagacacaguaaguuuaguuagguuaguugucgggggcaggggagggaauguuugagguuuuagcacucaauacagguuauauuaauuaagagcaaauuaguacauugugccuaucaugcugacacuucuaucauuaagcuaauggugaccucaaacuaacaaccacuucccucacugaggccucuuagaacaccagaauguuagagucuggcaaagagucacauaauaccuguucucacuuauacacccauugauaguucauuuuucuuugucucucuucacuuuuaacuguauaauaggcuuuaaaguucagaugagggaguacuuuaaugaauaauauacuaaauaaagaacaauagcauuagcauaacuaaaacucacacuuagagauaauucaugggcuuaacuaguuugcauguuuuaaccagaucaucuguaaacacaaauuacauuucuuuccuaacucuuuauuauaguuugaagaugauagagacucauaugaaagggaguauuugcaacagauauaauaaaggaaauaguuuagaugauacuacuuauuguauuuuaauaaugguaaugauuacaaagauugaaacaauguacuaaauggcugaaauaauuauuuucuuuaaguagccaaaagggauuuuuaagagguaaauaauuuccuauccuuguccaaaguauauuaaacacgaguugaccaguaucuuuaauguauuaaucaauaagcucucaucugaaggaaugcuauguggauuuauacaacucuaaagaaggcucuauaaauaucacaugauuuacugcuguuuuuaagagacaaguuucugguaaugacuaagaaagugcuucaggcaaauuagugugacauacagaaaauucaguacugguugcaagaaguucauaaauaaggcaggaaauauaaauaaguagaauaauuuggaaugguaauaagcugguaaugcuaauaaugcuaauaacaauccuaauaaggauuguuacuguaaacgugaagauguggauauguauguguaaaucuauagaacuaugucuagcaaauucaaaaugugucuccacuaguuaaccagaaaacaguguagcaaaagucaccuuuaacuguagcuuguguuucuuguuuuggcagacuuaccauauugagacauucugaggaaacugaguuaugucuauagcauuuaugaguucuccaaugggaacauccccaacaaagaaaggcagaacuaucauagguaaauaaaaucaaggacagguagaauccacagacaaauuguaaauuauauuacugauacauucccuuugcauuuaacaacucuuguccuguuuauguggccucuuauugggauauacugaauuaggagauacaauagccucuuuuuaucugacaucuguaagcagaauugucauuccccucucaugaggaauucagaugugcugcacucaaaacacacucagauucuaauuccaaacauuaacuagacucaugcauuucaucucaaaucugggaauucccauauugauaauucuauagaaagaauacaagauaacaagauagacauaccaaaaagaugacuaagcccuauaaacacuaaacaaaaauagaauuuuccaaagggagauuaaaacaaaaaaaggagaaagaaauugcuguggaucugagaacucuguuguagucaagugaauuuuuuacuccaauuauuuacuucucccugugcccaugcuccucaccauauaacuuugaaauuucucucagaaagggucacauguauuuccccacccuuuuggauacagccuaaaacuugcuuuugcccgggcacaguggcugacaucuguaaucccagcacuuugggaggccgaggcagguggaucacccgaggucaggaguuugagaccagccuggccaacauggugaaaucccgucucuacuaaauauacagaaauuaguuggguguggugguacgucccuguaaucccagcuacucaggaggcugaggcaggggaauugcuuaaaccugggagguggagguugcagugagcugagauugcgucacugcacuucagccugggcgacagagugagacucugucucaaaauaaauuaauuuaaaaaauaaaauuugcuuggacuaauaagaugcaggcauaaggguuugccagcuguacaccaacaucuuacauagcacugugguuucugcuugccccaguguucugcagccaugaccgucagaagaguaggagagacacacggauuagaaaugacuccaagcacaggcaggagcuaaaccuggccagaccuggaacuagaagcaaagcuacccagcugagcccaaacuauaugaaacaucccagcuaauccacaugcaugggauaaacaaaugcuuauguuugaaaaccauuaagagcuugagguuauuucuuacacagcauucuugugacaauggcuaccugauacauugauaaauuaaagugggcaaaagaaauauucuucccuucuaguaaucuguaaauaauacuucccuccugcugagauuuagcuuucguucacuuacagugaaagucagcaaauuacgccugacugaaagaguguuaccuccaaugaguucauucuugguuggccacugacuuacuuuuuuccucauuaucaugcugacaaucauauugacuuucaaaugcuuacccuuucucuaauguguuggggauaccaaccccuguaugaccucaucuguaaacuugugggguuaagugaucacugguucuucagggcccagacuuccaaggagagauguguggaagaccacagcauggugggcagaggaggaaagcuaaacaauaggagugcuaaccuaucaaucagccuaacucugcuuccaucuguguuagcuacggauucuucauguggaaaaucaguuuuacuguauaaauaucaaaaacuacuagaccagauguuuucuaaagaucuaauacucaaagacuuaugauuacauuuuuuauuuuaaccaccccuucuuuuuauuucuauucccaugacccuaauuuaagacacuaucaccuaaacuccuguaucacuuccuaaccugaccgccggcuuuaagcuguaaauugugugauuuuauuccccuacuuaaaacgagagaaaacacaacuuuaacagggcccccaggcucucccuaccucuccagucucauuuccugccccacuuccccaccuuucauccuggcuuagaacacaccccacacuucaucaccucgggguuuucucccaugcuguucccucugcuggaaaugcucauccucuauucguuuugccccucagugucauguuauaagucugccucucagagagacuuucuucgaucaccuaaacuacagaaggccccaucugaccccaucauucucuaugacagcacauucuucuuucuuucuuugcacuuaugacuuacaguuauagaaacauuuguugguuguuauaucauucaacuuucuauuaaguaucaguuccagguggccaggggugaaguugucugguuuauuuuuguauuuuuaggacccaaagcaguaccuggcacauaguauauacucaguaauacagaugaguggaugaacugaugaacuucuuagcuuuugucaacauuuuuuucuaccacuuuucuauaccauauaacauuucccuagaacaugugaucucaguuuuucauuugcuuauaccugcucucuuaguuaccuuccuuaauccaugcauaauauuccuuauguucuugaacauuagaauuuucucuucaacuuucuuuauucaucauacuucccucuucuuacucuuuucaugcgcgaguggucacuaucugguagguuaugggagauuauuauaaagcugaucccaaaucuuagauucuauuuaggauaaaauuaacaagaauaguccuucaauaaaugagaucagaugccuguagaaguaaauacucuaugccaccugacugaggugacugaagaguuuggcagauaccuaaauuccaaguaagauggccaggaaacgguuuuaggaaaaaacaauaacaaaaauuauauccuagcuaauuucacugaccuccaucagaagaaaagaaaaaaaaauaagugcuugguuuguguuuagucuagaaaauauggacacaaugaacaaauaauuuggaacuccauugcuggaauguggauuuuccagcgaugccuggaauagagaaaaaacauaucugauaaagguaauauugugauuaucagagaaauggaggcugugggagggaaauguauuggucacaagcucucacugcaguuuaaaugcaccacuuaagaggaugcuuugagaguaggcaugaggcuacuggcugcugaaauaagagcucccucugcaaguaaagaagcuggcauuucggcuuaggcagcagucucuggugagcugguuuaguaugaaucaacuuccaaaaauucaaucuauucuggguguacugaaaacauuuaguuucuuguucuguaaagccaagauccacaccuuaaaccacgguucugaaagaaaaugcccgagccugagcagucaguagccuuccucggacuccaguuacaucuugccuggcuuucuuuccaauucucauaugaacgacacucuauuucuuguuauuggccauaccuauuacuaucaaccuguugauaauuacaugauguacuuuugugagcacgugauuacacaaaauggaauuaagaaaugcgagcauuuuuuugucaucguggcaauccgacacuccuuagagcuaagacacaaugccauagucucagcauacauuuuugugagugcaguccuaggauuccccuuuuacccaauguuauaaauuuggauaaugucuuggaaaguuguuugggagcucauaagcuaccuguaguaaacagcauaugggacaauuaauaaagaaaggugcuagagaaaauaccaaaacuuuucagaccugggacggaaaucuuccccacaguuggaugcuccaucuccauaacgaggccauuguguaauaccugaaaaggcaaaaacagagagaaaaauaauuuacaaaauaaaaccaucuucaauugcaaggcauggacagccaucuauucagucgacaucaaagaaagauauggcaaaacacagaaguguuuaacauuuucauuugaaaguaaacauuugacauaaaaauaacguuucauccuauaauacaccaaaugaagccaaaaaagacuagaggauucacggacuagaaaacauuucaauaagaccuucccacucuuaaaauuuuuauuugcuccuaaauauagcagaugauuuccucucuuucauuuauggaugcuccccuaauauuaaagcucagccuuuuccugcauaaccuuauggcaggacucggccaaggucaagaaauaggaccucaaacagagcagcacacuggggugguacacaugcuccuggaaaucuguucagcagaagguauggggagucaguccaguuugaagaauaaaucagaguauccagaaggcucggugacugcuggagguggaaggauucagggcugcugugacaagcaaauaagcagcugacagcaaauccagaggagacccaggucagaagcaagcacagggaagcugaaccaggaacauuuucaaugguggccaagaccuuaagcauaagacuagaguucagaaacaggauuccaggauacuggaguaaaaaagccagagacuucaucccagagggcugauuagguucucaugcaauggugaggcaggaaauuuaaaaaauaauaauaaaauaaaauaaauuuuucuauauuaaauuaauuuauuucaaagacaacaauaaguauauuuuuauaaauucuuauucucuauaacuaauaacuucaaauauucuauuuucucuaaaaauacaacaaaaaucauaaaaaaacuaaacaaaccuaaaacuacaacuauuaaacaccauaauaaaaauuauaaaauaaaccaauacaaaacucuuuaaaacaaaaccuaaauaauaaacaucuaaauuaguuaaaaacaaucauauacaaucauaaauuauaaaccuauuacaauuuaauuaacuaucuuuauccugcuucuagaucccuacuuucacgccacuauaaacuuacuucaaacuaacccacccccuuuuauaaaauauacauaaaaaucaaauacuaucuuuauucuaaacccaaucuuuaaacauuaaaucuacuaaaucuaaauacacucaguaauaaaaauacccuccuacauacaccccaaagucucucucuaauccuccuaaucccacaacaaugggaccgagauagguaucuagugucccaccaagaacacaagguagcuuuggcuuggauuuaaaaucuaaggccaguuacuagugcagggacauucuaccagugccugacaagagaaaugugacuugaugcugaaucacuugaguacugaaaugaagcaacuuaaaucccuggcaaacgaaggcuggaauuuucccuggggguaagcaaaaagacaaaauccccagugcccuccaacuaaaggugguggaugggcugagggcauggaaccaaauucugauacauaaguguugaauuauuggaggcaaaauguuuugugauacgcaaauaaaaaugcaacacauuuuuuuauuuaaaaaaaaacaauuggaggcuaccuggguauacugucccaaagaauccaacaucuauuacuggaaccuuaguaagacauuuaugggcaucuuacauauaaauuguguuucaccuacacuaucuaccaagcacagaaccucucuuccugucuuguacgugcaucuaaaugacagaaguauuucaguggcacaguaaucuuacagaccacgauuucaugccagcaucccaaagaguggcagcuauaaugguucuacagcauuuugagcuucagguaaaagcaagauuugcauaucuaccuucuuaccauaauccauucacagagcaaaagagcauggaauaaagaaaguaauaaaauguuuucucacuuuguuaaacucggagagagagcucaaauuucuuggguuuuauucauuucuagugagucacaucauaaaauaaaucaucaauaagacaacuucacgggugaccuuuuaaguuuagaacuacaguuuugcuauggcuaaauauucuggcugccacugguuucuuugggaaugguuaccacuuuucgggugaugcucuuuaaacaacgaugucaaccucccucauugaggaugauaacacaccacacagagaugcuuucuuuugggaucaccagguuuguacucaagagcuggccagauaaaauucucgccaguguuagaauugugcuauaauuuaauucugguguggcucguucucagcacccgccccgcacagcuuccuccuaugugggggugggggcuaaaugccaacgggaggugcuaaaucucaguucuacugaggacaggaacaaaaauaccgagcuaaauuucacucaaaacaauuaucugcacacugaaucauucuucucuccucguaucucuguugcccuccugacuaccucuuuguaauaacacugcagugcuacucacgaaagacaaaagugaguguucuuagcuaaauauaacuuaacugauaguguugaaauuaauuaacgcugaauuuuaaucauguagcaaacguuaagugucaaacgugaaaggguaguugguaaaggucaagggacauacgucaaaguuuugugaagcaaaagcuagcaguugauugaaauuuuccacggaagcaguuuaaagagcguacuuucuccaccccuaugccgauugcugucuauauaggauauuuucaguaugacacuuuaaccuuaucaaugccuuugcauugaaaaccauuccguuuuaagcaaaaauauaaauucuucuuacauucggcagaggaaguugcaguuucucauuugcuguagcaugcauacaauuaugaggcaaaugggcuggugugagccccguguucagaaggaacugauguauuccccugcuugguugccgccaaccuuuucauauaaagugugaaguccauacaauuccauaggcuuucuucuugaaucaggucagaauaucccacagaacaauggaggcuguggcagugcugucccuggaaacccugccuaaugacuuggaaucuuggaaaacucuccagccuuguuuguggggcgaauccugcucugcuuaguaacauauuagaggauuucagaacccaggaagucugucugaauucuaacauaaaucucuccugcuucauuacccuuucacguuugacacuucaacucccuuucauguuugacacuuaacuuugccacaugauuaaauuuguccccucuaaacuucauuggaaaugaaggaacuaccuguuaucaccauuuguauaacauuuuuuggugaaugguuacuaaauguuuccuuguucuuuucucaucuggccccaacaccccaaccucuaucaccuuaaccuagaaauucaauuaaaaaauguuuuguuuuucugaccacuaacaauuaacugcuauaauuucccuuaagauauucauggcuuaaagagaguuucaugccuuggugcuaggucuggccauucagggcauucuuuguugcauauugaguuauuucaauauaaggcagggaauuucuccagaauuuuguagugaauuuuguccauuuagcaaugucuuuggauuuuacuguuuucuccuucauuuuacuuauuuuauccuuccuaggucuuucaugguuuaguagcucuucuaaauuccauuucuucuccuugaaauuucaaaagccuauucuugacaagaauagaauuguagucagugcgccaaccucuuuagcaaaguaucaggccuauuuaaaauaaggucucucuuucuuucucaagcguuuuacagauugacagccuaaugacagagucaagugguaauguauuaaugauggggggaaagaguaaaauguauaccuuaaaguaacgugggaaauaaaaguuuaagugaaaguaagaaagucuuuuuauaaaguccuauggcagaaauggcagaagaaaaaaauuuguaauauagcacuagcaagacaaaaaaugcaaaaaauaaaaauccauagacagugaaaauauuuauggaaagugagagaggaauauucuaaugaaaagacaugaaauuacauauacaaaugauauuuguaaacacuacaguguccuuacacauaucaaaaucaaaguaauaccaucaaugguauuagcaauaauguacaaaagagaacugaccuaucuauucacuguggauaaugauaugaccuauucauucaacaaacacgauagcacuuauaugcuaggcaaaaugaagaagcuggcagugaaaagaugaaugaaccugcauuaaaaauguauguaauuagaagagaggguacagaauaagagaucuuuuucauaacacagucauauaaauuguuauaacacaguuuaagcuccauaacaaaggagcaaauccaaagaggagcaaguaaguaacucugccuaucuugaaagaaguuggugauuuguuagauuaagauaauaugacuuaggucagggagguuaguaaagaccagagaacaaagauaauguugaaauuagauguuaagguuaaaaauaacaaugauaaauguaguaacagcaggugcugcucagcaaaacuccuuaagggucaggcauuggguuaggacauaaagcuuuauucauuuaauccucucauuaaccagacuagguaggaauuauuaucuucaccucuacugauaagguguuagaaaccuagaggggcuaaguauuuguccaagauuucacaauuacuaaauggcugaucuuggauuauaauuuaggugugucuaauuuagccagguucuggcaguuggagacaaaaaaaaauggaaaagcuuuauuugauuuaccauuaaaauaacuagcugauguggucaauucuguaaaaaaaauuagucacuuuaguggggaaagaaaaucagccaaacagauuacaugacaccaugugguccuauuaguuaauacacugagcugcaccauugcagguagccaaggauacucuggcaccacagauacaaaggcugugaaaauuggaaguauuugaaggggauggacccagagggugaucuugggcaaggcauuuaaguagucuaaggcuuaaaacccucaucaguggccaggcgugguggcccacaucuguaaucccagcacuuugggaggccgaggcagguggaucaccugaguucaggaguucaagaccagccuggccgacauggcgaaaccccgcgucuacuaaaaaaaaaaaaaaaaaauuuagccaggugugguggugugugccuguaaucucagcuacucgggaggcugagacaggagaaucgcuugaacccaggagacggagguugcagugagucaagauugugcuacugcacuccagccugggcgacagagcaagacuccguuucaaaaauauauauucaaaaaauuuuaaaaauagaaaauuuaaaaaaagaaucuuuauuaguaaaaaggggauaauaauaucucuuucuaagggacgaagugcaaugaugaguauaaagcccugagcauaggcccuggugcagagugugcucacaagaagcggcaacuguuuuuccuguuaccaauagacuggguucaaacucuggcuucaucagguacaagauguguggcuuugggguacauucauugaacacauauuaaauguacuaacaguaaagaacaauaauuaauaauaagcauuaaauacauacuaaugugccaggcauuguuaagugcugaggaaaaacugggucacagaaaacucaaggucaugcccucaagaagcuuacugccuuuuaagggaaacuuuccaauuaagcagaaaccacuggucuguuauuguuacauaauauuaucuguuuuguccccugcuauaugcccagugccaugaauguuaucuggcacuaucugguagaugcucaauuaacauuuacugaauuuuuuuaaauuaaauugaauuaacugaguaaauugcagguacuuccuuuugguuucuuuauuuuauagaaguugggggagagugcucuuauuuuaagcuuuuaaugaaugccuagaguucucuagacacaaaacuguuuuacugaauuuccaaaauacagucauuuuuaggaacuuagauaucaaguucuaguguugccuugcaauuucuucaguuuucuaaagcagcuuccagcugaucuugaaucugccauauacacuguacauauuuuaagacacuccagaggccaugccgagaagcucugcauggacaauggucauuaucgauaaaggaaagccaaaaaacaugggcaugcacauuuauacaugugaaauuaaucuacuaaacuugaagaaaacaauuacagaguucuucuucauuaagaauacucagaaaaccauuuuuaaaacacacaauaucuuacuaagcaaaaaacacuggaguaauauucuuuauuuuauuucccauuuuagcaauuuagucauuccuuuagcauaauaggaaaacaaccuuggaauaauauuugaaagguuacauaacugaaggcaaaacuuacagugaauauauuaaaaaguuaauucaacuauuucugaaaacugugcccucaaaaaaugcaaaaauaacauaaauuccugacaacaaauugacaugaaauuuccuaacuuuacuuacaucagggguccgcaaaccgguaccaugguccaugguauggggguccacaaaccaguaccgguccuuggccuguuaggaagugaccugaacagcaggaggugagcagugggcaaggagcauuacagcuugagcuccgccuccugucagaugagcggcagcauuagauucucauaggagcgggaagccuauugugaacugcacaugugagggaucucgguuggacgcuguuuaugagaaucuaaugauaaauguaauacccuugaaucauccugaaaccaucccccauccccguccauggaaaaacugucuucuacaaaacuggcccuggugccaaaaagauuggggacagcugacuuagauaaugaagaucacauguaaaagcugacuuuuuuuguuaucuuacuucuuugaaacaauucacuguuacuaaauuucauucugcugugaaugcaccugacauagccuuuuuccuauuuucucuaauuuaaaaaaacuaugaaaauuggucaugcaauauacacacacacauaauuuacacaaacacauauauaaugugugugcauauauauaguguguauacauauaauguacauaauauacacacacguauauauagcuuaauguagacuaauaaaaugaacacccaugcaccaaacacccagccugagaaacagaacuaccaaaauguuuaaagucccagguguacccagucccucccucuucuauccccaaauauaauucuccugaauuuuguuaaucuuuuccuuucuuuuuuucuacuuguaucaguguguauauacuccaaauauuuaguucuggauuucacccauuuauaacauuuaauucaaugaaaucaagcauaugcuucucugacuugcuuuuucucauaacauuguuucugagauucacccauucugaggcaugaggccauaggcuaaucauggccauuaauaugaaguaugccauuguauaaauacuccauaauuuaacugacucugcuuuuagguagcuuccaguuauuuuaccauggcaaacaaugcugccauuaacccaucucuucaugcaacaauuuuucuaggguauaaaccuagagcuagauuugcuauggcauaguguuaaauauaucuucacuuguuggguaaugacaaauaauuuuccuuaaucacuuaccaaucacucccaccaguugcuuuauaucucagcaaaacuuaauauuaucagaguuuuuagguuuugccaaucugaucacugugaaaugguaucuuauuaaagcuuuaacuugcauuuccuuaauuacuaaucagguugaguauauuuucccugcuuaauaguaauuugcauuuccucuuaaaugaaaugcuuauucaagaagcuuuucuacuggcuuaauuauauuuuuauuuuucuuucuuuuuuuuuuugagacagagucucacuuuaucacccaggcuggagugcaguggcgugaucucggcucacugaacccuccuggguucaggcaauucucgugccucagccuccugacuagcugggauuacaggccugugccaccacacucggcuaauuauuuguauuuuuaguagagacaggguuucuccauguuaucugacagucuugaacuccuggccucaagugaucugccugccucaucucccaaagugcugggauuacaggugugagccaccaugccaggaugcuaucauguaugaguuuuuuacauauucuggauaugaauucuucauugguacaugaaaauacuggaauugaaauuauggcuuuauuucucauuuauuuuguauuauguuuugaugaccaaaaguucuuaauuucagcauuuucaaacuuacugaaauuuuccuuuuguucuucgcuuuuuaugacauauuuuaaaaauuauuuccuauucuuaaguguuaaagauauuauccuaaauuuucuuauaaaauguuuaaaccuugaugcauuuauucauaauaaaaggucacaaguuagggauugaagggaauaaucucaacuuuuuaaagagcaccuacaaaaaaucuaaagauaacaucauacuuaauggugaaauacugaaugcuuuuccucuaagauugaaaaugaggcaaggaaaaaaauaauaauaaaaauaaaauaauaaaaauuaaaaauaaaauaaaaauaaaauaaaaugaggcaaggaugucugcucccaccacucuuauuugacuuauuacuagaaguucuagacacugcaauaaucaagaaaagaaaaacauaaaaggcacacagauuggaaaaauaaauaaaauaaaaauaaaaggaacaaauauaaaaaauuaaaagaaaaauuuaaaaaggaagaaaucauacagauaacacaauuguccacauugucaagaaaauauacaaaaauacucuuaggacuaauaaaugacuucuucaaggucuuaggauacaagaccaauguacagagaucaaucauauuuuuguauaccgacaauaaacaugugcaaaccaaaauuaaaaacaacaccauuaauagucacuaaaaauaaaaugaaauacuuagauauaaacaacaaaaaaauguauagacuguguaugcuggaaauuauaaaauguugaugaaagaaaucaaucaagaccuaaacaaguggagaagcauacuauguucauggacuggaugauucaacauaguaaagaucccaauucucccaaaauguauaaguuuaaugcaauucuuaccaaagucccaggaaagcuuuuuuguaaacuuuuuaaaaaguucauuuuaaaauuuauauggaaagauaacagccucagaauggcuuacacaaucauaaaaauaauaaagagauaauuacucuaucugauauuaagauauacuauauaacugcuaaacaccaagcagguacuaggagaauaucauauuggcagagagacagacacauaaaucaauagaacaacagagaacucagaaauagauccacacaaauauguccaaauaauuuuugacaaagguacaaaugcaauagaggaaguaauacagccuuuuugacaaauggcacugaaacauguguacuggagcuggggggaaaaaagaaacucaacauaaagcucacauuguaaaaaauuaauucaaaacggaucauagauuuaaauggaaaaugguaacuauaaaauuuaggaaaauaaacaggaaaaauauuuaaauaagaaaauaaacaggaaaaacuaugguacauccauauuauggaauacuccuuagcaaugaaaaggaacaaacuauugauucacacaacaaccugcgucaaucuuaagggaauugugcugagugaaaaacaccaauccaaaagauuacauaguauaugauuucauugaacauagcauucuugaaaugacaacauucuagaagcagagaacagauugggggucuccagaaguuagaggagaaaugggaguggagggaagggaggugcauguggcuauaaaagggcagcaggagagauuuucguggugauggaacucuucucuaucuugacuauaucaaugucaaugcccucaaugugauauugugguauaguuuugcaagaaguuaccauuggggaacagggcuacaugggaucucucuguauuauuucuuaucacugcauguuaaucuauaauucucucaaaacaaaaagcuuuuuuuuaauuauggucuccuguggguauaaugugagaggggacucaauuuuauuuucucagcuagaaauauauugaugaauagaguuuuaguagaaaacauuuuuaucuuguuccuaauuuuaaaggaaaugcacuuaaugccucaucacugaguauguuugugacaaggaauaauggcauacuuuaucaaguuauagaaucuauuccuaguuugaugagaaauuuuauuauagauguuuacuuacagcaaauggcuuuuaauccaucuacugggaggaucauauaauuuuucuccauuaaucugaucacuuacaacugcaguaagugaucaaauguauugucuuaaaauuguuuguuacuuguacaauuuuagaauaauuaucuguuucaggugaauucaaauuuuuauugacaugaggugacuugaacaguaaugcauuuuguuuuaaagucgguagcaucuaacauuacuaaagcuacacuggcuucauuuugguuuguauguucuucaaacaucauuuuuaaccuauauauaugcaaccuuucuaaguuuuuaguuuuauguguaucucuugaaaauagaaaauagcaggauuuauucuaucuuugccuuuuaacugaaaaguuuacugcauuuacaugaauugacauuauugacauguuuuaauucaucuuagaaucuuacuuagugccuauuuuuggcccccuauaaaaaaauucccaucuugcuguguuugagauugauugagauuguuuccucacauuuacuaguuugaagauauauacucuaucaaaaggauaaucuuuuuuuuuuuuuuuuuuuuuuuaagauggagucucgcucucucacccaggcuggagugcagugcugugaucuuggcucacugcaaccucugccucccuaguucaagcgauucuccugccucagccuccugaguagcugggauuacaggugcacaccaccacacccagcuuuuuguauuuuuaguagaaacgggguuuuaccauguuggccaggauggucuugaucuccugaccucgugaucugcgcgauuauaggcaugagccucugcgcccggccuuuuuuuuuguuuuuuuugagacggaguuuuacucuuguugcccaggccagagugcaguggcaccaucuuggcucacugcaaccuccaccuccuggguuauagcgauucuccugccucagccucccaaguagcugggauuacaggcgcccgccaccaccccuggcuaauuuuuauaucaagacgaaauuuuuuuuccuccagaagucuuaacaugcauauuuaacuuaacaaaauaaaaauguaaucaauaccaguuauccccguaucaauuauaugccaggauccaguuaucccccuaccaauuuauaugccagauguuuucaaacuuucuugguuccccacauuuuuucugucucuguaaauuuuucauaaugcccuuaggcaaaaaggaauacuguuuuguguauuaaguaguauuguuuuguuuauuaauuaaguaaaaacaauauguauucauauccuaauaacugaguggucauuugaaaaaauaauagacauaaauuauaauaaaagaaaaaaaaucuuuauuugauucuuagccacuauuacuuucuaacaguauauguacaucuguuaggcacaguaaaacuucuuaaaucuuggaauugaaucagauaucuccauccauauuucuuguuuuauauugauuuucucuugguacuugcauuuuuuucauagcaacauccauccaaaaaccaaguuugaucaaauguguuuaucaaaggaauguagugugauucaaugucgaagcugugaacuugaggacacucugugcuguguccaauauacauugcccuguuucccuagaaaauauaaacauccugcagugccccugcgcauucacuaggaugucaugagugccucaguacauaguuugagaaccacaguuaccugcaauuggguucagcauuuugguuuucuauuuuuuuaaucuggaaaucauuaguaucaauaccguuuuucaaaaucaaugauuuuuagcuuacuguaugcuuaugcuaauuuuugauccccauuuuuuuaucuuaggcuuuccuuuaguggcuauauucucucuuccuguagaauaguucuuuagaauuuccuuacucaucuguucauaguaaguucuccuaguaaguugguuuuauuuuccccaaaguuacuuugcuuccaaauaaagauauuuuuuucuuuauuuuuuuucuuucuucuaaaagauuuguauugguuguacauuucuaagcugacaguuaaccuucuguugguauacugaugauauuauuccauugucuucugaguuucacuauuguuuucaagaagucagccaugauucuaauugucuuugcuuuguagguaaucuguauuuuuuuccucugagugauuuaaagaucucuaugucuucuguuuucuacaguuuaaccaccaucagucuaaaccuaaauaccuuuuuauuuaauguauuuaauuuuuacugaauccauguagucuuuaggacuuccugagucugaaaaauuaugucuucaaaaguuuuggaaaauuccuaagcaugguaaaauauugccucugccuauuuucucuagcuuccccuggaacugcaguuauauauacauuuauauauacacauaaauguauauauaauguauuauaagauauaauagauuauauaaauauuauaauauauuauauauuauauauugaaauauuauaauauauuauauauuauauauugauauauuauaauauauuauauauugauauauuauauauugauaaauuacauauauaaaauuaaugcaaauuuuagcuauauauuagaugugaucacacuguaugucucugccucucuuguauuuccuaugugugugugugucucucuggguugaguuguaauuaauuuauucagaucuauguauccaaucaugaauucucucuucuaucuaaucuaccauuuaauuugcugugcaguuguucuuaauccagagaugauuugcauucuguuuuucuaagugcuuaagggcaccucugaaauagaaccacauuaaacuuaauuuucuguuuggugguuuuugggccaaguagaauuaauuacuguccuauauauaggacaguagauuuguagauagcucaucuccuagccccagaaaaaugagagauuuucaagaaccauggucaaaacagguuagaauaucuacuguuuuuuucuucagucuucaaugacagguuuuaaaauuuguuugcuuucuuuuuuguuuuguuuuguuuuuuaccuaguucacccacugacauugcugacuuuuggauguccgaccuuuauuuugaaguuucuauucuaucucccaccuacuguggacuucaggauucuuguaauauccucauuucuuauggcccauaaaguucagguucuaagcuaaagaguauuagcaaaugcugguucuagugcuugcuucucugcaugcauguuuucuaaucauuuuucuacuggcaggauuucucuggucauauagucccccauauugucagaaacagagguucuccagaugucacuguauccucuuuaagcuacauuugaagucuuaauuugguguuccaaccuuucccaagacuaaguaguccagaaaauacgaaaaauaacaacuauuaaauaaaagaggaaauacaacagaauccagugaaauacaaaggugauuuaugaacuuuaaagucaggauauucgaagucccgacuuacaucuuuaauucuauccuucuuggcaguggggccuuuaauuaaguuaucccagaaccaaacuacaaacuuucaaguuaagaaagcauucuuuccccuccagcacaggaguccacaaagcccugugaaaggaaccauuccgagugguggucagcagaguaauuuugugugugcugucuucacuuagcaagaaccaaauaacuccuucauucuuaggaauuuucuaguugcccagugggacaccugugaguuuugauuaguccuaagaacaggucaggagguuguauauauacuauauuucugacuggauuuaguccucucuuccccagagacugaagauucuaggcaagaauuugggaguccagucuaagaggcagaagcuaucuacuuuauuaaugaagugaugcuucauccucuucagaagccauugaggcaaacauuuuucuuauuacucuucauuuguugaucaagaacucaucacuuaaaugucugccaaccauucuauuuuuuugcagggaccaaaguaacaaaaaaguguaaggaggaaaaauagucaauuggacaaaaauacagcauaacaaaaaaaaaaugcacauggauucucugaguuggcagaguuuucugugugacuugucagggguggacaguccaaccagcaugaauguaaagcaaggacagagugagugugagaggaccauacuugacacuugccuaauaucuagguggcaauuuguaugugccaagacacagugaaacagauuuuucauuauuaucucuauuuuauauaugaagacacagaucugaggagguaaaaugacuugaguaauaauguaaguuaagguaaaaggugucuaucugacagcagagccuaugaucuuucugccacacuugugucugucucuaaaguguucaguacgacuuuccacuauaauaagauucuaguauugcugaucugagugcaacacagacauaagaaaaaagagucauuggggacacagacuauuccaaauuauugccauuagcaguuugucauuucuucugcuggugcaagugcugucugagaaaauuagguauaguaagaugcaaguaaucuuuuauggagaccuuucucucugucuccuugaggguaauguguuguaaacucuacugaaauuaaaucuccuuugggaucgaauugcaacaaggcaucuccuuauuugauguagcaaagcuuucccuuaguaaguccacaagaauaugaagguuguaacaaaacauuaacaucugcuuccuuaacaaauuuucuuaauaaagucauacaugccaaauauguuuaagacucauuaucacucuugauauaguaugauagaaguuuaaccaggaaagguuuucagcaucaggaagccacaaaggaaacgaugucguggcacauacaauaucugaacagccacaaggccaagcagcgguugauaaaugugccgauuacuuaguccucugccaugaggaagcaauaucauuuguuugcuuuaugucaaccauucuagagaaccauaaccacacagggaacaaucaagugacaguccuguggcuacagaaagacacggacacugcacaugacauccuccuugugccugauucauuaugccaaaaauuugcucaggcucaaaaaggccagaaccauuaugauaauuaacacguuucuaagacuuaaaaacacuaagguggugguccuaaaauucaauaaacucaguguuuucauuuuacauuuugguuugcuuuuccugggaauuuguguggauggggaaauacuuugcuuguugcaggcagauagaugcauguuugcucuaggccaggagauuaaggagaacuauuuuaggaaggagccugugugaccaggccugagggagauaauacugauaaguagagcagggucacugauaacuuugugggcaagugacccuuuggauaugccaagagauguuaucagggagaaagggcugagucauguauauauaauucuggcuuacucuagcuggaguguggggcagagggguagagauggaaauacauagaaacuaaaauggagugacaugaguccagucaggagucaagccugagcuucucucagacacaucuguguucccagcugacuuggcucacaauuucuuuuuuguuuguuuguuuguuugagaugaagucuugcucugucgcccaggcuggagugcagcagcacaauuucagcucaccucugccuccuggguucaagugauucuccugccucagccucccaaauagcugggauuacagacaugcgccacuauguauuuuuaguagaguugggguugcaccaugcuggccaggugggucucgaacuccugaccucaagugauccacccaucuuggccucccaaagcgcugggauuacaggcguguuggcucacaauuucaaucaggugucaucaaccugccuuacagacacacuguuucagcauggauagucacauggauaucacacuaucacaucucaacacccaaccagaaaagugguuccugccucugcccugcuuaaguaucagggagagugcugccuucugaguuccagcuguguggugugucuucuuauucagauccaugcuuuaucuuuugggccugacacuugacacugccacucugguuuggacauuuugcuuuugcucacaauaaagacuuuccuugaaguugaacccuauguccgaugcccaccuuacuuugccuaguccuugaauccaaccuuacacugccuauaacagguugaauaauggucauccaaagaucucaagucccacuccuggauuauguuaccuuauuuagaaaaagagucuuuucagaugggauuaaaugaaggauuuuaaaauggugcaauuagccuggauuaagggagugagccccaaaugccaucaccaaguguucucauaagagaggcaagggaagaugucacagauacacagaaggggaagcagcaaugucaccagccagacagagaauggagugaugcugccacaagccaaggaaugccuauagccucagaagcuggaagaggcaaggaaagauucuccccuaaagccuucauagagagugcaaugcugccaacaccuucauuuugaauuucuggccuccagaacugugagagaauaccuguugucuuaagcaguccgguuuguaguaauuuguuacagcagcccuaaaacaaacuguauccuagcucccaagauauauccucauagauuaucaggagcuagaauucuguuuaauucauguaccccuaucuaaacaaauaaccccuccauuuaaaaaacaaagaccggaaucaaucuucugguccaaaagagacugacuugcuacauaauggagaaaggaauauuuugagcagcacauaaucaugaugaagucaacuagaugguauucuauugcagcuauuuucauaaagaaauauuauuguuuucauccuauguuucacucuuuuggaacuagcuuugccacucucaauaacuuaggaaaaacuuaaaaccaaauacuguuuucacaccaaauuuacauuucuuccacuuuaacgauuuguuuaggcaaaugaccugaacucaggcgcagguuggugauuccuagggugggguggguaugcaccauguaaaugcagauucaugcuauccucacucuuucaauucauuucuaagauguaauuauuuucugaggauuccugaaauugacuuucuuggguuuuucuuucaaguauaaaggcauaauugauaaugcuguuuuuuccuauaaauaagaauauuccaaaaccuaaauaaggagaugaggaacagguauuucaaaggauccugaucuuaucuaaaauaauuguggacuaguagagggaacaccuaccaauuuugguucugccacuaaucagaugagagggacugaguaaaauucuuuuaacuucucuggacuucugucucugcacuuuuaaaaacuggacuauuauguucgaccauguagccucguuaagauaauuagaugaauugaaauacuuucaccuaaacacccuugagaaacugucaaagucaauagggccacccaaaacucauucucacccuuucucacaccugcuccucccaaauucccuaccaaccacuagcacucccauucacucagucucccaugucucacaccugggaagucuccuugacuuugcccuuucuaacaacuugccacuuuuguccuucagucaaguuaaauuccuuaccaagucuauuacuuguccauucauugaagcauuauucacaauaccaagauauggaaucaauauuagguguccauugguauguguguauacaauugaauacuauucagccuuaaaagagaaggugauucugucauuugcaacaacauggaugaaucuggaggacauuauccuaaguaaaauaagccaggcauagaaagacaaguaucacaugauuacacuuauaugugagaucuaaaaaaguugaacucacagaaauauagaguagaauggugguugccaggacccaagggagagggugguagagagauauuggugaaaggacacaaaauuucaguuaggaggaauaaauucaagagaucuauuguaccaaguggugauuauaguuaauaauaacguauugcauuuugaaacucacuggagaguagauuuuaaguguucucacccacaaaaaaauaaguaugugagguauugcagauauuaauuagcucaacugagccauuacacaauuuaugcauauuccaaaauaucacagcauaugugagaaauauauaucauuauuauuugucauuaaaaaauaaaaauagacugggcaugguggcucacaccuguaaucccaacacuuugggaagcugaggcagguggaucacuugaggucaggaguuugagaccagucuggucaacauggugaaaccccaucucuacuaaaaauacaaaaauuaucugggccuguggugcaugccuguaaucucagguacucaggaggcugaggcaggaggaucacuugaaccugagaggcggagcuugcaaugagccaagaucaugcgauugcacuccagccugggcaacacagcaagacuccgucucaaaaacaaaacaaaauacuaucugaauggacucuccuguguucaaauccaaccacgucauuccccugcuucauguucuucccuggacccucuguauuagcaggaccgagccaagcagcccaagggcaccguuuauauuuucccuggcuugcacaguguuuuauaaucauuuuccaucuuaauugccaagauugaaaauuuggagauuucacauacaaacccggauuuaugaauuuccaugaaaaauaaaaggguauggaugcaaccagacccuuggauacaaccuacaugagcugagaggcagcucuucucuuuagcaguggcguguguuuuccugcuuuccauaguacccaccacucucucugcugguuacccaguaugauucacucacugauuucauuugccuagcaucugaugguaucugaauuguaacuguuggucuacaagauaaaguccaaaauuuagcauggaccaaaggcccucagauucccacccuggacuacuuuucucaucucaucucacccaaaugcaacaucaaacacuuguagauuccugaacagcacacucuuucaaaaaaucuccuugauuuuuaauaugcuuccacucaccaccaccucuaccacaucuccaauguuaucuucuuugcaaacauguguccugcaagacucuacuuaaauggcacuauuuuagcgaagcuuuauuuggucagcucagaacaucuauugugcuuccucuucuaaugcuacacacauuauagaauuuaugauguugguuuccaauaaucuguggacauauagucccugagaaaaggggacaugcucacugaccuuuauaucccuagccucuagcacaguaccugauacauacaaguguuaauaugugauggcuaaaacaaacaaacaaaaauguuggaguacuuauccacuacuuggcacgcagcaagcacuaauaaauuugguuugacuuggaguaaauaauauuagguaucacagacuagaauuaaauauuaaugaauuucauuuuggauccaaucaaaagagaaaguaauagcaucauaguguagugucugacuguaggcucuagagucagacuuuacugauuaaaauucuagcccagcuacuugucaaaaugguuuaauuaucuguaaauaggaauuuuaaccugcuuucaaggauauugagaugauuauaugacuuacaaaacacugaggagcauuuggcacacagcauuaaacaaauuuagcugagauuauuguuauugcaauuaccguuaugguuauuguuuuguuauauaaagucuucuucaucaagaugucucccuuauguagccacuccacagacuggaccuauagaagagcacugcagugagacagcuauauucccaggucuucuauaucacuuacauaagguaaaaaauauauuuuuucagacaagucauaaagccuucauuucccacagauagguauuugaagaaaguccuccuuucauucaguuccaauuuaguccuauauaaauacauguaauggaagaaaggcuauucuaaaacaacaauaaaauaccaucuaccuauaacauauaaauauguauauucuuuuauuuuuucuuuuuuugagacugagucucccucuguugcccaggcuggagugaaaggugcaaucucgacucacugcaaccuccgccuucccaguucaagugauucuccugccucagccucccaaguagcuggaauuacaggcacccaccacuaugcccggcuaauuuuuguauuuuuaguagagacaguguuucgccauguuggccaggcuggucucgaacuccugaccucagcugauccacccgcuucagccucccaaaaugcuaggauuacaggcaugagccacuguaccuggccuaaauauguauauccuuaauaaggacauaacuuucaagggugaaaggagacauauaauuuuuaccuugaagguaaagguauaaauuuauauaauggguuuagucaauauauauacaaagaacuuuauaaauacucuuugacuaaacaauccuaauauucuucaucuuuuuuaaggagauaauuuuaacaaagaaaaaaaccuuuaugcauaaaaaugcucaucucagaauacuuguaguaucuaauugguaagaaccugucuaaaacuagaauaauaaauaaauaauaacacagauauaugcuagaacagugaggaaauaguaaaauuauguucacaaaguuguuuaacaacaugagaaaguuauuaaguaaaaaugcauaauguaauuuuauaugaauaaacuaauccccaauauuaagagggaaaaacugaaaggaaauuaacacuucuuucuuaauaggcacuagaacuacagcauuuuccuagguuuacaaaauucucuuucugcacauaguuacuaaacauuucaacuuuaugaccuaugcauucagaauuagacaaaaaguuacauuaaauugacagguacauuguuuaucaaagaucaaaguuugaaaaacucaguucuaaucugaacuggauggcuguauagugagauauaguuauuucuugcugagcuucagcacagauaucagacaugaaguacacaacaauguuuuagguggaauagucuuccauuugucaauaaaugaagguauaucauaaaaaaacuaucagggccuuggaacuugacuaaauaaaaauugcuuacaagagaggagaaugguccaaugggcuagauuccacugcugaagaugaagaaagaugcuuggcaaacaguuuccaaaaugcuacagcuuuauaucaacugagacuagggaaucaacaacugcgacuuagaaaugcaaaagugaauuuguauaccuuggauaagcugaagaauaacuuccaggggacaauaauaauagauuuccugcuaaacaaaucaugacaccuuuguacauagcauugaaaaguguaccgugaaaggcaaaaaaaggaaaucucacaggucaagaaauccuuguauagagaaaaaguaacugccuuagcuaacagugagcaaaggagucacuaauaauaacacgauagcaugacuacuaauauauuagucauuauuugacagcccaugggggccucaccuauuucuccaaacacaauauacauagucauuuuagccuuuucaaucacacacuacucugucucgagagcuuugcuuaaguaccccauucauccuucuccugccaugcaaauguugugcuuuguuuauauaucauucuuuguugucuuagugcacaguccuuuggcuacggguacuaaccccuucccugaugaucacacuuguuccucccacgaaaauucuuauuccaagcagcaccugugcagucagguacaguguguguccucacgguggcgguaagccaacccauugucggugcccucccaaaacagaccuggcaauucgguugcggcgccucagcuuuccuuucacccuacucugaauguaauaucucuucaugugugauuacacugaaauauaagauauuggccuuuauaaacaccuaagaaacuguuaagugucuuaaguaugcagguuaguacauauuggguaauacagaugacccuuggacaacacagguuugaacugcacggauccacuuaugcauggguuuucucccgccucugccaccccugagacagcaagaccaaccccuucuuucugcuccccccucagccuauucaaugugaagauacugaaaaugaaaaccuuuaugauaauccacuucuacuuaaugaauaguaaauauauuuuaucuuccuuaggauuuucuuaauaacauuuuuuuccucuagcuuacuuuauauuaacaguaagaauacaguauauaauacauauaauauauaaaauauauguuagugauuguuuguuauugguaaggcuuccagucaaugguaggcuaguaauacaguauuuggggacuccaaguaauacaacgugguuguccugacaccguuccugcguaggaaccuaaucccugcauuguucaagaguuaacuguaauugcuaauauuaagugaguauuuauuacguguugagauuuuauauggaucauuucccgacuuggggcagccuggugccagggccaaaacucuugacacucauuuuauauuaucuucuaaugacugccuuccugauugcaagauucucuaauacuucgcuaggagcucuuugccaucccucucuauaaaguucuuuacucacuuacucuuucuggugggucccuugucuaaaaaaaaauccuuaaaaaucaaggcuauaaaaggguuugaggcaagauaaauaggcaaaauccgauuucuccaugaaaagagucuaggauuuucaucaagaacacagugauucugggaacuacagauuuguauuaacucugcugagaaacgggauuuuaagguagguauaaacaauuaacuauaggguuucaagagauuaccauuaggaggaagcauaucagcuuccucauaggggacaaauguacuagugaauuugaauaguuaaaagagagugaaaagaaaaaaaaaaaaagaaaauagaggucccuacugcucaaugucuguuaugacccucaauguguuauguuggccaccuacguaauagguagaguuucaacuagaaggagaaacuuuaaaaggaaauaugagcaugcagaaacucaaaagauuaaaagugggcaaggguucacggaaaacgcauugugucauuuggguauuaggauucaaagaagauaguuucagauaaugcauaccauaaaaguauacucuaaagaaagaaggucucgcauuuuucauuuauucauucaaaauaaagaguccucuauauuacugcuuggcacacuagcaauguauaaaaauccucuagagaauuggcuuaggaguucugcauuccugagacuacaggugaugcugaugcuuccugaacucaucuucaguagcaaaauucuacauucuauaaccgcuugagaacacuaccauauguguuaaguccugggaagagaaagcaaggccaggccucaaugagaaguggggaacaggaucugaaaagagccccacgacagcuccugucucagcaagcacuccuccuguccagcauuucuaacucucaacuguuuugaguacuucuagagcuuuuuacauggcuauaaaaaugggcuacuggcaaaugcaucaaaguccccuucuacagcagcagaauagauguuuaaaaggaauuuacuuuuuguuuccucaaaccuuaaauagcaauguuuguuaaaguuuuaucuguuucuaauuugaccuuuuaaaaaauaaaggauauagaguugguucccacagaaauuuagcuuucaugcaugacauaaauauacauauguaacuuauauguguauauuuauauauacauauauuuaaaauauauauuauguauaaaaacuuacauauaauacauauucaaauugcacuguacugauuucagaaaaagaacaguaaaccacuagcugugcuuagaucucagguuccaggacauuacauuuaaccccagacccccagagcuuuuuuuuuuugagauggagucucacucugucaccaggcuggagugcagugaugcaaucuuggcucacugcaagcuccgccucccagguucaugucauucuccugccucagccuccccagcagcugggacuacaggcgcacgcugccacgccguuaauuuuuuguauuuuuaguacagaagggguuucaccacguuagccaggauggucucaaucuccugaccuugucaucugcccgccuuggccucccaaagccccagacuuucuuaauaagagacagaaaugaccaagaaugccacauagacacaaauagggucagauguggcaauggucauuugcaauauucuccuacuugauaguucccccaugugaagaaauuccucuuguauguuuuauuuucuccgauuaagggaacaguauaggcaaucaugugcucauuuuuuuugccuuaauuuagaguuaaguccaguucucaaaugaucucauaccaggccuugguccuuagcauaaauaucuuuucauuuucuucacaugaugucuggucucauuuuuucugaucuuaauuguauugcucuguuucacauguguuucuuauaaacugccuugaauccuuuugagaaacagacaggaaauacacaaauauugauccauuuguugauucaaccagcaguuuccaagggccugcuaggugguaggaacuggugauagaggugaacgagaucccauauuaugaagaugcagacaguaagcagacaauuaugauguauagugguuaagggcugaauaucuucaauaugugucugaauuaaugggauauaguaugaaaaacaaguaacucuaguguuuccuggaaagucauacuuuuguuuuuuucaccaaaaagucuuaaaaacaaauuagagauuuccugugguuucgugauuuaauucaaagucagaaucacaaguaggaguccauuagaaggaauuaguagcagaagcuguuccaguuaagucaaaguaaaccucauucuucuuuagagaacugggacuucaaggagacagaauauuccagaggcuaagcagucaucugcugcauuaucgguugaggaauucgugcauuuuguauauuucuggaaauagacgcaaaaaagaaagaaaaagccgcagccccuacacccgcuggaaaggggaaagauacggagaaagagaagaacacugcuaaacaccacuagagugggcacagaagcagccacucccacagccaucaucugcuuucaaacccgugucaacugcugaggaaacucaaaucggagaagucaagucaguuucaaaggucacaaggaaauggugggaccaagauucuaguuccuuuaccuccugcuaaaauuggagauuguguauacagagccagcugagugccuaagguccagccucacauaaaugcaucucgugugcuuaugaaauaguaugaccuccaguuucacaaagcacaaagcuuuggaagcacuuugucauuuuaguuaaguagaaguuucaauaguccuguaaaaaauguucaugaaaacucugccaguuugcuuucuguauuuggacuccaagcuagcugaucucggaagcaaauuacuuacacagcacuauugguagauucauuucagauggcaaacauaacuugagaguacagauguuguuuaugauuuauaggguuuauaaauaauguuaucagauugaaggauaucgcuucaaugugucacacagacauuuuauugaccaagaaaauagaaauacuucaccgcaaaggggcaauuugaaaagauaugauaagacaacagaaguagcaauaugguaauucagcuuagagaagaaacagauagguauugaacauuauauuaaaauguauuucccaaaauauguauaacuauuauguaucaguaaaaaauaauaaaauaaagcuauaguggacaaaccaugagguuuuagaaggcucacuccauuuucugucugagccaaaugugauuugaaaacagccaguggagaagcaaaaaaguccauuuucaugcaacuggcuugacugcuuuuuggaauugacuauauuuggucuaaaacugacuguuuucucauugaaugagccaacauucccaaggagcauuuaaaugaacuauaucgucacagcaugggaauggcugagcacugcaccaaggucuauuuucacuugauuauauguguauuuauuauguaaaaauagagcaaaauaugacucugccaagagacuccccuacauuauaguauaagcgugagcaaggauuucuuuaaauugaagagcuguaugcuugcuuuguuuucacagcugucagccuuuuuuuaugcugaaaaauuuuccccaauugguuguuauucaucauacuuauuauuuaggagaguugacugguagcaaaaugugcuuguuggcaacuccaaaagaggagguccucuacccugucaauuugugguggacgaaaucauucaaagacguuaaaaaaaaaaaauuacugggagaaugguccaaacacaggccagcuuuccucauauuuaaauggauagguuuucuuccuuugguugaagguuucuauaagaacuucuuucaucugggaccagaauauauggaugcaauacgaaaaucuccuaugaaaggacauucuugaaauguguccaacucuaaaagucucauugggaaucauauuuucaacuucaagcuauguaaaaugaaguuucaaagcuaccaucccuucacagauuguacacauaugcauaaacagagauagaagaaacuuuaucuccacuguagcaacugcaaacuagaagacauauuccucagaggcaaagaauguccauccuaaaacaggaacagaaugaagccacuuaagaaaauggucaauuauggaauguucugugcauaaguauguccauuaauuaagaaaugaacugaaauuacuaauggauuucauaauggccaccaaccagcugccaguuggcuguagcuuggugacagaugguagugacugaucuggacuagauuugaccuagagauaguccaucauuuauuaaauugcagucccaaauaaaauuccaugcauugcagcauuucaccauuaugucucacagugagauccucugagagcauuccuuaucugccgccacuguugcagacagcaaacuauucaaaaggcuuaaauauaacacucaguaaagaaaguucauaauaacucucaggagaugaaaaaaaaugcaacuugaaugacugucacuugaaugaggcauaguauaaaauggcagcucuguuucaugcuaaucugguuaccucccagcauugauauuuacaccuuccccuccuuuaaaaaaaagaaaaaucaaggggguucucauuuacacagcaacaggcagauaguggacuguuuggguucugcuuuaauccaucaacacauucucaaagugaagagagcugcuacagacuggcuccagaaccugcuuacuuaaggcuuuugcaugaacaggucacuggagugggcacaucaaaaguuccaauuaccaugaccagacucuguuuccucaauguuugaguauuucaaaaaauuaaccuuaugugcuuuuggaagauaaguuucauaaaaccaggaaaaauaaccugacucuuacaaauccagguagaaccuagaaauauaaagaaaaaauacagcucaguguuuuaaaaucuuccauguaacaugcuguaaagcuuucuucauguugucaaaacaccgugcaucuuuuagucucauucaaagaugauacguaagggaugcauuuuauuacaaaauauauacauucaaggagcaaaaacaugacacagaguggcaucuggccaucuaaaggcuauuauuuuacuuauuucuaagagacagaacacuguuauuaguaaacuucauauuuaacacauuacacuaaucuuauucuuaaaaacuucuuguuucagcuggaaagagucugacuaauacuguagucauucuuucucauacauguccacugaagggccccaaauaguagagaggagugaacagagauuccauauacauuuuggggaagagucuacagaggccucaccaugaauaaaaugucuuuguauucucaugcuucauucuaaaacuguucaaauuuugcauuugauauacagcaucuccauucuucucuggauuaaaauguuuaaaauuguuccauuauguaaaaguaauccaagaugcggcauuuuuaugccauaucuuugugaaccccuccauguccccuuguaccucuuaacauuuacgugccuuuugacaaauacagaucuaacacaaauuccuugguuaauagauaagaauacucaggaccaaggaguuugugacuuaaccaaggucaugugacucuaaaaucacaugagguuaagugacuuacccaaggucuggcaguggggggacuagaaucuagguuuaugacuuguaccagaauugcaugugcucccagccuggugugcugccucacgccuguaaucccagcacuuugggaggccgaggcagguggaucacuugagguuaggagaucgagaccagccuggccaacaugaucucuacuaaaaauacaaaaauuagccgggcguaguggcagacaccuguaaucccagcuacucaggaggcugaggcaggagaauugcuugaacccaggaaguggagguugcagugaaccgagaucgugccacugcaugccagccuggugacagugagacucugucucaaaaacaaaacaaaacagaauugugugugcucugccuacuaagugacgucucaccuaagcucuccgcacuccugucuuuucccuuaugcaccuuuauuucagcagcuucauugcuucucaccucaucucgcccaacagauucucaucuucaccccaguucucccucuguguggaaccacuucucaaccucauucugcuuuccauuuuucuguugugggcuuuugccugguuuucaguucugaaaaucuuuuuccugguuuucaguuuugcucuuccuaaguugguggcuugcagaagucccacagguuuuaagguccccuggcauguggcucuccggggcuggcuccagcuagguauaaugccaaagaauccaaugugggaacaacaagcucaacugaaagucccugagggagaccauggucagggguggaaagcugaugugaugcauacaccagcagcuaggaaagcaggagauuuaaagaauaaucacaauacauuagagaugauuagagccuggaacagaaugugaaaaagauuaggauacagaggacugaggaacagggaaaggaaaagaauggccagacaguuucagaaagaacagcaugugcaaaggccuauauaccagaaagcaggacacagucaaugcccugaaggaucaaagggguuucauagaaaagaugagcccagggagaauggcaggugccagaucacauauggcuccauaagcuaugucggggcaucgggcuuuaucuuaaggacaaugaagagauaugaaaaaguuuagacauagaauaacaugaugaaauuuguauuuuaggaauguuacauaagaaauuuccaaauuggccuuaauuccuuagggaaccauauucaguuaccuuuuuuaaguggucuacuuucauacuggcuuuuaaauuuuuauaucauauagucugugggaaaagauuauaaauaaauauuuguauaguaucugauauauaagaauuuguucccagaguuuguggcaauaguguggacacuggcucagacacaaguauguggaauccauuucaauaaguauuauuuaaaauauuaaaagugcuuuuucugaaaaaaagucaaugcaaaaucauuuuuaaauguuuacauauacaccuaaaucuccaaacugcugguaguaauauuaaauggaaggucaaaagcuauuuugcucccuuuuuauuggacuauuauuaaacagucagaaagccuagcaguucauuuaucagacaaaaaaaauguauaaauguuugacaaauaagccauagccaaaauguuaugacuuuauuugaauuacauuauauagacaaagcaugccaauccaucagccucaaguuacugcccuguuaccuauggaaacaguaagauauuuuccucguuacuuaauaauaccaaaucucaaauaaguaucacaacaugaaaaacagauguuaaaaugugacacucagggucagcuuacacugcauacuuguucauuuuuaagucccggguuucuucucaaacauuguuucugaaauuuuucacaagauuuuguuggauuugguugcagagguuagagucuuaauacacauaugagacacaaauagaaaacugauuuguuauuaaucaacacagcaauaaaaugggagaugcuaguuuuuauaucagaaugcuuauugcuuugcaugaaauaugauuugauacaaaugaccaaaaucaagagcacaguuucuauuuuuauuccaaaagcacuuucauuuguauucucccuuuacugugucaaucuuaucaguuuauuaaagacauaucuuucauuuaaaauagaaaauaacuuuucauuauugugcuauuauagauaauuuuuaaaaacuaaaauaugugaauaaagaagaagaggagaauauacuucucauuauguaccauuuucaguaacuaccucuaauauaaauuuaguuccaaauauuuuuuucuauguauuuauaucuauauaucuauaacuaugucuauggauauuuucuuagaaaaaauccuggaaccaaacgaugcagugaagaucuucccaugccaauuacuauucaucuacagcguuauuuguaaauaucaagggcagugcccugacauagauaugcuauaauuuauucaacuaaucacugauuucugugcguuuaaauuguucccaauauuucaguuuuauaaauauugagacagccaaaugccuacacagauaaaaagggguccccagagaaucuccaaccuuccccacaaguguuuacaucagaagcuuuugugcaaaugagggaaccugcccagggcuugucugggcaugcccacaguggacuggagcccgacaugugcccugggggaaauggguggggccacggggaguucacgccuugugcacgggaggagcuugcugucuucagcuccuguggugaccugggauucaaucugugagucagaaaagcugcuagcagggcucucucuugcuuugguucguuuuccuuuuuccccuucgcccaauaaauuccauuuuccucacccuucuauguguccgcgagccuaaucuuuccuggucgugugacaagagccugcuuuuagcugaacuaaggagaaaguucugcaacaauauuaucgcagugaacaaauauguagcuuaaucuuucuauguauucuugauuauuuccucagcauacauucaagaaauaaauuuugugucaaaagggugcauauuuuaaacuuucugguauauaacugcuaaaauauuguauaaaauuacauucccaguagaggugagcagaugacauuuuucuaucauauugguuuuuuuuucuaguuuucuacuauacuuuguugaucccaaaaggcacauuuuucuuucgcauuuuaacaucuuuaaaaucuaguuauauauuacaauucaugguauaucacaguuagacuaguggcauuuuuucuuucucauugauacuuauaauguugcaucauucaauccauaucugaaaucuauaaaauauauuaucugcguuuauauacugugguuguguuuaguagauacagagaaguuuuaguauuuacauagugagcugcuuucuucauuggcuucauguccaugauuucucugauuuucugugauaaacgcuuaccuuaguuuucuauuauuauauauuaaauugaaauauuuaauaaaaguaaucucaaaaauuacucuuuucacaaaugauuagccaauuacccuagugauauuuauugaauaguucuuuugugcucacauauuuaaagcuuauucuauuuaaauauuacuaaucccuuuaaacacaacaagcauuuaauagauaaccauugauucauuaauuaaauuuguuaaacagaaguagacuuuggaaugaguuaaaguuuugaaguaacuguuuggaccuucugcagagaugacaguuguacagguuaaacaucaaucagccauuugggcucccugacuuauuacugcucagucacauuauauguaauaggauccagcaaauugaaaccuaguauuucuucacugcugaugaccacucuucugaccugauggaaucagggaggaaggaggauugugcagggcaggaaaaccucccugcuucaguauucaacagaauuccacaggaauuuacuggcagcucaccagggucaagcaauauguuaaagucaggaacauguuccccacccagcucaucaauugaguucacaaguuccucuuauaaugcccaaauccagcaauacacucaccuaccacuuaauaagcggcuugucugugcuuagcacuaaagacaggagagaaauaggaaaaugucucugacuucagaacgccagcuagugaggaagaaagauaagucaauaacaagcgcuacaaaaugcaauccuuacuuuccugauggagaggagggugcaacaggagaacaaagaagaaaacuaugguccaagaggaaacaggggagggcgaaaaaccacaggaaagugguaugugaagaaucacuuggcugauacagaguuggggguacagggacugggaacagcuuaacaagcauauggcaggagaugugagggaggaugucaaaagacaagucugggaaaacagaaaaggaaucagaagauaggaagaggagguggaauccggacucagcaacugauugaauaugcagguaaagacagggagaagucugggaugauucuuccuuuuguagcuuuuauguuugguagaugcucgugcccauccacugagauagaaaacacaugagggggggcaaagguaagcucaguuuuagacacauugagcucuuuuguuuguuuguuuuauggaaaaugagggcaacugauggauggagcaugcuuugggugacauuccuuccauccuguaguggaagacacuggguuccugaagggagggagaugggauuggaugccagggaacaggagaugggacuuuaagaagacagcggaggcaggcuagauguucuucugcaauuguauagaugaggucacagcagcaaaacuucccaucccaccccgcaucaauaccuuugcuguguuugcugcacugaccauaacugcucauucccuguuguguaacugaaaugaauagaucguucaagaaugcccuaucuguacaaauuuggucuauuuuaagaacaaaggagagaguuuauuuuuuuuuauguuucaguggaauuaaaagugugauuuuuauaauccaagucacacccuuacaauuuuuuuuuuccauacacaaccuuaacuccuggcaaguggaaggcagagaagccacauucacucuguguacugaccugugauuugccgcugaguuuuaggaacaugauagaacuucaguaugaauuacauauuucuacauuuaaacagggucagaaguggcacuacccagugugggaguuuagacugauuaauugccuucacggaaggagaaaaguauggcuaggaacugugcaaguauuauuguuucauccacauauuauuuccauguauucucuuguacaguuugacuuggcuagcaugcaagaaguuucuagcuuuuccaggguauuacaaucagcuuuaaaaaugucuagaguuaaauuugcuucugagaaaaacuauuugugacuuaauugauaaaagccagugugaacucuauuauugaagaccuaugcaguuauguaauaauuuccuuaaauaauggagaagaucuuaaaaaagaaaaacaaauaaaacccacacaagcacaugguuuucauuuggggaguaagggcuggagagaggcucugcucugagguuaacuucauggcuucaggcaaaacuaggagauuuaaacagaaacuacagcagaaccauagcucucuuuuuagggacacuuaaauaaguauaugacaaaucucagagaaucuuuugaauuugggugggggaugaguaguuauguuccuuuuguuucuauuuuuuugauuuguuuucuuuuuuuguuuguuuuuuugagagagucuggcucugucccccaggcuagaacgcagaggcacaaucucugcuaaaugcaacccgccuccugaguucaagcaauucuccugccucagccucccaaguagcugagauuacaggcgcucaccaacacaccuggcuaauuuuuguauuuuuaguagagacaggguuucaucauguugggcaggcuggucucaggcuccuaaccucaagugauccuccugccuuggccucccaaagugcugggauuacaggcaugagccacugcacccggccuuguuuuguuuucaaugauuaauauuagcuaauuaauguucucauggaaacugacauaaaguuuaaaauguuucuuaauuuaauaacuucagaugguuuucuacaugggaaauggaaguuagauaccaaaugauguccccuaaugugguuaaaaugccucuuuuccaaaaggguuaagagaauauggagaaaaguuuaugcaugaugugauggggagcauugggagagggacaggagaggguagggacuggagagaaacagaaggaauaauccaaacaauuuucuacacaacugauaauucccagacaaacacucaaauugaccacagcuagauguguaagugcagagaaggauuugcacaugcuacagaauaugaagauggaauuacauccaccucuguugugguuaaggcccaaagguuaaacacaaauuuacagguggcugugauucuagaaugccuugguaggacuugcaaggcaguggugaaaacugguuuuuaacccuuaauucaacaucuaccuaauagguauaaaauuauuggaauacaguggcauuucuugugauaacacccugaccauggauguacaaaggaacugcuucuuccugcccucaagcuuaaucaaagaggccugcagaagauaaccaagaaaagaugggaggguuaucauaccuacaggacuuagaaggggcuaaggaaaugcucggaggccaggcacaggagaggcacugucugagcccagagcccugcaggaggacuuucugaguggaagaagaacaaaacugcccuuucugggagagggucagccugcagcagucuccaccccagagaaggucuacaccagacuacacagugccagucaggggaggcuucuccuguccuugcaucuacucugcugugucccuuuccugacagguaacuggggccaggggugcaggacaagugaggaaacggaacagaagccaaccgcacccccuccuccucccuucauuaaagaccucugaauugaagugggccauugauggaaaaaaauagaggcuuucauucuaaaguaguucagagauuuugcuauuccaccaugugaauguaagaaauacauuuuagacaagucuugugacugaaagggauguggaagacguuuuacuaucaagucacugaaaaaguucugggaugggcccaagguccagaggcaguaaaaucuaaagguuucaaaagaauaaaauaauggcagcgcacucugaagucugcucccuaaguuuaacucuauggagaugugaggccugcaugugccaaagggcccccuguggccucagguaagagacuccauccucuucugagguauauucagaggcugaauguugaaauguuggauucgacaucccuuucuggaaagauagcaauuaacugguaguucuaagaaauacuuuaaaagaaacaaauauauuuccauuuuauuuggccagcauuucaaguaaaagcugcauacucaagacaaauuuuauauaauccuaaacucuuuuucucuacagaggcaaucaguaguuuuccuuccauacugcauuauguuccaggagguuugcacaacaucccauaacaaauuauggugaaaaaucaacuuucaugugaaacauauaaugugagauauaugcugcuuuccaguucugccugaugcaacaacacaauaugcuuuauuuggcuagaaaauacagcugaaucuguucuuauagaauuacuugugguuaagaggagguagguuauauuuuucuaucagaucucaccuaucaacuucucuguuagcguugcuccuuuaacaaacaccauuccuaaaaguuacaagaugaauguuuaguaauccauacaaauaauuugaauauucagacauggaucuaucauucauaaccccuauuuaccaagcaaagaagcugcagucuacauacuauagaaggcaacaaagucaaagucaguuucaagugccagcuguuauggcugggccgccuucuaagucagcuaggcuugcggagccgcaguuuccucaucuuugaugcggaccucacuuccagagccaugggaagaacugaaugagagugaggaugugaacaccucugccacgcuguuaagugcuaccuaagcgcaggccagucauccagucauccuguucuguacaugucaaggcaugagccacuccagggaacucaaagacccaugagacuggauacugugcucagaguuuacaaaccuaaaaucuaguugaagauacacagaaacauuuuaucaaugacuucaaauauaaacagaauucacaaaacaguauaaauucaaugagugacuccaacaguuagugauaagguuccauagggagcagcgaacucugcgggcagcagcgcugaaguuucaaaagauggaggaauggaggucuauggggaggacuggauaggaaagagaaauggguauggcaguuuuuaauacagaaguugcaaacuaacgucuccauuaucaaauuucacaacaaaauccugauuuccagcuuuucuuuuucuuucuuuuuuuuuagauagagucuugcucugucacacaggcuggaguacaguggugggaucucggcucacugcaaccucugccucaagugauucuccugcuucagccucccaagcagcugggacuacaggugugcgccaccaugcccaccuaauuuuuguauuuuuaguacagacaggguuucaccauauuggccaggcaggucucgaauuccugaccuugugauccacccaccucagcgucccaaagugcugggauuacaggcaugggccaccgcgcccagccuccagcuuuucuuuuaacaccaggggcugggucggaguugcucucugaagaaaaguuguccucucuugggcagcgcaguggucacuucuccugaguuucucacacccguuggccuucacuuacugcuguucccugcccagcccugguaggcauuugagauugcucaucucugauuuagaaguuucauuaaccuuguuaaacagugcuccagaccuaaguguauaucaaccaacucaggcaacgacacuguacucccaauuccuuccuuuaccccaguccacuggcagcagcuuauccuguaacaccuuaacggcugcauuucacacucuaaacacagagaacauacaggcaaaccuugaguuuauuuuagauggcaucuuuucaaauaaaaacuccucaagguaauuuucuuaaauuaagaucccaugggaaaaaauaaauuaaccaauaauaaaaccucugaugagcccugggguugaucuuucaguaaguggauaauuauuugcugggcucuccacucaaauaaaauuaucuaguuguagcaucucuuuuuuuccuagacuaguuauuaaugugauuauaaaguuuuucucauuuguuuuucuuuagguaugauuuuagaaaucucucucucuccugcuugcacacacacagacacacacaucuuuaaaacuacccuuuuuaugaagaucuagaggagugagaaugaaggaggaggaaguggaugaaaaacuccaaagauaaguucucugggguaaaacauuaacagccuuaccacccucagugccccuuacucaccaucuauaaaacagaggcugggguuguaucuauauuauuuccacaaacugagauggaucacaaauaauuuguuccuaauacuuguagaauaaaaauuuacaaauggcuucucaguaaguaaaagcaacuucaagguugugucuguagaaauguaucuccucuguguugcguucuacagcauuuucuagaaugagagagaaagaggugguccgccguauaguuaacaugcagagaauguuucauaacccagagauagaugcagucaguacagugaagacugggaauuuugaaaagaggagcaauaucuaggaauucuuuuuuaggaaguuagcugggugcugucccuaguuuauguacagcccuguccuuuccucaagaaaauuucaguaaagaucuauguugcuuccaaugcuguuuaggguaaaauuuguguuucuuuugucugagaaugucuucaaggcaaucuucaguaugcuauaaccagugguucuugaaguugguuccuaaccccugacuagcagcagcagcaccugggaauuuauugaaauuaaucuuugagcuucaccccagaucugucagaaauuccggcagugaagccccacaauauguauguaguuuaagucacccuccaagugauucugaaacugaaguuugagaacugcgguuaucaccuauagugaguaaccacuacggagaaaccaucuguaguagaggcuguuggugccacccauucagaucuuccugaccagccaaugcacuuguacucuggcugcuuggaggaauacagcugaggaaacguuuacaccuguguccuucuccaguuacuucuccaugcuaggcagaacaaggagagaugccugggaagccaccuacccacaacccuggguuggcaaugacauaagguucuuaagccugaacuccuugcagggcaauacagcccugugagccuggggaccagaccaaggcuagacuuugccuaagaccauauccuuguagauccuccuccuuuucuaucuugcucuccucacucucuuacaggauuuuccuaaagacugcucccucauuaaauccugugcacaugaauccacuuucuagggaaauaggcuaagacaugacuaauuguuguguaauuacuuacgaaacuuuucuuagcgugauaauggauggggcuaguuauuguuugguggggaagaguuaacacaugugggaauacccauaggagucuuaucaaaagggcaucaaacaacauugugugcucuugcacugcuaaaauaaagguugaaaacugguggaucacaugaucccuagugacucuucuaaaauuuaugucaucauaauuccugacagugaauaagagauacuuauuguacaauuuugugauaggaaguuccaagagaggcaaguacucauguuuacuaacaaaauaauucauugaacaaauguuuacugcuccucuauguucuaggcacugggaccucuaugguaaacucuacaggcaaagccucuacccucaaggaacuuccaucuugaugacagagacuggcaauaaacagaugaauacauguaaucugauauagagaggugagaaauacuauggaccagaagaaagaagcggaagggaauagagcaugauaacuggggguggggguuggggagugcauugaagaggugauauuugagcaagcagugacugcaguaaggaaagcuaugaggauaucuagagugcucaggcggaagcaacagcaaguauaaagaccugaggcagggguuugcucagcaagggagucaguggcaggagaugaguucaggauguagccaggccccugaucacauaggugcuugcaggucccauauucacaagaagaacaugaugugaucggaaggccuccaagggcucugagcaggugguggcaugauugagcuaauguagauagggcaagagaagcagggaccacagauaaaaggagagagcaguaggcuaggugagaaugaaacaaacacuaacggcuuccagaaaaguuuauugaccuauuccuuuacuuccuucauccacuaagagcucugacaggcccugcaggauguacacacucuacauacucaaugcaauucuccuuuccuuuuugcuuuaucacaaccuggaaugaagggcaucaagucucagacauccagacugagguaaguauaggacaccauuaaagcacagaguacccaggaaguguuucaguccugguacccaauguugacguuaguacugaaauacuucaauaguacuaauauaucucucugcuuccugucacuuuaaauggugcuguggagacauggcaaguauccuugagaccacauucuauuccugaagcugaaaggugaggaaugacuuaucucuauuucauuuuauucaaaguauauaaauauuauuaaauaauaccacaaagaaagauuguauaucauuucugcuaacagcuaaaaaucuguaauucauuucuucucccaaagcuccuauucauugcuaaaauuuuauuguauuuucuaaaugcacagaaaaagauauuuccauuaugauuuauauuacaaccaaguuuuaacaaaagaagucaauucuuugguaagaaacaaaaauccaccagaucuacuuagaaacaauauuuaaggcuuacauccauggagauuccuuuuuuaaaugaaauucaauuuucccauuuguaaguuuccugauguugaugguugugguauaugugccuguggucaagugguuuagggaaaguggguuauuggaagauuguaggugcugguuuuaaaauuaaaccugaaucuuucacaugccuuaaggaucauauccaaaaaacauuuguguuccauaggaccaaagguacuaucucaccacuaaaaugcaaagagccagaagucuauuuauacauucuccaugauuuguuucccagauuuagcuuucuacaagcacuuccuucagggaaacacacacuuuuccucucuugcagcccaauuuccuguaggagugccucuuuaggaaaugauaaucacagcaucauucuuguguuauaugaugacaacuuagaagaaaaacacgcauauacauucauucaaaacaccuuccgaaacaaaugaggaugaagcaaagaaaggagacgaagaaaacguucucuuugcccaaacaguucugccuuuuuaaaaaaaaaaaaaaaaaguagauuuugcagcauuuucuuagcuuacacugaaaauucaaaucuauaccccucauuuaaaggcagguucuucuuuuaguguuagguguaaauucauguaaucugagucacuauucgaguucaguccaaacaguucuaccuugggcaauuauaggauauccagguauccgaggaagcugcuaggacaugcuaacacagagaugcucuuguuccaagagugaggguggacaaugaggguggguaguucucuacuuagccgaacugugucaugaccacaaucuuugugaagacucuuuuaaggagcaggacugcucauccugagcaaagugagagucugggaacuaugcucagaagaaaagaaaaaaggaggcagccagauuauauaaccuagccuucuaaaugcaaagccagcacacaaagcuaucucaaaauuuuuugucaaugcuaugguuucuucuagauccagacucagcaaggucucuagagauagcugcucgcuggaaguggugcugggaacaaggcuggcuguccccacaccagagcagccucuagaaaguugcugaauggauguuacugcccaccaaagaagccacugccaugagaaacaucacccagagaggaagauguuuccacuuauuauaaucaaguccaugcucuaaccucacaaugaccacauuucccaaauucgaagacucuuaucaugcugacuuuucucuucuuuuuuuugagacagagucucgcucugucgcucagguuggagugcagugccacaaucuuggcucacugcaaccucugccuccuggguucaaacgauucuccugccuagccacccgaguagaugggacuacaggugugcaccaccacucccggcuaauuuuuguauuuuuaguagagacaggguuuugccauguuggccaggcuggucucgaacuccuggccucaagugauccaccugccucggccucccaaaguauugggauuacaggcaugagccacugcgcccagccacuccauaaugacuuuuccagaaggauaagaaucacuaucaugauugaagacacauacugauauaaaugucuuuaaauauaaauuaaaauauauguaccauagaauaaaggaaaugcuguauuauuagaaauauuaaugaucauauaaauacuagacaaugcugagcccuuccuaggccauauauuuaaagguaugaucucauguagucuucauaaaaaucacaugccucugaagcagauagaguuuuucucauuuuauagaugauggacacuaaggccaaagaaaaauuaaggaaauuaagaaaagugagggaacccgguuuuauggcucugaacucaugcccuuuguaccacaccaguccccucugaguuucugagauaugccaccauggaaaggagccgccagggugcagaagauggugcuguuuucccuguugucccaguaaaauccagggauaaaugucaaggaaaaaggcaauaauuuggcaccagcagcacaguuaagugguccgagaccuugcuucaagcucuauagcuucugauggcauaaaaauuaaauauuacuucuggcaugacccaaauuuuaggaugaaauguaguggaucagaaggagcaauggcucuggggucugaaagauauaggauuuguaauaguguuaugcugggauaaaagggugaaauuucuagucagugucaaaaaugggauuuguaaaacaaauggugcugagaaaauuggaaauuagaaaauagaaucacugcuucucaauaacaccaaaauaaauuccagaugaaccaaaaaauugugaauaaaaaucaaagcauaaagaucuuugugguaauggaacaguuuuaccucuugauugugguguucauuaucuaaaucuaccugggaugaaauggcaugacauaauacauauacauuauaccaaugucaauuucugguuuugauauugcacuauaauuauguaagacauuaccauuggguacacaggacuucuccacaugauuuuugcaacuuccugcaaaccuauaauuaucucaaaaauaaaaacucaaaauaaauuuuaaauaaaagcauaaaagaaauagaaugaaguaaaaaacagcugaacuuggugugggcaaggaagaauccuuuuuuaaaaaagaacugauaaacgacuauaaaaauugaaaauuucugaauguacaaaaauauaaaauuaaaaggcaaauauuaagauuuuucagcauaucugacaaaugaggagucagaagucuuaauaugucauuuacauagugguugaaagugugaacagacagcuuggccaaaaaccaugacuccacuacuucauagcuacacggcuuugagaaaguuuccucacugaguuucagcuuuaccgucugugaaacgaggauagcaguaccuucuucaaugaauuguucuguggguaaauaaguuaauaugauguaacguaaagcccuuagaagaguaucuggaacacaguguuaguuggguuaguuguugucaucguuguuauucuuauuauaauucaauacaaaaacgacaaaaccuucccuaacaucaggcucucagguauguggaagcuggcuggggaaaacucauccuuggacagauugcccugugccaagcuguaacauaaugauacccucaugcugggucaggucuggccauugacccugacagcugauaauccauguuaugcuaugugaccucuaccccuguggucaccuguuagcuggaacuccuugcucuuuccaauaccccuaccucccugacuacucacccccaccucccuucuaauaugggucuuauuguccacuugguuagguaauggcgugcuuguaagagcccccuugugacagcaucugguguugucaucugcauacucccacagauuacugcugauaauccucacaaaauccuuguggguagauauccccacuuacagaugaagagaagugaacucaguaaagucagugacuuucccaagaucacacagccagcaaguaauaguuccuauucucaaagccaauuuuucugaauuaaaagccaaggcugcaaguuuccagagugaugggaaacucccauauuaugggcaucaucuaaacuaagagauucacaauaagaaucucuagggcucuagagggagcuuuuggacaccuuguugucaggacaaguuuuacuuuucucuucuugauucucgucaguguuccagaaaggaggauccaccguacaagucuccuccggucaggucagcugcuccuauaguuagaccacgcuaggcaugagcacacauugcuuuugucagaccuuuaguggcuuuagagcuccuucucuucgaauggacuggaggcucauagaacauggggaccacauguugcuauuauuugguauccacucacaacaauuaacacaguggucuguacuuucuaauccuuggcccccaaacuugaagcacugcaugaagaaggcagagauagcccauguuucuguuugagaaggucuuguauauaugcccaucuuugaccaucugggauuauaaguauagaaacuugaguaucaauaucaggaaauguauuugauuuauugcuagcucuuaaaaaucacuauucacugugaaugugggcaagugauuaagcuuuacuggaucucuuuucccacacugugaaaggaguuuaucacuuuucagcaaaacuacucuaaaagauaguaccuccaaucuuccagucuccaaagaaguuugaguauguauauauagagagguuagaggaggugaccuucacaaaggacucaagaaucacauucuguggggaugcugugggucaauucagagcuucaccugugcugagaucuccaggaaaaaucuguucaaaagaaccauggucaaucggacccuggcaaggaccccgaccaccaccuauaaagaggacaggcugucgagaccagccugaccaacauggagaaaccccaucuuuacuaaaaauacaaaauuagccgggcaugguggcacacgccugugaucccagcuacucgggaggcugaggcaggagaaucacuugaacccgagaggcggaguuugcagugagcugagaucgcgcccuggcacuccagccugggcaacaagagugagacucugucucaaaaaaaaaaaaaaaaaaaagcuaggcugaaacacacacagacacagaaggcaaauuucuccuguuauaacaguccauguagauagcauuuagaugcuuuuccuuggaauaacaaaggugaggcaggacugguauaacaguucugucacauauaaaaacagaacccaaauauucuugcacgcuuugugggcugauuugagaguuacguaguuuugggcuauaaaagaauuccauguuuagcugugguuauaggugaggggcccaugggaugagaaacuagcccaggaaaugcauuucagugaucuuucauugagcuggaaauccugcacugacacuugcaggacauuaaaagaacaccuuguuacauaguucucucaacccccaaaacauggagccgacucauauugauggaucacuaugaaacugaaaguagcuuuacaguaggucgaccccuaaagcagagaagcuuaaagugaaguggacucaaugcuuuuaaaaugcacauaaaucuaacauaccaauaccauaugcucaaaacaucauugcugagcacacgaaggaggaaaaggcagauggaugcccauaguccaagaagcagagaagguaauuuguggcuguuagagguaaugaauaaugauuuaacuugguuuucuugacuuugguauuuuuuacagaaaaagucacaugaaaauguguauuuuucacucuauuauuucccucaccuggaacagugccaaguuucuuucacauuaggagaaauccuuugacacagugagagguuagaaacuagauuuuaaauuucuuuuaaacuuguucuagcagcuggccugcccauccaguacaaauugugagauuuggaagaaguuugaucauugguaacuaucucucuaucaccacuuagauaaucugaggaaggucuggcugccuucaaacacccugccucaggcagaguucagguuuuugguggcuuugaggguuauuuuaggaagguaaucuuuggcggggcuuacagaaaaggcuaaugacaaagugagaguugaauccugugaugauguaacccagguggauugcgcaguaaucugugaguuucuuaugcauuucuacagcuuuccuuugacauaugugugacagcaaagggacagaaccauggccuuggagcaaaccagggucuccuaaucugaggcuaaguuuuuagagcauaucucuccuucacucacugucuggcucuaggccacauaagaacuucuuccccaacucaguuuccuuaguugaaaguaggaggaagcccccacguaccuacuucacagagcuuuccagugaaguuuagcaauuggggauggcagagcauguuacaauuuuagaacugcucuagagauucaacagugaaaauacacuagcuaauuaaacaaaauuugguagaaaggagaauuggaaauucaccuucuaucagugcccgaauggcuguggaugaacaauuccuuuaacuacuauguauuucucuaguucccacauaaacucugucauuucccaugggaucgccuggaaaauacuaugcauauacccagcauaucaucguuuguugggacaccuagcagcuaccucugaaaggagagggcugguccuggaagcagccagauggcccugaagagguagcuuugguccucaggccucccagugcuguaggagcgaagcugacgcccacagggccucugaacacuggaauggcggaugagcucagcucucugaaguggcugccguggcugagauaggagugcccugccacacacacuuccuagaggacaaguucagccaaagccacauuaaaagaugguugcuuaauguuggcagaacuuuuuaggaggcaucaaaugagagugugugggagggggagugggcaucagugucauaaaaugacgaagcccaacaaacguuuccugucuucacauuuaaaaucucuggagggggaggaagccagccucagaggccuggggcuuuccugaagaaacuauaaaaggaaagaaugauaaaaggagccaggguuucagcaggaccacuaccaagcaaaacaaagagcagaggaaagaagauccccucucaacuccaacccuugcuuguaauuuucagaauggauuggcuacaggaagcuacuuacaagagaggggagguuugguuuugguucugcgguggcucuucucuccucagugagugacugugggucgcaucuagucuccucuuacucccacaauauagauacauuuaagaagucaaacaagaaucaguggcugcuuuuugcaccacacaccgccuacuggccucuaacaaaauacacuaccugcucagaaaguaucccuugccaccugaacucaugcuguuggaaauuaggaaaagaacagguuugaacagcagcugauacuuagauauaaaaccaccgacauggucaauaaauauguuucuucauuuuccaggacagggaaaagucaugcagcauuuccucugacauuugucaauuuucagucacaacaaaaauacaaauaauugauuugaaagcagagcaaaugaaauauuguucaaaauaaacagcguuguugcccuauuucuuucugguuuccaagucacucaaacaagaguauauuggggagguuucccacuacagaguccaugaauaaauucaaugcuuagauuucucauuucaugaucacuuaaaucuuacaauguaagauuucaugcaagcaaggccuggacagacccaugucuuaggaagaagcuaaguucuccugaaugcuugagggaucuccaguccuaagaugggacuggagauguaaaggcaggcccacucaguuaauguaugcuccacugcacaauuuaaaacacaggguguaaggcaguuuuucaaagagguuccaagcaucuuaagagucccagaaauuguauuugacucaugaaauuuagaauucuccacccacacuuaucaaugucaucuuccuccuuguccuuguuccacccuccucuguaaaucaagagacacaugcagcugccuacagcaaccaaaagauuucuccaauaaagcaaauucuacuaaaaggggaaaaaaguuucaggaaggcucacagagauuaaggguuaaaccaaauagccuggguucugauucugaugcugccaacaaugaaauaauuaauggcauuuauuuauuuuuuaacuuauuuuauacuuuauuuuauuuuuuugagauggagucucgcucugucacccaggcuggaguguaguggcucacugcagccuccaccucccggguucaagcaauccucgugccucagccuccugaguagcugggauuacagaugugcaccaccaggcucggcucauuuuuguauuuuuaguagagaugagguuucaccguauugaccaggcuggucuugaacuccuggccucaagcgauccgcccaccucagccucccaaagugcugggauuacaggcguaagccacugugaggggccuuaacagcauuuaaacacccuuuauauauuucaaauucauuagcauuaugcaauucauucaaccuuuacaacauaccucugcaggacacggggagacucaucacccuuaguuuacaaaugagcaagccaacucuagggugggucuguauaaccuggcagcauucucacucaguguccacugccauguggccugagcucccuuucuucucacguccccaccuugucccaucugcacacacaaaccuacucgcucuccaccucugugccccuuagcagcuuguuucaacauacugugagcugcaucccaguuauugauauauuucucaguguccccaaaggcuagaaaccucacugagggcaagcaucacaggagccccaucuuugauagccugaggacauguugccauaucuugaaugcaguaugugcuccauaaauauuuggcacauugaaccaaacugcauuaaucucauaugaaaucgaaaaccaggugaauucugugccucccccacccuguaaccucuuguucccaacccugacucccaccuaucaaaaccuacucccagaucuuucaaacacauaaaagacugugugauugauagaaacuuaaaauguuacucaucacaguagguaauaaacuugaaucuaaauggauguggcucuaauuucugguauagcccgaaagucuuggaaugaucugggaaugucagggccuuuucagcagaccagaaaucacauuuagaacccacuggcccuugagccuauaccaaaaucgcaggcauccacagucacccaccucacuucucaucuaugaguugaaaaguaugagucauaaacuguuggaaguauuuuuaacucacgaauuauguggauaguaaaauguaaugcuucaacccuaacuggauacgaagcccaaucuuagcaaccaauuagacaaggcugacuuugaaaucaaagcaaaugaccaaaagaaaaaaguaagcuauuucaauagacuguguugauagccugauauguguaaguugaggcaucaguguagucuccacagcaaaugacaggguguggucgcuucuuccucuuggaugcugaccacaagaggaugucuaacccuaagggagacagcauccugaacuugcucucugcccugagccugcacuccaguuacacagggugaggauucugcauuccacccuugaagaguccugcaagucagggcaagcccccugucccuagcagccuccgucuuuuugaguuacacuuugggccacuaagucuggcccugccuaccucuucuggccucacccucccuaaccccucuaagagccuggauugaggccaccugagacauucaccugcauuaugcagauuacauagauaccaccuuuaccucuccaaaggccuucacauugcugucaccuggccaugccagccacuugcaggcugccaucuuaccaucucuccuccaucuccaggacuugcuugugcuauacuuugccugcagugcccaucugagcaucccacucauccuucaagauucagcucauuaaccuggaaagccuugacugacucuaccugucagaaugucuuccucucuguuuucgaaaaaucuugagcacauaucaagcacagcauguaucacaucaaauuggaaugucuguuaacuucucugcuggguauucucaaagguccugcacguggcuggcacauugcgagcacugagggggaaaaggcuuguuggcugucugacuagcugaaugauugagcaauaagguguaguaugagccaucaucucagaccacggugaaggaaaggccacaaaucuuugagaugucccuguucuccaguagcuaacacacugccugcuuggggcauguuaccagguaguuaaaugaaacugaaucacacaauucucaucuugaccaucuuuauucauucagccaucaacuuuuuugagauggagucucauucugucacccaggcuggagugcaguggcaugaccuuggcucacugcaaccuccgccucccggguucaagugagucuccugccucagccuccugaguagcuggaauuacaggcuccugccacaacaauuggcuaauuuuuguuauuuuuuuaguagagaugggguuucaccacguuggccaggcuggucucgaacuccugaccucaagugauccacccacuucagccucccaaagugcugggauuacaggcaugagccacugcaccuggcccagccaucaauuauugagcaucuacuacauaccuucauuucacugggcacugugaaagcaauaaaccagguaagucaagagucuagagucuaaagaaauaauagacuuauaaacagaaaagagucauagagaucggaauaaaaugccaaguacuuuuuguaggcaagauggggaagauuuaaacagggaguugaguuucaaguaagauuuugaauaaguauaugaauacacacuuuuuugagccuuuuugcuguguguguguguuacgugugagugugugugugugcaauugcuauccgcuacuaccauacuaugcacaaaguaccgcagugcaaauauuuaugcaaauguuaauuacacacuaauuacacacuauaaucuaaaacuucucuugguuauuuucugccaacacaauguccuuuggcaggucuuuaccauuuugguuguuucugggugacagcuguuuucauauuccacagacccuaguuugccuucccuaggcugcuuacucuccugaguccuggaaaucucucguguuaauuauuauuuuuuccagcugcagucauuguaaacuguagugugcuuuccccucauaguaauaaauauucauguauuuaugaaguaaugaagaaaaugucgcugagcaugaaagaguugaugucaacagucaggagagaaagagacacagaguuaaaaucuacuaacauucucaaacauuccuaguggcucaacugcuucggauggaagaggcugaaacuuggaguuuggagguucugauaaugacuacaggaugggcaggaaaacaaagauauaaauuuggcuaguuuuggcuuugggugucauuuccauuucaugacagcacaggggugagaagcauuuuggagcuucuucauauuauuuauuuaucccuuggagacuggcauagucuacucaccccaaacauaagauggggccuggguagugaugacuggaguugcaggcugcacagcuccauuaggaaaugaaaguuugcuugcaguagggucuccuaaucuggacuuuuaugccaagccucugaccucagaccuccauuaaaaggcaucuccuggcucagaaauggcuaggauaacggcacagguaucaguuuccuuuucuacaauucgugacugaugggugacugaggauuaauguaaaaucaguuuaagagugcuuugaaauauuaacagauaguugcuggacaugggugcauacaggugugcacacacaguauacauggcagauguccacuagacauaugcuauuagacagaaacgggaaaagaacuguaggauggguuggugguauacaguaguaaguagacaagcauuuucuaaucagaaaagccuuguagaacuaacucugccauuuaggaccuuagaaaagcuacucaaccucuccagaccucaguuucaucaucuccuuaacauaaugguucuuaacuccaugaaguucccuccuccagggacaucugauaagucuggagacauucugauugucacaaacuagagugaagggguuccuaccggcaucuagugaguagaggacagggaaacugauaaacauccuauagugcacaagacagcccccauaacgauuauucuuaacccaaaaugucaguagugccaacacuaaaaaauucugucuuaauggaauacuaauaauuguaccugucugaaaaaaagccuuuguagcucucaguaauauuugcuauuguaguuaugaucauugccauuacguuaucacauccugaaaaagaacucacauuaaaauuacaauauauuucuagggauugaauauuaaauucuccaagaaacauguuuguauuuuaauaaggguuugggcugggcgcagacucaugucuguaaucccaacacuuugggaggccgaggcaggcagaucacuugagcccaugagcucgagaccagccugggcaacauggcaaaaccucaucucuacaaaaaauacaaaaauuagccaggcaugguggcacgugccuguggucccagcuaugcaggagucugaggugggaggaucgcuugagcccagggagucaaagcugcagugagccaugaucgcaccacugcacuccagcaugagcagcagagacccugucucaaaauaaauaaauaaauaaauaaauaaauaaauaaauaaauaaauaaauaaaaauaaggguuuagguagauaacauuaaugaaauaaaugauuaaaauggugaaagucuaaggcaucuuaaggcaauucaguaucugggcuauuugggugcagauggcaauuguaauaccccucaacaaugccccauaagcacucauccuaaaaacaagauuuacaucauaaaacaaaggggauagcugcacaaaugugucugcucuucaagccaaagugacuacagcugagcaggucaccaagugauacuggucuauccaauccccccaaaacaucucuagccacuugguguaaauucuuucaguacuucuagaagaaagguagucauuucaucucagaaaguucagagccauuuccuagccaugaugucuuuuuaaaagagggaucugacuacugauggcaagaauuguuuuauaucuucuucaguuuguuuaacaggaaacaaacuguugaaaagaggacaaauuuguaucuuucucauugacuuaaccaggggcaaggcucuauuuagcaaccagcaagaacaauguagaaauuguucacuaacaacgugaaucacuuucagacaauccccacaaaaucugggauaaguuagguggaagagagauaaaugauaguauguggaaaauguuauuuaugaauguuaauaaaaauuucugcugcaaaggaaauacuagagacaaaacugaaaaggcucgacaucaagaauaaagcuuauuccaagcugauucugagaugcaaagaagcuaagggccagcucauuaagugccaaguucaagaaagggauggcagcccagagcuauagcuggagaaguuccucuccucaggguuuugccaggagccugcucacaugcuuugcaaaccaucacaguuauguuagggcagaccugacauccuugcugaacuuucuccaugucagcuuuucgcacaacggaaacaaguugguagguuuaggacuaaaggcaaucuuccucauucacacuuggggccuuugacagaaacuuucaaaacggaaaacgaaaauagaagccagucaaaaucaagaucucaaguuuuacaacaucuagagaucccuuuuaaggacaauagcugauaaaaccagaauaaacuugaacuucagugaaaaugcacuacaagaaauaucuagauacacauuggcugugcaauggauccugacaucuuuaauuuguuugaucugugggaauguuuuccaaaagaauggugagaacacagcaggacguuuuucugagggcgggacaguguuuugugagguugaaaugaaauuguuuuaaauuagugauugaaagaagugucuucccguagaacuuucccaggucauggaaauagcaaauauuuuaauuguguucauguaacuggauuagggaagaaauaaauaccagcuaaugcaccagugagguaaggugagcuuccaaaauucuaauacugaggaauacgcugaacaucagguugaaauaaaaagucaggcuuucuugacuggcugauauuuauuucaugauuauaucuuuuagcaaauauguccaggugauucaugcuccuucagaggcaguauagcacaguagccaaauaguguuaucucugaagccuaaaagccuggguucaaaucccagcucugaaacuagucaugugacuuuaggaaacuuacuuaaccucucuggcccucagcuucuucaucuguuaaauggggauaaugauggcacuaccuuauaugguuaccguuucaaaaauucaaugcaugaaugcauguaaagcauuuggaauagcaccugaaagugugcuauuaauucuaggucucaucucaucugcacacaggcccugugaguuaaguaccauccaucauucucauccacaaauaaggaaagggaggcuuugcuaggucaauuaacuuguccaaguucacacagcucauaagugguagagccaguacuugaaaaacuucuaucacgaguuaaagcccaggcucauaaucacucacaaaauaauguacugggggaaaugacugugaagagaagaguuggucuauuguacugcaggaaacaauggcuacuagggcggagauaaggcacauucuuaguuuaagaaguagcuccugaugacccuccaggagacauucacaacuccuuuccucucuccaaagcccguauaguagagaugaaguaauaugauuucaaagaugaccccuacuagcucagucaaacuaaacuucccuuaaacaggucauuuuccugacacuuagcacaaagcaugaauaucucaaagcuauucuucuuccccuuacucaaccaauucucaagaaugugucacucucaucacaacugugugucucauugguagaaugggaccaugaacccauuucagcuggcuucuaggugaaagaaaacaggccuagcagguucuugcugaguuuuuaaaugaaauuuagaauuggugcccgagcccuuucuguaucuauuuugcuucuggaauccucucuccaguacaacuaucccggugucccaggaagccaggcucuaugaacuguuccugaguuagccaaagugugugcugcaguaguauauucuacuccaucauuaaauuuuacagcucuaauuuucucauccaguuucaccuccaggaaggcucccauucucuuaauacacaguacgagacccuuugcaucuucacuggcuguaccacggaaguccaaaaaaucaggacugucaagcuuucaaauuuugcuucuguuguucuuacuuccuaaaccugaaguagcuucuucauuucccuauucuaugccccaauccauuguccucuuaaccuggcaaaguaauacccuuauucucaggggaagacuuaaaugucccaccuucacuguaguuuuuauagaaccgaguaucugcauucccugcaaaacagaauuguuaccuugucugcaccacucaguuguucaugauucccccuaaguaccacuacuauaccacuuauggcaauguaucaagcccuuucucugcucagcaucuagcauagccuugagacauaacagacacagaauaggguuuacugagacauuauuaacgagugacuaggauaggugaggcagaggugauacagcgaaacagcacaauuuuugguauuagagacaucuaguucaaauucuggcuuuaucaccuccuauggcaagaccuccaugaaccucuguuuaucuaugaaauagaucauuucaauaagaauccaaugagaaaggguuauaaauauuuuugcuacauggugagcacuuaacaaauuuuugugucucuugaaaucugcccacauuuucuucucuuuauauuccuccuuccccaaacuccaugccauuccucucccuagaaaagaagaaggcgguuguugaaacuuuagauaaaaaagaauucuaagacaaguuuuaggugaguucauccaagcagacucuaagaaagaaagacauccauuugacuuuccauuugacuugaauacuauaaaucugaugucaaaaaaguuucuaguaugaagauaaagauaggauucuuaagccaagacuuuaauaauuucuggcugccaucacugaguggauauagcaggcugucuugguuuggcuccauuaaacuuuugauauaucuagcguauaucuaacauauaucaaaaguuuauaucugauuccacucucaccagaaagcugggccugacuucugggaagaauuauugaucaugcugauuucaauucuuucuaaaccccaauagcuaugauagcucaugaucaguaagaaauauggcuucuggguaugauccagcugugaggagaaaaaguucugucuuauaucaguacuaaaggcaaaaaaaaaaaaaguuucucacauaaauuaaucaaguaguuuucaggagucuacacagucucauauacacuguagguucguaagagaaaauauugauugaccuugagcccaaaaaccauuucuugcaucuucaaguagagggccaggucacuccaggauuucaugcagcuccacuuguuuccuguuucuauagaauccgucuucauucuuugagauccuuaguucuccaacaguaggaagacccaauaucaguuuuuccugagucuuccuuuucuauuccagaggaaauaucagacagccaagugcaaaaggcccaaguauauuucguccagaugggcucuugccuuuuccucuggagaagaaccagaccuugagggugucugucagugacuucuaguuacaaccuuuagguccuccuaagauuucagcucaaauguuuauauggauggccaggugugguggcuccugccuauaucucagcacuuugggaggcugaggaguguggauggcuugagcccaggaauucaagaucaaacugggcaacauggugaaaccccguuucuacaaaaaaauacaaaaauuagucaggcagucaggcaucuuggcacgugccuguagucccagcuacucgggaggcugaggugggaagaucaucugagccgaggaggucagagguugcaguaagcugagauccagccacugcacuacagccugagcgacagaguuucaccuugucucaaaaaaaaaaaauuauagggaugaauugaucucucuauaucuugcuauuccauuaauaugacuuacagcaagaauuaugagaaaguaguuuuuaaauaauuaacauauuaagcauaauauaccuauuaauauaauuaauguauugggcaauaauuaacauaauuaggcauagggaagaaguaagugcuuacgaaagauaauauuugauuuauagaguacaucuaaagguagcuagaaggucuacuuaagguucuaaaacguuuuauaaauuguuuuuugagcagaagucuacucaugucacaaaaauauucuuaaucauauauauaaugauauugugaauacaacaacuuuaaggcaacagucccagacaaccaaauuguaaccauuauguuuaccaucuuggcccauaucccaagcuccacauguuuucggcauccuuuuuggacucaacaauaaggggcucaacuaugaagacuccuuuauguuacuauuacaaaugcaaagagaacaaauccauuuauguaaauaugaauuugaaauucuuuguaguauggugaccauaugcauggauucucagaaagcaaaagccaaauauuaauuucccauucuguggaaguacuuuagguuucugacauagggaacugauccuauuaagugguaauuuacaguggcuacuuguugcuuacauguggaaaauccauagggguaagucauaggaauuagggaagagaguacccugaguaaaauaauaugcacagcuaauccuuaugacucacucaauauccuucuccccaauccccccacccuucaauccauccaccccacccccugccacucaauuaagugaaacuguccagccaguuuggcugcuacaagaauuugaguuggagcaaacagacguggucuguuuauaagaaaugggccuuuagccaugguuucaucucauuugcaccaggauuccacuagaagauuuucuguguuggcuauaugaugcccuucauauagugugaaggaaguacaagucaggaaagaauuuuguccuuauggaagaucagcaggaguagaaagccucugucugaaaucugagaggauuauguuccacuaaaguugcuaaauauucucauuggaaaauuacccacgauaauccucuugaaagugacauucuaaacaaacuauggucuuucugcuuugcuuggaaaucuaugauuuucuuaaaaaauucagacauaaaaaagguaaaaaagauugccuuugugauauuuuuauuuuccccagaauuugggggcucauugcuugcuauccacuggacaccuaagucuucucuagaacaacaagaugucugcuccacccaaggcuaccuuuucuauuacuugacaggcuaaaaauuaguaaacacacaggcaaaaaugaagggcaaugugaauuggaacacguagugguuugcagcuuucugaacaugucuuaaccuacaagaagcuuuuaaagaaacuuuaaguugggucugccucagaaaaauaagucucuccuuuuccuuccuuccuugauaaacugaaccagcaauagucaauguaaaaccuaccauauuugcuccacuccacaguccuuuaaguuagccuuuacacacauccauuucuuuucagaauucaguagugugaugggguaaagauuuagaaucuguacucucuccaaaauuuuuuuuuaaaauaugaacagagaauuuaaauacuuaauuuuaccuacaaauaugcuacuuuuaauuuaauuuaguaauuuauaucaugugcuuguguaaauuauuuuuucuaacucaaaaagaauauaauuucaguacaagaaauguguaacaugcagagaaacauuuuucaaaaggggaaaguuagcccuaacuuuuacaccacaaucucauuccaaacacuauuaguguuaagacuugaguguauuuccuuugaaauuuuuuauuuuucauauugucuuuaauauaacagugaccaacaugugcuagaaauuuuguaacuuaucuucuuuuaaauauuauauauauauuuuaguggucugaugacaaaucuguaauucagauacaacugcuuagaggcuuugggaguuguuuuuaaauuuuuacuauuacaugguaucuuagcgacaaauauaauuucaagacaaauagaagugccauggcaacuauuccagugacuggguacaagacuuggauuguaauuucuuggggcaaacgugaauucagaagcaaaauuccuaucaugaaacaucucacuuuaaauuucugguaacagagacacccuuuucugaaugugcugauccaggaaucuguguaacagagaaagacugggucuccaauggcuucaacugcaacauugucacauggaagaaaguugaagcuguugggccaagacugauugugccauggcagucccgaggucucugcuuaucaaaggacuaauaauuacugaccauugcauuaagaauacuauugagauuauagauuuguauaagaguuuccaaauuaagucuuagcaucuugaauauucaauaaaaacuguugaaggaugaagaguuccaaauuaacaaacugcuuccaugguaaauaaacugguggcuaaaaauauuggggggcccuguaauuccaaauacacacaaaagaaauggacaaaaauaaauuaucuccaccauuuccaaguauagccaccgccucucugcuucaagcuugcucacucauagaaccuggaagccuucacagaagccuggugaaggaguuccuaagaagcuugccauaagucuucugaaguauguauggguguagguggcacaaauuaaaaauagaggcuagugcuugcuucucaucuagagauuacugaggaacugagaucuguuggaucagcucaugccaauaggacaugaaggggcuauaacgguaugguguuugugggaagaaaaauugcggguauaaccauuccaguucucuacgaaauuuugaggguggaaagaacucagugguuccucagcuccucauaaaggaacacagagguuggaggggauaugggagcuguggggccaccaaauggccauuagaaaaagguagaagggacuagaccaucaacuacugaugcagcuaaaaaauaauuaaucugccacucucugggagggagcuggaguaaaauugaaagucuccucaagaaaucacaacuacuacaucaacagaguccaccagugucagagaaaaggagacaaaacucaaaacaagaauuucugcuuaaaugucugcuuccucccuguccccuucugccaaugaagcuagcccuugcuuggagagugacaauuagaugugguagguugaacacaguguuuauuacucuucccucauaauucuccaccaaaaugacaguagagaauuuuuuuuucaagaacaaaccuagaagggcaaagagaagaggaguagaaacaacagaugaugauagaugguaacaacauuuuacaggcugaaaaugcaguggauaagcaguaaucaacuuagaagaugggaaaaaaaugaaauuguggguugggggugagggcagugagaaagaagccaguucaaacaugugaauccugggacuggaguaaccugaggaaggugggugugcaggguaacacugaaaacaugagcaucggcuuaaaguuuguaaauaggugauugccccucccccagcuucuagagguuuugaacauagaagcuguagauuuuguaacaccauccacagcugggaacaaaagugauauuccaugcagaaaaccagacaauuaacugaaaauucacaugccaaauuugacauucccuauccuccuucccugacugagcuccuagaacaaagacaaucagguuuaaaccccacaggcagagauguguagaguuucccucuagagaacugaacagaccaagagaauggauguguagaugcugauauuugggguccuucaaugaaaaagcccgcuuaccaucuuaucugcuuccacucaagaagcugucagucgucaaauccuacucacacauacaaagcucccagucagcuuaucaaugccacgcucugaaauaucaauaguuaaugcugucuuucugugugucaagcaccauucuaagcauauuuuaauuuuuaugcaaauuaacuucuuuauauauauagauuaauguuuuucauauauacacauaaacuuaauuaccacuuuauaccaguuuuagaaguaccauuacuauucucauuuuuucaguaaggaaaguaaaguacauaaaggucaaguaacuugcucaaggucacaagcuacuaaguaguauggccaguuucacagucuuuugguuuuuauccagagcucaugcuucuaaccuguacaucuuacugccucaaacaugacaaagugaagcaaaaaaagggaaacaauggaacaggaaaccaggaaccagaagaaaaguauaaccaacuguaccacauuuacucagguaaaauauuacaaucauaaaaaaauaaaaacaggaugcucuuucauucagagaacgagagugugaaugcagacaauuggauagaugagcuauaaaauagaauuacagaacuaaaagagauagaaaacuaggaugaucuaucuagaaaguaacaacagauugagcugugguaugaaauucucaaagaauuaauauaagaaaacuuccaaauugcuugaauuuuuuucaauagagauggggucuugcuauguuggccaggcuggucucaaacuucugaccucaagggaucuucccaccuugguugcacaaagugcugagauuacaggcaugcgccaugcgugcggccuaaaacuuauguguaaaugagucaaagaauaaccaacuagcacaagguuggacaaaagaucuacacuaaaacauauuacugagaaauagucaccagauauuaaaagauuauuuuuaaaguuucuagacgggaaaaaaauccacaaucaaaagaugaagaauuagaaugggaugaggcaugcaacagcaacucugaagguagaauaggacuggcaucuggccgauuaccaaucaaagauaaagaugggauaaagaugcaugcaaaaucuccacaaaauuauauccuauguaucuuuuuccaauaggaaaacaggguucuagaaaauggucccaaguugauggugagaggacaauucaggaagacagucaaacagcaacgucuauagagaauuaauccacaucagaagacaggauagagggcuccaagaggaauaucuuuagguagauuauaauuuguaaauuucuugauuuuuaaauauuguaucacacaguuuuacaacuccagcagagaauuuaggucugaauuacuagaacaaacacagaaaauuaagcaguguaugaaugaagucaaaauuguuaaauucaggaaaauacucauaagagccaggugugguggcucacaccuguaaucccagcacuuugggaggccaaggcagguggaccacuuaaggucaggaguuugagaccagccugaccaacaugguaaaacuccaucucuacugaaaaaaaauaaaaauaaaaaaauaaacacacacaaaaauuauccaggcacaauggcacaugccuguagucccagcuacuugggaggcuaagagaggagaauugcuugaacccaggaggcggagguugcagugagccaagaucacaccacugcacuccagccugggcaacacagcaggauucugucucaacaacaaaaacaaccacgaaaacucauaaaacacuaugugucucaaccaugagaaacauuuacauacucaugguaauguaaauauuagcuacuuauuuaaccaaaauagugauauaagauuauauugggaagggagagagagaagcagguugugaguuguguagaaaauggaacaagagagcuaaauccucauuguccauggaacagaauaaaugucuaaaauucaaaaaauauuaggaaaugguauuaacuguauuauuuagaaaccuagauauaauuagcugaauaaauaacuuucagaguuuuccagagacgagaaucugaagacgagagguggcacaagguuaugcuguuuuucauuauaaaucuauccauacuacuuguuucuucaaaccauauguaugaauuacuuugauuaaaauguuuuaaaaaauuacaaggaaggcuuuuuaaagagaggguagagucucagaaauggaaucuaaguaaaauggaaugccucuuugcaucucuguccauuaaacaacaccaugacuauggcagagagaauaauggcuccccaaagaugcuauguccuaaucccugaaaccugugauguaaaugaauaaguauggauguaauuaaggucacaaaccuugauauggagaaauuauccuggauuauccuuuccuggcugcaggaagugagauguaguaagagaagggcucaacucacccuugcugauccuugaagaugaaggaaggggccaugggccaaggaaugcagcaggcuuuggaagccagagacagcguucuauugacaaccagcaaagaaaacagagaccucagucauacaaccacaaggauuugaauucugccaguaacacacaugaucaaggaaauggcuuuucccccaaaaccuccagaaaggaauacaucugccagcaccuugauuuuagccuggugagaccuaugugagacuucugaccuacaaaacuguuagauaauacauuuguuuuguuuaaagccaugacauuucuggaacuuugugauggcaauaauagagaacuaauauagacugccaaaucccaagccauuucacgcaguuaccuacuuaagugacaacgucugagagugaauguugacacuuaauaugcucaauaaacacaugaacuuaaaauucacugcagagauugucucaucuucucaacauaauugacaagggucaacugagagucaagcaauggaguauccaucuugccaucacaggcugaucaguaguuuuuagcacagccaagaagucugaagauucccacagugggaaagggaacuucaaacaaccaaauuucuuccacguucuuccacuggagccauuucucaaauguguccaagccagugggauguguuuaugauggaauuuaaauauuuauaagcacccaagauaaaaaagcacaagcucagacuucagaagccugcccugaagaaaggaaggggguggucuugagcacagguggaaaaacuaaccuacucucacagcccucugagaagcgacauuugcagaaguuucagggcuacacaggcuuuaacaaaagauguuguccuucacuucaaccugacagccagcaaaucaggaaaaucgcccugaucacuuucuuaacuagaacaucaaagccucuuggaauuaauuaauaaagaauaacugagaaauugucuuuauuaaaauuucuauuuacagaaaaaagucagguuacuuuuuuuuuaagcagaaaagucaucuaaaguaaauuuuaaaaggauaauuuacugauauaaagugagaaaaguaaauugacaaauuaaaaaaaugcaaaggaauccuauuucacuacugacagggcacaaauuccaaaaguugugaaagaacagcaacaaaaauggaaguaaccuuuuccauguucacaauacauacugaccuuucauuuucaaacauaucuuuuccuuugggagacaccaaaaauguagaauggaaugagauaaauauaacuuagauccacauucacaaaacagaaaaagaauaaugacucuguucaagcuauguaaaucaaacaaaaacuuaacucuucuccuucuucccagagaaaguagguggauuuuuuugggggguggggaggggaugggagggagucaguuuucuaugaaaccuuaauagacauagaaaaaaaacaaaguguuuuucuuacucucacacaccaguaaauacaauacuucugacaccagaugugugaggauuucuccccauacaccaagcaaugaguucuccagcggacaucaacugagugcucuguaauucuacucagugcugacauuaucuaccuggagacagcagcagaucacacggauuaaagcucagucccacaauacugcuucccacuucagaugccagucacaagccccagguugugaccugugcuucugacugacuggcuauaaaucaagauuccuggucccccuucuuggguuugauuaauuugcuugagcagcucagagaagucugguaaauacugcucacauuuacuguuuauuacaaaggauacuacaaaggauacaaaugagcagccagaugaaagagauguauaggguggggaaugggagaagggacacagagcuuccaugcccuuuccaggcugagauggagcagggaccccucuuuuagcaggcuguggggaaccccgaagcauggaaauaaaggaaaauccugagcuccuucaagggaaauuccaggcaccuagcuagccuugagaaguaaaugagcaacuuaauaagcaaaaagguaauaguagucuaaaacaacagccaaggaaguuagucaaaacaauguuugguucucuauagaaacucaagauaucuucacaugcaccccugacuuguuuuucagaaacccagacccccaccaaacagaucugccuacucgaaaaacugaggacugaacucugaccacuguucucuauuccaaauuucuuccugagggccugaaggaagucaugcccaugagcuagagcuaauauuauuuucugcugauccccaauuuuaaacaaagcuucauguccugaaccagccacaaaugagaaaagcuuugaauccaccucuggccuguggguccccuacuucaagagguccugccuuuugaggucaaaccaauguauaugguccauguuuugauuuaugaguuugccuguaacuucugcuuuccugaaauuugugccugccuuuaaaaacccuuaccugcaagccauugaggaguucaggagagaaagaagcaucagcugcccugauuugccuugcuuagagcucugccaauaaaugccuuccuuucuacuccugcaaaaccucggugugguaucuggucuuacuguacggagaaagugggccccaguuggguucuauaacaaagcgugccacucuccuggaaccucuacccauuaagcuaucugaaaacucaucugaaccuuguuuuggguuuuuauggaggcuucauuacauuaacauaauugauuaaaucauugggcacuggugauuagcucaaccuucagcgccucugcccucccugaagcuuggggaaguggggcugaaaguuccaacccucuaauuaggcuuugguuuuucugguaaccaaacucauucuaaacuguauaggggcugccaaucacuacuaucuaaugagucaugcugucucauuagcauaaaaaagacacacuaaucacuggagauuccggcuuuuaggguuuucuuuagagaaagacuaaauguccuauauauuucacgauaucacaaaccccaugguucccaguaucugagguguauuauaaaugaggaucaggauguuuugaaguuaauauuccagaggaagucuucaguuguccauugcuaguggaaacaugcucgcacuuacaauuuuguucagguuuaaagugcaugaauuuuccuaauguuaaguguggacauggugcuucaucucauuacucaugacugccccuagagccucaccuacuguacuacuacuuuagaagacugccaaccccagguagaaugaucaugacuacauuggccacacaugccugauuugcauaugguaacuauggucaccauaaucaaagggagcauagaaaaugcagaauaggggauaugugauucccaguuauaaauuucauaauuuccuccagauuaggauuguaccaauguaaaauaugagauuuuuuuccuccuguaaaacuucauggaacaaguaguuauauccuuggguggggaggugaguagaguauaauuaccuuuugacaagagaaugcacccugggacuuucaaggcacagucuucaggccuuuuauuuuucuuuuacuucuuuuguggguguguaauccuuucuuaaacauuuggucuacacauggauagaccugugauuuuaaauggccuaaugagccucagacagacuucuaaguaacacucaugaauaagccaaagagagauucucagaugcuaacauuuauuguacugagauuuuuuuguuucuauuugcugaauuuuugccucuuuuaaaaaguuagcacuuauugaacauaauauauccugaaucuuuugcagguguuaaacagcugacuucgauuuuuuaaaagaaauccaucuauuaccaaaccaaaaaguuaaaaacaagcucuauuuauuuaggugauucugauaguaaauccuuccucccuauucugccugagaaaaaggauugcauuucucugcaaaauaaaccuucugugaagauuaagauaugaccuuuuguggacuuguuccuuaaaaagcugaaggguccaaaauaugacauuacauuuucuuucaucuaaccauuuaauuuaggauggagggccaugcauuagcaacaaugccuuaaaaaaaucaaacagcauaucuuucuauaucaugacacaaaugcugcaguaugguaaguagcuuucaguuaagguauuguguagacuggauaugaaauucucaucaugagagaauacuggugugaauaagaggaucaaucacaggauagcaaaugagaucuggaaaagggaggaggauuuuaauaaagacaaacuaaauuuuaguuccugagcaauuuagccuuggacucaggacucuaccuucuacaugugggcuuuuuuaaucauaaauuuuccaauguuaauggaauaucacuauuuuaucaacuagcucucuucuauuguccaugccagaaaagguauucucugcauccagccagcagaacagcagcaaagugggaaagguugucuagaguacuauuuauuauaaauagaggcucuugacuucauucaagagacuggcauaaaugaggggaguuguuucugguaggaugcaaacuugccuagucagagagagguugucaugagauuguagccuuaagacacuccagcauagaucaguaauguaucugcaaguguucauuuuaauguacaccuuugagcuggucaucuguucuuaucagggauacacacuccaggaauggugggcuagcauggaaaaaaucuuaaacaaaaggccaacuccagauacaguuuucacaagauagcuuucagcuaucuucaagauugauaaacacuaggggccuuguucuucagcauaauggauauuagaaaugcuccuuucucagugaauuuagugucaagauaugugaacuggguagacauacuacagagacguuuguaccuucacauaaaagagaaugaggcauaagaauaugggaagcccaauggccugaacccuucagaaggguggccugggcucugcaaaguacucuuaugucuagucucugauuugaauaauucuuggucaccacuaucuugaacuauagguggcuaccaaagucaaccagaaggaacuucaaaauuaugagcugaaguggcuaaguuuucuauuuauuuauuuauuugccacggguuucuuuguuuguuguuugcuuuuaauaacacuucgcaauaguagugaaaggacuguucuaaaagcccagggcaaacaaaccaaauugguuacagugugagauucacugaaucaaauuaccuauauuuucuucauguaggaaaaaauaucugcccuaaagcacaaaacuguauucaaaauguuacaguuccuugcccuuaugucucaucuagauauacuauaugaauaguucacuacuggaaaaacaauucauaccauucauucuauguuauuauaguggaauuuugcuuaugauuuuguuaaaaaucacucagugaugucuggcuuauuuauuuauuuauuuuuggguuccaacaaauuugcccaggaagggaaaguaugaauugccauucacaccccacuguguacucuuuucuuucuuuugguggcuggguaguucagagggauuuuucuggugaaaaagggaaguauggguaauuguuuuuugacaacuaaaaauagcuuuagaucaaggaucuucuuccuucaucauauauucacucauuccugcucauggacagggagcaugaaaagcuguaaaaauguuacuaugagugcaaaaaaccaaugccgagugagagaggagauaaaauaggagcagcaccuuagaucuuugcugcuaugguagccagucuccacgacggcaaccaaugauccuugcuuccuacuagcuaugccuuugaugucccucuauacugaacagggaugaccucuguuuucaauaaaauacugcagaaguaaggaugucugaccucugagaacaggucauaaaagguauuacagcuucugcuuugauaucuugaaucauuuucucuggaggaagccagcggcugugcccuguggagagguuuacuggggagaaacugaagcugaccacuaauagccaggucaagcuggccagccaugucccugggccacuuuggaagcagcaccugcaaccccaguccaaaccuucagaugagugcagcccaggccaacauguaacagucaagaucacccaagauugcuucugaauuucagacccacagaaacugugaaaaauaagaaacacuuauuuuguuuaaagccacuacauuuggggguauauuauguagcaauagauacagcuacuaacccaacgucauuuccaaccccauucucuuuugacugacuccugcuauagagaucuuuuaaaagcaagauaugaacguucuuauuagccucucuuguagccagaagugggcauggaacucguucugaccagugagacauaaacaggagucuacugaggaagcugucuuauaaaaggagcagguagaaagagaguucaucacacagcaccuuccucccaguuucugcuaugaacaugaugucugggguugagguagcuaucuuacagcagggaugugacaugcaugagggugaaaagcugacagcagaggauuguggaaugaaaacaagcaaacagcucaggucccuuaugacacuguuggguaaguaaauuaauguuggcaacuuccuaccacuuuggugagugauuaaaauaaacccuguuuuuauaccacuguuagcuaaguguucuaucacuuacggcugacagaacuccucauuuuuugaaccaagaaggggugcuuuagagaacacguccuaaaauguagaguuggccgaaugaaagagauaggacaucuggcugugagguuccaacucuuucuguuuggaaacaggauuaccuuuauuaugcaguggugaaacauuuguuauaacuguugccuguugggaugcaggcugugcaaugauaaaagcuguagaguuagagguaaaugugaaaacacugauugggccagcuuauuuuuccauacauacguuucggaacauuuagaaaacucacaugggaggugaaugacuuaugugggcacuucauggcauggcauguuagaguaugacccuuuauacaccacacacacacacacacacacacacacacacacacacacacgucauucugaaaguuugcauuuguauguuugguuuuuauaacaauuuuugugugaagaaacaaaauaguaaacuucaaaacacaagggaauaggccaggcgugguggcucaugccuguaaucucagcacuuugggaggccaaggugggaggaucaccugacgucaggaguucgagaccacucuggccaacauggugaaaccccgucucuacuaaaaauacaaaaauuagcccagugugguggugcaugccuguaaucccagcuacucaggaggcugaggcaggagaaucgcuugaacccgggaggcggaaguugcagugagccaagauuuugccacugcacuccagcccgggcaacagagugaggcuccaucucaaaaaaaaaaaaaaaacaaaaaacaaaaccgcaagggauuuuucuccuuggugugucucugcuucgaugaguaacacccaaguaaacauuaugcaggaucugguauauacuuuuccuauuuagcccaugaauugaaaacauauauuggcaaaagaucaagaugcaagaucucauaaaacauauuucacuuguugcccugaugauaaaguaauaauuguuagaaaaguaauaguagccauauuucaauucuauacuguuuccaagcauacucuauaugcuauuuuaucuaaauuuaacaauaacuccaugaaguaaguuuuuuaaucagucccuuugcuagaugagaagacugaugaugcuuacaaaguaagccuagcacuguucaguccagagcuuuuggucauaucauuaugugucaaugccuccuguuuccggcucccacaucuccccaaccccauccaaaucuaaucaauuaccagcuacuguuaauuauauauuugguauuacucauuuuuaucugcuuuccagaugugacuagccucagccaccucacuggucucccugacuccucuccaaucugacugcggccacagacaucuuucuugucuauacuuguucauauuucuccacuguuguucaaagaauuacaucaaaacuccuugacaugauacuucugaauugugucacuuaccccuuccuugcuuuccagccccaucucccagcaguccucuccauucugacaccucugucuccgaacucuuacugcucauucuguguuugauccauauuggaugucuccccguuccugaugcuuuuccagcuccaggcauuugcagccgaaagcaccucugcauggagcaauuucccugacucuuuuugcccaacucccauaccuccuucaucuuagacaucacuucugacccccagcuguagcuuaaguggccucacuagacguuucuuuuagcacgaugugcuucuauuaauccaggccucaguguugugcuuuugucucucucugagccuagcauaacuaaacuugcacaguuaacuacucauucuccuucuaaaacacaccacauuuucuacacauacaaauauauaugcauauaggcaacauauauuuuauacauaugugauuacacauuagaagauuugagaaauuggucaggcguggugacucacgccuguaaccccagcacuucgggaggccgaggcgggcagaucaccugaggucaggaguuugagacuagacuggccaacauggaaaccccgucucuacuaaaaauacaaaaauuagcugggcauaguggcacgugccuguaaucccagcuacuuggggagcugaggcaggagaauugcuugaacccaagaggcggagguugcagugagccaagaucacaccacuacacuccagcccaggcaacagagugaaacucugucucaaaaaaaaaaaaaaaagauuuuagaaauacauauauaauauuacauauaauuaucuaacaggaggagagauucucuuuucaacucuagagucauacucuaauuuauauucuuaaugaucuuacuccaccuucuaaguagacuagguucaaucaaaaacuuuccuaauauacagcacucaccuccaccuucugcaucauggacggcagaacuucucaucuuugucuccuaaaucacugacuugauuuucuauaguucuuuacuaucauugauauacauucuaauauugcuauguacuuaaacagaaaacuauuucuauaccaaccuuuccucuaaaaaaagacaaaaacaaaaacaaaaaaaccagacugucuggauuucuucauuucuacuugugaacuagagucauuuuuauacauuucccaauuuauuuuuauuuauuuuacuguuuuauuuuucauggaugaggcucuuuuucggaaguggaggcacacaugccggggccacaauuuuugguccccguccagguucuuuccugcugugguuggugagaauuccucuguagcuguuaaaugguucacaacugucuuugguuuucauaacuguuuugccuuuuuaaaugucuucaugaguauuucaguagagagccagggaaggacauuucauaaaaugugaauaugaugccauuuugaacugaaaucccugcccauccuuaaaggacuuauucuucugccauuauuggcaccaaccagcucuauuucucugaagugaagcaucagauuuggcaauaaacugcaauagggagcuugcacuacaagguaaugaaacuuuccacagacuguguauccuauaguaaaagucuccauuuuauguagccacuccuuuuauaaaauuuauaccuuccaagaagaaauaguacuugguacuuuaacaauaacaaaccuguucuuugaaaaaaccaaagaauggacuccuaguuuaagccuuuuacauuuuuuucuugcauaauaugcuuaaucuuuaaucggaucaauccucauuuuaacagagcuuuuaaaaguguaaagucuguggcuaguuuucuuguuguuauuguuguagugccuguuuguuauuaaguggcuuugacagaaaaugaguuugggucguagaaaagguuucuagauaucuggaauaucuuuuaagguagcaaaaacccuuuguauaauugagggaagaauuauugaucuccaacaguacaaagucacaaugcauaaauuuuagaccaugaaagauagaaucggcuccaaagcauaggcaauuuuguuucaaagacugguuuuuguucaugaaaaaaauguaaugcaguuaguccccucauauuuauuaagugauaggugacuauaaaagaaguuuaugaauuguacagccuccauuuguauguuguacuucagucagagacauuuuauggaugguuauauaauacucuucagcuuuacauagcgcccuuaaauagaaccacaaaacuccucacagagaguuucauucauaaauaaauaaaaaaggaaaagaaggcuuugaggcaagauuuaaauagaggaagugacucagugguucagagggaguuuuggcaaagagaugaaauagcauccacagaagaagaaacuaaaugaugaaaggccacgggaaguuagagucagagcagcaaagagaggagcagagcccacaggugguuuauaagaaauacuuagcacagagcagcauuagaauccauguuggugagaguaacagacacaucacucuacagaagaucaaaucagugauuaaggggcaaagaugagaaguucuccugauacauagaagaaagaaacaaagaaaugaaaacaacaugagaaagaagauaacagacauggaggauggagauuccaaauuuuaaucuaaacaaaauagaauuuuccaaauaagaaacaaagacaaauggaacaaaacuaguuauaaguuauugaagaaaauauuacugauauugauagagaucuaaauauugugguuuaaaaguaaauacugaaauucuggaaaacacaaacuaauuuacaguggcauauugcagguugccaaggucugggaugagggaagaucgccuacaaaagggcaugagggagccugcuugggggauuguggugguggguacacaccaacacauuuaucauuuauacauuuaucaaaacucaucaaauuguacacacgaaaaggaggcauuuuauuguauguaaacuauaccuaaaugaaauuaaaauuauugaaauuuuuauuuugagaugauuguagauucacaugcaguuguaagaaauaauacagagcuccgacauaaccauuaugcaguuuccuucaaugguaacaucuuguaaaacuauuguucagucucacagugaggauguugacauugauagaguaaagauauauuccaucaccacagucccauaaccacagggauccuucauguugcccuuugacacccacauccacuuccuuucuguccucaccuucuccuuaaauccuagcaaccacucaucuaguuuccauuucuauaauuuuguuauuucaagaauguacauauaaaaggaaucuuaucauauguaaccuacugggauugucuuuuucucugggcauaauucccuggugauccauacaagucacugcagguaucaauaguuuguuucuucuuauuacauucuguaacuugucuuuucaucucuuaauaaaguaucucacagaggaaaguucuuaauuuugaugaaauucaauucaccauuuuuccuuuuacagacuguggucugaugucaacucuuaagaucucuuugcuuaacccagauccuaaagauauuucuacuuaaaauuugugauguauuuugaguaaauuuuuguauaggaugugaaacuuagguuagguuuuuuguuuuguguuuuguauugccuauggauguccaauuucuccagcaccauuuguuaaaaagguucucucucccuacugaauugcuuuugcaccuuugucaaaaaucaauuggguauauuuguggggaucuauuucuggguucucucuucuguucacugaucuaugugucuaucuguucucuguauacaaucuuguuuacuguagcuauaaaauaagucuugaaaccaaguagacgaauuccuacuuuccuaaucuucauuuucaaaauuguuuaagcuggacuagauccuuugccucuaaauaaaacauuuagaauaagcuuguuuauguuuugcuuggauuuugacaggaauuccaugaaacuuauauaugaauuuggagacaugacaucuuuccuauauuaucuucuaauuuaugaauacaguauaucuccacuuuaaaaguauauuugauucaccagcauuuguaguuuguaacauacaagugcuauauauguuuuguuagguuuacaucuauuucauuuuuauccuugagagaauguaaaugguacugcauauuuaauuuugguguccacauguacacugcuaguauauagacauacaauugauuuugauguguuuaacaugcacccccuaacuuguugaacucaaucuuuaguucuagaaguauucaguaaauuaugucauuuguaaacaaagaccauuuuauuuucuaccuuuccaauucacauaucuuuuauuuccuuucacugccuuguuguggaggcuagaacuuccagaacuuuguagaugcucuuuuucaaguugacaaaguuuuccuuuguuuauacuuuuccgagagucuuauaaugaaugaguguuucauuuuugucaaaugcuuuuucuucauugacugacaugauuauaugguuguucaucuuuagccuguuaauaugauggauccauggugucccacagauugaaagacucaacagaugaaaagugccaauucucuccaaauugauauacggguuucacacaauuccuaucaaaaucugagcaagacauagauaacauuugguuuucaagcauuguaacuugcacccuggaauaaacccaauuuagucaugguauauaauuauuuuuauauauugccaaauuccauuugcuaauauuuuaaguauuuuugcuucuauauucaugauggauaauggucuguagcuuucuuuuguguacugccuugucuguucauaaaaugaacuggaagugcucuguccucuuuuaauuucuagagguuuguguaaaauugguggguuuuuuuguuuuuuuuaacauugguaaaauguucccuugcaaucaucugggcuugaagguuucuuuugggggaguuuuaaaauuuugaccucaauuuuauuaauaauuguaaggcuauuuauauuauguguuuaauauugagugaguuguaguauuuugcauuuuugaaaggaggccaauuccaucuaaguugucaaauuuaagucaggcacagccacucaagaggcugaggcagaaggacuggucaagccuaggaguuugaggacggcuugagcaacauggcaagacaaugacucuaaaaaaaauuuuuuuaaugucagauuuauguguguauaguuguucguaguauaucuuuauuauccuuuugaugucugcaaggucuguaguaauauccuguuuuauuucugacauuaguacguucuuucuccuuuuuaaguuugucagucuuugaaaagguuugucaauuuuauuggucuuuucauaaaaccagcccuuuguuucauugauuuucuuucuuggcuuucugcuuugaauuucacugauuucugcuuuuaccuuuauuaauaccuuccuucucuuucuguuuuauuuugcucugcuuuuucuagguucuugaaguaagaaagaucuuagauuacugauaugaaacucuucuucuucuucuucuuuuuuuuuuuuuuuuuuuuuuuugagauggagucuccugugucacccaggcuggagugcaguuuccucguagcuuccaugaugucugaugagaaagcuacuggcauucaaauuguauuuccucuguaggaaagguguuauuuuucuuuaguuguuuucaauauuuuuuucugugucuuuaguuuuuaguuuucaguauuaugauguauuuuggcaugaauuucuuuaaguuuuuguuuagggugugcuccacuucuugaaucucuacaacuaugucucuuaacaaauuuggugagcuuuucaucaaauuuuuucuaguacuuuuuccaccuauucuuuuucuucuaucuuuccuggucuccaguaacagggcuguuagaucccacagguccccaaagcucugcuuauuucuuuuuuucuagucuauuuucuaucugucguccauuaagggugauuuauuuuguucuaucuucaaguuuacugauucuuuucuugguucccuucauucugcuguuaaauccaccauuaaguugaggguuuuuuuguuuuggggugguuuuuuuuuugguuauuguauuuuucaguucuaaaauguccauuugauucuuuuuuagaucuucuauuucuuugcugagacuuuccauuucuuugcugagauuuucuauauuuucauuucuuucaagcauauuuauaauugcuugaaguauuuuaauuauggcugcuuuaaaauauuugucauauaauucuagcaucucuguuggcaucuauugagugucuguuuucauugaauuugagauauuccuaguucuugguuggaugaguaauuuuuuuuuuuuuuuuuuuuuuugaagcuuacacaauuuggguauuauguuaugugacucuggaccuuauuuaaaccuucuguuuuagcuggcuucaucuaacucugcuucaauacagccaccccuguacuggcagguuagaguagaagucuagguuccccauuuggccuauguuagaccuucuggagaggaggaaaccacucaucacuagguaggagugggaguucuggcuucccaguaggucuccacuuaaaauugcccugaauggaaggggcaaaaaaucuuuguccuauuccucauguggcaccgacaucacagaagggggccuugcuacuacugaguagagggaaaauuccagccucccuauguggucucagccuggcagagaugaaaguccuaguucuuuauuuggccuucucugaacacccugucagggggguuggagugucucauuauacccugacaaggguagaagucuaggcucccaacuuggcuuuagagugacugggggugaguucacaguuuuucagugguguuuggcuagaguacagcaguuauugucuaaaauauuuuugucuugugaggcugccccuuuccuugucuuuugguguucuuggagcuuucauuguccauggccuauuaggguuuccagauugccaccuucuuuagcucuaacucuggaauauauaaguccaaaagaacugaccauccuauugcuucuugggucuugagaugucuaaccagucugucuuuuucucuuuacuuuuuagagucuucuuauguuuguuucauauauaauaucuagaguuuucguuuuuacuuagcagaaggaauagagaaaaguacaaauauuuauucugcuuuucugggagcagaagucuccaaaguugacuuuucuuaaagaaaauucuguuuuagagaaugaaucaaugaaaagauccccaagacaaaaauauuuugguaaauacuucaguuacauauaaugaaucuacaacuauucauauauaaauuagaagauuaucuacaaaggaauaaaauaaaaauaaagaugaaugaagcaaugaauggcagaaaaccauuaaauaccucggaguuguuugaaagaaauaauuuuaaaauucugaacucaaacugcacugcauaugugaagacagcacagaaacauucuaagaugugaaaggacucagucaauaccauucaccaauauaucauacuguaaaagaauuuaauuaaagauguaccauuuauauucugacaaaugcaaauuaacucaaguaugaaaucucaguuuuaagaagauuagcaaugagcacugaaacugugauuaaauaauugcuuuaauuaugauuauauaauguucuaauuuuaugaauaucagguuucuugguaucaaauauaauauccuuauaauuuuuucucaguugcuuucugaaaaaaauugagacccacaaauccauacaaaggguugacuaaacaaaaaauugguucuuugaaaggauaaacaagaucaguagacuacuggcuagauuaacaaagaaaacauccaaauaaacacaaucagaaacaacaaaggugacauuacaacuaaugcugcagaaauacaaaagauccucagagacuauuaggaacaucucugugcauacaaacuaaaaaaucuagaggaaaugaauaaauuacuggaaauacacagucucccaagauugaaccaggaagaaacugaaacccuaaacagaccaauaucgaguucugaaacugaauucguaauuaaaaaccuaccaaaaaaaaaaaaaagcccugggccagauguagauucauagucgaauucuaccagacauacaaagaaaagcuaguaccaauucuacugaaacuauuccagaaaaccgaggagagacuccucccuaacucauucuaugaagccagcaucaucuugauaccaaacacuggcaaagacacaacagacaaagaaaacuacaggccaacaccccgaugaacauagacacaaagauccucagcaaaauauuggcaaaccaacuccagcacaucaaaaaguuaauacaccaugaucagguaggcuuuauuccuaggaugcaagauuggcuuaacauaugcaaaucaauaaauauaauuaauuaaauuaacagaguuaaaaacaaaaaccauacaaucaacuaaauagacacauaaaauguuuucuaucucauuagaaaucaucaguccuuucauucauuuuguugucccaaugagcauuuuuuuuuuuuuuuuugagauaggaucuagcugugucaucuagacuggaaugcaguggcacaaccauacagccuugaccucccaggcuuaaaugaucccccuaccucagccucccaaguagcugggaucacaggcgugcaaccccacaucuaauuuuaguagagacgaggucucacuauguugccaaggcuggucucaaacuccugggcucaagcaauccucaugcucagccucgcaaagugcucccaugagcacuuucuuaucuuucaaguugcgaguccaugauccaucacuuuaacaucuuucuugauauuaaucuguuguguccacuucuucuuuauguuguacccgucaaguaagccuaugacuuugaaccaaucuaauuaucagacuuguccuuuccuaugcaguguugggggaaaucauacgaacacauggaacauaaauguauuauaucugaagucacuggaucuucagcacuaagcagaacacacucuugguuucccuggcuggcuuuccuuuuuuccauuccacacaguagcuuguucauaucauuggucuucccacuauccgcccacuacuuccuucuucauucuuugaaaacauucuuguuuaccagucccugggaaaaauggaaaacaugaagcagaaaaucccuaaauauccuguccacccaccaaaaaaaaaaaaaaaaaaaaaaaaacuaaccuauaacccuacuuucuuucuuuccuuccuuccuuccuuccuuccuuccuuccuuccuuucuuucuugagacagagucuugcucugucaccaggcuggagugcaaggugugaucguggcucacugcaaccuccgccucccagguaaaagugauacucccgccucagccucccgaguagcugggauuacaggcaugugccaccacacccagcuaauuuuuguauuuuuaguagagacaggguuucaccauguuggccaggauggucucgaucuccugaccccaugauucagccucccaaagugcugggauuacaggcaugagccaccgcacccagcccucccuucuuucuucuuuccuuccggccacaagaagcaguucucccauucaaggcucuuuuccucaaacugucgaucaaauccuauucucucuacccuauacagaggcuuauauccaccaguauauaagccugcauauauaaguauauaccauuauauauaaguauauauuucuucucauuaucugaauuaucaaccucagcauuuauacuuaccggcacaccuauuaaaaaauaaaauacauuaaauuucaaaauaaauaagaaccuugcugucacauccugugcucccaccuuaucuucucccuauccuaccuagacucuuaaaagacuugucuucacucacugccuccguuccccaauccccacuccucaaccugcugcaaaaugguuuugguccccacucuauagagaguaauucuuucccuacaauggcuucuggaaugcucaaacuaguggaaacuuuuauuccuuucucuuacuucacuucucuuuaguucucaccacccuugaaaacugccuucuucuuaaaacgguguuuucacuuggcuucacucaugcuggauuuuccugguuuuucucuucucucuugagccaguacuuuauuuauuuauuuauuuauuuauuuauuuauuuauuuauuuauuuuuugagauagaguuucacuuuugucgcccaggcuggaaucuuggcucacugcaaccuccaccuccugaguucaagcaauucuccugccucagccucccgaguagcugggauugcaggcgcacgccacaaugcuuggcuaauucuuuuuguauuuuuaguagcgacaggguuucaccauguuagccaggcuggucucaaacuccugaccucaggugauccgcccgccucagccucccaaaaugcugggauuacaggccugagccaccacauccagccuggccgguacuuguaaauuugcuuuguaaaguucacuuucuuggcccagccuuauguaucuauauuccccaggguguucaauaauacagcauuaguaaaauaauuacaguggacauauaagaaaaaauuagaucgccauaaaaaugacacagaaaaagauuuuuuuuuuuuuuuuuugagacagagucucucacugucucccaggcuggagugcaguggcgcaaucucagcuuacugcaagcuacgccucccggguucacgccauucuccugccucagccucccgagcagcugggacuacaggcacuucccaucaugcccagcuaauuuuuuguauuuuuaauagagacgggguuucaccguguuagccaggauggucucgaucuccugaccucgugaucugcccgccucggccucccaaagugcugggauuacaggugugagccaccgugcccagcuccagaaaaagauuuuaauuaaauuuaaaagauuauaagcaucauugcacauuuagcauaaucuaauguuaaauaagugaagaugcuuguucccaguuauucaguggaggacuuuguuucaguuacauacaucaguaaaucagcaguucucaucucuguuugcucauuccguucuucagggaagcuuacugauaccuaggauccauuuccagagauucuuucuuaaguggucuggguuaugcuccuggcauuaugauuuuuaaaagcuccccaggugacccuagcaugcauccagauugagccagugcaauaaauucuguuuauuguuaaugacuauuugaguuagauuucccugacuugcucuguaaagcacucuagcuccauguuuccaaaccuuaacaugcauaaaaaucaccuggagauuuucuuaaacuacagauuccaauucauagcuuugcaguguuacauugguuugccaggacugcuauaacaaaauacugcaaguggaguggcuuuaaaaacaaaaauauauugucuuacaacuuuagaggguagaaaucgaaaaucaugguguuggcaggaucgguuccuucugaggacguuaagagaagaaucuguuccaggccucucuacuuggcuuguagauggccaucuccccucuaugcauucucuguguccaaauuuucccuuuuuauaaggacaauagucacauggauuaggcccuccccccagugaccuaacuuuaacuugauuaccccuguaaagaguuuaucucccaauaaggucauauucugagguauuagggauaggacuucaauaugugaauuuuggugggacauaauuuaaaccauaaaagguggaaaucaagaauuugcauuucuaauaaaccucuaggugaugccaacacugcugggccauggauuacccuucgaagaacaagguucuaccagacacaauuccugugcaugggacuggguggaauugaagcacgcuuauuuucagauaaauacaauugagaggaucuaagggacaaccagcaggugggcagaguacuagaaacagguuacuggucaugccuacgggauggauuaauuuaggaacauacaagagaccaccccaucacagaggaucuccaagagagacuuggggugggagaaauaaaccuuuaaguaaugauacacacacacacacacacacacacacacacacacacauacaccacaaaguaauuuggugaauauagugagaaaagaagacaaagagacagagacagggacagagauggagaccaacgagagaaagaaauacaccaaaaugucagaaauacuuuucucuggauggcuuuaagagugaauaauacauucacauaacuauuuuucccagacuuuccagauuuuuuuuuugaaauauacauguauuacauuaguaagcaagaaaaaguuaaaauagcuauuuaaaaagaauuacccuuaauuaaaaauuaaacaaaguccauaagacugaucaauucuuuauuuaccuucaugaaagagggaaauaauucuucauugcaguaugaagauaaaauaguuuacuaaugugcugccauuagcuggacaguaugcuaacauuuuuaauaaugucauuuaaaguacuaaaccugccuguuuucuacauauagaaaacaagauugcugcuauacuaaugacugucacauugaauucucaguuauaauugaaaugccugaaauuacgagaguuagucauucauucagcaaauauuuauuagcacccacucugagggaagcuccguuccuggcacuagacauaucacaagaagcaaacgaaaaaggauuugucuucaaggagcuuaaguauuagagcaugauuauaaguauuaauuuuuuuaaaagguaacaugaaaauauaaaauauguugagaucauuucaggucccaguacggcuagaaagaaaauuaaauagagcgcuaugaugcaaaguggaaguucuuuagcuucuauagucaugcaagauuucuugaggaggcaguauaugaaaugagaccugaaagaggaggagaaugccacacaacucccuggagaaagagcauuccaaaucaaaaaaauaguuaugugcaauguuucugugauagggaugagcuuggcagguucaaggucccaaaaggaaggccaauguggcagaagcacagugaacaaggagggagagaggaggggccugggguuagaggacuaggcagggucuggucagguagaccuugaagccuaugauaauaaaagcgauuggaugauucuaagcagagaaauaacaugaucucaucuuuaaaauagcagucugacuucuauguggggaggaugggcuauaggaggagaacagaggaugugaggagacgagugagguggcucuugaaguagaccaaacuggugacacagugcaggcuagguuucagcaacagagcugguaagaaagaguugaauuaggacuauaauuuggagguugaaccaacaggacuugucaauggacaaaaauaaaaaaucucacaaaccucaaggacauucuuuggauguuagcuuaagaaaguaggccuuugauggcaccauuugcugaaaagagaaaagcuugcuuuggggcaagggggagauacguuugacaaaaacaaacagcucuguuuugcaugucaguuuagaguuacgaauucuaguagagauaccaguuuggcaguuagauuuaaaggucuggaccuuaguugcagacugagcuggcgagaacaauuuagagauaucuguguaucagugauuuaaaaaacucaaacuggaugaggucaucaggagagaggguauggcugaagcacuaacauguaaaacaugguagagaaaaagaagccagcaaagaagaccaagaagaaggaaauccaagaggauguuguguugcagaaagccugaaaagaccauguuucagaagaaacauguaaccaggguggcugcugagaggcugaguauaggaggggcuuaacuauuggcacugacaagacauagaucaauggggaucugguugaaagcuuuuaguagaguuguaggagucaaauuccaauuucagcagacugaaaaagaaaugagaggggaaaauuuagggugaauuugugaauuagugaauuugaagaauguuuucaaguaguuuuucugugaaaaaaagccaagaaaugggguggcacuugaaagaaggaccaaauuaaggggauuuguuuuucauuuuaagacgaauuauauuacaguauguuuauuugccaguggggaugaucuggcagagaggaaaaaguugaugaugcaagacagaaaggggauaaugguaacugaaucuuucagaagguacaaaagacaggaucuaagaaaaaaacugaagcgguugguuuuaggggcaggaaucacuuuucaguguaacaugaugagcaaugagaaguuaaaguaguuauugacuaauuuuaucaauuaucucuaagaauuauagauugaggucauuagcuaaaaacauuuaagaagagacuggagaaggugugaaaugaacaucuuagacaauaagaaagugaguccucuaguccaucuaugcaguguggagcacccauuucacacuuuugguuguaaauuuguaacgaguccagugaguaaaguugcauguuuuuucacugacauuguucaagagcacaaauacagguguggcgccaaguagacaguugguuuuaaccagccucaggggguucccagucauguacaaugaagggacagggguggcaagaagguuauaaugcugggacgggaauccaggccaguagacagagaggugagggcacaaggagaauggugaggaacugaaaacagguacagcuguagauuagugggagaguucuuggaaaggcagaaucagaguaagugagguaaacagaggaagucagagacuggguuguuuuuaucaaacaaaguuuucugagguggcacaacucuguugugauguuggcagugauuacaucuaagguaugcccgccugaaugaauuuccaacagguaguagcagagaggaagacagaucaucaaagccaaagaggucugagaacugaugagugcaaguucaggccaagcuuacuauaaaaaccuccuggcugggcacgguggcucaagccuguaaucccagcacuuugggaggccgaggcgggcagaucacgagaucaggaguucgagaccagccugaccaacauggugaaaccccgucucuacuaaaaauacaaaaauuagccagacaugguggugggcaccuguaauuccagcuacuugggaggcugaggcaggagaauugcuucaaccugggaggcagagguugcagcgagccgagaucaugccacugcacuccagccugggugacagagcaagacuccaucucaaacaacaacaauaacaaacuucccauacucucugccuuaccccauuucacuggcuguauaucaaugucaaggagacauuaccucauauugaauaugggagagccucucucagccucaaugacuauauagagcaauccucccaguuagaaaacuuuacgugagaaaccuauaaacugaaggugaauaugccauucaaauuuugguguuaauuuguuauagcagcugucacuguaaccaauauuacauccaucaugugucuuauaauggaaguuggagacgucuucaaaaaaauuacuuagauguaguggccucacacaccaaccauaacuccacauuuccucucuaguuuaauaaggagaggaacaagaagagaagagaaaugaguuguuggcucccacucacaguguaguguacuauacuguacacuauuguauaguagaguaguagaguauaucuaaggaggagaaagugauggugucccucaccccaagucaaguaaauucgagggcucucagugagucacugguuagaaauugggacugcaugcaagaaggguggauuggcuucuuuuuccugcuguuuuguuuuucauuuaguuaaguuucagaaaccugaaggcccacugugguaaccagccugcaauaugacccacaagaauccuguugguauucauauaucuguguagcccauuuucacacugaauuagggcuacucuaugugacuacuagaacaggacagaagugacaguuugugacuuaugagcugaggucacaaaacacaugcagcuuuugccuuggucucuuggcucacauauucugggaggaagccagcaucaugucaugaggacgcucaggcagcucuacuaauaggcacgcauggagaggagcugagacuuucugcccauagugagccccaggaugccagccauggaagugagcuaccuuggaagcagauccuccagccccaauaaaaccuucagaugacuacaccuccacaugacaucuaacugugaccucaugagaaacccugaaauagaacugcccagccauuucuuuagaauuucugacccagggaaacuaugggauaauaaaguaucauuguucgguuaagcauaauuuugggaguugaucuguccugcauauuagaucccuauaacaucagagaaagccugccuaauccauucccagaagugugagugcauucauaagcagagacuagugacugcucccagacuagaaacuuccagaaaugagagccucacuggagcagccaugccaacaggucuuguagggacaaauagaguacuguuccuaggaaugaaaugagucaaacuccacaccacuccaguuuccccgggcccucaaagaacagaagaaauuuucuguagcuuucuuggcuuaugugaugacacauggagaggaagagccaggcaaaagccauggguuacacaagaagccaccaggccaggcaugaggcuaccccacccugugaggggugugggauuuuacggcuggaaaugccaaaggaaaacuaaacagccucucugugagaaaguacucacaacaaaggggacucaaauaauuguaagccuaucccaagacaauucaucacucaaaacacauucaccuuaaaugaaguguccauagcaucagacagaacuagaucaaaucggaguacagccagggacacuuccccuaccgccuguaaccagaguaacacaagagaguaucugccuuugcuaguucccugacccgcagauaaggaucuaggucuugaugaggaugaggagaagggaaaucagagccaggacagaucugccccuuaaaugggaaaaagauaggacuuuaagccgaguuugggauuauaauaauauuaggucucauauuaaaauaaccagaaacuuauggagucaucucaauaggaaauuaagagacggaaagggggaagggguucaacauaacagaguugaaacaauaacuggaaaaaaccaagaccauuucaugccucuaucucagaguugagacuccucaauaacgagguuauacaucauauauucaugcugacuuguaaauauucagagauuaacaacauaaaugccaacagacagaaggccuagaauucauggacaaaaauggcuuaaucgaagacuugauacaauaaaggaauaauguguuucacugucauuagaggcuuugguuguuuuaauucccuuucaccuaaguuguucuaagguuuauauuucaugaaauuaauaauuuaauucaauucccucuaagaguuuuccuugguacuguugugucauggaucacuagauuuggugucugacugagguuaucaucccagcuccaucacugaagagcugcaaaagcuucagccagacauuuaucuucuuucacguuagguccuucaucuagaaaauggggauuauaaaaucuacuucauggccgggcgcaguggcucaggccuguaauuccagcacuuugggaggccaaggugggugaaucacgaggucaggagaucaagaucagcguggccaacauggcgaaaccccgucuccacuaaaaauacaaaaaauuagcugggccuaguggcgggugccuguaaucccagcuacuugggaggcugaggcaggagaaucgcuugaacccgggaggcagagguugcagugagccgagacugcgccauugcaccccagcccgggcgacagagauugcgccacugcacuccagcccgggcaacagaguaggacuccgucucaaaaaaaaaucuaccucacgagauuacuaauuaaauguuacagggccugacugagcacuugauacaguauaugcguucugaaagacacuuaaaacagaaucuaauaauuauaaguuuguagauaugauaggcuagcaucgauugacauuauugucaaucucaaauacagcacagauaugguacugacauaccacuaccauggaaaaauuacuucugggaugacaacaacaaaggaaauuauuccuuucuuacucaccaaggggaaaagaagcauaauagauacauauauaucuccacaaauucuauagcaguuauauacauauaacuguuuucauggaaauuugauuuauagcuuuaaagaaaaaaaaaucaccuuaaaaucauguaaccccuaauguauccuuucccugaagcuauaaacacaccuccaguuauucuguccaacaaaaauacaccacagcagguggagucacaaaaaaguaaacgguuucaaucuuuucauucauuucagucuauucccucaacaaaaacuucaaacugcaggugcaugcagcauacuucugcuaugacaagagcaguguaucucuguaaccagggcuucaucuaaugaugugugaacuaaauguuaacugcagcaaaaugacuccaagccaagaaagccccaguugagggucuugccuggaagaggggcuaaaccacaggaacacaccaaagagugggguuggaucucuggcccucgggagaucaucauucuuuccuucccuucaacuucuaauguuucgagaacagugcaaauuaaauuggaauucuguuugcagacauuccucauuuuaggguccaaauuugauuucagucuggaaacuagcaucuaaaugaguuugagagaggaguagguuuuaagaaaggucaaggaguagguuuuaagaaaguaaaacacuaaccaauuauuguagggaaucaguuucacaucuggaauugguuacaugugggacagaaggaagaguuuucuuaggacaguugguuuaauuacacuuuuuaaaacaagaaagaauaaccuaaucucaaaugcaaaccggcuaccucuagcuaguggaucuauuugcuucucaucauauuucuaccagaauuauuaguacuauauccacaaauaguuucaaucuguuguugcuuaaguaaggcaaacuuuggaauaucccuuugagguacacauuuuuccugggagaauuaguguguuagggucaaaucucgguguucagacaucuugucuauuaaaaaaaaaaaagaugcuaugauaauaagcaugauuuugacuuaagacugaccaagauuuuaaaauacuagcugugugacucugggaauguuacuuaaucuugcuuuaucuuuuccuuaucugggaaauauggaucauucuuaucuuaaagagaucuauauuaugauuauuauauuaaauuguauagcauauguaaaacaacaaacaauuaugacuaucuggcuauagaagguagucaauaauuguuaauucucuugccccucucggcuccuuccuucuauuauuuaacaacuuauuuuuccaaaggcaauauguuuuuggcaaauauaaugagacaggaagcucaauauagccuacaaccuaaaacaucaguaguauggcacagaauacaagaaauuaagcauauacauggauuuaaaaguauucuccauuggauauggccaaaaaaaaguuuauuguugugguuuaauacaguucuugaaauguaucuccuggcauauauuuuuaugauugugguaaacugaacauuuuugauuucaccacuguccccuaccccuccccugaccuugccaaaaauaguaauuacucacauauugugaucaucuugacccucuguaagcaggacaaucacugucccuggcauuaaagaauauccuggcucagagugggucaucagcuuuguaacugacgccuccauaacacucaagguuaccaguggacaaguuugcaaaguaaaacuuugucagaguaggggagagaauucugcuuuccuaugaaguuuaguguagcuaagaauaaugcugaaagcaguauuuuacucccaaggagcagguuauaaccuuuucagugaaacccagccaguacauuuauagcacauuaacacuagugaauggaaaagagcgagagggagagaggauauaauuauauaaauuuuuuuaauuuuuaauuuuuuuuugagacaggaucucccucuauaauccaagcuagaguacauuggcacaauuauggcucacugcaggccugaccuccuggguucaagugauucucccaccucagccuccugaggagcugggacuaaaggcacacgccaccgcacucagcuaauuuuuugauuuuuuguagaaacagggucucgcuaugcuguccaggcuggucuugaacuucagagcucaaaugaugccccgccucagccuccaaaagugauauugccuauaauuauagucaccuagccuauaauuauauuuguuaaggcaucaaggcauugguuguuuuaauugccuuucgccuaaguuguucuaagguuuauaauauauuucaugaaauuaauaauuuaauucaauucccucuaauuguauugucuauuuucccccacuugaaucugugugcagacguaaaucuguaagguugaguuaggggacagauaguggaccagugcugaccaaagagaucacagugacaucuaaagaugauuucagaaacaccagaugcuauagacccaaagugguggaacaaggcaucacaauuauccaaagaaaagagaguuguuuguccacauuuugaaagccccuagggacaguuuucaggcacuugguuugggucuuugugugugugaagcauauagugcaggacgagauuaaaucgauauuuaaaugacaugcaagacacgggaaccacuugaugugguugagcauuugcucucguuacacucuguucuguuuauaaacauucuagcuaugugaauaauaaaaagccaagcacaggccuuugucaucccuucaugaucuuucugguaccggaggagcuuaggaggagguguugaguuuuugugugcuaaagcuugucaagggcacaucaaaauguaauaacgaaaucaacuacuagacagauuggauggcagauuuuggcagcuaacaaggagcuuucucguuauaggaugugcaagcuuguggguugcacugcaauuagaaaugaacuuuuuuuuuccccugagcucuucuuauccuuuucauucucauaagugacaacagcaaaagacuaguucucacucucuaauguacucuauccaucucccuguugcuaaaguaacuagcaucuuaauuuaacaucaaaauuuuaaaaauuggaucaaugcuauucaguguuugugagauauugauaccuuaugggaaaguaagugauauauuacuuaaaacuaauucucuugacuucuuucuauguaugcaaaauauccuuuugguauccuuuuuuuuuuuaauuguuguuguugugguuuuaaccauaugucuccaguaggaaagcaagaucuuuguuucuuaacagcugauauguacuugcuacugugucacacaggaguccgcaauacuguuagcggcaacaaaaucauuuccacagaaacuaaauuuagcuuucaagaagagaaaaacaauacuauuuuucugcuacuuaauagauggauuucaugugaaacaacacaaugaaccaagucaaaauguuuuucagggauuaaaaauaagacacccaaagguccaagugguucccucagagauucacagccuaucugggugaggauuaggaccuccugcagcugaccaggcagcucccaggcaaucagaacaauuccagaagagaggagagaagaaacugaaagggagggaaaaggagauggggucacugaagucagcuuuuuaaauacacgucggaauguccauucaagagucagcuagcuuacuaagccauuuuuccugauaggaggguugauguauacaacugucacagaguagaaguaauggacaauaaauucauaacaugcuauaaauuuucaaaggacaagaaguuuuuauuuuggaaaaaaaauaauaagcucaagaauuggguauuaaguccuuaagagauaagaagaacuaaagaaaagaacuaaucccauauucaacccuuuuuuauuuuaccagaagaaaaaagaaauguaguuacacauucaaguguucuuugaauaguccaccauuuuaaaaugcauuuaauauaugccaggugcuagaccaggaucuggggaaucagagguaaacuagaaacuuccuuugcccagccauggucaaguaaaaguaauaaggacagagaggugcugagacuaacuuaugcauggugcccaacagagauacaaagaugaaaucauuaagucuccucuucaugguagagaugaagcugaagcugaguccuaaaaagugaacaggcauuuucaagacaaacugggaggaaaggauauaauagguaagggaaaagccaguggucaaagccuggagaguuagaacagagugugaggaaagaggcagaucuccagaauaaaacagacaugagguucugaagaucaaauauuccacaagaagggaguuuggauaagaaggucauuaaggugcuuuaagauggaggggacaugaucuaugcccuuuacaaagaucuuuaggcagcacuguagcaaacagaucggagagggaaaguauuauuauagcaauacagauuuuucuuucaaaauaauguuugguggaagcaaccagugcaauucccccaacuucuuguucaaauauccaugaagacagaaaaaauacuaaaauaaaccuaaaacuaauaucaacagacuaugucugaauuuaggaaaaugugcaauagcuauuagauaauuggagcuaggcugagaugcaucugucucuauaccauucuauuuucagacacagaccaaaaaccagaaagccacugaguaguaaacaugaagguggagggagauccuagagguagaauaguacagcuuugaagauggagauagacauaaccuugauaucacaaauguauuuuuucauguauucaaucaguucaucaaaccagagaaauaagaaggcagggcaggaguaaguuguucuguugauagaauagaggugcacuauaauuuaugccuguuagaaaaugggugaauaaaugaaucugcccuccacaugcaaaacuaagaaaguaauucaaccucaggguauaaaggacaguuuagcuuccuuauuuacugaaaaauacugaaacugaacacuuguuugaagauaaguaaaaggaaaaccaacauggagaaaaugauuugcccaaaaaggaauaagaaauagcauccagaaaauagggaagaauaaaagacuucauaacauucauuuauuucaggacugaguagaaauuucaugaaaacaucuggcuucuucaaugaggacaaaaagucaaggaucuaggaugggaucaaauaaucuuaaggaaagaacagguggagguaaaaagauacaaagaugaaauaaaaugagugaugacaaaaugaaaaaauaauugcaauggcacuaaaaccccauuauuagaauuaaaauaugcauugaaggaagggcagaaucaaugacgcauaaacucaaacaaaaaugcggugguaagcacagaaguuuccuuagaauacaaagaaaagaacuaagcaggaagaaggaaaugagagcuacagaugauaaaacccauaaaaccaaguugaggcugaaugauguuucugaagaaaagaaugaaauuaaagaaaguagcaacaaucaaagauaaaagauuaaaaaaauucuaugagaugaagaaagucauguguaagcaguuucaaugguucacagcuuagugguucacaggaaaaccagugaaaaaaaugcaugccuaggcacaugaugauaaccuuuaaaaaguacaaaguuuuugcaaucuauucuucugacaaaggucuaauauccagaaucuacaaggaauuuaaacaaauucacaagaaaaaaaaaaccauuaaaaagugggcaaaggacaugaacagacacuucucaaaagaagacauucauguggccaagaaacaugaaaaaaagauuaacaucacugaucauuagagaagugcaaauuaaaaccacaaugaaauacaauuucacaccaguuggaauggugauuauuaagaagccaagaaacaacagaugcuggugaagugcagagagauaggaaugcuuuuacacuguugguaggaaugggaauacaugcacacauauuuucauugcagcacuauucacaauagcaaagacaugaaaucaacccaaaugcccaccaaugauagagcagauaaagaaaaugugguacauauacaccauggaauacuaugcagccauaaaaaggaacgagaucauguccuuuugcagggacaugaauggagcuggaagccauuauccucagcaaacuaaugcaggaugagaaaaccaaacaacauuauguucuuguuuauagguggaagcugagcaaugagaacacauggacacagggaggggaacaacacacacugcugccuauugaggguuagggugggaggagggacaacauuaggaaaaauagcuaaugcaugcuggcuuaauaccuaggugauggguugauagaugcagcaaaucaccauggcacacauuuaccugugcaacaaaccugcacauccugcagauguacccuagaacuuaaaauaaaaaaguacaaaguugagugaaaaagucaucaaauucugcaauaugaggcaacaaauuuugauuauucuuagcaauauccuuugcaacacuaaauaccaaaugaaaauggaggaguaucugauuuauugcugaaaguuggcuaaaacauguccaugggaucacugccaauuauuucugccuaacagauuauaagaggagguaaaacacacccuacaaaacauauacacagggagcggaccaaaccuuuaguguuggauuccucuaaaugaucucagauuauucaacccugcuuagaaguuacaagagcagagagcugaaaccaacauguuucaggccucuaagauggccuccaauagucugcauguccugguacacacuacuguguaaucccccccuuugagcacagauugaauuuaguuauccccuucuaaugaauagaaugugguagagguagcauaaugucacuuacaagaugauuggcuucugucucagcccucuuucucuuccuugcccugaggacuccugcugucauguugucaccugcaaaacugagauacccacguggcaaggaacugagagaggccuccauccaagagccugugcagaacugaggcccuuaguccaacaucuuaugaggaaaugaacccugauuucaaauuccccccauuugaaccuucagaugggaaugcagccuaggccagcaugucaacugcagucuucugaaaggccuuaggcagagccauccaacuaagccaugcucagguuccugacacaaaaacuaggagauaauaaauguuugcuuuaagucauuacauuuugggauaauuuguuaugcagcaauaaauaaccaauauauuacagguuaauaaugaauaaauuuaagaguaagaaaauaguaagugacucuuugaucucuccgucucuuggcauucugaaauuucuaccauauggacaauuuuugaauaacugaaaauuacucuuggucuugggaaggaagacgccuuuaguuugagcaagagccucauauacauauuaauaccauuaugucucuauguacuacacagauuuagaaaucagcuauucaaccaauuaaaccaacaaucaaucuaucuuuaauaacaaaauaaaauguccaaaagaaaucugaaaauagaagauagaauuaauauagaaaauauccuaaauaauuaagucuaccaccccagaguuuauuuagaaggccugauagcauagugcuagagaucacagaagcaguggcuaugcaaagguuaucuaguaacuuagggcaaguuacauaaucucucaauccuuccccccccaucuguaaagcagaggugugacauguaaagacuaucacgggggcaugguaccuacucaguaaaugugacauacuauuauuacauuguaagagguaaaaaguggcaaagaagacaaaaauuaaauuugcuugacuucugaucucaagcacaggcaucucaaauacugcuguuugaaucuuaauucugacaauuaaaaaacauaggaaaaaaaauauuuugaaaaauggaaagguaguaaaacguacagauuucaaaacaccagagaaaauauaagcaaagaaaaagcucaaaaauggaaaccuaaguaaccauuuaaaaaacaauaaauuagugaaagaaguuuuagaccaauuauauuaguaaugauaacaaauaagaauagcucucuuaaguuuuuaagaaaaaaguuucauaaauuuguucaaagaacaaaauauucucauuauauuaguuuccuagagcugcuguaacaaauugccucaaacuaggcggcuuaaaacacaaaaauguauccucccacaguucuagaaguccaaaaucaaggugcugggaggcccgugcucccucugaaggcucugaagaaaaaucccaccuggucucuuucuagccccugguaguugcaggccauccuuggcauacuuguagcugaaaugaaauaaaguagcaauaacacuucgauuccugccuucaccuucacagggccaucuuccacacagugucuguggcuauguuuccuuguaaggacaaaaacgcucuccuuguaaggacaccagucauuggauuuagggccaacccuaaucaacuaugaccuuguguaaacucaauuacaucugcaaacacucuauuuccaagugagcucacauucacagguaccagacacaggugccagggguuaggacuucaacguaucuuuuggggaacacacaauucaacucacaacuacguacuguguucaaaagguauauaccugaaaacaacuggaagcaauuuaaauauaugacaauaaggaaacaggccaaauagcaugcaucuauauaaucaaauauuuaaaaucuacuaaaacuuuguggaagacuaauacauaaaaauaucagugaugugauaaaacuaaaauuauuaaaauauaaauagaugcuuaaauaugcaaaaagauauaaugacugcuaauuauguauguauauauauacagaaaaaucuuagggaaaguacacugaaauauuaaucaucauugacuuuguugguaggacgagaugauuauuaguuucaucuucauaauguucuauacuuuaaauauuuuauuacaguuaaaacgcuuuucuagacuuuuguagucuuugcauuacagcaguaacaguaaaguauauuuuuuauacccaucuucugauaguugugaauaugcaucugcgcuuuuugaagggauugaaucaauguucaaggaaugugcgggauguaggauagcuguggguuuacucauaagguaauaaugaagauuauacaccaaugacuggguuuacagucaggaucuccuacuugguggcuaugugaacuugggcaaguggucuaacuuuuuuuuuuuuuucuggagugcaguggcucaaucucugcucacugcaaucuccacuuccugggcucaagcgauucuccugccucagccuaccgaguagcugggauuacaggugcccacccccaugccuggcuaauuuuuguaguuuaaauagagacaggguuucaccauguuagccaggcuggucuccaacuccugaccucaggugauccacccaccuuggccucccaaacugcugggaguacaugcgugagccacugcgccuggcugaggggccuaacuucuacgugucucacuguccuaacauuaaagcuggauauaugauagggcuugucucagaacaucauuuuagaaagguuuuugcucauauauucaauaagaauaauaagucaacugcuuuucaccgauaauuugaccagcaauuuccuauggaguaucugauaguaucaguaguacuuuugcaccaaccuaauauauucugauugaguacauucuccugaaaugcaguaugaugacuucaaugacaaacaaggcauaguagucugaaagugaccccuuagauauuuguguuugucucuccccuaccaaauacacagguaaguuugauauauuucccaauauucuuugauauccuucaagugccuugauauaauagugauuuaauguuagagacuuucaguuacuuuuccagcccccaguaaaaaauggccacaggugcugagggcccugauauuaucuguuccugcuuugcccugucaagcugcaugugcugaaggccugugacacucagguguacccagcccagcuucacugaacucuagccaguguguacagagcacagcggucuggauuugcccacuacacuaauucugcuggcagguaugccugauuucugaaucagcagcagcauccugcucacccugauucauucaugcaacagauauucauugagugggaggcccuguacuuacuagaugcugaacaaaauugcaccugccuccucgaguuuagugaauuaaagcacuaaacaaauacagaaugauccacugagauaaacaccaaaaagaaaaaugauaugguacaaagacagagaacaagaggaagaggugaccugguuagauuggguaguuggggaaggccuguuuguggaggugacaauaaauuaaaaacuucaaggaugaaaguaaccugccgugcaaagacugggaaagacuggcccgggagaagaaauaaauucugcugcgugaagguccugaacaggaaagcacuagcccaguaaaaaugauagaaaugaagccagugaguggugcagagaagggaggacagauaugaguuagcuaaacagagaccagacccugcagcacuuggucuuguaggacacaggaagaagugcauuuugauuuuguuuuaauuucacugagaaggcauugauggguuuuaaacaaagaaaaaaaacccagcuauuuaaauuacauuuuuacaaaaguggcugcuuucugaaaaacagauagaaaauagauaauagauagaaaaggguagaaguggaaagacuaauaaggaggcuaugaggagucccaagugaagcauaacggggccuugaacuaguauggucacagagaauuggaagcauuugagcuuuauguugggaaagccauaauagaguuauauuauauguggggaagaagaaguuauauuauaugugggccauugcuaggauucuugcuugagcaaauggcuggcugguggggucauucauugagauaaggauagacuugagaaaaucuuguuggggguaucugguaguggugaagaugaaaagggggacuagaguucagucuugaaaaugugguaacugaaauaccugcacauccaguaucccaauggagaugaaaagaggcaguuagauauccaugucuggaacugagacauggggucuaagcucaggaugaaaacguggaaguuguaauuggaacugccuugugagacaguuaccacugcgaauagagccugagccugaaccccagcuugauuggcagagaagcugaccucccaccuguuccucuucacugugcaguagacccagaucuacccucggaucccacuggaucccagguguuugauaucgagacugauaugaccuagagauuccuugccaggcuucuauaccaaaggucugccuccuccaaucugaauccagucuauacuggaccaggugucuguggucuaccaugagcguguauuuaaaugaguauuagcagaaagguagugucuuucugaggaggaugaauccacagugcuucagggaaguaggguaggaaaaauguuggaacagauggccuucuuugcaagcaauugaauagauauugcucauguggugugaacugaggaguacacaagagaggcaagcccugauauguuuauuucauguccacuuaguccccggcccuuuguacauggugggcccucccacaccacauuccagccugggagacagaaaagagccacggcccacagcaccaggcucugguguucuucuaggacuguccucucacuugcucucuagaacaaugaggcucugaucuccuuguccaacucccuaagagcgaugaggacauuuuaggcagagcagccaaaaggacggaagguguggaguuaagaugcagcccauguaacagccaccagcaguucagugucucuccccgcgagguaggugcugacuaacaaaggaaaaggagcaggagauagcagauggggguacagaacagcagcaccugcucuacagagcgauguugacucaugagauuaaaaggccugcagcgggcaggaagaagggaccagcaggggaagcauguugaaauguaucaugcuguaagcacuggagaacaccugacacagaaacacagccacagugcgguugagggaaggugcaagaucugccuugcccguggacccaggugcggacaggaggcugggcucgcaaagcaacucggguaaaccccauaagccagucugaggagggcaaguuucggugacggcaagcaucacacagggucugcccacaaaggaaaugaggagacgaggaaugacaggagcuuccuccugcacacggaauucgaggagcugccaaacucccuaauagcauggcucccuaauagcuggcaacugccugacaguucuaagagugaugaaauccagagaugaaagggcuuagcaucccugagcagagagugccugugggugagccgacugcucauuaaccugggcugaacacccugcaugguuucuugggaucaacaaacacagcuguaggaaguuuaaaaaauugacaccuuucuugugaaacauagauccacccaugguggcccacaggguugugaaucaaagcugaaaugcagaggcaaugugaggaaaagcaaaagcaugaucaguagugaguggcuccauaauccagaaagcagugauugagggguagcugugggcacagcccagaaccagagaggcaguaaggagagagaacauucaaggggacaggaucuuaaucuggacauggaaggcacuuuaagacagaucaagaucaggagacaggguguucgcuauaugggggaaaucaauaaugaacugccaaggaauaaggauuuauuugucagaguuucucccaggaaaccuccgccaucuuuccccccuccuauaguuucagaacuuacagagaagcugaugcaggagucaguuagggaucaaucuaucaucuuuauuacuaguaaaccuggaccagagaauguggcuaguaucugaggucacgaucagacuuccuaccuucccgcacccaucccaaacgacagguuuuccagaggcagacgcacagcuugcccaguaagauuagcacaaagggaaagaagaacauguccugcccgcaggcaaacugggcugacagaaagcaagccccagggggcugagccauagaaagucagcuacucuccccaguuaggcaaucagauaaguccccccuuuccuuugggagggggcuggcaggaagggugaaagcuuccucccuuccuaguauuuccagaaggacagauguuuccauuuuacgggccucaguagggaugccuggaaaggaagaaaauuagccuccuuccauuguacuggcauauaucgucagauuguacauucugauauuuagagaagaaaaauucaaaugagcuaggagaaggccuagagauuuuuuugauccacuuguuuucaaauguuuuccuuuuagcauugaacucuuucuucagauacaaaacaaaagacagagguguucuuguugaaugggacaaaaacguaagaggugugggaaguccaggcucaacuaagaggacuccccucuccucccuagcaccauccaaaagcaacucagaggaacccggcacuucacacuauaguuuccagaccucugaaaugguucuacugcacuggaaaaauguuaagcagagaaguuaugugacugcccaaauugcacagcugaaucaaugguggagguacucuacuaggauccaucacgguuuggcucaucuugacaagguccuaaaaucaacacagagagcuucaagucacuugaaagggacuuauauuauuaauaccagucuaauuucuucuuaucuugcaauauaccucauauucugaugcccauaggucuuagaggaggcuguaccuagccaggaaguucacacugaaaaauaucacuaaaaagaguugugccacugccaguaauacagaucuuugcaaaguggcaaguaauuauaauccagaugguuuaacuggaggaaaagugaugagcuaauggagcuuccagucaccuccaacacaauaauuugaauaaggugucuuuuucugguuuuguuuuuguuuuuuugccgccccuugccagaagggaccagucaacaaaaacaaccauuugucacaaugggcagcugcuaauucgaccauauugcccucacuauaacccuggcuuuccaugagcaaggaggcggugagguggguguuucuaaacaaacagaaaaaaaccaauucggcuacugcaugcagaaucagguugaaucacaugaaauccaaugaaauggaaacacugaaucacauguuuuuguaaaucauaaauggccaaauacuggcacuuuaauauguuucaaccuguauuucacuggccugguucucaacugacucuuaccuuccaguauuccaaauaacaggcuuuagucccuuguucaucccugauucugccucuuaacuuaggacagggaccaguaaauauagugcagccuucuacuuaagguucuguggacugagcaugucacaggaguuauaucaugcccuuccuccagcuaauacugguucuuguccauucccuuccuucuccuuacccucaguucaugcccacacacccacaaucauacagagacugcugagaccaccaacucauuucauaccaacugccaaacacuuuacagaauacagaagaacuuucacuacuuucagaggucacaggagggccaggaaccaagguuuaguaucucugcauuugaucacuuauucuucccaagaacaucaucgaaaguauauaaaaacauuuauuucuauuauccccuucauaauuauauccacggcauaaucucugcaaaagcaugugcaugcuuuaaaaagccagugagugucaggggaauucagaucaucagacguuggcaagccagaauaucacuauuaccaaacuuacuuuacaaaacaaaguggagguaaagaccacgggaagggaaauucaaacaucaaacaggauugauggguuuaucaucaucgcacuacauuacagagugaccucugcagacuggaaauuggguuacaucaacaaaccucacuuuaaagugugagaugaaagagugccuccccuaacguuuugugguauaacuggcucacguuuaaagaaaguaugcagccagguacccgugucacauuucaaucugugauauugacauggaugugaaaacccaagccuuugaaacugagccuuucauaaguucaacaaaaaccugaaacgcacucuccugcgaagaccugaaggacagagaagguaagaugauaaaggggaaaccuuuacacauggaacauuuuugaauuuuccugccaugggccauaacucaagugugucaaaguagagcuuagcucaaauaauugacauugguuuguuugguuuuccucgaucugaaggcuuaccugccuuguaaagauuccaaaacaucagcaauguguugccaaaguaaggaaaauuauuaggguaacagaaccagccauacuuaaguuggauucaauuauccaaccccaccgcacccaagagugcccucuugucauuuauuuauuuagccaaacuaauuucucuguugguuuggcaaacucucaggcaagcagugaagagcucaggcauuaaaugcaaacuucauuaacccacugcaaaugaucuucauauuuuuucgauaauguuccaaaaggaaaaugucucugcccuuuacuuucaauuuuuagucuuuugcuuuauagaauacagaaaaacuauaauuucuagauuuaauguagaaauuaacagauaccaagccaaaugucuuauccuuugguuuuauuauuugguguguauauaggaaaugaagggacugcagagggagggauuucucagcuucccauaaaucauuugaaacaagguccucagacucugcccacuugugacuuuaagguuaagaaggggaagagagauaucacgaaggguauuugaacuucuuguaaacagggauaaaaggcuauuuguuaauaucuguugaugcaaaaaagucuccaauaguaaaacaccaaaauguccugauaguuuuaaagucuugaaaauaucuccagccccagguccuuccuuggcuuccagccagguccaaguccccuuuaccaggaacacaaccccaggaugcauuacgcuuccuaauucuucauagucugcuucauuuggcaaaggaccuaaaccuaaccacaacaguuaaaaagaaagacuugcauucuacuauaaaauauacaaaucaugaaauguauacaacuaacaaaaacaguuucgguacuacuugaugagaagaauuuuguggggggugugugugugcauguguauguguuuuuuaauucagcauuccaguaaugugaaaccacuguuuaagguagaaaaucauuuuucaaucucaggaaacaucguuacuagcugccaaaagucaauccauauaauaagaaauauuugcuaaugcugaacaccugcacuuuuauagauagccucucaggacagcuguggcugagucuucaagucuaccaauacagcagccaaguaaaaacacaaaauuuuagauaagaaugcuuguugaauuagccaugcauguaucuacacuaaguguaguauauuuauuggugggcucugacaguuauuagauacaauaaaguacaauacaaaauauauccaggauaagguuuccagcugcuaaaugcuuauaucuugaggugguaagauacacaaaucaaaacauacuaaagguauaaacauauaucaugcuuauggaagccauguguaaauauuuauuucacuucccaugguuagauuuaacuuuuuuaguuucauuguuugauuuuucugacuugcuggguuuaagaggaaaaggcagccaccagaagucugagggaaggauucauuaagaaggugcaagaauuguuuuaugucuuucugaaaugaguucuagcaagugccuuaaggauaguuuacacuuucuugcauacuauucaaacaccaugaugcugaaucuucauagcuuucuaauuccauuagucuucucuaaccaaucaagcaagagacagagaaagaugacuuuaaaauuauuacuauaaauaauaaaaagcauuuauugaguaucgacuaagaaccagaaacugaaugacauccuuuacagacagugaguuuaauucuuacaacauucugaaaaagcaagccagacgcaguggcucacgccuguaaucccagcacuuugggaggccgaggugggcggaucaccugaggucaggaguucgagaacagacuggccaauguggcgaaaccccgucucuacugaaaaaaaaaaaaaaaauuagacggcaugguaauccuguaaucccagcuacucaggagggugaggcaggagaauugcuugaacccacgaaguggagguugcaaugagccaagaucgcgccacugcacuccagccugggugacaagagcaugacuccuucucaaaaaaaaaaaaaaaaaaucugaaaaagcauauauuauuaccuuucuuuuacaagcaaauaaauugaaaaucauaguaauugaugugaccgucucaaguuagauauuugauaagucaauucuuaucugguaauagaacuggaauuuaaacucaaguucaucugcugugagauauuguggcauuucuucuguguuauacuuccucuuuugccaauauuuaauuagaacugauuuuuuugcugggcgcuauacugggaauguagcgguaaauuaggcagaugugguccugccaucacaguuuacgaucuagcccgggagacagaccuacaaggaguacuaauaaguaaaauuugggcuauaaacagauaguauagcauacaagaggacaaaaggggaaccuggccaaaugauauaaauucugcauucugcacaagaugccacagaaaacuauuugcugaguaaucaacuucauccucuaaacuucaagucaucccacuguucacccaauucaaucucaauagcgugagauuucuauuuaaauaaaguguuuuccaaucaguuuucuuugguuucucugauuucagcagggccagguagaauaauuagauuagagguacuggauggguucuuaaauuucuuuccuuggauuucaagccuuucuaaugccuuugccuugcagcacacgucccaccuacaucauuucugacguacccuauuacucccucuccuucacccagucaugaccuguuuauccccaucacaccuccagaaggcaaucugacaucacaggcauugcaucccuacuacaucauuuuccuaauauacacccugcuccuuuccucccuuacuggccccuauagcacuuugcacacaaggauggagcaaauccccaaaggcagaaaggacaaauucauauuauucuuggguacugggucuucuccucauacuaagcagaaaagucagaauguuucuggcagcacccuaaucaagcuuuuaacaccuuggaacauguguucagucauuucugucuucagauuuuuucaaaagcaaauacaagccauguaaagcgcugagauuaacuagaauucuuuaauaugcacaggauagaugaccucugccugcagacuacacucucaugagagugauccagccagagcuucaccuacucucuuucaucaaggaagcauuucagaaugcaaauaagaguaauauuauuaaagcaaaaagcuugaaucugcucaauuuuuaaaaaaauaaaccacuugaauucacuuaacuaguaguaauuaauugccuauguuuuacaacacaccucacagccaaggcacuguguuuacaaaccugccaccaaaacaagugccggauauuugaaggcaguggcuaguaacccugcacucuaaaagcaacuuacuguucaacagagguaagcuacagaaacagggacugacaggagggagcucuuuuguggcaaauuagcugaaaucauaaguaguucagauaaaaugcaccacauaugcucaaauacacacccuauagccucuucuaaaaauuucaaccaguaucaggacagauaauaaugcaaucaaguacuuacaaauacucuguacaagucauuagaagaaacacuguguuacugagcccaaagcuuuccuuccacauuggcugauuguauagaaacguuaugccuucuaaaccuuucauacuaaaaaaucuuccaaucaccauauuauaaucucaaagaagcauauuucaugcuguuagcauaauaaccaauuaguuaaugugugaguaugaucacuuuuauaaaacuaagaaacaagagagguaaauacaugacagcaucuguccagguucucaguuagaagcaaaacauggagagacuaagcugugguguuccuaccagaggaccaucacgcugaaguggggguagccaguuuucucagucuagagagccauguguucuaguaguuugcugacuaggaucugauguuaaagaauuaacaacaaauaucaaaaagauguuuuaaaucaaggaacuacccuagugucuggggucaagggguccuccccguuuccuaucaaacacuucuuucuuccuuuagagauccugguuccuaugccucagccauaccucuccuugaugcaagauauuagauuucaauguuucaggggaggcugccuuguguggcaagacaccaaaggaccuucuauucacuagguggucagucuuagcacauucucaccaagucccagugucacucugugagccauaaggauaucuggcuuuucccauucccagcaaacagaaagaugaagcugaauugagaaguugaaaaucuccauuaugauuucccuuuuacauauuuuagugaguuuucccuggagggaaacaaaauuaugaguucaucaaacauaaaugggaaacaugagcuucaucagucauccccgcauauuaaaaguagcuccccuuucggguugcucaugaaauaaaauugguaauagcuuauucccaaacuuuucuagaucuuuuagccccaggagcacacagcaaaagucaccacuccuuucacuaguaauauuuccuucugccuuugugaaauccuugccgggaaaggagggguuagggauaucuuucugaauauuuuggggacauacauguauccaaaaggaccauuuaaaaaauuuuaagaccaaaauaggcaugauuaauuagaauggaugcagacaauauggcuuuuuaaauugugguaaacuauauauaacauaaaauguauccuuuuaagcauuuuaaguguacaaaauacauucacaauguuauauaaccaucaccacucuucacuaccagaacuuuuucaucaucccaaauagaaacucuguacccauaaaacacaagcuccccgugcauccugcccuaguuccuggcagccucuaguuuacugucuuuaagaauuugcuuauucuaggcaccuuuauaaggacuacagugcuuuuaaugucugaaaauucuuugucacucuuuuacaucaaagaguuucccuucccuugacugugggccuaccuuagugacacauuccuaaugaauagaaugagguagaagcagcacuggguaaauugcaggcucagacagaggcaauacagcuuccaccugacucccuccccaccucucccuggaagccagccuccauacucugagaaauccaagcagccacauguagaggucaaggggguucuggccacagccucagcugaagacccagucaacagccagcaucaaccacuagucaugugagggagccuuuagcuaauuccagcccccagcuuuagagccaccucagccaaugucaugugaaacagagacaagcuggccucauccagcccuccccaaaugucagauucauaagcaaaauaaauguuaucauuuuguguccaaaauguagggguaguuuguuaugcagcaauagagauuuggaauaccaaccagucguggugaaugcuggccaguacaucacauagguauauaucagcugaauaucugugcuccacguaucccauagaauagaucaagccaaaaauucacaagccaacuccagggaauccuggagacaauauggcuguggaauauuuaggucaauuaaguccacaguaacuuaaauccaaaguuaagguaggaaggaaucaacagucuugaaucauccagugauaccuggguaucugcacaauggugauuaacauucacacauugauugggagaaaacaaaauucagcuuuuggcuauuuugauaacuugccccuucguuuaauaaauauuggcaauaaaaacagauuaauaggagaucucaguggcagaagaagagacaauaaugcagacagauucuguucuggcaacaacaggacugaaagaaauaaauguuucaaaauauucccuuauuuggagcuucaacacaauguguuuauauagagauucuuauugcuauuuuguguuaauuuaauuugauuagcauucaauguuuuuucuggcugauaacucaugacuuucuuuaguucuagaaacuucuuagcuguugucaucuguuguauauugucuuuucuucacucuucugaaauuccuguauuucaugucucaguucauccccugaugcucuucucuuucauaguauauccaacuuuuucuuucugcaauauuuuauguaauugacucaaucccuauguguuuuuuuuuguuuuguuuuuuguuuuuuucuuuuuuggagacagagucuugcucugucacccaggcuggagugcaguggugcgaucuuggcucacugcaaccuuugccuccuggguucaagugagucucaugacuuagccucccaaguagcugggacuacaggcacuggccaccaugcccagcuaauuuuuguauuuuuaguagggacaggguuuuaccauguuggccaggcugaucuugaacucuuggccuuaagugauccaccugccucggccucccaaagugcugggauugcaggggugagccaccgcacccagccucagucccauuuucauuaacugucacuucaacugcguucgaucuauuauuuauucuccuaauuagagucuuuuucaaacauuuaaacuguaugaaaauuuuauuuacaagauuugugaugaguuauuggcuguauucauucauauuaauuucaaaaaauuugcuuucucuugacaaucucuuuuuacuacuuaauuuggauacucauuccuuuuuuaucuuuucaaagauuuauaaaauaauuuucaaauaacuugagcaaugcaugauaaugucuauuuccuuagguguuaaugcuucccauuuguugggugcacuggcuaucugccuuaaauucccucgcguuuuaaaacuugggcuuguaagcucuucuugccuaggaaauuuuguuuugcuucauuguuuuuaucucuuucuaaacuugccuaccuguaguggauaguuugacaauugccucagcccugacaccacagucuacagugcagaaccaggucuuauaguagaaguccgggaucuugccaggaggaaaucauaguuccaguuccugugggaucacauggaggcaccacuggaaaauccacuggaaugagcagguagcugauuccucucugggccacaucauuucuaccacagcccuugacaucacacagagcaguagcccucgagaugcaccgcgguggguugcauuuagugucucaugggguuuggacgauaaggguuagauuagcucccucuuucccgucucagugccccaggcacuucagcgccagcucgccauguguuuuuucacuguguuuuuguucagcagaaauuuuuauuuuaaauucugcuuuaucagugaaacucuauuuuuuaaguguuuuuuuuccuccaacucucuguguuccaaguagauggagaggcacucccugcuuuguguuccacguguacucacucugccauuuugacuauagaggcaagaaucagaauaagagugauucuuuucauuuccucaaguuagcaugacgaucccuauauuuucagagauaaaauuucauauuuaucaugauggacagaagaagguaaaacaagcauaucauugcauaaaaugauauauuugcucuaauaaagaacuaaaaauaauauuaugaugcaaguauuauagguaaugcaaaggucugauaaauauuugauucagugcuaacuuuuaaauauauaugcauguauauuuaugcaaaaccagaagauacguagaaaaucacacacauuguauuccucacauaggacaugaaccuuucacagaucuccuaagcuaccuuuaugagccuuuaaaucuuuggaauugguggguuuugcuugagauucauugcauaaacaacuuucuggccaggugaggacuggcucuuugguuauaauuuucaaagauaagaccugauugcuugauuuuguaccaagcaccugcuaaaagguaucgcuuuccuggcuaaaagugcaggugauuugacauaugcacugacugacaagagacuucauauaaauacuugucuacaugucaguucauugugaacaaacuuuaauauguucgaaauccugagucaagucagcccauuucaguguaagcccaucuuucugcaaagaaauguguuuuggcaugcaggauauaucagugaauguuuauuuuacuuaaaaaaugaaggagaaauguucuuuugauccucaauacuaaguauucaauagacuuaaaagagaaaaaaauauagacacuuuugguuucgauauuauuuaaaagugucuguacagaaacucagaagcaaaguuacugagcaucuucacuaggugauaaaaagaaugaguaagauauacacaauuccuccucuagccaauuuuauaauauaguuaucuugugcuaugugaugaaucucuuauaaaucacucaauucucuucucucucucugucauaguuuuugaagcuauccuccuagggauagugccuugcacauauuguguucccauaaauauguguauaaugaaugugguaccacuagaagcucaagaugaaccaacauggcuugacuuuuauuuuuaauuagcuaaagaaaaaccucuuuauaauagagucuguauccagacucaugaaauguacaggucacuaaauuuaggcaacccuagugacacuuaagaauacucaugcacuucaauuucaagugaacuuguauacuagucucuuuugcuuaaaaauucuaaauggaagacuuuaaaucucuauuuugaagauguagugaaaaauaaaucauauuuucaacuacuugugugacugacauauacuugacauucaaaucuuuuuugaacaaaugaaugaaugaauaugguuuuacauuaucuguauggaaacagauacauaacauucuuuuucuucuuacucaggcauagaacagcaagcaagucagaagaaagaaacuggucggguaacuccauauuccuuuuucaugucuaucuaguaugucuucauguugagugacuaggaaauggaaaauaaaguacagaugaugaaaauggacuaaaaaauaaaaaugaauaaauaaaguacagaggaacagaugccugaauaccaccacccauggcaaucacagaccaccuaaggagacucagaggcagaagauucagagaagcagguuuggcauuuacuaguuauacaccacaugccaggcccauugucuaaggccguaauucuuacuuuccagcaaaaggccagcagcuuuucaaggcuugagcuuaucaaggcuucagaaugaugcugacacagggcaggaaagaaucaggacuuccaucccaugagggagacaaugucaaacaagaauaggucauccugaggguccaccugugccaaaugcaucccacucauauuuaugguggacacaguauguauaaagcaccauuuccaggcccuggagaucuugugggaaaugagauccugcuccuggggcgcuagcauuccaggagaagaguuagagagggcucucuggcuugggagcaucugcagggauuaaggucagaguccaaagaaaaaacucaguaacuucaaaaaucaaguuggggaugacccuggauuaucaaaaguaaaaguucaaauccauguagcaaugagguaaaucucuauuuuccuagaagaaaagauaggagccuguucaugaccacgggaauaucaacucaguggucuucuagccuucuagcuauguccuaugagaaaagacaggagccuguccauggucaagggaaucuuaacucaguggucuucuagcuaccucugucaaacccuacccaggcuuuugagauggaacugcccuuaugucucaggagacauggacaucugcaggcagaauccgaucuaagcagucuguggcauuaccuuauugauuucaaaaaguaaggucuaaacauggaucacuucuuccccucuaugguuauccagacccaauccaggcacgggauuucagaucaugaaaggacuagcuuuuaccaauuuguagggaaacugcugauuuaguucuuugaugagugaaaaccaucaaauguugaauuuguugaauggugaaacuaaaucuaaacagcugguggcaggaaaaacaaaugucacaugguaaucuucacuccuauucaggaugcauuuuauauccaaaacuuauaaccguccauacacagccaagcuuaggaagaaaggguguuauuaagcauaaaucaaaucaggagucuaugcugaaagcuaaaugguuucuuguuacacguaaauaaugcugaaaaaaaaacagaaucacugaaaguaaagcugugcaauacauuuaugccacaauagagugcucaugaaaacaaauacucucuccuguuuucauauguuuguucuuuccuaucauucuagaacacaggguuagggagacaggaagcaguaggaugaaauaaaauaacuuuggacuuuacagucagaaagauuuggguaagaaugucaaguaaccacguacuagaugauguggucaaaucacacagccacucugagucucaauuuucuaaucuauaaacagagauacugacacccauaucauaagauuuuuguacaaaauuaacgagucucccacccacccccccgaccccgugugugggucucauauacaucuacacacacaaacacaaagacacacagaccaguuuauaaauccccacuguguuagcucagaaucuugaauauacuuuauuauacaacuuuuaaaguauuugcuauaaauuuaccuuuucuauuagacugagagcccuuuugggggacaggagauguaucauauugucuuucugucaugaggauucagaaaguuauuggcauacaguuagucagaaaaaguuacuucauguuuuuguuuuuuuaacauuuauuaugcucauguccuaagagugcucuucuccauuuacugagauaggauagcaucuaaguuccaauauuccauuaugcacaggcaaaaucuuuuuuuuaaccaaaaacaauauuacaaaaagagguccuacuauuuuuuaguuucugcuuauccuuucuguuggucgcucuuucuucugaaauagcaucucuguucuccauugggucaggcgacugugagcagauagcagguauuuuauaaugucaacuaaucaagccauggaugaagaagaaaaggacccaguuccccacuuccagagggucaacgggaagcagggcaggggcuucccucuguguugugacuucauacguagcugguauuacaagacuuuggguuugugcuaaggaacaucacugaaggagaaauaguagaugaaaugagaaagcagcucacaggagacagguuucccuguagcauaaagaacaguuuggaggaagugaugggaggcgcaaagcguaggaucgcucuggcugguugaggaggaagugaggaguguuccaugccuuaguauaaauuuaaaaucaugaagcaagaagucaggagucaauggcaauacaggcugguaauccccaaaaccguucucuccugaagugcuaggcuuuuauuucuccaaugaaauuggccucaaaaauuuagaaugucuccuuucaaacccuguagcuucucacugcaacucugcaggucacaaaaugagcuccucuuguggauuaacagaucuuuucaagagucaugaacauuauccuuccaggguaauuuuacauguaauauaaaauuuauccauaugcaaaaaguuacauguaauuuacauacggauaaaacauauagauuuaaaaacugguauuucuuaauacauaaaccugacagaggaggcagucauuaacucucaucacuaauucugaacaauaacuuucccuggccccuucucaaauaaauuaacuuuauucccaucucaguuacucacagaugacaugaccucgaguaacauauucucccucuauaauggccuucaaaauugaccaccuccuccugccguuauccagcccccuauuccugccacauaggauuauuugagauccacacacauuauuuucauugcuauauccuaaaagcccucugccucuugucugugaggcaaacucagagucuacuuucaaggcuuuccucaaagcucuucaucugagagucuccccugacccucugacaacucucagggagagcaucuacccucacuccugguuuauuacuuacucugugugacagauucugucaugucuaaugacuggcuaaauuauuuagaucugacaugccuugaagagcagcacacagguuuuucucuaucauucauuguuucaaaccacauaaauuaugcuuaguaagugucggcuguauguagcuguuugaaagauaggcaugaacugcgcugaaauacucaagaaggagcuuuggaaaggccaggguuccugcauuccaucccaaguuaacucagucagaaccuaugaggaggaaccuaagagucuggcaggcaugauggacagugagauuugggaaccagugcuguaaaacgaggaugcugaaacagaguaaauccuaucaccugaggucaggaguuugagaccagccuggccaacauggugaaaccccaucucuaccaaaaauacaaaaaauuagcugggugugguggugcacgccuguagucccagcuacuagagacucugaggcaggaaaaucgcuugaacacgggaggcacagguugcagugagcugagauugugccacugcacuccagccuggguggcagagugagacuccaucuaaaacacacacacacacacacacacacacacagaacaaaacacacacacccaaaaacugaguaaauucuaaagcguugaaugcuauccacuuucagagauaauuaaaaaccugaaaggaggaacauuauuuuaucuuguacacacacuucauuuaaacuugcaguuguugguguuaagaaaagagcaggauucaacgucaggugagaucuuuccauucaagauggcaggcguuccugagugugcucucaucuggccagagggccugaucuagaugucccaccugacaggaacccccaauuuaaauggcauacucugauuacugaaucacagcuacaaaaccagugguucuaaacgagaacaguguagauguuuugugaguaugguuauugagggagacauuugacaaaucacuggacuggugcuaaaugauccaaccgccuagcauaccucugaugagcaccuugcauuucaauaagccuauuuaaacaacaaaacauuugcaguaguccccuuuauccaagggggauaugucccaaaaccccaguggaaaguuuagguuauuaaaauagaacaauuauaacaauacacuguaauaacagauauguggauauggucucucucucucaaaauaucuuauugcauaucauauuuuccaauuagaguugauuucagcaaccaaaauuacacaaagcaaaacuacagauaaggggggacccuacugcacaauacauuuaaauauaaaaccacucaauauaguaagcauugauaacaugaaacccgaaguccaaaaggcaauaacuguuauauucaaauaaaugcaggccacauguuucaauuugaggaugucaaugcuguacucaauuccugccagacacauuuagagagcccuccugccauuuagcccuggcagagaaguuucaugucauggugaggcaggagaauagugucuggaggcagggaaccuaaggcuguuucacacugacuuccuagaacuaaauugaaaggaaaacccuaacuuuccaugccuaaguaacaaaaggaccagaagcuacucccuuugcaaacccccaccuuuucugcaaggcagaugggaaacugaaacuaccucugauugguugcuuuuugcaaccaaucagauauuuucauaggaguguaacuuugaaacuucacuucagccugcugucugcaaccaaucagacugauugugggccaagucuuuguuugcacagaagugcaacuuuguaacuucauuuuagccucugauugguugcuuuccacaaccaaucagauguuugcguaggaaugugaccuuuguaacuucacuucagccucugauugguugcuuuccacaaccaaucagacugauugugggccaccacuucauuuacaugggaugaacaccaaauggccaauaggaaagcucuagcagguauuuggacccaagaagauucuguauccacagcccuugaauggcugcucaggaccacucccacacuguggggcauacuuucauuuucaauacaucucugcuuuuguugcuucauucuuuccuugcuuuguuugugcauuuugucuaauucuuucuucaaaacaccaagaaucuggacaccuuccaccaguaacaaugggucuugacuccacauccucuucuuugucuacaugccuuucaaucuucaccaaaaguaggagugggauaaaaggccuccccuuguuggcacuuugcaauaccuuugcaaugcacauaaaaauauaaggaaaacuggaaaaauaaaacauuuucaucauauugccuuccuucaacuugcaguguugaaacuacuugauguuuugaacaaauacucgguaaauaugcugauaugaaaacuuuaacuagacaugcacggggaaaggaacuaguauuuauugagcauuuuccgugugccaagcacugagcuagagaagcagguaugauugugcauguuauacagaaauggaagcucaguaaagauaagcaacuuggcauaggacacacaauaagacccagaacuaggauuuggacccguguuugucugaccccaagaacccauuccccauaaguuuucucauuauugucuguaaaaauguuuacuuagcacauuucauucuuuccugaauccugcagaaagcacacauucccaggagaaagcugaaaauagcuauacuccuaaaauucuaugaaagucucucugggccgggcucaguggcucaugccuauaaucccagcacuuugagaggcugaggcggguggaucacgaggucaagagaucgagaccauccugguuaacacagugaaaccucaccucucccaaaaauacaaaaaaaaaaaaaauuaggcacacgccuguagucacagcugcucaggaggcugaagcaggagaaucgcuugaaccugggaggcggagguuguagugagccaagaucacaccaccgcacuccagccugggugacagagugagacuccaucuccaaaaaaaaaagagagaaaagaaagaaaaaagaaagaaagucucuuuaaaggcaggaaaauaacacagagucugggggaagcuuccugaggagucaaggagugcuggaagguagaauggaacauuuagauaaaggaacguccuuuuggccacaaggugguugaaugcccugguaugguaguuaagaacaaggaggguccuugcagggccuaucaaaggcuguacuacuuucuaaugcugugacuuuuggguaaauugcuuaacuuuuaccauuaguuaaaagaaaauacaaauauguacuucacagggugugaauuucaauuaaauaaagaaugugaagugcuucacaccaugcuugaugcugagcaauugcuuaauuuuuuaaaaucacuccuaauaaauuguucauggaaaaagcaaucaaucauucaccuguccugcacauggacccugacuguucuacagugaggguuuaaguuagcuucugauggggcuugcuaaucagccugcuuaaaccccgccaauccgcuauacuguguuaauguugcaggggcugggggauuucaucuuaauaaauuuauuuuaauaguuugcaccacaguuucuccuggagagaaaacugucuuuguuuagaaaaauacccuaaugaguugccugggguaaaagaggugaggcucaaggaggcauggguaagaaggaagcagcaaucaaagccucacugaagaaaugaagacgaauuuugaacugauggauggcaaggagaaaaagaaagaggaggagaaggaagaggaggaagaggaggugagggagugaggggugcccaacuugguaaggcguaauaaugcagucaagaagaaccuuccaguggcagaguggcuucagaauuuuuaagaacauggauccugauacccuauuuaaauguuuugcugggauauaaaccuucaccuacugcccugaaaaucuucacgaacaguucucugugggagugaaguggggaugaaggggguugcguguuaaggaaaaaggauugaguuccacgucuaggucagcauggagcacagagaaaaaugcagccggaggagguaagaugcagucaggucaagaguucgccaggaagaacuacccaugagaauagguccgagaaugugcagaaaucugggggauggcauuggaaccuuuuaggagauaugaaaugggggauugaggcaauuuuauuucaaucucaaaggacagagugaccucagagacaaggaugaccucagcuaacaucugaguuacaucagcauuuucaacugggggggaaagauaagaaugcacuaugauaagugggguuguagcaggcagucauuuucaaaguguguuuguuuuuuacagagaaacucuucaaaugaaacauuacuuggaaguccauugugaaaacagauaaaagaaggucugcucagcuuggcguguuuguggugugcguguguguguguguguguguguguguguguguguguguguuugcacagaaacguuuuacagagacagaggagggaagucaggggcccuaccuacuugauuuccucacucccgacuuuccuuuuauccaaagagcaguucuacucgugauaggagucuaaccaucgcaguuuaaaaccgcauauagaggugcauuuggcuguuuuucaaaaaggcagcuuaucagcacauuaguuaauuaagcacacaaggucucaaaucagauugccuucacuuauccugugauucuaggaaaaucggcuuaaugcuuuuucauucuucaucuauuaauauauaguagguauauaagcauacacaucuucacaugguuauugugaugauuaaauguaaaauuacauguuaaguacuguaaaaaggacuagcacagaguuaaaaauaaguguuaacuauuacuguuacuuuaauauacgucuuccuuuucacagaaauaauaacauauagauaugagguuaucaaaccauuuccaguuuggcgauuaccuaaaaaagguccugguggagaaagaggagaggauagccuagagcaagaggaagauacugggggaggaggccugaggugggugcucugucucagccccauguggacugggaggagauggagggaagugccagggaagcaacguucuccuuccaggaagaguaaccaguaaaucacuccaagccagagacugucugacauaugacacacaacagaaauuagcccaugaccuguuuaacgcauguccauuugauugauuuacuaugaaccacauacugacccuucuugguauuuuggcccaagaacccuuaauuaacauuaacagaaauaaagugauuaaaauaucaaaacccaguaucccagagagacauagaaucuugaggcagaaagcagaagaaaguaagaaagaaauauuuacaacucuauuucuucagccuuguucuaaaaugaggaaccagucauuauaaaagcuuacaaaacauaauucucucguaugccaucccaaaaaauuauugauuacacacuggaauguguguguguguauguguguguaugagugcaugugcgugcacaugugugugaucauuccuaaaacuuaaaaggcaaguuuaagauuauuaucugaguaaauaaucuucuaacgaaguccaaaagcuaaaauaguacauauuuucuacaaaaaaauucuuggaauuguauugcuuuuaauaaaauuuauuaacuuaauaauuuucuauaaaaggagauguuaaaaagaagagggaguauaaaaugauuuguggaggcucauaaaacaauaaauuguacuuguagaauacagaaaaaugagagagaaaugcagcucuccuauuuacaguagccaugugaaauuaagggcagaguccaguucugcacaauucccuguuccaaagcagucuggguaauuuaguauuaugggauaaauauuuacggacaaagucuaaaauccuggggaugacugaaauagaguagcauugcugauguauuuugggaaagaaaaguaggaacguguuucuaagacuuagaaaaaacuauggagucccuggcauggagagaugggcaaauggagaaagagaguuaaaagccugagagauaaugaaguguagccuucccuuguggcaccaaggagugguuccauaugucuuuacuggcagggagauuucuagaaaauccuguuaucaagcaucagagaguuuggacagagaucaaaugaaucgcccaaggucacacacugugucagagcagaccaagaguuagaacucauagcccugaaguuuccaaucaauuguuuggcucccuaaaccacaaaugcuugucaaggaaaaagucucccuacagcuuaggcaacacagcugcagaauauuagcccaagguuuaaaccagaugggguuucaugguaucacaggcucagaaccuguuuugggggaugcauguggaaagucagggagagagggaagagaggaugguugagaaaacagugaggccuaauuagaucuucccaccccgacagccagccacccuucaaagacacacacagacacacacacacaaacacacacacacauccuauuaaguguuauuggcugauaaaacugaaaauacuggucugaaagaagucaucauuuuaagaauaagucaccaguggguggguauagcaguaugcauauaugugugugaauuuuagccagaaauuaguuuucagaagaugaaaaaaaaaaaaaaaaaaaaaaacaaccacaacaaacaugagggcaguuaagucugagaucaaugaaaaaaguagcuuccacauuuuggauggucuucauauugcugaccgagcagccuuggguuuguaacuguuuugggcauuaccaccagugagagcuugaugaaagcugagguccucucccaggaacugcugaagaacccauacucacaaauuuaucaucaaguuucagaaguucaaagaucaccguuaagucaaagcccaaguaugagaagcccuguuguaagaaguuugaaugaucagauaaagaugugaaaggcacuaauuggcacacugauuuccaaaaaccugccccaagggacacacgucucaugagcacaugggacaccugcuaaaaacacaaauaaucugaagaucucucacauccaaaugaauccgaauuucuggggcuagaaggaugaggcaggugccacagaaagcaguauuuuaacugauggcaccagaugauucugauacacggucagguuugagacccacugcuguggacagcugccuaacgaugcuguuaaccaguuggaggcuuccacgggcuugccucaaaugccugugacaaagguaacagaaguugggggagggaauguaagaauaaugaucauauuuuccaaucucaauuugggaccaagagccuaacaaugggcagaaauauuugaaaucuggccuaucguaaaaacucagggacauguggucauuguagauauaagaugaaaaaugucugagaaaucauugguuuaaagauaagauagccagauggucugcauuaagccagaaaguuccaucauuugauuucacauccugcauccuugauuuucucuugccuguuaccuucuccucaagcuacugaaacacccccuucuuccuuuuaucaccggauuucuccaacugcuccauaugucagaaaaccucaccagagccccuucugaucagccucagggcugaucugcaggccgacaccagccuacucuguauuccuuugcuuuauagccaaaggccccagagauuuaacuuauuccuucuccuuagguagcuacuccaacccacucuucccuggagacuuugugcguucaagccucaagccagggaauaaaaagcagcucagcaucucagcucuaagaauauccacacuggcugauuuccaucacugaucauuacaaggagaaagacaggagaaaccaaaauaacacacauaagaaagcuccccagaguucaggggagcaguguucuugcugcuguguucgcugggcuagaauugcugacuuccuuguguaucuucaauuucugacuucccauuuauuccucaaccugcuacaauaauaaauacaauacuaauaauacauauauguauauacaaauauuuguauucuguaugcaaguaaauaagccugugaugauagaaggaauaaaaauacaggcuaaaaaaacauugaugcuuauuucgagaacuguuuuacucgcugagaagaaacaaaaggaaacaggcaacaaaaugcaaaacauccuccucucucuguuuaucauggugguuugccuucugauaaauacaaaaaauagaucugaauuaaaccaaaguaaguuaaaacucaccaagacuauuuccaccuaaagauagaugaaguuuccccuacuguuuugcaaacuuguuccucuugcuauuuagcuaacagugaggaaagcaguccuauaaauuaacacuuaacaaucuauuuguguuugaaaugauaauuuuuaucagucucauuauuauuauggccauucaccaaaugcuaaguaccauacuauguuaagaguuauuggccgggcgugguggcucaccccuguaaucccagcacuuugggaggcucagguggauggaucaccugaguucaggagcucaaaaccagccuggcuaacauggcaaaaccucgucucuacuaaaaauaugaacauuagcugggcacgguggcaggugccuguaaucccagcuacucaggaggcugaggcagggagaaucgccugaacccaggaggcagagguugcagugagcagagaucgcuguugcacuccagccuaggcaacagaacgagacucugucucaaaaaaaaaagugauccaaauugaaaaaugagugauguagguagaguacuagcuugccacuauuuuauagagauagaaaaugaggcuaaauaucuugagguuaaauaucuugagcaaaguaacauaaauucaaugugcuugaacaagugcugugcugguaaauguuuaacaaauggcucuuuggggugauaggagaguccugaucuuuaguauuugcugguuccaagguguaaauacccccaacaaggggaucacaauugucagguaagguacaucccugacaucaugcacaccguggcuugaauauagaccagcuuaauucuaaaaggagaauauuccuucacugccacauucuugagaauggaaguaugaguauggaaauuggacacuggacauguuuucuuccuggcaguaucaaacaauuucuaacuaucagcuauuuucacucauuguaaugguaaaauauagaggaaagccacuaaguuauccuguugcugugugaagucagagucaaagugaaaacucuuuguagauaacuuugaaagcugaauugaaaguaauacgacaaggaaacauuauauaaaguaugauaagcccacuaauggaaacuaucagcccucuuuuaacauggggcugauauaacaaaugacaucacaaaugaaucugaagggaaaaaaguuuuaaauggcuuuacuggguugaaaaaacuuugagauaaaagauaggaauuacuucauguguauucauaaaacuaaagugaauuuuauuccuguaucagauuuuaaaagcuauauaauaaaaauauauucucccacauauuaaaaaaucccaaacaaaaauuguaaagcugauggaaaggccaugcauuauuaauauauaaaaacugucaaacaaaaaaauucaaucauaaaauuggcagaaauuauuugcuucauuuagauuuuaauauaaaaacugugaguacucuagaugaaggaaaaaaacaaaauuaauagauguaugccauuuggcaauguaaaauaaacaaaauauuuuccaauuauuuaucagaaaauuucuuuagccuucauuuuaaauauacuggccuacuauaggauggaagacaauaauacaaacauuaaagaauuaauaaacaaggcagaaguacucaugacuaguaauguagauguuucaauuauuuaauuaaaauaguucuauuaaaaugggauugcaagaggccugguuauauuucugauguaauggguucuuacagaagcagacaugcccaugggccuuuguaaauaauagaaucucaucucugaaagaaaauauggaaggcgucaucuagccaaaggggaacucccauaguauuccuggccagagugggagaggagguagagguagggaguguugaauguuagaaugugacucaaagacgguggguuuucagcacauucuaacaucggauggcucuaauuaggagaguguccaucuuuguucaacaggauccucuaucuauaaguucagacuuauaauuguuuccuaauucugucuccuagaggacagaaaugacagaaagaaaauaaaauuuagaaacagaaaaaucagauuuaaauucugaagacaucaccauuaacaagauuagcucaaauaauguaguaucugagccucaguuucuucacuugcaaaacagugauaaaauagauaccaacaaaaauuauaaaagucaaaugagauaaucauguauagugccuuaugaacgaaguuucuauacaaauaaauaauaaaucaugugaacuccaaaaauuacuucugacagucccuaaauuauuugaaaauagcuagcaaaugccaucaaggaucuucgaagagggaaaauuucauauucaacacagaauguaugaagacaugcuacuagccugaauaucuccuuucaaguuccaguuuggucaugaaaacaaaguuacuuggucaugugcaauucuaggacaguaguauggguaccacuuugaugcugcucauggcuucaguagaagucugguuagguucugacuuauuuuggcaguaaagcuacagcaauuccuguugagugagauguggacugugagacagucaacuguaguuucaagauuuguguccugagcaacgggaaagauggacuugccauaaauaaagaugcagaagacgguggguagagcaagacuagcagaaaaauuugagauguuuaugagacauccauguagagauaucaaguaguacucuaacaaaauaagaauugagaggaucaaaaaagaaagauagcaguaauaaagaaugucaaaaccaacuuaagaguucuuugaaaauaauucucagaacauuagcuguguaacaggucuagaaaacaaucacucaaaauucaaaaagcccccaagaaugucuucuagagaaagaaugaaauggauauacauaaugacuaagcaacaggauuauagugaaguaaaaauacuuuuuucucucaauuauguagaaggcaauuaaaacaaaaagaaaaauaguauuucagagucgaugacauaugaaaaaacugaaggaagacaugauguugaacaaucaguacaauguaagaaaaaacaaucucuuuagcuuuuuuaugaguagcacaaggguuauaucacugaaagcuuugagaaaaaauuauagucacagcucuccauuggaaaaaaaaguaugcaguuauugguuuucaguguuuagaaucaauuuauagacaaaaucugaaaguuauggaauuucuaagacauuuuaagucuucccagauuuuagaauuucacuuuuuaaucccaguaaguuauuucuauaauggcauucauaaaaguuaagugccuuuuuuucaaguagcuaaauuucuuuucuccuggaagagcaagucaacgaguaagaaaacaugcacacacacacacacacacacacacacacacacacacauauaaaucuaaccaguugaaucagaauuuuacuggacaucugagcucuuguacugugagucaaaguucuucuucaaaaauaugucaaaaggagacauuucaucgguacacuucagauagcauaaaaguauaaagcuucaagcuugacagaaacuuuggaggagaucuuauucaaagccuaggacuggaugaccucucaaagcuuuuaucuaaccuugaucaucuaaaaguauucauuaagcccccuuaugacaaagguuuucagcuagacauuaaaauaguguucauccauuuuucaaagacauaauuccagucuuuaggauugauuucuucaaaauagugggaaauagaggcaaaugucuuuggauuuuuuuuuucaaauauuaaacaagaagaaaaagauuaauaaauaaaguguagguuuaaaaaauaagacaaaacuuauuugccuuguggcacaguaugaaaaaagucauaauuaugccugaccuuuaauccacuaaaaaccaccuuuucaaauuugaaauggaaaaauuuauuggauaccuggguuuuacaugcaaaugggaaaauauagacuuuuccaggacaaccaacaucaaucaaauagaagaugcuguuaaauguguugucuccaggaccccuccauucagaccaaaaugcuacuugaggccuccauuccccuuggagggcaaggugggaaggggacugaaccccacuucuauugaagacuguuccccaacaggacuucucccugagugaaggacaauaguccuuauggccaccuucagagucuuuccuuguuucacucguuccauggucccacaauccaccaugcacuucaaguggacuacuuacuccccaaaauaguuugcuuugucucugaggauaacuagguuugcauuccuauugcaucauuuacuagcauauggauccugggcaaaccacuuuagcuuuauuucgcuuugauuuucucauguauaaaacuaauuuaauguugggcgugguggcucaugccuguaaucccagcacuuugggaggcugaggcggguagaucacuugcggucagccuggccaacauggcaaaaccccgucucuacuaaaaacacaaaaauuaguugggcguggugguucacaacuguaaucccagcuacuugggaggcucaggcaugagaauggcuggagcccaggagguggagguugcagugagccaagaucgcaccacuaaacuccagccugggccacagaguaagacuccaucucaaaaagaaaaaaaaaaacuacuuuaacauaccuaguuccugguuucuucaaagaauaaagaagaaaacacauguaaauacauuguucaguaucuggcacauaauagucauucaauaauuauuaaccacauucuccagucauauauuuaugcuauuuuucacauuagguagugauccugaaauaaaaaauauagagaccucugagggaaaagaaacaggugauguuuccaagagauaaaugcauuaauuaaaccguaauauuauuaaacauauuaaaugguauaggugucuuucaaaauggagagcaaacucuucuuaaucacuuauuuuacuuuccaugcagugaagggggcacauaagaauccauggcacacacaaccaggaggaugaagcagaagaaggugggaagccccauuucuuaaaauuaaagcuuauacuugggcuuaugauuacacauagaaagacaaaaauuuuauuugcuccuaaaugauccuuguguuuucgcuaaacaauugaauaaccacaauauaccacggaucccacauuuccaugacugaaagaaccuaggagaucauguauucugcccaacuucuccacugaacagcagaugagcucaggcagaaaaaguccauucuacagcgauguguuggguacccauucuguaagaggcauggugaucuguauuuaacaaggucaccaaggccuucugacuuucugcucaggauccuucuagguuccuaucuugauagcaaaaaauaaauuuuuuucucacuugagaauuaaagggcaugaauuaacauaacaccacaauaaacaauuuuauuuacugggauugagagguucuggaaaaaugguuuucuggguaggugggaauguccagaaaacauuuuuguuaaaaucuguguuaaaaaaauugcuuguuaaucuauauuuauuguauugcgacauuuguuuaaagaaaaaaaaucuuugaaaacugaggagcuuguaguucccugggugaucuuucaucaaucugacuauagauggaaucuguauguuauuagaucaaauuugugguggauucagcauucaauauagaauuagcaguguguuuguaaauaaauucuuuuuaaauuuuuaucauuuucuuuuuuucuuucuuuuuuuuuuuucuuuugagauggaguuuugguuuguugcccaggcuggagggcaauggcgugaucuuggcuuacugcaaccuccgccucccaaguuuaagcaauucucucaccucagccucccaaguaacugggauuauaggcaccugcuaccaugcccggcuauuuuuuguauuuuuaguagagaugggguuucaccauguuagccuggucucaaacuccugaacucaggugauccauccacauuggccucccaaagcgcugggauuacaggcgugagccacauuaucccuauuuuauaaguaaagaaacugagacacagguuaaagaaguuacccagggucacacagccauugaguaguauggccuuuaucauuuuccucuuuauuuucaauacaggagaaaaacacuuuccuaaguucugauuucaacaauuuuguguuuguuuuuaauaaacugugguauggccucauuaaucuuuaaaaaaaaacagcacaacuaccauuaagcuggugcaccuuucccuauuuccaucuauagcaaugacuacugcauaaacuaacauuucccaaagcaugguccucugacacugacuuugugagaugcugcaagaaauaaagaugucagcauaugauugucuccuccuggagacagacaccuacauuggauuagcaaaggauucucaaaguccagcagaaaagaagccugcuuacauuguaugugcuggugguucccaaacuaacauaaagcaguacaugucuuuagcagagcauguauuaacauccucugacuugcuuuauacagaacagacuggggaaguuggcuauagacacacaagaauguguccucuucucgaaugcagaacucaacaaaauuuagggaaagcaagaaaaaugaagaaacauucuucaaagucaauuggauaauguaguuaaaaaaaaaaaacagccuugggguuguuuauaauuuuuggcuuaucuucuacccugaccucaggguaauucccugaauuaaaugguaggcuuucagagaguggagacuaaaaaccauagacauacgaauuagcacagauaugacauucgaaacaugacagaaauaacuugaaaauaaaauucaaacuguaacccauaguaugcacuacuauguaguuagaaauacugggugcaggccaggcgugguggcucacaccuguaaucacagcacuucgggaggccgaggagggcggaucaaaccgaccaacauggagaccagccugaccaacauggagaaaccccguuucuacuaaaaauacaaaauuagcugggcgugguggcaggcgccuguaaucccagcuacuugggaggcuggggcaggagaaucgcuugaacccgggaggcggagguugcggugagcugagauugugccauugcacucuagccugggugacagaacgagacuccaucucaaaaaaaaaaaaaauugggugcaggauaagacugggaaggaagagcaaaugugugugucagcuguugcaagaagacuacaccauugagcucaucuuuccagaauaaaagaauucugaugaggaaaacuaaugucaagaagccacugccuaugcucuuuaucucucugucuccuccaucuaucccaguuggggaaaacaaagucaugauggagcuaagugaagucuaacuccacacauaaucagagaauaaacugucuaaacacaguuucugagugcccgaaacaaauguggccaugcagaucauuagggcaucuucacuucgugccccuuuuagcgacuccagcugugaaagcagccucauggugacggcccccaccaaaacccugcuaugacagccccacagucuuucgaaguaagaggcuucacacauacagacucucagggggagucuggcauauaagaguaucguugaauuuggcuccaaggauuuuuuuuuuagauggagucuugcuucauugcccaggcuggagugcagugacaugaugucggcucacugcaaccuccgccuccuggguucaagcgauucuccugccucagucucccuaguaacugggauuaugggcaucccccaucaugcccagcuaauuuuuguauuuuuaguagagacgggguuucaccauguuggccaggcuguucucgaacuccuaaccucaagugauccaccagccucagccucccaaagugcugggauuacaggcaugagccaccgcaucugguggcuccaaggauuuaagcagugacuuuaaaauucaaaauauauuuaagaaaugcaaauacaauucuaauaaucauguuagcuaauauuauuugaauguuaccauaugccagauacuguacuaaguuuugcagguuuuucucauuuaaucuucauagcuaaccugugagauacaagcuguaauuauucccacuauacagaugagaaaaggcacagagaguugagguaaauuucccaaggcugcacagcuaucaaggaaggagggugaugcuauuccaaucuaggaaggcugacuccagacucuguccucuuaaucuugauaccaugcugcuucuuguaagcuaaacaaaagcuuugguuugccaaaguaaacaaagacaagguccugauauuucuuguuugugugguggcugggugugggcucuagagggcaaguguacgaguucaaagcuuugcucugucucuaaguggguaagggccugcgagcaaguauucaaccucacuaaagucucagccuccccagcuguaacauauggaucauaaugaucagcauuccagggcacuuacuaugagccacauauuccagagcacuuugcauagaugaacauauuuaauucucacaacaacguaugaagaagagacuguuaucuaauauuaccuaaauaauaguaggacuaaagguucucgcagauauaaaguacuuugaaaaacggccuauccauaaaugcuagccacaagagacaucaugaacauagaaauaaacugcauaacacauuaugaggaucauuauuguaauuuaagaauguuguuacuaaucagugaucuguuguaaaaaaaaaaaggggggggaaucaaaguuuuuaacagugcuuuaaugagacauaaauuuauaaaauauuaacaauaaaaaugacuagaagacagcucugugauagugguuacagcagcagcucugcauacaggcugcacagaucauaucagcuguucuacucaauggcugugugacccuggguaacuucuuuaaccugucuaugucucaguuucuuuaccuauaaaaugaggauaauaaaaaugccugccuuaauaggauuauaaaauggagauaauaagaaaguuugacucacaggacaaagaguuuuaagugagcuaauauacguaauguacuuugaagaaagcuuggcagauacccaaaaagaguuagcuauuacuaggaguacuauuguuacuacuaccacuacuaugcaauuuuacuaccuaacucaguauaucuugugagagaauuauuaacccaagagaagaaauggggcacaugguguagagaucacauuugauuuaaaauaaaagcaacacuccacaugaagauccaguaacccuauuuccugaaguuugugaaaggacauucagucauucaguauguuuuguuccucuuucaaucaugccccaccauuaauaaucuaaaauggaaaacuuccuaggguauuauuuuaaaugagucauuacuaaccauuaugaugcagccugaaaauacaacuagcacuucaaagaaaauugaauuugcuaauaaauuaugauaauucauuuuacuuuacacagggaacgacugacuguuuacagauucauagccuaauagcucuuucauuuucaguguuggaaaaugaaauauaccucaaagcauaugguuauucuggagacauauuacuaaaucugaugcacccugacuaaaaaacuguaugagugaaccaugaaauguacagcaaauguacaagaaguuaccgucaacagugggcagacaaggccuggagucagaaccaagcacacucaggggaaaugucuaaaaugcaugccuuuccccuaauuccacuuccuuacccagccuccccagacguggguucuggaucagaggaggagugcugauccagauagaaauucugacacacauucaguugcuuugagaauuaccauaauuaaucuuaaacugacaggaggcaagaccaaaguucaugauggaauucgaagucuuaaacacaacuaaauucccuuggcccaaaguggagccacacauaauaagcuguuaaaaaucaggauuauuguucaaaccagcacugggauuccaagggcaguccagaaucacuaggauuugcugguuucuucucagaacaccccauuucuaaacacucaauuuuggcuuugccaaaacaaaugcaguuuccaagggggagcagaugagguguaaguugaaccauuacgcguuacaagucgaaugucugaaucauuugagaacuagcucucuucuagcaaaauguuuuccuagaauuuuuuucugacuuauguauuauauuaaugcucuucccuacucaacaaauuuuaucacucacuaauagacaacaaaauaaaagacacaccacaaaaaucaggaccaagaaaaauaacacccaagcuaaaaaauauaucacaaaguuaauauaauugggccacagauucuguuuuaagcuuccugguagucaaagcaagaagagaaaagguuugcaagaauuaaguuaaagggauugcagauagagacccagauguaaaugauuauucaaaaauuacauguauaaauauuuccuuaauguggguguacuuaagacuuacaugcggaugcuacaugaagguuuuccuucacacuucccuuccagagcaauggcugcugcccuuucccuuaggccccaagccacuccagaaggaagugguguccugcagacgagacaauacuucaguuuuuaaaauauggucaguguuuccauuuuaaaccaaaagaaauaauuguuauuauuauuauuugaugaacaagcuuugugguuugggaaccucacauggcaccuauaauaccaagagcucaauaaauguuaacuaacugaauugagcuuuguggcuaauagccugaacacuuacauugcucuacuccauuauaaaggaaaauuugaaaguaauggccuauaaugcauucugauuuggcuuaaaaaaaaucaaaaaacaaaucacuuagcguuuugaaaugucgacuuaucaagaacucagaaagagaucauuuguuacuccaaugcauuaugcaaagcaaaaggucaguaaacaugugcuggaucggauucggcccaauucuucagguaucagcuauauagucacaauccauuuguuguuuugcuguuauuuuuuuaagaguuuucagugcaauuuugaaguaccaauauguaaacaaaaguuaagaaacagugugugaaagaauaaagugauaaucacauuucuuuuucuuuuuuuuuuuuuuuugagauggagucucgcucuguugcccaggugcaaucugcuuacuguaagcuccaccucccagguucaugccauucuccugccucagccucccaaguagcugggacgucaggugcccgccaccacgcccggcuaauuuuuuuguauuuuuaguagagaugggguuucaccguguuagccaggauggucucgaucuccugaccucgugauccgcccgccucggccucccaaagugcugggauaaucauauuucuauuguaaggaagaauggagagaacuucccaugcagugagaagcuacccugcauccauccuggucucugguacuuacaugaaccuaaguuaaucuucacaauaauccgaucauguacacucuaccauuaucauuguuucacagauaaggauacuagggcucaaagagguuaaauaaugugcucgagaucacagauacauacagcaagagaauaggagcccauuuauauguaauugcaaagcucauguuauuccuagcauaccuugaaagaacauucacauagcagaauacaggauacuaggcccauuuuucuaaaugagaaaaccaaaaaaaaucagaaagacaaacuggcauuguaguguaugcuagagacagaacuacaacucggagcuguucuaccaaucacaguagguuugcucugaaaagugucacugacagaguguccgugacauucugaagacaguuuaaguuaauaaauaacaacaauguguuuucccucuuuucuuuuuaccauuuuuggcucauugguaaaacagacuuuguaagcuuauuugugaauucaacuauuguacuaaaguacaaaaggacauaauugagauaaacuaaaaaauauaauaaauggacuaaaaacacaccguuuucacaagggaaaccacuauuuucuaggcugcauucccuagagcuagagaaaauacuucuaaugagcuuugaguaaucccauaaauugaaaaccuaaccuuguaaugccugauaguaaucuaaacuacuuagcuauguuuuguauuauaccacaaaacagugguuuguucaugaaauguaacaaaauaucauguguuacucauacuuuggccuuaggcuuacauguguugaaaccauaauccccaacguauuucagaguauguuuggacaaccaaaguuacccuacgaaaaugacccaaaaggaaaacccuauuccauuaaaaacacaaauugcuaagaguuaaauguuuaaguauugccuagaguguauaaggaagauuuaaaauauaguguucauuuuucccacuuaaaaaaaugaaaaaggaacauucaggaacgaugcaggaaaguuguaaauuagcuauauccugaucuacuucauguauguuacauuacguaauguggaagaaacgagauacuacaucccaacaaaaggcuguuugauacaaagagcuucagauucagagagaaaggggcuaccuugguucuaaauuaggaagacguuucaggguaaugcagaauaucagaaacuaauaauagaacucacagguugaagacccucaagucaaaauaccugaagcccaucuuggaaauauucauggacauuauugaggccauaaauucuccauagacagggcuaugguaguuaagaaugugagcagcaguaucagguagaaacaugucuaaaacccaguucuguaauucacuaggucuauggccuuaggaaaagcacuucaccucucugggucugaauuuccucuuuucuaaaauggauacuuuucucccagaguugugaggauuaaaugagaugguguaugcaacaugcuuaguaaauuuccuggcaccuaguaugcacucaacaagucuuagcuacuauuauuguugucauuauuauuguuuuaugaauaaucuucaugauuuggggacuuaacaggguaacuaugauaaaagagcucaauacauguuuacuaauugaacugagcucuguggcuaaaagcuugaacacuuacauugcucuacuuaauuauaaagguaacuuuuaaaguaacaucauccaaacucugggaaauacuggguuggccaucaaauaagacugggaaacgcuagguuccugcagaacuucucagagucuucaaugucacaagguaaauuauaaaauucagccaggugugauggcucacaccuguaaucccagcacuugggaggccuaggugagagaagcacuuaagcccaggaguuugagaccagccugggcaauauagugagacccugucucuacaaaaaauuuaaaaauuagcugagugugguggugcauuccuauaguuccagcuacuuggggggcugaggugggaggauaacuugagcccagagguugaggcuguagugagcuauaauuguaucacugcacuccagccuggcugacaaagugacacucugucucaaaaaaaaaaaaaaaauccagaaaaagcauacaauaaagccuucaguguuucucaaauuuauugcacagauuccucaccuggaaaacaauuuuacaacaugaucucuacauuccucccuccuaauuaaaagguuagaauaucaagcauuuuucugaucaaauuaugcauaugaauacauaaaaaggaugauucuucuucgaaagcaaaacaaauuagaacuuucugcauuuucccuuuccaaggcccacccaaaaaggacucaaucucugaugcuccaucauguauauaacuuaauccuuuaacuuaaauagaucaaguucaucuagaguuuauuuuuaagucauuucugauuuaauauggcuuuuuaaaagcuuacguugguugacauuaaauccuagauguuaacgcugacagguuccaugauaaagacuugaucauguaagaguaaaacauuuuuugaaaaacuuacuuuuuaguagguuucuuauuaagacaaaauguuacccaaauccaaauccucaacaauguuuaaugugguaaaagcaguuaaugaaacugucacuuuaaucuccuaaguaaaagggaagcaggaaacaaggaaaggcuccauuugccucuauuccccuguauuccacacaaagacgcuuccuggaugcucuaggaucccaaaucucgcccuuuugcauuuucucucucugagcugaagacccuguuuccaucuguguaguggguauccucacacguggucgcuucaguuuccauaugcccaaagugaaacucacgacugcagcaccaaaccuuucucagcucauccuguuaucagugucauccacacuuucagucuucuucaaugcuuccuucuuugucauccuccaccuucaaucaacuuucugccucuuagaaagcuuucccguuaauccuuucuccaggagccccacucucuuuguccuucuucuuuugucuuuucugcuccaacagaagguagacagcuuccuguugcuauuuuugacauuccucuacccucuauccauccacuaccuuccugagagauguuucuaaaaugaaaagcagcccucacacucuccuagugacagucguucaacgacuugccuucuccgacugaauacgaugcaaucugcucagcaugcuagacaaggcacugcacaaacugauuguaaccuaccacucuagcccaccucucaccaagcuccacuccuuggacuccagccucucaaaaggcccugugagacacacacacaccauuucuucuaccaucuacuaucugccacgcccaaacuugucuuacuggcaaacauacaaguaucuuucaaacauacaaauaucuuuuaauacuuaccucucaccagccugcagagcagauccuaacuccuaccccuucauaguguuguuauucccaucucuguguuucccucgcaauuaauaucuuccuuuauuaguguguuuuuuaaguucuccucuggacggaguuucucaagauuguagguauucucuuuucuccuccauuucugacugcucucuacagcccuacacaauggcagguacauagucggugcccauucaugucuguucagugacugaaaaauaaaugaaugaaucaaauccaaauagauuuuaaggcuuugauuuuagaaagagcuauguuaaacauaaggaaagccacacaaauaugccaaaucuuguauucuccaaaaaaacacggaauaucuugaguggaaagagugaguuacuagguaauucuuuguguggguccauuugugucugugaacauaaagacguacacuuugguguauugugccacugaacugaaugucaucagagcaaauguaaagccccauuccacgaugaaaggaaacugguggcucugaaguugauuggaguaaaacauaaaguaaguuaucauuuguuucuuugacauaaaauuuccccaaauaacucaaggcuguauuuccauggccaucgucuuaugcugguagagcaucacuccugagaggaaaaucugcccccguguuagcaaaagcuugaaauucuuuaagccaggcgcugagaggcggacgcgugugcugcucugcccagcagagggcacacagcccccaauaccgugcaacgccggccaucaaagcgggcuggcaggacugggugaaguuguucaacaaacccaagccuuugaauccgggucagcgugcugaccuccuguccuugccugcuccuuggcauucuguucuguucuucccacucacaaugagguguuagugaaccucaagcucucaggcaaacccguuugggagcaaauagggagagggcaaaggugaggcucuucacucaggagugugaugauuucuuggaaaaggaagcuuuaacucacuccuacuuggccuuacagugacagaaagcacccuaaacuggcuauagccuacauucuaauucuuucuuucuguaagugaauaagggacgaucaagguggggguuuucaauaggccccuguccccaaacugaaugaaaaugacucucuacucuuacugauuugguuuaaauaucuuaggcaucggaaguguaacguuaagaucacuagucuauuaaaaggcucaauggcauaaaguccuucaccuaaauacguuauuuauacuuaaugagcuuguagaagaggagcgaaaacaugacauccucucacauucuaaaaacagaugcuucuguugaucuauguaagaggaagggccagugaucuagaaagaaaaaauuaaaaauacaaaauaaaccaagcagauucauguaacauucaaggaaaccuacaaguucccacgcuuuuucugagaaaagcaagggaccaucauaggccuugcagggagauugcuugucugcucuguuaaucaugaaacuuguuaagagggaggagauagcaagggccucgggcgaacacucagaaagaugucacaaaauacuuuuuuucuuccuucaaaauaugccucaagcacagaaacgagaagccugcccggaauuuuacccccacauugaggaaccucccccacuccuaugcaaaggucuagaagcaggagggaacauggcuacugaaaaaugguggccaccucaggaugggcuaaagaacaaaguggggacuggggauaaugaaagaugaagguugguguaacucacuguaaauagcgcuaaggauauuaucuauaucuuaaacucacgagaagccacugaggaauuuuaaacaggggaaugacaugagcagauuugcauguugggaagaucauucuagaaauagaaaauaguggggcaaguuuaugcauaucaaacaugaaaugucaaauuaaauuucaugcuuacuaauuaugauagggcauggcaagaucauuaacuuauuuuugaaaagcaggacauaccaaauaagaaggggaauuuuucucauuucuaguccacuugacuuacacccuaaacccagggccucaugccuugaacaaugcuaagggcuacuauuuaugcagaccauaaggcugagaaccaucuaaauccagaauaaaaucucaagggauuugagauuuuaucaguacuauccuacuuucaaaucauaaaaguauuauucauuauacaggaacuuaauuacacaaaaaaacuuauggaacagcuacuauauuuaauccauuguacuagacucuuuugggaacucugagaucaauaaaauguaaucuuugucuuuagaaauucagagacuacuucaaaucaaguagaggaaaucacuucuuuuuuauuggguuuauggguaaccuugggcacacaagaauaccaaagaaagcacuuucgcuaucauuaugcauuugucauacauauuccuauguaucuaaacccuuuuagucucuuaacauccaauuauucaaguguaaauauagagucugaacuuuggaaaaucaaauuuaaaucaacauauuuucuauacucucagguugcauuucuuugaaaaauagagguuacauauucuuaaaaacacaugagcaccaacuagaggauaacuguaagugaagaauauauuuaauucauccuagaauuuaacuucccuagaaguucacaugagaguucuguuccccucaguccuauuuaugcucagaauuacuaugccagcuccuuguuccaacaucccaucacuacugcaguucugaaaagcagccacccaagacuguuugggaaauuucuaccauuucuagaagaaagugagaauauccuaagagugucauccuguuggaaaauccuaccacuacuaugaauaaugucuaggaugggauugcuaaucccauggaagggagagauaguacauacaccuagaaaugauuagaauggaugacaaaaagaacagaagaucccagaagggaaggaaacaguuccaguagguuuucaugaggacacuaugacuuccuacuguugcaagccaaaagagugagggucaugaucagcucuguauaccacuggaggcuauaugaguaaacagcaaacuguucucaugaaagcaggauguuggcaaacugacaaacugagucugugguccagaaggaauacugagggcagucacaacccaggcacaaguguuucuugugaauagacacaucugaagccuguuagcaauaaugugaaccugugaucagucaagcagcugaccagucguuaccuccuccucccugcucuuucuacccaauaaauacgaagggcuguaaaggcucagggcugcuguguuugcucaccagaagcagggagcccucuucuuccccccgacagaucccuucauuaaaacaguuucuuuuaaguuuucauuucuggguucaucccccuucauucagucccgugguaaccauggcaaagcacagcauccuacugccucaguaacucagguuuggggguugguugguugguuuuucccauggcuuaaguauauaaccaugguuugaggguugaccuauaaucugauccuacauuacagcagacacaauugagagaggaaacaaaucuauuucacucaacagaguugggcugagauuacuuaaagugaaaccauguuuaaaauucuaaguauuguuauaugaagaggucuccaagguaaaaacuugaaagaguaugucuauaaaaguccaaagaaacuauuucuaaaugaaaauguugagugcuuuaaaaugcgaacucucaggcaaagggcaauccuuuuuuagauacacuuugaauuuggcaauuugaaggguuagaucuuauuugaaggguuagaucuuagaaaaaggguguccaaucuuuuggcuucccugggcuacauuugaagaaguaucuugggccacacauaaaauacacuaacacuaaagauagcugaugagaaaaaaaaaaaaaaguccucacauuuuaagaaaguuuacaaauuuguguugggccacauucagagccaucuaggcugcgaacugucugcaggccgcauguuggacaagcuugucuuagaggcuuaggcuuucucaugcagagcugcuguugucaaauacuagaagacaaagcguaagguuccugugauacuccacaucauggaauuucaugguaaugaaccacagcauaaagccaggguacuuugugguucauguaaguauuuccacaacagacucaaaaccuucagaaaauguuucuaagcaguauuauuuuaucacucagaaauccauuacaugaguaccucaaagauuuguggcaaggacauguguucuugacgguuacaguccacaggggaaccuggugucugcagaucccagaucucucccuuugccaaucaaaugagcuaggaacuucaggucaauacaagacaaaagguaaacuagaauaacaaggaguuuuuagauuguacaccccaaugccaaacucuacagauucccaccuggaagcuauuuccuaagacauccaaauagcaaauacugaacuauuugcuacuaauacaucuggccauucaaaggguccugcacauagauaaacuaaagaaauuuuguuugccuacuaccauaagcaguuuugaacuucauauaaauaugggacuuaaaaaauauccuuuucuccucuuucuuucuagaacuggcuucagauuuauaguauuccauuuauguugcuauauuagaaugacagugguacauuucauguuuugaccaaaaacuauuggaacauaguguugaacauaaguaccuuaaaaaguacuuaacugcccccucccccauaucaaaguaaagauagcuuaaaaacaaaacaaaauugucucuaacuagacaauucugagcaucauccucaugccacagacauaucuacucccuuuauaugaaaugaaugcuuauucauuugaauccaauccacaagucuuauuaaaaaaaaaaaaaaacucucuaccuugauucuucagaaauucugaauucacauguccccuugaucaagaaaaaaagaaaagugguuuacucugguuuucaugauuucuacuucccaaagguauuugaggcuucaauuuucaaaucaauuaggaaguuaaagucuccaugucucucaucaaagaaaaaugaacagaacuuguuacaauuauaucccccaaacugaugugaaagcccuggagauuaagcagaugcacagagguucucuaauaaaccuuguaacauuaacaaaaugaauaccuuagaugacauucugcaaaccauguguuaucagucagcccugguaacccauucaucuagccacaaugaugccugggauuugggugaaaguguuuccagcacaacuuuguugguugggcuaaugggagacuugcaugaaguaacuuucuuagaugcacagaaauccagcuugagucuacauugggauucacacacacauaagaaaugagugaacaggaacucuguuguuggaaauuuuugcucuguuuguuugggggaagguuccugaaaaagaauaaugaaaugguuuugcagacacauccaggaagaggcugugacuggcagaacagacugcuuucaacuucagguaugggucauaguaccagucccauagaaagaagaacugcugacgggcacaagaaauguuucuccagagcccaacagacaaaauauaacugcaaagaggaagagaagcauucuccucacaugugaccuggugcagccuccucacaaugagaaacgcagguaucccggcacccuacgggcacuuuggaagggcuuccagagcacauggugccgguucuuugaaugcugagaccaguauccauauagcacucccacucaggcacuaccccuacuugacuuccugggauuuggacuccaguaaggggagcuagagugaggaaaauaagaaaggacugcuugaagguauagcuagaggcccagaguuacaccaguggguagaaagcaauacuacaguuuauuauguauuaucaacaagcugguaagccuggggaaacuuagcuuagaaaucaaaagcaauuggguuuuaaguuuguuucuacaaggaguaagagagaauauuaaagaaaaucagacgggcaguuuggaggaagagaaugaaaacuuguaaucaauaaggugacuuauauuacccagaaucaugcucauacaggaacucuuauaaaaugaauccauucuuaggaggacugaaaggcauuccaagggaccagcuuuggugcugaaguuaauaugacccucaaagcaaaagcaaguaaaccacugcaauuugguguaaaaagcauggcuaucaucuacccucccacacuucauuuccucaauuuuaaauaaaaacauuccuuacccuucaauuuacagcgaacaauuuaauuuccuaauuaaugagaauacacacgcuacccacaaacuucugagaaacccucucccaacccuaugguauccuguggcaaggauaauauuggguagcaagcaaaucucgagcaccagcuucugaggcuucccuuaaagugucgguuucaaccucccucucucaucugaccacaaaacagaccugcuucccguggcaucggaaguuggcagcagcaacaagagacaguauuucauuuagaaggaaguggagaggaagguaggccccauuuagguuccccuuacaauuccaacucuucagccaccauuaaguuuagaaucguggacagaaaagaagauggucuuggagaugagagagaugcucuuauuaagaaucauuauccccuugucaguauuuugacggucuaauauucucucucucucaaaugucaacccucuccauucugagagccauguaucacacaugugugguuugaaaauuugcacacuaucuacacagauccugugucugggaugguagcugucauucauuggucaaaguuaccaucuucugucaccuucuugaccaccugguuuucucaaauaauauccuacaguuauggcucacaucccaugcauccaaacagauguuugucccguuaacagauguugaugucccaucaaacagauguuugaccccugcaugcucauucucacucuggauuucaugucuacgugaacagucccucuucuugcagugacccuuucucuaguucucugcuaggaaaaagaaauuuauauacaugaaugcccagaacaauuaucaccucuaugaauccucccuccacuggccuuucuaaagagcaucugccuguauaguaaugaccuggcaugcugauauacaugaauuaauuguguauguguccagcucccugaacaagguucaagacguugauuucgucccuuuugguagugaagauaauuagaaucucuuggcugaaucaucacucuaacuauagucuacugguagagaggggcccaccaugguccagaacucaagagaaaggcaugguuccaguauauugagugcugugguucaguuacccuuucacacugcugcgcuuuaagcaacagcuaagguugugaauuuaaacagcugauaucuuggcauguggcacuaccuaugcagagaucuggaccugcaaggauauuaucacuccagcagaugagaauccacuugucugugagaagccauggguacacuaugugacagagauggagaaaaggcagaagcaugcuaauaugacuuuucagucuuuuccugaccuuuuuggguaaaauaauacacuggauuuuuuuuuucggagaaacuaauagaggaggcagaugauaucugaagggcucaaagauuagcuggaaaauaaaaaauaguaccuauauuugucaggauaggcugaauuauguuacaggaacagcaacuccaaaucucaguggcuuaaaacaacaaagguucauuucucuuccaugcuauauuucaacugugggucaauaguggacucuguuccuuucaaucauugaggaacccaggcugacaaagaagccacuguaucaagcauuuaucaguccaccaugccaaggaaaaugagagcucuucaaggucucaggcaggauacagaaugcucuggccuggaaaugacauacaacccucuguuuguggcaccauggccagaucuagucuucaucccaccccucuauaagaaagccagaaagugaauccugccacauugccaaaagucagaaagcuggaaauauuugguaaacagcacugaugacuaccacaugaccuuauuuguaccucaagcuuguaaaguagaucacacuuguuacaauaaauugaauuauauuuuacuguuaacugaaucaaaugcauauugcucauagauguuuccauauccagucugaaagauucuaggaaaaaaaaaacuuaucugaacuugaaguuguacaacaauugcacaguucuaucuccaagauguuuugcugaggaaguuaggcuagaacaauucccuguuugauaaauaauuugggaaaaauuaaccuaccuauuaacaaucugauuuuuauauguuaaggauuuucuuuuggagaaacagaauccgauggaaaacagagauucauuaggauaacaaaaagauauaaguucuaguuccuaucuucuuaccuacuugcuguauaacuuugaagcccugugcuucaauauuucuacccagaaauagacaacaugauuucauucaauuaucaaauagucauuucgcauccacuggaugcagccacuagguugcauugguaauacagcgauuaagggggaagauacaugauacuugaucucauggaucuucuaaucugcuugcuacuaguuacagaaaucacuugauucuaaauaauagauuguguuaauacaggaauaaaugugcauaguacaaaaauuaccaagacugucacuagucuguucaaugcaccaguauaagagcccuuaaaaggagguaauagggaagacaagugacaggaaggcaacgaauacaagaggcaaauguaaacuuuaacacuucauauauuagcugaaagaagaucuccauccauccacaucuaccagacccccaguguucaaugaaacacauguccaaguuuccaaagauauauaaagccaaaccugccacauaguguguggcccauucauggaggagaagagucauauuuucuuggguaguugauaggaccuuaaguucuccuuugacuuccuagguauucaacuugaaauaauuugugcauguuuaaaggaucccauuuccuaaaugaaaauuuacauugcagcaguaauauucaauguuaccaaagugaccucuauacauucaggaaagcgguggcagaauuuuaucuguggcugucugguccuuuuaauaucgguaguaccaauaugguuuccaaggacaugauguacucccagugccuauuguaauuuuauuuuuuagcuauuuuuauuggaaugaaugaauaaacuauuaaaauacaaagaauccuuuuauaacuauaaaggaaauguguaaaaagcaaugaaaaggauaagaaaugguuucuaaauugaacaguuuguuuuauuauuaacaauaacaauaaaguaagucacacagcucauaaguccucccagaugagacaucugugggauucucuaguuugaaaagaaacuuagcuuauaaacaugucagccaugucccgaauaaaaugaggauuucgcacuacauggaaaugaaacuauuuguucuucaacauguccaagauucaguguuauuuuaagaugcuuuuccuuccaauuaaauaggacauguuuuccaucagcugcagagggaaaagguaccaguaacuuugaugaauauaaauugcuuaagcuacuaaacuuaagaucauaggcugucaaccacugauacaaaaucuaaauccaauccagcucacaguguaaagagucugaaccuuuguuagcaaagaucaucuccauauucugguuaccacauuugaccuuuaaugaguugggacagcuaaaugauuuugaagaugggagugguguaacuaguuauaacuguaacuaguuccuaaaaauuuaccguacuuuuuuuuuuuuuguggcaugaaaaagaaaagaaaaaagaaaggagagagguguauuuaguagccauugagauacacaacauaaagggaguuagugaaagcuucucuuuuuccaugccccugucccagaaacaaugugaggacuuguccucugccucuaaggugaugucaguuuuaucaaugacaacgugucaauuaaaugcucccaacuuuguaugcaaugcuuuucaacuuucacugacucuauucgacucucuucucugcucacggcaauaaugaaucaugauauauuacaacaaaaauuaaagaagcacaauacacuuccugaaggcuccacaaaugggaagaagggaauggaaagaauguggccuucagcaucauacaaauccaucacuuaagagcauuaugaccucggucaaacuauuucacuucugccgaggaaguggggggcauuuucaucaacuauaauauggaggacaauaguuuuucacagaguuguggcggauaguauaaacauaauauauuuugaagcaccuagcacaggguaauuuuuaaauuuuuugguuucuuacuuagaauauuaaauauacagagaauuauuuuuuuucugaugucuuaugcaaccucuuuuuucauauucagggccaauggcuacccuaaaguaaaaugauucauucaugacagaaaaaaggagacuuugcccauaaacuucuccuaaacuauuauagaaaugaugcuuugaggaucucaucuucauucuaaacguagcagaguggcuugaaggguuaaggugagcagggaagccgagcagauggggcuuugaguuucucucccuacuucaaccaaagcagcugcacuguguucuguuuuacauugaccaugcauaaaugugggauuugggaaauucaccaaugauguccuacuucuuuauugucuuguuagugccacacaggaccugacuaaaauccugugaagagaggagggguguccccagcuguucucacugugcauaauccuggaagaaguucaugguaagagauucacagguaaaucuggggccauaguuugacucagacuccucauuuuauagaggagaaaauugaggcauagggagguuaauuaacuugcccaagugagcuaauuaaaucauuugagagcauguugaaaugggcaaauuccuagcaacuuggcaaguggagguuccugucauaauaacuggauaugaaaaggaagggcgaucacauuucauaauuaugguagagaugacuuggguagaacagauaauauauugggauuuuacaucauauuuuuuuuuuuuuacuuuuuuuuuuuuuauacuuuaaguuuuaggguacaugugcacauugugcagguuaguuacauauguauacaugugccaugcuggugcgcugcacccacuaacucgucaucuagcauuagggaucucucccaaugcuaucccuccccucuccccgcaccccaccacaguccccagagugugauauuccccuuccuguguccaugugaucucauuguucaauucccaccuaugacugagaauaugcgguguuugguuuuuuguucuugcgauaguuuacugagaaugaugauuuccaguuucauccaugucccuacaaaggacaugaacucauccuuuuuuauggcugcauaguauuccaugguguauaugugccacauuuucuuaauccagucuaucauuguuggacauuuggguugguuccaagucuuugcuauugugaauuacaucauauuuuaucuggaaaaucauagugagauuuuguuguuguuguuguuugugagacagagucucagucugucacccaggcuggagugcagugacgcaaucucagcucacugcaaccuccacgucccaggcucaagugauucuccugccucagccucccaaguagcugggauuacaggaguguaccacugcacugacuaauuuuuguauuuuuaguagagaugaguuucaccacguuggccaggcuauucucaaauuucugaccucaaauuaucugcccuccucggccucccaaagugcugggauuacaggcauaagccaccaugccuggcccauacugauauauuuuaacucaaaaaucuucuuugacacucuuuauuacuguuuuauuagaguguucucaaacuuucuuauucaugaaacacucaggccacucuugaaggcaacaauuguacauuguccuuugccaaugcccauuuucuaguugccaacaaaauccaucuacugccccuaaaaucaccaaccaaggauaauacgguuugaccaugccuaccucucuggcacugguugcugggcaugugggaugguguggguuuggggaggcaacggagagaaauuguuaaaccaguagaaaagggagagggguucccacuagaaucccacgggcucuaggccaaggacagagcuggguguucagcuccuccccugcucuggauuccaaggcgaagucagccucugugacucugaacucuuaaguuuuacuggccuucaccuucuuaccuggccauauccuucauaaucauugacuucuuccccuuuguguccuaccagccgcucagaaucugacccaaagcuaugcuuuucuccuaggcccuggucugguucgaucaccuggcacuuacuugugcccuuaauucuaaacaggauauuucacuuaguucuuuagacagccuuuugaugcaaagugucaaaauguaaaaauuacuauuuaucacugauaaauguguacaacugauaucccugaccucuagggaccauacccaagaccuagagaugggaaacagcaaugggaugaagaucucucuuuaccuccuugaucauggggaaacaaaacaaaacauagacuugcuacuaccucuuuuuuuguuuugguacacaucaaaauaucucagucaaaaccauauucaaaauguugccuggcucaggguaagcaccuccucagcagaacccaaauacggaaucuaaaaacaaaucagaaagccccuggcacuacuuuacuucuaaguuuacuacacauucuccaaauaucacacaguccuccauuccauaugcaugucccuagauuagcaaucuugcaauuuauaguauacgaaguuuccaaccuccuuuauucaccuucaucauuccucuagcccuucccugcaugcucucuacccacaaucccucugcucagggcgugcagacccagacagucaaccggagaggauggaugucucuuccagacaaacaaccagugcucuaaggaugccucaucuuauggucugcaaauccaggagcagcagucaccauuauuuuauuugaaucucugccacaaaauaauaagagagacaaugggaccucaucccuauccuaugggaccucaguuaacaauagcuaaauuggacggcccauaauuaugaugauuagcaauuccugagggugaaagugaucuuagagagaaucuaagccaacauuucaacucauauuuaaaccuguuguuuaauauuaccauacauuugucuucuaauguaaauuugacacuuucuacaguaaaaaaauucugucuuuuugcaaaguuuuucuauauuuugugccaagaaauauaggcauaccuuggagauauuacaaguuuggcucagaccauugcaaaaaaagcaaauaucacaauaaagcaaguauuguaauaaagugaauaucaaaauaaaauaagucacaugaauuuugugguuuccagugcauauaauaguuauguuuacacuauauugaacauuauuaagugugcaauagcauuacgucuaaaaaauacaucuuaauuuaaaaauauuuuauugcuaaaaaaugcuaacaaucaucuguuccaucagcacaucauaaccuuuuuacugguggagggucuugccuugauguugauggcugcugacugaucaaagcgguggcugcugaaaauuggaguggcuguggcaauuuccucaaauaagagaacaaugaaguuuacugcauugauugacucuuccuuucacaaaagauuucucuguuacaugcgauacuauuugauagcauuuuacccacaguagaauuuucaaaauuggcaucaauucccucaaauuuugccacugcucuauuaacuaaauuuaugaaauauuuuaaauccuuugcugucgauucaguaauguucacaggaucuucaccaggaauagauuccaucucaauaaauugcuuucuuugcucauccauaagaagcaacuucucauccauucacguuugaccauaagauugcagaaauucagugacaucuucaggcuccacuucuaauuuuaauccucuguuauuuccaccacaucugcaguuacuuccucuacugaggucuugagccccucaaagucauccaugcaugcugguaucaaauuauuccaaacccugauuaauauugguauuucaaccuccuccuaugaaucacgaauguucuuaauggcauauagaauggugaauccuuuccagaagguuuuuaauuucuuuugcccagauccaucggaggaaucacuauuuauggcagccacaaccuuaugaaauguauaaaaauugcuccuugauccaugggcugcacaauggaugcugugucaguaggcaugaaagcaauauuaauuucccuacacaucuccaucagcgcucuuggguaaugagguacauugucaaugagaaauaauauuuuaaaauaauuuuuuuuucugagcacuaggucucgacaguggucuuaaaauauucaguaaaccaugcuguaaacagacgcaguguaauccaggcuuuguuguuccauguacggagcacaggcaagguagauuugacauaauuccuaagggcccuaagauuugcagaauugucaaggagcauuggcuccaccuuaaaguaaccagcuacauuagccccgacaaaggagucagccuguccuuugagcuuugaagccaggaacugacuucucucuagcuuugacaguccagaugauaucuucuuccaacagaaggcuacuuugaauaccguaauaaucuguuguuuaguguagcuaccuucaucaauuaucuuagcuagaucuucuggauaacuugcugcagcuucuacaucagcaccugcuacuucauuuugcacuuuuauguuaugaagauggcuucuuuccuuuacuuccuuccuuuacauucacaauuuggcuguuuggcauaaaaggccuauguuuuggcccauacuggcuuucuacaugcuuuguucacuaagcucaaucauuucuagcuuuugauuuaaaaugaaaaauguguggcuauuccuuucacuugaacacuucaaggccaauauaggguuauuaauuaaccaaauauuaauauuaucgucuuucaggaaauaggaaggcccaaugagagggagagagauggggaacagcugaucacuagagcugucagaacacauauuuauuaaguucggcaucuucuaggagugcaguucauagugccucagaauaauuacuacaguaacaucaaaaaucacuaaacacaaaucaccauaacagauauacuaaugaugacaaaguuugaaauauugggagaaauaccaaaacgugacacagagacacaaagugagcauauguucaaacauuggcaccaguagauuugcucaacacaaggcugccacaaaacuucaauguguuaaaaaagcaauaucugcacacuguaauuaagugaaguacaaugaaaugaggcauuccuuguaguuagaaaugagcaaagaucaaaagcauauauccaaaaugccugaaauacauuagaggaucuaaaaugcauguaacauuaacaaauuuaccauuuuguuauuugguuuaaguuuucacuaacuuaagaaauauauuuauggagauauuaacauuacuauaacacaauuaagaguaaauuaucuggccuuacuuaugucuacuuuugcucucccuauauaucuguuauggccugaauguguuccccaaaauuaaugugcuggaaauuuaauuuaaucaccaaugcaacaacauugggagguggggccuaaugggauguguuuacauauugagggcucugccuucauuaauggauuaaagccacuauaaaaagggcuucuggaauccguuugcucucuucugguccuuuaccaugugaggacuuggcauuccuacccucuagaauggcagggagcaucuuggaaggcugaucaaggcagcaucuuggaagcagagaaacuggcccuaagaugcuggugccuuaaucuuugacuucucagccuccagacucugagagaauaaauuucuguucuuuauaaauuacccagucucaugcauuguuaaaguagcagaaaauagauaaagauaauauuuuaaaguggaauuauaagaagaaaaaggagguacauaagaaaauauugucuuggcucacagucuuaaggauacacacacaagcacacacacacacacacauauauguacauauuuaaacaauacuacaagauuacuaaacagagugacaagcugcuaugacaccaauuacugguuuuguaucaguuuagaaaaaauuuuauuuagauuauuuuaauuagaucauacuuugaaaaugugcuacauguugauguauaauuauauauuuauuuguacaaaacagaauuauuuccuagcaagcaaaaauaucagauaugaguuuucucugcaaauguaugcauauuacuccagauucuaaggaaaauggcaagcaaaugacagauaaaaacaaagaagaaaaaaauaacauuuguuaagugcuuuauagccuucaaacuguuuucagauucauuaccucaaauuccacaauaguagaugaaauucauucaaagaauaacauauccuguaauuuacauguucccuagugacacuauuuuaagauuaaccaggauuauugcaguauuauuaaauaugaugguauuaaaccuugaaccuagagaaaugcuuaaagcaaagaaucaaaugaaaugcuuaaaucauaaucauuaauuaauauuguuuauaguucuuuauuaagauuaaucacucuugaaaccuaaaacucuaaucguuagaaaugugaccaugggaaaguuagaauucuguaugucaccucuucaauuauaaaacacagauaaccccuuaccuccuguagauaauggaccaggagaguuaauacuuugagguccucucugccuaaaaauuauacuaaucuauaguuuuaugaauacauaacaaaacuagugaacacagagugauauaagaccuucaggaaguuuauuucgcaugcagcgcaccagcauggcacauguauacauauguaacuaaccugcacaaugugcacauguacccuaaaacuuaaaaguauaauuaaaaaaaaaaaaagagaauuuucuuagaaauacaaaaggagggcugggcgcagugacucacaccuguaaucucagcacuuugggaggccgaggcgggcagaucacuugaggucaggaguuugagaccagccuggccaauuggugaaacccugucucuacuaaaaauacaaaaauuagccgggcaugguggcacacgccuguaauuccagcuacucagaaggcugaggcaggagaaucgccugagccugggaggcggagguugccaugagcugugauugcaccacugcacuccaguuuaggcggcagagugagacucugucuggaaaaaaaaaaaaaaaacagaaagaaagaagaaaaagaaauauaaaaggaggauauaaauauaucuguuuaaaagauauccauuuuacuguugucucauacaagugauuuauauaagugaaauaugagugaaaaugaaaauuccauuauguauugaaaaauuuuaaagcaagcuuuaaaaggauugaugauuucauaugguagcuauuuucauuuaaacacaauaaaaggaaaaugggauaagucauaugacaucuuaccaaucauguuaauuaaaacaucacuuccucuuucaccuccaacugcuuugccauggcaaugacaaauaaacacuaaauugaauaaacauuuaaugugucaacucauguuaaaugcaaauuuaacugcuuuagguacacacacacaucacuuuuaugaauuuuuaauuucuacaucauuuuucuauuauauguguuguauauauuuauauaucuaucauaaauaugaagacauguuuagacacaagaauuuuagaauuauuuauuuuucaaaauagccugguuacaauaacuuaacauauugagaaaauaaacuuggaucuacuuguaagucugucuuuguuuaucauucaacuuuacugaugugcaauuuauauacaguaaaauucaccccuuuuuguucacaguucucugaguuuugacaaauguauagucauguaaccacuacuaccaucaagauacacacuauuuucaucaugucccccaaaaaaucuguugugucucuuuauaguuaaucccugccuuucacugccagcuccuggcaacuccugagccuguuuucugucucuauaauuuugccauuucuagaacgucauacaaauggaauauacaguauauagcucuucaccucuggcuucuuucacuuagcauaauacauuugugauucauccauguuguuacauauaucuguaguucuguuacuuuucaaauuuguaagugguauuccauugauuggauguauuccauuauuuguuuacucauuuaccaguuaaaagacauuuaggcuauuuccuacuuguaagucuuucuaaacauggcagaucauaaggcagcacaguauugugguuaaaagcuuagguuuuugagcuagacagauaugaguuccaaucucagguccaauaucaacuuguaccuuugagcaaauuacuuauauucuucgaguuagaguauuguugugaagauuaaacuaguauguggccuguaaauugguaagugucugcuguuauuauuacuacugucccuagugcucaaacucugcucuacuuccagucuugaaacuaaucccaaauuuaacacugucaaucaccucagagcuuuuacuauauuccuuacuuaaaacaccucaccccuucucucugcuucccuucugcaagacccaaguuccucuuccuccaggaggacuucucuaacucacaguucacauuuagauugccauucugcacauucuuagagcaugcaucauccagucuggcagccacuacuuacauguggcuuuauacauuuaaauuaauuacaguuaaauaaaauuuaaauccaguuccucagucacagaagccacacuucaagugcucaagcaaaacggcuaguggcugccauauugggcaaugaggauauagaauauuuuaaucaucauagugauuuccauuuuaaguucuaaguuaaaaacauugccuaacacuuaaaacuauauaauucuauauagaacaggaaaaacuaauaauuagcagacaucgacugagcuccuauucugugcaagacauucuaccuuaagcaaugauacagcaucuuuuaggggaucuugaaccaccuggacaauuauauuaaaaaaauuuaaaagaagaaaugauuaccaaggucuggcagguaaaagaaaaaaaauaauaagucauugaaauuuagaaguuggccaggcacaguggcucucaccuguaacccuagcacauuggaggccaagacagauggauugcuugagcccaggaguucaagaccagccugggcaacgugacaaaacccucaucucuacaaaaaauacaaaaaucagccaggugugguggugcacaccuguaaucccagguacuugagaggcugagguaagagaaucaccagaaccugggaggucgggaccacagugagauauaaucacaccaauacacucuagccggggugccagagugagaucccgucucaaaaaacaaaacaaaaaaguuuagaggcaugugugguggcucacgccugaaaucccaacacuuuaggaggccaagugggguaagauggguugagccuaagaguucaacaccagccagggaaacauaucaagaucucgccucuacaaaaaauaaaguaauugucagggaggcugaagcaggaggauccacuuugucaaaagaucuacagaaucacaaaacgauguucuuccuagauuugucucaagcuaaaggugucucaaggaaaaaguaagcuuuuaaaguccaaaccuugaaugagaaaauaauuguguuuucagagaagaaggcaaaacaaagacgacaacaacgaaaccugacugcuggaagacucauuucagaauauaccuuaaaaagccacuauaugucucaugaaucaauccagauacuauaucacccaccccucuggcacaagguuaugacucacugucugaaaccacaaugcuuauagaauccucaaacguucaaggauaacuacauuugguucaagucagcaauagaaagggagcucauuaagaauuccccauuuuccccacuacagucccuuaccauuagaauccaccuacaacugccagagcugaugggaucauuccaauuucaucuucucaaggaggauucugagaacuauugaagggugaguuuaaaggugaaucaucaaagccaguuuaaauguuuugaaaagauuaaggcaugaaauuaucauuuacaaugcacuugccuuagaagauccugguuuucuacuuuuccauuuacacaagaaugucaggagauccuccugagaggaagcagaauguuaagauacccugggaagucagagucauuacuaucacucccaaggcagcuauaauggcaggagaaaaguauccaguguaaauaguucgccacaguggagccuuauguuacuguauauacaacaugggauuuggaacaauauccauaugccaaucccagcucuaucaccaucuagcucuaucaccucauuuaauuccuuaguuucuccugucaucaguuuauucaucuguaaacugggguaacacuguccuuaauuacuuugauggaguguugugauggucaaaugagauaauggcugggaaaacacuuugcaaucuguagaucacuaugcacaugggaacuauuaucuggucuuuuccccuaaaacacugcuccuuggaguucacuuagccugggauuuuccaacuucacuucuaaaagaacauuuuuggagcuacucaaaugaagacuuagacaaaauaugaguaucuguuuucugcuuuuuuucugauccaaggaacuuucuuccuuucacagauuuagcucuuuaugucauuaacuaaauuuaaaucaugccuaaagacuuacuuguuuggcagcacaguuucauauccuguuugguuugauuuuuaaaauucuuuuguaaagcacuccaagauguuugcaugaagaucacucaacaaauggaagccucucucgaauaauacacacacaaggacacacccacaucaaugagaagaaacauaauacagacuuuuguuaacuugauaaaacaagugcucaaaaaacaauuccuaaaauuacauucgacgccacacuguaugaccuuuucuugacugagagagccuuaacccugaacugacuuggaaagcuaagguaaucugguagaauucaacuccaccaacuuauauagagagauguaaguguaugcuucaacauagacacaauauuuuccaugaagcaggcauccuggcaaguaaaaauucccucguguuucagcauguaucgagagacuaaccaucagauccugaacuggguuacauaagcacaauacccuuauuguuagcagcuguguauuggucagcauugcacaacugaccaggugcauggcaggauggaguuuugucuuuauccaaagauucagaguagaugggcucaggacuugcucuaugauggcaauauauuaauuccaagccaucaggauuauuauaacccauaagauacuuugccaauuuaugcauaugugguaaaaauuaaggcauguaguagaugccaaaagagccauugguuuaauguggaaaccuucuuuucaauucugaauguuuaagaauucauuuuaaauguaauugucuggaugugaagguaaaauaauugacucaaugacacuaaauaucaucauacaauuccagggaagacauauuuaaacuaccaacggaaaggauaugugauuuucaaugaucacuuuaggauaaagguauaacacuaaaaguauucauuagaaaagccaaggaaagaucaauccauacaggaaagaagaguuucuaaaauugaaaaaaaaaauugaaaaaucuaucucccucuauacucaagaaaaaacuucaaucacuugaaauuaacaaugaagauucugacuuuuauauugccuuaugacaggauuucaaaggcuguuuucucaccuuugcucuuuacuugaguuuaaauacuuuaaaguauauuuuccuuuacggauguaccaccccauucaauucauuuguugauuucaaaaugaaaucaacuagcuuccaauaccagcuaguuguuauuuaaggguacuguguugcaaggcaaauuauugagcugcuaguuuuuguguucuguauuuucacagucaguuuuugcuauuacgcugauuuaauuuuuaagaaauguuuacuuauacauaaaacacaacugauccaaaauugcuuaugaaaauaaaugacaauauuuaggauauacuaauaauaccagcauuacuauuauagaaaaugcccuguauugacauuauuaaaccacuuuucuaaacuuuuuggauacagagcuaauauauacugacuaugugcucugugacggccauggaguuaagggcccacccaaugaggaagcuacgaagaguuuccuuaauguauagaugaggaaguugaagcaaagucauuagagaaagcugaaguuaucgacgccagagcacuugcucugcaccagcaaccuaaugaugaggauguuugaagcugcaauuaacagaggaugaggaggacuucugcuccagcauacgaagaaaggaacuccauuuccaaguuugggccacaagcuuaccuucaguacagguaaaaauagugucuacaaauagaagauuaucaaauacccaaauuaugaauuauguuuaugggacuuuuauuaaugaaaaauauucaacucaagacccugugccucaauuauaauaguguaguggcaaaauauugacucauuucaguucugccugugaaauaauaauggaauucaaauaucucauuguugagagacacuaaaaccaguacacaauuuguuaauaugcccucaguuaggaaaucacguacagauuauaccaacaaaauaugcacuucaccguacugcaaguaacaccauuuugaaggggauggacuccacauucagacucuauuuuagcuuguaaucugugaugaccuuauagaaaauggaaugguuuuguauuucuuuauuguuucugaaaguaaucucucucggugacuuuuccuuauuauuguuauagagagcgaugucuguuuguccagaacuguaauuuacaguaaguucugggugagauugugcaugucccuguucaauacuuucaguaccaaaguggaaagaagaaagauuauauauuuccuuccuuguuuuauuuuauguuuccuuucucuguuuuauuuccucagauuagucaugcaggagcagggacauuuauuucugugcccaauagucucuucuauuuaauuucuuaggccaguuuuuacaaauaaagaagugacuuggacuccucgagauucucucuggucacuuuccagguggacuuuucuuucccggcuguaaauggcaaaaugagcagagccuccauaaauuaggcacuauuuguacuacaucuugcagaaauuauuuaaauauucuagccuauggguguuccuauuuuuuauuuccucugcaaauggucuuugauagauaucaggggaaaaauauacacacaucauuuggaagauaagguguuaaauaugcaugacaaaaucacaaucuugaaagaaaaauaaaguaacccuccacaauuacgccauguggcuuccuucaugauuaauguauuuuagggaaaaauuaauuuccacaucuuuccccaagaaaacaauaaaaacuagaacaacaaguuacuguaccucuucugccuuuaguuuugaaaguaaaucaagguaugucaaguuugcagauuuucuggaaacccugaaauggaaaguacuccuuagcuggcuaacuaccuccuggcuuacaugucacuuaggugucauauuuccucaucuaaauuauguuccucacaucagugucucauaguaccauuuucauucuuguauaaccauaccugcaauuauagaguuuuuaauuuccuaccuccacaaguuaauuguaaacuguuuuucuuaaauuuuauuuuaaccauuauacccagugccuaucacaguaccugguacauaauacacacucaauaaauauguaucgaauuaaugauuaaauaaacagcgaagcacacaacagggauuuuuacugcuuaaugaaguaaaauacagugucauaaugucuugcuagugcaucuucacacuaaucuacaauuacagucauguguugcuuaacaacaggaauucuuucugaaaaaugcguuguuaggcauuucaucauuuugcaaacaucauagacugcacuuacacaaaucuauuaauagaugacauagccuacuauacaccuaggcuauaugguauagccuguucuuaggcuacaaaccuauacaugucacuguacugaauacgguaggcaauuguaacaaaaugguauuuguguaucuaaacauaaaaaaguacaguaaaaacuuaguuguaaucucauagaaccaccguccauguggucugucauugaccaaaacaucauacauggcacaugacugcacauauuaaucaagaaauguccugugccuuucuuuuuacccaccacaaugccucugcuuugugaagucaugauggucuaauuucuuacugaggcaaggccaaauacaccaccugggauauucugaaguuaugguuugacuuuucacaggauggccuggguuuugggagaugcaauguuaaauaugugugauaaaaugaaagcaauucaaaagacaauacagcuagguagauguuauaccuaagcaagcuacaagucuucuagcacuguucuuaaaccuccuucacgaauaacacaaauaguuuaaaugcuaauaggacauauuuuaaauauauuuucuaaguauuauagaauggucucuaccuuucagcaaacuaucauuucauaugaaagagauagacuaauugaucaagagauagauaaauguauguaugauauauauguacuauauacacacaguauuauauacuaugugcauauucuguguauuguauguugaaaaauauaccuuguucacgcucauguuucacucacguaauggauuucucuuuauaauuuugcauugcaaaaacaaagcucuagaugaaacauuuccagugacuuaaucauuagagacauaauaaaacuagauaucuaggcaaaaguuaagguuucuuuccucacagugucuauuuggcaaugcagauuguuucauaucacuggauaaguuacuuuacaguuaucucuuuaaucuuagaauaaaccugaccugauaggugaauuauuucaggaggaaaggcaagaggaagaaaugcugacucuaccuaaucccuaaaccauccuacucugcuccaggugggacuccuuaagaacaguacagggauuaugugcuuuggccucacauuggguaugucagcuaagguccucaagacucugcaaugucauucacguggccugaaaugcuccaguccugaccuguccaacaaaguuccuccuucauuuaaauuucugcuuugagcauuacacugucuccugacuaaagcccucuggaaucuagacacccacgugcuacgacacccccacaccauuuaugucuguuuccauaaaaauagaugugacuuguuuacauguuuucucuguguuccuggguccuuucaugugucugucuggcugaaaugaaagacugcagaguauuuccugcaacccaaccacagcaggaagacucagcucuguccuuggaccaccagggggauuccaucgugggccugacgugugggggugaaagcugcauugucucccagcuuuucaauggccccaaguugccagugaaaacagaagaaauucacaaagcccagaaaccauggcucagguugucauaaggcaggguugaaauguuacuucaguuucuauagaucacuaaguucauuuaaccauggaaacaugaugcugguaacugcaugaaaaggugaggugucaguggcggucuucaaguggugaaauguguccccucgauugauuucaccauuuacuuuucugagguucuaauggcagaucacaaaaaguuauuuaaaaaaaaaaagaaguaguccacuagacagcaagcucuaugaggucagaaaggauuacuauuuugucuguuguugucauuauuguuguuguucauuauuguacugucccuggagccaagcacgguacucaauacauugcaggcaugaauuaacauuuauugggugcuuacauguucuagacacuucugagaacugguaauacugugauaaauaagacaaagcucuugcuuucauggaguucacauucuauuugggaaaggaaaaaauaaacagaauuaaaugaaaaagaaaauaucagaaacugacaaguaucagggaaagcaggugggggugaauuuaaauggcauggauaggaaugauaggucuuuuuuauugcaugacuggagcuagcuaugagaagaucacaagacuucccauucuugagugccuaagagaaucgccugaguugaagacuaccaaugccuuggcuauauucucagagacucauuuugcuggguuugggagguggggccugagcauugguauuuucuaaauguuccccagcugaugcuaauaaucaggacagaaccacugaagaggaaaaauguuccaggugaaggaauagcuaguaccaaacucuuccaaugaggggugaggcuugugauuagagcagugguugacaaaccucuaauuguaaucaccuagacagcuuuuaaacauccagauacccauaccacaccccaaacccauuaaauagaaggcaagggguggagguggggccaagaagagugaggagugggaagcaacaguauuuucgaaaaguacucaggaguuuucaauguacugccaaguguguuagacaaagugaccagucuuccugguuuucccaggacuaagggauuuucagggacauggaaauuucagugcaaaaacuggggcugucucuggcaaaugauaauuugucaccaggguuagacaagucauucucaaagaaugguccuacggcaucagaaacgcuggggugaggccccgcaaucuguguuauuacagccccucuacaugauuuugauguaaacuaagguuugagaaccaauguguuagaguaauggagaaaucuaugucuacaguguagacagagaagggggcaaugguuugaagaauuaaugaauaaaucaauugacucaucaggaaauauauguugauaaugucuaaacaggaugaauauuaaagucuugauuuuaugaauguauaagccaguagaaaggcauauuuugcucaagcaauaaaacaaauguuuauaguuuuuaaacaaucaaaagcaaaagaaaucagcuuaaggcucaaacugcugugaaacuccuuagaauagaguaccuugauaauaugaugccaaaagaaaaccacuuacaguuuaaaaaaaaaguauacuggaaagcgaaggggaaauuccagaaaggagggagcccaaaaugcagagucuauaaacuuuguuccaacuguggcugaccccugugaugugcauauagcacugacagcuaaagcuaaugagaacuaacccaagauuugaggugugagauagagaguuuacaguuugaguucagcaaaauuaagugacuauuuuuuaaaaacagcacuauucaggggaguauaucaaaauacagagucucuacaagagaucauucaugacuagaaaacauuuacugaauuuacucaacugcccccaacaugccauaaaaaaaaaaaauccaggaaaauacgagauuugcaagagaaaugacaaauaauggagaccaauuacaagauacccagauauuagaacuaaugucuugggaugcuuccacccaaucuuccuucccucucuccuccacucagaguagacaugcaugaguuuuagcagcucucagucuuuuccagcuccugucucauuuucucuuacaggugcuuccuguauuaacauccuugcaagugguaccugccucucugaggauccagcuacgcaaugaaucugagaaagcuuaaaaucggaaaugcugcucuaguaaugguucucaaacccugguggucuugacauacaggucuuauuaaaacacaguugcugggcuccaccuaagagaucuggauucugaauuuguaugucuaacaaguuuccagguaauccugaugcuuccagucugggcuacacuuuaagaaccacugguguaagcaucacucuccuuggccccaggacaauaggaugauaagggaucucaccaaucaccuuuccuuguuugguuucugaguuauuuccugggggaaaucugaugcuugagcaucugcuauuagagggaaggugaaagcauaggaggcagggaccaggccuucuccccuacuacaaccagagcaacucugcuacucucuguuucauauauugauauuuuauuugaugaaagaguucagaugauaagaaaaauauuugaaaacaauggcucuaauaaaacucagccaagcuguugccuauacaaaucaaagacaaucccggcaacucuugccucuggucggguuuaccagauggacaacacugaccaguagcuaaauugugaacagccaugcccuaugcccuuguacuaacuuucacaugcguaagucugcaguaacacuuaggucuccaagagcccucgauuucccugacucacauguucccugcucucaacgcaugggagagacuuuuuauccuuuuggugagacaaaauagcuucuaagcaaaccauauggaagaaacauuuuccucuggugagggcagaccuuuuucccuuucuucuuucacuguugccccuucaaaaccugcuucccuuguuugauagcugcaggggagaagacaaauaguaaucaaacaguucaaagcugcaggcagggucaaucuucaggcugcugcuguucuaucaacagauaaacacuucucaucacuuuuaauucuuuuaaacacauuccugcucugccacuagagcuaaguuauucaaaaagcuaaaaaguuucaugcgucuuauuuuuuauuuuauguaaaugaaagggccugccuuuuacuuuucaguacuaacugauagaugcaaacaugagcaacggugaauuauaaaggacugacagucgcaacucagugauacugucuaguuuuuacaacaugggagaaacauuacacaguuacauacaacucuuucuuuuucuuuuuuuuuuuuuuuuuugagacagugucucacucugucacucaggcuggagugcaguggcacaaucucggcucacugcaaccucccccuccugguucaagcaauucuccugccucagccuguugaguagcugggauuacaggcaugugccaccacacccggcuaauucuguauuuugaguagagacaggguuucacuauguuggccaggcuggucucgaacuccugaccucaggugauucacccgccucagccucccaaagugcugggauuacaggcaugagccaccacacccagccucagauaacucuuaacucuucagguacaagugauggaaaccuaagacauuuuuagcuuuuuuuuuuuucccauuuaaauacugccacuuaaugaaccaauaggacuucugagauuaaaagaugugggguggggggaaguagaugcaacauauguuugcuguuaaauagaaguucugacaaaaauuuggugggaggaagcuacuaggcaucaacuucuuccauauuuugaaucaaguaguaauuugaauaugccaucccuacgucacuauccugggauaauuaggaacuaucuuucggugguuaguuuuuuguuguuguuguuguuguuuuuuaaauaacguugguaagaaauuaaaucagagaagugauaaacagaagauaaggcaacaauaacagagagcugaaggggccuaaguccucuucuuuaaaaaguauaacacuuuaaacuuucauauugguagugaugacuuuuggagggguauguuugaggcagacgauccgaagaauuuacuccaaaacuucacccaucuccacccccacccccgccacccuccugcccaccauccugcuucuaucuuguugaaguauaggcauacugaaaaaaaucugcuuaaugaguuaaggagggaugcagaggcagugcgauggagggguggagaucuuaaacacugguucaaaugguugaguuugaaucucagauuuagccacucagcagacuuuagaaaagaugugcccucuuucugcuguuucuguaucuauacaucaguuaggccaaccuaacucuccaggauuguugugaagauuucguggcaugauguccacagaagcaaguccuacgguuauuuguaacauaguacuugaugcucaauaaauaucgguuaaaaaguaggaagcugauucauaaucuuuuggaagauuaaacuaacaggcccagccgggcacgguggcucacgccuguaaucccaauacuuugggaggucaaggcaggcggaucgccugaggucacgaggucgagaccagccuggcuaacauggugaaacccugucucuacuaaaaauacagaaauuagcagcgugugguggcgugugcuugcaaucccagcuacucgagaggcugaggcaagagaaucucuugaacuggggaggcacaguuugcagugagccaagaucacaccacugcacuccagccugggcaacagagcaagacccuggcucaaacaacaacaacaacaaaacaaacaacaacaaaacuaacaggcccaccuucaggaugacauaauauaucuucagaaaugaaauuggaaauaaagguuaaaacagucuuaaguuauguagggguuuguuuuauaaggaguuucauuugcuauauuggagaacuggggauaaaaaagagauaagugaaugaauaaauaaauacaauagaauguaggaaugcucaugcuuccauauacaaaggcuugcuggaguagagagaggagcagcugccaagagugaggggaggugaguauccagggaaaguuuugcuuugcacagagacucacagaggacuugagcccugguuauaagcggaauucgucacacagauguagugggguagggggcagggaacagugagcauaccagacugacauuaugugugcucauauaacauaugacuucagaauaacacaguuucaucaauuugccaugaaaaacaagaaaaagaaacaucauaggugaauaaaacuugcccauuuaaaacaggcaguuuuaagcagaagaaaauggagaaaguaagaaacaugaauaaggcucucaaauugugugcuauagaggaaagagagccaggaagucaacaaccugcucaaguccagcucuaccagaugcuaccugggggaucuuggacaaaucuccucaaacucugagccucaguuuucucaucuccaaaaacucagaguuggcuuagcagaucauuaaggcaucugccauuucucaaaaccguaggacacaaugaaaaucaaagcucuacuucuacauaucuauuaauuaaaagagaccagugaagaaucugcugcugcuuuugaaaaaucacuguuuugaaaccucacuucaccauacaaaacagauuauacaccuauaaaucuuaugucuauauguauguauggauguguguaugugcaugagcguauguguguuacagcuuauuacuuaggggaaaaauagacuggauuaagucacaccuggguaagguggauggggagggagggaugggaaggaaaaggaauuugaaaugucugcagagcucauuagugcccugauacuaaaugauucaaggacaucuuuggcuuugauucaaacaguuguucuguucugaguaacaugacgacaaucuaaagauccacagcuggccucuggaaaauccugucggauucuucuguucuaaaaguaacagauuugcuguauugguuggaugauacaggaccauuucagaaugaauccugucaaagccaggggcccagaggagcugcuuccuaaagcaguuuugguagaagaugggauucguuuuuaaguugcucugguauuaagaaaggcugaguaagcaguuuugagaggucacagcucaaguucacuuaaacaaaaagugaacauuuguguuuagacauuguggggggugcauuuuuguuacucuacccuaugucuucagucccgggguuucucagcccacucuccaaauaacgcagaggacagaugacgucaagaugaaucacaugccuccgcguguauauccugucuucucuucuuucacagaaguuugaugccacaauggaugcuaccaaugacaccauuugauuuggaaauaaggagauaggcccaaguuuuuaucggacacaccccucauucuucguucaucacagcaucccugaaauugaaagccagcagcgacccgagguaccaucaauuuagcugcuuauuccuaagaaaaaguuaauacuuuaaacauuaggauaauaugagauuaaaaucauaaauuuauuccagaggcgugaaggauuuaccccaaacgcuucuuucuaccuuugcuuuuuaaacugaagauaauccccauuaaaguuagacacagauuaaucuaauacauaauuuucacuacuugcuggggggcucagggauuguuauaucacaccgcacgugcuccccuuacauguaagauccuccccuccaacuccucaccucuccuuccuuagaucccagaaagcucugaccaccaaugaauggaacacgagccaccugagagccagugauaccaaaauauuucuaggaaugaauuuaucucuuuucaaauacaaacucuaagcccugcggaauuucuuuuucuuuggggaggcaaaagaaauauuuuccuugcugccacaccaacaaauuuucuuuuuccccccugaauuuuuacagucaauuuucuacacucaaauuugcaugccugguguaaauuuccaggagcuuuccuccuggaaagccagugucucauacgccucccagcaaacacugaccacauccugaacgaagcuaagcacuguguaaugcuaagcagaccugggcccguaggaaacaagaugccacauucgggacagcugucagcacucauccaacacccugccuuccacucguccaucccugcaauuagugaggagugagguuuggagguaaguggacagcuucugacccccaaagcaaaugagagcagucacuugauugcuauuuugcaaauacuuugcugagguugaccacugucugaaacaauuucauuucuauguaaguguugcuuacuaacccuuuucuccugagacacuugaacaucauuuuacacauuccuacauaaucccaaagaauuuaagaauaccacagauucacacuuuaguuuuaagcaacuggugccugauaaaagcuuuucugaagacagaaaaguagcuuggugguggugcuugauccauuuagcaaauauuuaagucagauucaagccaaugaauuuuuuuucauugauguguucaugcaaaaaacauuuucuugagcauuuauuuuguucaaaauacuaugucaaaugcuguagcugacaugaaaacagaagcaacagcuucucccuuaagagauauuugugugugcaugaacaauuguaacccuccuguauacagaaaguauagaauuuaaaauuuugaaauaggaaaauaaugacaugcauuuaccaaauuuagaaaugauuagacauggaacucaaaauuaauuugcacuugaguucacacuuucucacaauaaauuucauagucaaagaaaaaaguaacagaauaagugaucuauaaucaaauauuaauuucauuuauacaguaauucucaaaacuuuaauuuuuuacuuuauuuucaucaauauuaaugcuuuggggaugcuguuauuuuaaaaagcaguuaaugcuugcagauaauuaaaauguggcaagggcaagcuuagcuaugcaaagcauaauacaaugcaauauguuuuaaagaucuuuuauuguaagucaaauuacaaacugaaacggccuuuaugugguauuuugaucaguaaccugcuuuuacagauaaggaaacugaggcccagaaagaaagugguacauuuauaaaagccuacagcuuuuauagcacuguggcaggugccuguaaucucagcuacucgggaggcugaggcaggagaaucgcuugaauccaggaggcggagguugcaguaagccaacaucaugccacuccacuccagccugggcaacagagcaaagcuccaacugaaaaaaaaaaaaaaaaaaaaaaaaaaagagccuaaagcuuuugcccagaggggaguguaccuguugcaaacucaucgcuguuuuacucuuaguuuagacauaauccuaauuaggcugguuaucugauucuccagcccaacagaagacuuuuagaaagaaauaaaggaaacaccacuagacuuagauuuuacaauugcugcaaagucaaagaauuaacaacaaugaaggaagcagcuggggaaaagacaucagaaacaucacaaaauaaauacaucaaauaucagaaaaugugcagcagccuggugauguuuaacuuaagggcaauugcuccaugcacauuaacagucccuccacauuuaacugcauuccagucucuucuuguuccauucuccuugucucacauuaagcucuaaccacgcuguucuucaguucugcaaaacuugccaagugcuuucccaccucagggacagcucaugcuguucucccugcugggaacuccauucuccccauucucaacauggcugggccuucucucuuuaagacucccuuuauacaguaacugauagugcaugggcacucagcaaauauuaguucaauaaauaaaugaaaaaauauguuaacccuguguccuccaggaaaauuaaucuuuaguauguucucacuaacaagcaaagagaaaaaugcuuauaauauguccaccaaaaauguuuaaaauaagucugucuuaaaacggaguagcaacuucagguaacuaaaaaaguucuuauuuugaaaauauaaugcaaucaccacugagcuacuucccuaacauaguaauuucucuugaaacccucauuuucuuuucuuugaaagcaagauuuuauaacaauguggcuaaugcagccuuccuuuuuaugguagcaagcuacauaucaucaacuuuggauaccacacuucaugauuggugaaagaauaaucgcauaaauuuuugccuaacaauuuuuccaaucaguuaaguuaaaaaaaucaacuuuaucauuuaggucagaaucgaaggcuuaacaugauuaaaagguuuuuaaugcaaugauuaucaucagaauagaccacaggucaaagggaaaagacagucuaauugcuuuuuauauuguaacucucaacuaucaaugaguuaagucaaaguuuuuuuuuuauaauccuuccauauugagacaauuccuauuuuacaguagaaauguaaacccacauuuguauuuucucaaugaucugucaguccaaguugcucacuucacaagucuuaaggaagugccucuuugccccagcugugccaauucaaccuggaaugggaaacaucgagcucugacacccuuaagagcuaccaagauuuugugauggaaaugaagcugacaguuuugucagggaugugagaagcagaaucagauucagcuaguuccugcggagaugugcuggcucuaucaagaugaagauaauaaaaguaaguuugguggguaaaauggguagauauaacucaaagacacaugggaagagauacugagcgaaaggaugacauuucacacauuacugaucaggggagcagugccuuggccaaggguucgguaaccacuggauggaaaggagagacuugaguguuucccuaggaucaccuacguccuacauuuagauucaucuucuuaagaucuaaaaucccugaccccuauaucucaucccccuuaauucauauuucaagcaauugacuuacaaguccuuggcagcauauaugugcaaugaggcucuuaaugauccaaagucccauuccucacaugaauugaguaccucauuuuuaaaaaguuaccuugggccaacgcauguauuaucuacaaccuuugaaacaauccuuaaagguagguguuauuauuuaugcuuugcagaugagaaaaccaaagcucaaaaaggacaaugaacuuccccaaggucacacagcuaggaaauagcagagccaggauucaaacccaaguccuuuagagggaggcugcucucuuagcuucaauguugcuccuaauucucacgaaggaacuuauuaacugcuuuuggcuaaaggaagcuauuuuucuuuuauaaaauguaaauuaaauaaaaucucuucaaaaauauguaaagcaucuccaucaucuuucuaauaauaaauauuaacuucaccugagcuauguccuggguuucccaagagccauagcaucauuacaaugucauuuuccagcaagaugucuggacaagccaugcuucauggccaugcuccccacaggccaugucaccaccaacgacgacuauggugcccauuuauauuuggaagcucugucccaggaaagaggcaaucucugggagcugaggagcacauucuucugaaagcuguuuuuuauagcaaucacucaaacaguuuucauuuucuauaaguuuuguuugagaaagaucuuaggguaacaguccuuuguacaaaaccuuauagguuucuaguuuggaguuuuccaucuguuuuugacccuguucuugaggggugugugugugugugcauguguguguguguaucacugauaaagaaauauucuuaucaggguuauagguuaugcuuacuauguaccugaaugaugaauuuaaaaauuaagaaaugugguacagcaucacaaaauagccguuugacuaacuuuccacugaaucaaauuuuuugcuucuccguuauguccagagagacaugaucuuucuggcugguaaaagaaaagaaaugcagaacuuagguucuugccucuaccacuuauccuuucucagauaugaugucaucauuugcaaaauggaaauaucuaauaaaauacccaaguuauauugagacucaaauggaaucauucauuugaagacuuuugaaaaugacaaagucuaauaagcccucauguaagcuagugucuuacauaaguuacagucuuucuuuguaugccaucauaagagauuccacauaacagcaaccuucuguagcuucaaagguugugguguugcucaauuugaaauuucuuuugcuauuuuaaauuuggacauuuuuccccaggaguuaccuagucugaagacacgguuuacuuagagaagccuacuugcaauuguguggcucugugcucccacacaaaguaagaaaagaaacuugugacauguuagaauguuggccaacaaagaagagagugugagaacaacuuugaaagcaagacagacuuaaacuggauggauguucccacuuucuugagagcccucacauuaaggcuggagaaaagaccagaggauagagaggaggaaggaugagguccacauugaaaugcccagagugcuagaagaaauccccuauucaguaacuuuucagauaauaucuaggccuaugaugauuacagcaugguuccaaaaugagcgguaaugaauaguguugaaucauuuaaacuccuaagaaaaaaaucaagaacaaagucuaaugauuaucccuacugaguaaaauauugcagaccacaaaaugguuugccauucgaaugcauuuccagcauaaacaaacacauacuuuuaaugcacacacaacucccuacauguaaaccauagucaaaggcugaaagaguuaauuuaggccuugaagaaaaccugcuuuaagcacugguucaaaagcucuuaaauagcagaaaaaucaauacacuuuuaucaaacgucaguguuuauagaagcaauacaaaacaggauuuuguuaaauguauauauuacgccagaucaaacuguaaguuaaaacaucugcguucaaguuaaucucagauacagcaaggagauuauuugaauuguguguuuccuuucgugaccuuuuuagauguggcuuuuggggggacaggcgagggaauaauuuucuuaagcuuuuaguugccugcaacagugccaacaguugaacauaacagcaauauuuuuuuaaguuacccagaugaauaacaaaaaggaaggaaaaucccuuuaguaauuucaaaauaguguuguauagggaaucuuuaaaaauaaacuauagauauaaauauagguaugugcaucuaagauugcuauaggcuuuccauggcauaaaauuuucaauuaaaacagcuuuuaugagcaauaaucacauuuugagaaagcauccacaaccugcucacggguuauaccacuuccucgaugaaacaaaccuuaaaauauaagcaaauagaaugcauuuagcuuaauaugcaugauguuuuuuaacauaauaaagauuuuuaaggucucauagaaaguccuugguucugguuuguagcagacaagcaaagaagaacugaaguugauggaagcuuucuuuuuuuagcucuguuuuuaagggaucagacaucuguaauucaaauccauuuugauugaaacaauaaauuugauucaauucugaaauuucauuugaaaaguguaagagagaaauucaugggaccccucaaaguaaaugacaagccuggucucugaaauaugucaggaacacauuaacaccauguaaaaauaacagcagagccauaccagagucacgacggccaaauguccugaaaacagggcccuuccugggaaaggaauguguagaucuaauacuaauaguaucuguguuaagcacuuggaacauaugauugaaucuccuuaauuauuauuuuuggugugguaaugauauucugucuguuuacuuggucaugugcuggggagaagauaagaacucaagauuaagaagacuacacuguagacgcuccaugggaagcagagucauucaacaaacacacauauucacugaguguauauuauggccaggaacaccugaguuuaugaagcuuauauucgugugugugugugugugugugugugugugugcgugugugugugugugugugugugugauaugccagguguugaucacuacgaagaaaauuaagcaaggaaagagagugaucaagagaaaccucucuguugaggugacauuugagcagaguccuacauaaaauuaggcaguaagccccaaggaugucuguaaaaagaauauuccauauagauauaacaggaaauauuagaaugccaaagugugagcuugcuuagugugcuagagaacaucaaaggggucagugaggcugaaguagaaggagaagguuggauagagauagaaaauaagauaauagagguaaaugggaccggaucauuccaccucuggaauucacgcucaucaugauggaaagacaucggaggauuugagcagaacagggucacgaugaucaucguguucaaugacuagggugguccaaugaauaggguuuccaucuaaaguaaagcacaaugcugaaaacaauaccuaguauauaaacgaugugcaauaaagauuuguugaaucaaagaaaagaugaauuaauauaagaaauaauggggauagccuaugccccagcagaaacuuaucuaccauuagaccuuuauuccauuaaucaaagccauauucccuuuacuuugcagaacauaccugagcaguauaauaauuuagccacuucaagucaucaguguauuccacaaauuaguugacuaacaaaucuggccaauauaacuaucaacagaaaggagguuuccuaagugucuggacaaaaagagaccuaggggguaaguuuuccauuugauucucaagaaggcaugaguaaugguaaaaaauugagagaacgcuacuaaaaggagaauaaaauaaugcugaauucugccuauuuuucaacguuccuuaaagccaauucugguaauaacaacugcccacauccacaacauauuuuuaguaucuacaguacuucuucagaauccaguuucucuaguugaaggaugugguuaucaguccuggauuaccauucuuccugggguacaggaaauuggaucuugagcuacuuacaugagaacauaguuagcaagugauuuuuaccuagaccaggaucauauugggcauuuuggagacagaaaaauugucuucauucucaguauacaaaagccugcucugaaguaauaaauacgucucuuagagugcccaguucacuaacagaaagggaaaguugccauuagggagaucugauuccuucuaucagugggcacaagaaguuaggccaagccccuccuagaagacagucacauuacaaguaucauugacccaggucccagggcucaguaauauucagcccuuucuagguuauacaauuuucuucauugucaagauauuaaauggugauguaaaggacagacauaucuccaguaggaaaagaaauugagauucuguuucaugacagguuaacagaauaaguugaaauuaacucuuauaaagagaaauuucaaguacauuccuuuccucuacccuacagauauaauuauucccuuauuaugacaugacggugguugaauuauaaaaguuacauaggcuuaucguuugagauguugcauuuauuuuauuuuauuuauuuauuuuuuugagacggagucucgcucugucgcccaggucgcccaggcuggagugcaguggcgcgaucucggcucacugcaaacuccgcuucccggauucacgccauucuccugccucagccucccgaguaacugggacuacaggcgccugcuaccacacccggcuaauuuuuuuguauuuuuuuaguagagaugggguuucaccguguuagccaagauggucucgaucuccugaccucgugauccgccugccucggccucccaaagugcugggauuacaggcgugagccauggcgcccggccaagacguugcauauuuuuaacaaauaaaucaccuacaacucaacaacccaaagauaagaaacguuuugguauguuuacuucuagauauuuuuuucucuguauauacauaucccacucauugugcuguggacuuuuaaggacugauaucuguauuugucuccucgacaucucugggggacuacuuuuuauauacucuacuugccagcagcuauacacaaguaggccuuucagaucauauucuaaaauaauugcuagugcuuaauuauaaaaauucauucacagaaggaguauugcuuucacuuagauugcagaaagccauaagaggcuuucccccccuuuuauuauuauuaauacuauuauuauuauuauuauuaucauuagagacaguauugcucuguugcccagacuggagugcaguggugcaaucacggcucauugcagccuugaucucccaggcucaagugauccucccaccucggccuuccaaguaauugggaauauaggggcacaccacugugccugguuauuuucucucucuuuuuuuuuuuuguaaagacaaggucucacuauguuguccaggcuggucucaaacuccugggcucaagcaauccuccugccuuggccucccaaagugcugggauuacaggcauaaaccaccacacacagcccaaauaaugacuuuucuuuagcauuuccuagaaggcaaccacguaaaccaaauaccgaagaacugucaaacccuucuaagaacagacaguaucugaacuauuucaccuuugguagaacaugggaggaagaagcagcuaccauaaaagcaggcaagaugaaaauagcuaaaauuuuuacaaauuuucaaguccgaggauggaacgacaugacagaauaacuggaagucgcagauaaaaggggagucuccaacaagcuccugucuuugggcaaccacucccugcugcuaagaaagcaugggaggaggacgggacauagagcgcuucaggugcaugugcaugugcgugaugauccaccguuacuugggcggaggaagaggggaaggaguucaaccccgcucccuuccuuggaccccucccucacagaaaguagaagucuuaagccacugagagagagaaauaaaauguuucaacuaucagagccaaguccaagauccauacuuccgaucuguuucacuguaaccucaaauuaaacauguccaaaacgaacucauuuucuuccucuuaaaaucucuacuguuucucuuaacaauggaugguguggccgugcccccaguuugcauagcacaaaccuuggaguucaucaucauuccuucugucugacccuucuuuccuuagcgugaaauugguccuucuuccuaucucucagaccuaaacaggagaaccuucuaaaucccacuguaacgauuuaggucaggcccuuaccaucaucucccaggcuauuauaacagcuuccauuauaauuaauaccuuugucuucagucucuccaccuuucccacacugaucaauuucugucccucaucaaaauucuucagucucucaguccuacaaauugaaguucaaucuccucacgcagcagaaaacaucuuguauaccuuuacaaauacauuagaucuacaccuuauggccugucucgaaccccacugaagaaacugccaucacaccagcauccuacaccauuuuacaccucauugccucagucuuuacacgucagucacucagcauggaaugacccauccugcauuuucuaccagauaaaguggcauucaccuuuuuuuuuuuuuuuugagacggaaucucgcucugucgcccaggcuggagugcagucacgcgaucucgacucacugcaagcuccgccucccaggcucacgccauucuccugccucagccucccaaguagcugggacuacaggcacccaccaccacacccggcuaauuuuuuguauuuuuaguagagacgggguuucaccauguuagacaggauggucucgaucuccugaccuugugauccagcggcuucagccucccaaagugcugggauuacaggcaugagccacugcgccuggccuggcauucaccuuuuuagacucagcuuaggcuggacgcaguggcucaugccuguaauuccagcacuuugggaggcugaggccaguggaucaggaggucaggaguucaagaccagccugaccaacauggugaaaccccgucucuucuaaaaauacaaaaauuaaccaggcaugguggugugcaccuguaaucccagcuacuugggaagcugaggcaggagaaucgcuugaaccugggaagcagagguugcagugagcugggaucauaccacugcacuccacccugggcaacagaacgagacuccaucucaaaaaaaaaaaaaaaaaaaaagacucggcuuaagcaucuccaccucuggcgaaucauccgugaaccccuccccacaggucuguugugcuucaaguuaucuccccugucaaguuaugauguccucaaaguaggguuauugaauccacuguguuugucuuauuccuguugguaacuuuagccccaagcacaaugccuggcacauaauagauguucaauauaucuguugacuaaaucuuaaaucuaaaaugaagacacagauaggacucucaguuucaauaagugguuaaaaaugagugguacuaccaugagaugcaacccaguucuccaauuucagaugaaauacauucuucuguuucuacuuaugagaacugaaggagauuuuaggaaaaggaagcugaauuugcucauuccaauuagagaaggaagaaauccaauaaaggcuguuauacaugggucuugccacuccagcuuuugguaaagucuaucuacuacacauagcgucauggcauugcuagaauucuguagcaaguugcuuuuccuagucuguguaaaaaggcuuguauuaggccuuacccacucguaaggaauuucugaaagauauguguucagugauagcauuucuacuaaguccaaacacaggcaaugcuuuuaagaaggaacaauguggugauaaucaccauuuaauuucaaguguugcauauuuguuucaacaaauuucaaaacauuucccaaaggauuuuaaggaaagucaccaaggauguuuaacaaaacaacauauggaaugcuaauuuuguugugaugcuauacucuaauacagcaagaaacagauuuuucguaaaaucagcagauuugcaaacacuaauuaagaaacauugaaaacuaucaaggucaauuuaaaaaucuauuugaaaacaaauauuccuagucuucuuaguucuaguaauuucccacuggggauacacugcacaucaacaaacuuuuaccaugcaaguuuuacacuggaaguaaauaaauaaagacauacuuucaauuuucaauacaaagccaaacagugaaauuuggaggguuggguggaaauaaccaauuugucucuaucaguauaaucucuacucaggacucuaagauccuuggaguauuggauuucaccuuaagguacaucauuccuaaaagauguuccagaaguucuguguuuuccauaagggaguaugcucugacaguguuaacccuaggcaagaaugauucugucuuguguggaaaaagcaaguaacaaugagaaacuaguuuuacaucucugugcugccuuuugucccaugggcauucuuuccucugucucucugcccauuggacauuuuauuuucuacaaggcccuccacccaaaaaguagagggaaaacauguaugcauguguacaugaugugcacauguauauauauaugugcaugcaugcaugcacauguguguguaucacuuuccaaaugcucagauuuucaaccagugggcacuaacuaaacacucaugugauaaaccuagcuguaugcuuagggccacucauuucuugucauaguuaacuccacgcauaggaaguggggagauguguuauauuuacacucuucaagaacagaaccacuaguaacaagauauuuuaaauaggauaauucauagcaaacuacccuuuugccuaagaaccauugauccacaacagaagaccugauccgaauccaaaauagaaaagguuaaaauauaucauugccuauccagauaccaaaacuuuugcauuaguuuaacauauugcauuaccucuuuacgcacugucuuauuccagaacagacuuaaagugguuuuguuugaaauaacugugacaguggugaaaguuucaaaaguucuuguuaaauggaauuuggccuuuuguugcuauugcauuuucuuugaugaaauuucauauaaaugacauauacuuaaauaggucaguucuccaucccacacauccacaguacugggcuucccagaugaaaaccaaaaaguuuuuaagauaguaauguauaaguauagcaaacaaagaugaaaaagugugucagaguaaauguuacagagauuagucaaacuuaucaacugauuccuugagggacacuaucucauaaacaaauacacauucucacccccuuucuucuucauuucauuucaccauuuaugauaaaaaugagggaaaugugaggcuaugggacagguaggacaauuguaaccacugggugacuuuaucacauuucauauacugugauauccagggcugucgccuauagauacaaacagcacgacaaauaagacauacaacauuggaaguuuuaaaacauuauuuauugcuaagucuaaaacacucaaacaccacagcgcagugauugccaaagcuaaauuggaguuugugggcuuuuaaaaaguuucucuucaggggaacauuucagcccuguggagaggugugacauguaaggagauggagcaucuggcuggagaccaauuugccuauaagcccaaaccaaguggacccauguggagagcuuuuauaaaaucauaagcaguaaagcugaagaaaacucuagguucagacugcuuuaugguaucaauaauuaaacuggacucacugcacucacaggauuauugcaaauucugaguaaaccuaaagaauuuugaaauaaucuaauuaugccuuuguuuauucauauuuacauacagcauuuuuuuucucuguucuuaacuggauguuuaaaaaauucacagcuauccaagcauauuguuuaaaugcuuauagacaauucacaggaauuucccucaugagagagaaaagcagcauuagugaugcauauauccaggucccagaggcagagcaagaauaacaaaaugcaagacuagaauuaauguuuuuuaaaacugugguaaaguauacauaacauaaaaucugccacuuuuaacauguuaaaguauacaauucaauugcacuaaguacauucucaauguugugcaguuaucaccacuacguccugaacuucuacucaucccuaacagaaacucuuuacucaugaaacaauaacuccucacucugcuccccaccccaccaaccgaagccugguaacaucuaguuuauuucuaaucuccaugaauuugcccauucuaugaaccucacguauguggaauccuaaugauaucuguccuuugucccuacuuauuuuacuuagcauaauguuucaaaguucauccauacacugcaaaauauaucagaauuccauuccuuuuuuauaacuaauauuccauuguauacuauguuuuguuuauccaaucauccauugacagacacuucaguuguuuucaccuuuuggcuauugugacuaacguugcuaugaucacugguauacaaguaucugagucccugcugucaauucuucugggaguaauucccaggaguggaauuaauagaucuuacaauaauuuuauguuuaacuucuggagaaacuacuaagcuguuuuucacagaggcugcaccauuuuacauuccuacacugcacaagaguuccaauuucuccauacccacaucaaaacuuuuuauuuucugguuuuuuuuuuuuuguauggaauagccaucccaaugagugugaaguaguauuucauugugcuuuaacuugcauuuccuuaaugacuaauaauguggagcaucuuuucaucugcuuauugaucuguuuucaucuguuuaucuucuuuggaaaaaugucuauccaggaccuuucaccauuuuuuaacuggguuauuuguuuguuguugaccaauaaagguucuuuaaauauucugauucuuaaucccuuaucagauguguaauuuacaaauauuuucucccauucuguggguuguccuuuugcaagauagugucuuuuuucuuuuuucuuuuuuuuuuuuuuuagacagagucucacucugucaccuagacuagagugcaguggcacaaucucagcucacugcaaccuccgccuccugggugcaagugauucuuuugccucagacuccugaguagcugggacuacaggcacaugccaccaugcccagcuaauuuuuguauuuuuaguagaaaugggguuucacuacguuggccaggguggucucgaacuccugacuucaggugauccgcccaccucggcauaccaaagugcugggauuacaggcaugagccaccacgccuggccucgauagugucuugugauguacaaaaguuuuuaauuuugaugaagcccauuuugucuauuuuuuauuuuguugccugugcuuuuggggucauauccaagaaaucauugccaaauccacugucgugaagauuucccccuguauuuucuucugagacuuuuauaccuuuaucucaagauaggauacaauuucaugcuuuugcauguggagauccaguuuucuuggcacuuuugggaaaaagaguuuccuuuccucauugaauagucuuggcaccuagcuuaaaauucagcuuaccccacaugugugguggguuuauuuccaggcucucaauucuauuacauuagucuauauaugcuuguccgucugucagaucauacuguucugauuccuauagcuuugaaguaaauuuugcaauuuggaagugugagucuuccaccuuuguucuuuuacaagauuguuuugguuauuugaggucacuucaagauggguuuuuuauuucuguaaaaaacacuagugggauuuugauagagguugcauuaaaucuggagaucgccuugaguaguagaaucaucugacuaauacagccuuccaauccauaaucacaagaugucuuuccauuuacuuauguguauuuuaaugucauucaacgcaauuuuuaaagcuuauucuuacaaacacuuaaucaccacuuauuaugugccagaaacuguuccacgugcuuuaaaauuauuaauuuauuuaauccucauaaccccauauaaaguacuauuuuagcuucaguauaugaauaaaaaagcugaagcacaaaaagguuagauaauuuguucaaagucacauggccacuaagugguagaacugggauuuaaacccaggcagucuggcuacagaguccacgcuccuauuaugcuacacuccuuuucaagcauucauucauucuacaaauauucacacaacaccugcuaguucuccugaagcaagccaugagacaagaguuugugugcaggugauucauuagugaagugcucccaggagaaaucagucaaaggaauaaggaaagcaggacugagaaggggaagaauccaaacaaggguuugaagggccugccucagccuaauccugcggagcuguaguguguccaccucaaggcaagaagcagggccuucauacugcugcaccacucugcagcauaacacugcuguggagauaaacuucuagacaaucccagcuuuccauaugucugagugaagugccuccaguaauucaaguucaguccucuggagaaaguuacaaguucaaguuguuaggaacaaagcgugcugaagguggaggauagacuuaacagaggucaaaaaguggacucaagggaucugggcacagggcaaacaauauguauugcaucuaaggcacuguaccaagcauuagaagaagcaagaugaaugagaccaauacacuccccuucaaagagauuauguguuggcagaaagacaggcauacuuuauguaggguacauggugauaaauauuauaagaggggcaaacacauugcuaagaaguuagagagaagaguaacagcaaauguuuuauccccugguuaaaggagucacaaaaacaucauuaaagauguagcauuugaucuagguguuguaaauggaaagacuuggggaaagccuacaagaccauucaaacaugagcagccacaccgagauaugaagguauugagcacuuucauaaucauaccacucagcaauauuguacuuccuuacaauauuguuagaauacuggaauauuggaauuugucaugaguuccccaaaaaguauuagaaauacacacugucaggcuccacacaagaccuacugaaucagacacucagaagugggguccagcaggcuacguguaaaccagcuccgcaggagacugugaugccugcuuaaguuggagagauacuguucuaucacacccaggaucaugggccugugaaagcucaaccaagcgcuagacaucaggccaccugggacccaccagcccagcaucacacucauacacacuccuggucuggaaugaauaacacccaggacugaaaagggaguuuagacuagaugaagggacagucauccaaagagcagccuuuugugaagaacaagcuugaggcucagaauuccaugaggccuaaucagugagaaaaaaaaaaaaagacaaagaggaaggguuucauugaucagagagugcauccuggaccaucgagagcugaccauccucccauccauuuccuggaaguucucagaguucuugaucuuccauuuccuuugggaacugguccagcucugggggcucauaaauacccacacugccucauaaaaugacuggucaaaagaggaugagggcaggccguacuacuuugagaucauaugucaaauacuauauagaacaccagauauuuacuacagaaaaaacuguugagcagugaccauuaauauauuaaaguauaguuuaugaaggaauagcaguuucaugggccaggauaugcagaaggaauagcaguuucaugggccaggauaugcagaauggugacaugaauguaugaugauggggacaggcauuaaggucaggaugaggaaccauuaggcagaggagugaaauaaacagaagucaugcuuuagguaaaugauugucaaguuuugcaaaauggauuagaaaggagagaugcuggaagaggaaaaaucuguuaggcucaaaaguacaacuguugauaggaggaaaauauaugagaaacugacauauaugacauaaauuaagaauaugacaaacacaagucuaagggaagucaagggaacauuuuuaugcagacuguagauaucaauaaauacaacacaccucuucuguaaaagucagcuuuuuagcugaaacaccaaagucauucuuacccucaagacauuggucauuaaaauuacccacacaauaaaacauaguacagagaagcuacaacuacacuaugcuguuuaacucucacauuuaccauggaaguguucuaaaacaugaacaagcuaaaugauuccaguugucuuuaagacaaaugcaugcaaucacacuuuuagcuuaaaccuacaaaaagauucauucccuaacaaguuggcagguuaugaaugaacaaaaugacaaucuacaugccacuaaacucuccagaucuguuguuacauuuagggaaaccauccaccaucagaguuaggcauuaucuuauuaucagcucaucaaaaaaaguuaucaucugcgcagauuuacaauuuaacauuaauaucaaguauuuauugagugcucauaaugugucgggcacuaugccacuuacaugccuuacaacauuuauugcugagcacaaagaauuaaaugcauugccuaaguuacacagcuuuuaaguagaaaagccaggauucaaauccagaucugcagaccccagagucagaguucaaugcacuaagcaacuuuucuucacacauuagccuuuuuaauuuaauccuccuaacaguccuuguuugagauagucauuguuaucaccauuuuacaggugaggaacaugaaacacgaagaaguuaggugccagguuagcccacugggaagaucugaucugaguugucuaaguucccagggcagggcugccccacuaucugauauaggggauacucgcauuggaggcauccucaauauuuccaaaacacaucaauaguuucugagaaagaaaacagaacauuugaaacauagcccagcuugugcacaugcacacacacacucacacacacacacacauaauguggcagcuuaguaaacgagguagaugguguggaaagugucuacauuuuuagcuuuuuacuaucaguuaaugauuaucagucuacguguagaggguggacauauaucgauauagauaaauacauaaauaucuauauuuagaaagaaaucacauggauuagcugugauuucuguaaauccauggagaaauucucauauauuauuauaaaaaauaaaaaaauuaucucgauagagaaaacaugcaagugcaauggcauugaucaaggguuacaucauucgcggucaauuuuccaugucuauucuguaugauacaacucuuaaagacaacaucaauccagagaucauauacauuuuccuaacuaaagacccuuugcacuaucugaauguuauuuucugaaagaauaacccuuaguuaauuccuaggaguucccuaauuugcacccauaccucaaauucaacucauucuuucuuuaaugcaucaguuuucauuuugaagagagaacguauacagcaugacaaaaguaaacucagaaacacugcaagguauuuuguuuuugaauggggaacacaaguccaaaaguaauuauuaccugcccaaauauuuccacaaacuauuguuaccauuuugaacacuuuuuaucaguauuauuuuaauucugcaaguaaauaucuucugcucaacagacaugcaaagaucauucacucccauucuuuaggagaauggccagaagcaucucaaacucugaauagggaacgaaagaugcaagcucagccagguacaaggucugcaaucacagccacagcuucauauaaacagaaaucaggauuucuccaauccugugauuaugucaggaaaucucaaaucccugaaccaauugauuaauacaacgaugauggguucaggaaacaaagcugggugguggggguggggauggggggcuggaaggggcugggcaagaaaggcuacacuuaaaacauaauuugcccuuuuccuuccaugccuauggggaaagugugauggaagaugucacccagauugcagccuauguguuugggcaaaguucuagguuaucauuuauguauccuacuugcacuuugaucuuugucaugcugacaaaggaaaugaguggaacaagccaggcaaacccccaacgcaugguaaucaugacagaugagugggggaguugagccauuccagcuguccucgcaggccaucaccaggcccugggugaucuauuaguagggugagcccaggugcagggacuccgcuccaggcucagagagugcagccccagccauuaacugauguaagccauggaguaacuuaugaaaaaagcaugcaacaggaacagcagucaggaaaugguuacaaauuagaaacagagguauggagggcagaggggccucucaugccacaguaauaaaagcaacuuccucuuuuuccuaauuucagaaccacagaguagaauucucuccauaugaaauuccucacaagucgcaggcugcacuaaaccaccgccugucccuuucaauguaucacaguguacucacauggaaacagauguugccgccuuccugucacacuguuaagggaaagugugcugugacguggggaauggugaccuaugaacucucaagacaauucucuagcaccucauagaugcuuuuguuuucuagaaaaucgggauccuuaaaguuugauaaagcauuccaagaugguguagcucaaguuugaugagucugauaggcucuguuauugagcugaagggagccucucacagcuugcaagucaaguacaaugcugaccugugaaagcuccuugauuucacucugacugucuuccucaggcuggcugacucagcacccuugccucagaccagcuuccuguacuggucagaauaauucacccucuuaucugugucuucaagauuauuuuuacauggcuguauugugacacuuauccuaccacauuguaaucagucaucauguuuauguuugucucuccaacugaacggucucuucuuguggacaggauguaugccuucuacugccuuccauccauaggagugaucacuuauggugcccauggguguauguggagugaaugauggauacacuucagccugaacugucaauguuuauuaugaccgagcacaacauauauauuuauuucucuuucugucuguuuuagauuguauacuucccugugauuuaacuaagccauuucucuguuuacaaacuuugaaagacagcuuaaagauguuuuaaaguuauaugugaguauagguugaguauguuuacagaggauaguauuccugguagcauucagccuggaagucaauucucucccucaaaagacacauaauaucccuaaggaaaauaaauagaacguuauauucagcagaaacguacuuaaaccucuuauuccagaaaucaacuuuucaaugcaaaggccaaaaccgucacuaaggaucaccaaaggguggagugggaacuaagagaacaagaaguuuguaauccauaaaaucacaaguguuccaagaggaggauguccuaggagaaccugcugggcaaagagcaugcccacuugaauacagagggccugagaaaagagcucagugagggccuccgagcaacaaggcauugcagagacauggcacacugcugccugagggaaggcagggagaaggcugccacaggcaccugacaagacaagagaaaagagaagaaaacagguaaaauggguaaaacagaaggcaagaauaagggaaagugcugcaguaagauuuuguagccagaagaggagagcuguaguacuauaguaaauggauccugaagaacaaagaugaaauguaugugaacucugaaaaacaucuagagccccuugcgacaccucaaaagacacaaugagaguaaaauggaaaaagaacagaacaauggcuauucuggcuaggaagaaccugcuaagugaauugaaacugguggacaaagggaaguauauucauauuugauuuaacuguucaaauaauuauuuaguaccuuuaguuaaugcuuuugccauagcauaugauuacaugguucugaaauaaaugcuuuugguuauaagucucagaauaagagcccugaaaggauauuguauguauaacaaaugcuucaaugugugguugcucuccucuacccaagcaggcauaaacaguucuugauggaaucugccucuacuccugcuuucucauacaagaagagaaaagguacaauagagcagaauuggugucagaaagcaaacgcaacuucaugaaagacuagguauuccagggaagaacaauucuggauuguuagcuagcaggaauacuuaguaacacuagcaacacugaacacaauacaaauaguccuucccuauacgaagagauacaaccaauagcagaggagaaggcauucauaucccauaaaaggaagaggaccagagucacagacaagaccaaagaggauuuaaauuugauuaaauuucuuaaucggguaguagagccaccagcauagauaacaauuuaugacuguuuagagucucuucaucaggugguagagccaccagcauagacagcaacugaugauuguugauauccuaaaccacugauuguaaagucucccaacccuucucucagcuuccagugucuagcccuugcaaucuaucuuuugugacaagaucaaaguaaucauccugaaauaaacccaaacaugcuaucuccuccuuacaauccucuccuaguugcauuccacugccuaugaaaugaauucucaauuguucuaggacagcacuguauauuccucagaaucugaccccgagcuacccugccaguuuuaucuuccacuguccacuccccucaucuuuuucuucugcuacacaagacucuucaacaacucagaaacauuuauguauauucaaaugucuauacugccuccucaugcuauuuccacacuuauaaccugcuuuccacaacucacacaccuaaaucauauuuaucauucaaggcccuccucaaaugucuuuuucucaaugaaucuuuccuugggccaaucaaucauaauaacuguucuugcccuuauguuccgaccacauuaugcuaaugucugacugcaucaccacugaaaacugacauacuagagaguuguguguguccaauguucacacuagauaauaaauuccuaaggcagagguacacugucuuuuccaucuuugguuuccuccuagacaauuucagccaaaugcuugcauuucuuuaaggcuaccucuaauuugacauucaacuaaauucagucauuauuccaggauuuauuguuuauuccuagucauuacaaaagaguuuuauuuuuaauauuuucuauucauaauucauuagcuaagucuacagaaaguguauuaucagaccuaauaacacauaaaagucucccuugaaagagacagaauuuuauauugagcagaaacauaaugaagccucuuauaccagaaaucagcuuuucaaugcaaaggccaaaacccucacuaagaauuuaaccaaagaauagggugggaaauaggagaacaagaagguuguaauccauacauucacaaguguuccaagagggccaucagaaggagauccaaggagaaacuguugggcaaagaguaugcccacuugaauauagaggccccaaggaaagagcucagugagggccuccggguaacaaggugguuauuaggcaauacacucaagucaauuauugcauguuuacuuaaaaacucaauacaaaaauauaaaauaugauacuucccuucaauaaauagauaagaagacauggauuggguguccgaagauaggaaaggaugaauaggaagagccagcggguuuuuaggggaaugaaacuauuuuguaugauaauacacugauggauaugauacaugucauuauacacuguuuuaaauccauagcauguacaacacaaagagugaguucuaauguaaacaauggaguuugggaugauaaggaugggucaauguagguucacugauuauugcaaauguacaacucugggggugggggaaugcugaugacgggacacuauggauaugugggcacgugguauauaugagaaauucuguaucugcugcucaauuuuucugugaaccuaaaacuuuucuaaaaaauagucuacuaaaaaaagaaaaaguugggugccauaguucaugcaugaaaucccagcaauuaaaaaggcugaggcaggaggguugcuugaagacaggaggucaagaugcacuuaagcaacaaagcaagaccugucuuacaaaaaccguuaaaaauuuuaaaaaauuagcagugugccauggggugugccuguaguuccagcuauucagacaguuuagcggggaggagcauuugagcccaugaguucgaagcugcagugagcuaugauuguaccacuacacuccagccuggacaauaaaaugagaccuaaucacaaaaaaaaaaaaaaaaaaaagaaagaaagaaaagaagaaagaaguuuauagcuuauuuggaggauuaaaauuaaaacacacaaaaaguaaagaaugcgaaacaguauaaaacugaggucacuaaaugaaauacuuguguuaaaaaguuguagaaaauauaucuaagauuauaaggcuaaaaggagacaaaauaguuaagaguugacaugauaaggaaaauaaaaaucccacuuguaagaauuuguuuuaaaagaguaaacagacaugugcaaagcucuauguaugaagcuguaucucagcauaaauuacaaacaaucuugauauucaacacuggauuaguuaaauaaauuauaaaauauccauaaagcaaauacaccaaaaugauuaaaaauaauccuuucauagguauauguaugugaaugaaaaaugauaauauaucagaguauuauuucuaauauuuuauaaaacuacacauacacaaaauuuuaaaaagcuauaaagagaaguaaccucugauccuugaauuaaggaaaacauuuauuuccuucuuuuguuuaucucuauuaucugcauuuuuauaguaugcauuuacuuuuuguaauucaaauaagagcugaaagauaaucuuaguaucucagaacaaucuggaacucaauguuggcauucccuccuuuucucucugaauccaaaauuagauauaauaagauuaaguccauaaaaaaguuuugaaauaaauaaaacacucuacuuaaaguaauaauaauaaaaaagacauagccauuauaaguuuuuaaggaagguaugaugguuauuuuaugcauaaacuugacagggccacagggugcccagacauuuggucaaccauuauuccaagugugccugugaguuuguuguuggaagagauuaacuugugaaucagcaaacuaaguacaguagcucucaaccaaucaaccgaagacaugaauggggacaaaaaggcuacgagggaacuuugcuugccucgcuguuugaguugggacauuggucuucucugauccucaaaguggaaccacaucaccagcuuuccuggcuuuccugcuugucaacugcagaucuugggacugaucacaugauucaauuacucauaagucacaugcauaugacuagucucuucuguaguugucaggguucuccagagaaacagaaacagaagcaauaggagauauaucucuuauuacauuaagucuccuauugcuucuguuucucuggagaacucuaauacauaaaagauuaugauuagaauuaugcuugaagaagguuaaucuuauaauggcaugcagagcggagcugggcaaggccagaggcuaaauauggagccagaaagauacugcagaaagugagcaaaaaggaugaguggauggccugggguggaauccgugaaaaagggcagauugucagucucaggaaaucaacaggacugaguucuaacuucagcugggcuacuaugcccugggguaagucacugcccucgccuaagccucugauucuucaucuauaaugugaauuugauagaucauaaaucuuccaggguccuuuucuauucuaugagucuaagagucuguugucaauaggaaaaaauauuuagaggcuuuuauucaaacugugaauacauuggcuuaauuuuguugucuuacacugaauauuccaucagugcucaauaaauaauacauuaagccagcucuuuuggacuucaggcuuuaauuuuaaugcccugacuuuuggcaaacucuuuacaauaucaauuacuuuauuaacuuugcaaacauauaaugaaaaaaugggcacauuacuuugaaauaggccugucuuaaucuaauuaccuuucuuaaggaaaaaagccaauuuaugaguauaauuauuucauaucaaauaauuuauugauaaugaaacauuaaauaaccacagcacuugauguaauuugaggacagcgcacaggaguuaaagugagguuccaguauuccaaagagccaugccagugugauacgugugaauucuuuucccauuggucugcuacauguaaugauguccugugucuaagucugagcuagggcaggaggaaagaguguuguuaaauuuauuccaaauagaaaucccaugucaaaggugaaagacauuugagugcugggcuugaagauuaacuuccuggauguugaacuucaugugauccauaugauguaugauucugauuuuauagauacacaugacugagccuaucugaucaaauuaaggcaaucuuacaaacaaaucaguaggccacagaugcaauaagcccacagagagugcauuguuugaaucacauucauuaaugccaucuucauccccaucacacaguucucuggguauuuccaaagucaaauguuuaaaagaacacacccaugauucuucuguggcaagcauacuuuguuauucucuauauaacuguaaaaaucaaacagaaaaagaaaggaagaaaaaaggaugguacaccaaaucucuuuucagccuguuaucugaucucuuagaaccuggacacacaaaccaacucuuacuuucauaaaauuauucuccuuccuuugucuugguuucuuuuuacaaugaaaacuggaucuaacagcguuaauguccggaagcuuucagguaaggccauauuuuacaucauauuuuauuggucuuggcaguaaacuuggaauuagccauuaagucaggauuucucaucucgucaacuccaggaaaaaugcaauagacaaaggagaaacagccagagaccuugaccaacagaacuauauuaaaccaguaaaacaaaaaguauuccaugugugcuccaguaagaaagaagaaaggaaggcucaacauuucuaucaugaggacuucuuccagcagagaggcuccacaggagaccuuucauugaccuucacugagaaauaccgaauaugucaugacuuucuucaacuccaccucuucaguccaugcuaucaguugagguuuaugagagcugagcuaucauuucuaaagacagaggaauuuguuccaaaaauaucuggcuuuccacccccaccuucauuuauaaaacaaaccaucuaagucuuucaggcuauuuuuccaccagcuuguuuauaaugugguaaugauuaugcuaauaccaguugggaauacauucuauguggacauguugugggaaugugauuggagugugugggggagaggagagggcuguauaagugcaugaggagagcuauucuauaaaauuauaguacaugcccucuuuccauauuuacuaguuuuuguaagcuccuucucaaaugggaaauagaccaugcuuccuuuccagaaggauaguuauugaauaacgaacaccauguguucugcuaugucuuauuugucugagcacucugcagcuauuuucuaaaccaaauuaauaacaguauacuaaacugauuucccuagugaaaacugcuggcuacuaccaaugucaguauguacaccccacugcuccccaaagcuuagguaaucacugcauaaccaaagucuacaacagccccagagugggggcaaggcagcuuucaugguacacaagggaaaauugacagccucuaauuaaaugagacuguuuacacaagcgauagaguauuacaacacuuucccuacaaaaagaagagaaugugaaauuucagaaaagacagauuuaauguggaacuugucaccaccgucagcuucggcaugauaaaaugcacauggaaagucccuugcagcaagcccgcugcaaagaagauucuuccuucgucugggucagaggguguggaugucucuaaagaaaaugcuaccucuccuuugcucacacacccacuugcggcacagugagcuuuccacagcauauaugggaucugugggcugaaugcuggagacacaggggccagagccuggcagugaagacuccuggguuauggaggaaaaaggaaguaucuccuuucuacaaauuaagaaaaugcacauccacaugacagcuuaacacaggacaccggguguguacagaaacugcccuaaaaaaaaaaaaaaaaaccucccaccuucacccaagccaaguaaguuguaagcaaagacaacacaauucugguagucaacugaucucaaaagggaucucuaauuuuuaauauuacauuacuccaaacuagagugccuccuuaccaaguaugauuuuugucacaucaauauaugggcauuuuugugaagccauaccugaaaacaggcuucuguuuucucagcuaaacucucaauaaauguuggcagugauggaaguuuggaauacuuucauauuucaaauguggugcuuuuguucccaacuaaauauauaggcacauauacuuauuauuaaaacacacucuacaaacucccuacugggggaauuuuaguuccauuugaacaucacaacuaaaacauucuauucauuccacagcauguucacucucuccaaguaagaauucuuucugguguuuucugacauaaaccuaaaaguucauuauaauuugcacaugaaaaauccuuuuaacaguuagaaucaaaaguagcaugaguuaaugguccaguccaccagauaaacuuuugcagguuuccaucugaaagucauaauauaaccuuuuauccugugugucauugguacagaagguuuugcaaggcaggguucuucaaacugcaagauguuaaacagauguacggcagagucuuccaauccuaaacuaugaagagccuguuuucagucuguguguugcagccuucauuuuuuaaauuauuuuaucaagaucuucagguuugcacauuucauuugugaaaauuuuguacuuguuaucauuuuuugagcugcauauauuuuagagaacuagauuuuaaaacauacuguuuuugaacuaaauaaagaauauuaauuuaaauguuaacauguaaaaucauauuuucagcaggaugaucucugcuuccuacagcaggugcuggaagcccaaucccagauguuuugaaguguaaauagcaagggaggaauuugagaaauggguagagaugccagaaaaaggaaggcauaaauuaaaaacagacguauugaaacauuaguucacauggacauuuuggcuuuuguuguucacuggugggcuucuauacuuagcuauuucucgugucacaaaugucacuuucuaagacacagccauagcaauuggccuaaauguucaccuagccgaugaagcaaauucuauuccuacauugaccagaaagacaugucugacauuccuuuucagaaugcuugagacucauaauccuaccuuauagauauggccauuucccccauguuuaacuacauagaagcucggaguuuaacuauaucgaaucagugucauaaacaggguucccuaaagcuugagccucagucuuugcagucgaaaggcccauucugccccuuuuguucuuacccauuuguuacuugaagggauuucagaauacauagcucuaacagaguuaaaagggugcuuauaaauguuuucuccuuauuuagcuugauguuggcacagccacuccaucauuucaaugagacacacaugagcaaaaaggccuuuauuauauaggcaggccuuuauaauaugggcagcuuccuucucaaauauccuuuuuugcuaucaaacuaaucaguacuaugggauaauuaaauccauaccuaguguaaggcugaguuuucacuacuuuaaccacaucaucgccaagacccucugcaucuacauugacagggauacagagaacagcccuguuuuucaaaagugugagguaucccuggagaaagggaguagagcuauacccggcuguuccucaugacucuaggauuugcaggaccuguggcugaaaaguuauuuaccucuuugagacaugguuuacucaucugugagguggaugaugaugaugaugaugaugacgaugguuaugauuacauugucuaugucauauggccuuugugaggaugaauuagauacuaugcauaaaguauucaggccaaugccugacacauagugcuaaauaacuguucauuaucuuuacuuugcuucacacauacccucugcuccaaccaaagugaacuccucucuuuuaaaugauccuugccccuugccacuguauugccaagcacuugcugguccugacccuccucccugguggaaggcuuucuucauauauuccacuaucuccuaccugugacagcucccuguccuccccaguaucuguuuaaaauuuuacccauucuucaagauacaccucaaaugccacccgcuccaugaaauauauccuaaacucuucaaguugugacuucucugaaucuccaggauuuuguuuuuucuaguuuacaggugugaauuuagcauacuccuuauuuaauggaacauuauaauuauugguucaugaauagucccucuguuauauuuacauuccuuuguaaucccaauccaaucucuagacucuucuucccacaggaaacuacucuaauauauuucauguaacuuuugaaaaauauguacuguauuauacauucauucucauuuauauuacuggauucugugauagagcucuugcuccuuucuugauugcaccaugcugguuuuuacaauccuuccaaguuuccacaggaauuucuaauuauugcauaaugcuuacugcccacacuuuugacaaucaacuacugcucaccagaaaugaauauguucauaucugaccaauauagaccuguuugaggauuuucuuaaucuauaugucaaagagaagaauugcagggucacaggaauagguaaucuuauugccuaaguaaugacaaaccguucucuagaaugucugcgccauuaugcaauaucaacagcaguccauguuggcccccacaucucuacauuucugccauuacuuggcucucucugguuuucuaacucuugccacuuuauuuauugucacuuuagugacaucuuauuauugcuuucauuuguaucucucuccuuacuaaugcauuuaaucuucaugggucuauuuuucuuggccauuuagcuuauagagccuggagggcauuuuuaaauuaaaaugcuuaucuuuccucuucacccacugccaaauuaucaauuccuuuaagguauaggguauuuuuccuucauuuuugcacucacuguaacaccuaccauggcaccugaaacaacaaauaaaacauaaacacaaaaauaacggaaggaauggaaguauaaguggaugagaacaguuacauauugcucuuacugcucucuucuugccaaacccaugacuucccuuggccagcugaacugaaaauagcagcauccauuuaauaucucaaauaccauaaaggagggaaggaagaagguguuaaugcacagaauucuaaaguucuacugcgacauacacaaucagucuccucggucccaugugcagggacacucacuucauuauucacuuuuauggaccaaauggaagucagccuggcaguucugccuuggcaacuuccaaagcucugcuuuucaauacagguauacagccugguguaagaaaacugcccuguuugccaacauuaauauaccccagagaguaaguaggcauuuaccuagcagccagugcaggaagcuguauuuucuguaacuuuccugguaaggacagagugacaauggucuuacaccuaauuaacucuaccaucauggcaacuuccuugauguguaucauaaaagcuguccagccacauggcaugguaacuagaaauaaggguuuuggacuugggcagaccuguuuagaauuuuggcucugcaauauaccagcuguuacuauuuuguuucucaucugcaaaauguggacaaugguccuuaccuuacagagcuauuguaauaaauaaaugaaaugauaaaguacuugguaaaugauaguuauuuuauuauucccauuauucuccacccuauuccauauuaucaagauuacagcaauaaauaaaaggaugcugcuaauauauaaaauaaguauugaaaagacaugccuauacuuaugauaaaugaguaaguggaagauuuuccuugcaaaauugaacuguaguuucuguagugacaaaaacauuuuaaacauuugguucuauguuuuagucccaacuauaccacuuauuucugugugaguucaagcaagucucuugaccucaaaccaguaggaaaaccaguauauagggauaauguuaucuacuccccagauauacuauaaaaauuugaugugauuauaaaugugaaugcacuucaagaccuggaaaauagcagaaacauguuaaauaucacugauauccauaguuugauagcaccuugguuacuacugguauuuaguuaguauuggaaacaauaacauauucuuaacauaauuccaaaugucaaacgcauuuuucuagggauaaaaugauguuggcaaaauuuuuuacuuuguacaauaucauuaagagauuuccaccuuuuauucaauauucuaggaaucagaagauucucccuaacauuggaguccaaagaagaggagccaccaucuccuuaacuacaaaacaacugagagaagaaaugucucccuuuagugccagugaagaguuuugcuucucuagaacaacuguuuauuuuugaucuuaugaaacgcgugacacuuguaacugauuugccuucuuuuugcuugcugcuagaaaucucagaaccaaauucgaggucauuucugaaugugcuggacuacacagcaugaauucuguguccucucaccucauucauagauacauuuuuuuauuccuacccaucuuuuccuuuccccagauuuuccuauugcucuuuuaucaucuugaguaaagaagguuaaacuaugaauaaaaaguacaaucucaaugacgagucagggaaaaguaaguuuuggacuuccauuuagagccauuuauaggucagcaaucuuuugucucugugucuucuuucugcccugaacaaccaaggcauccuagucagucucucuucaucugcauaccacuuuaaagagcccaggggucuuccaaguacagucacuacuaagaaaaugucuucaguaaauuuuuuuuuuuuuuuuuugagauggagucucgcucugucgcccaggcuggaauguaguggcacgaucucagcucacugcaagcucugccucccggguucacgccauccuccugccucagccucccaaguagcugagacuacaggcaccugccaccaugcccggcuaauuuuuuuuguauuuuuaguagagacgggguuucacuguauuagccaggauggucuuaaucuccugaccucaugauccgcccgccucggccucccaaagugcugggauuacaggcgugagcccccgcgcccagccuucaguaaaauuuuaaugcauguugcuuaucauucuuuguauuguaagcaccaauccuuaaucugugcugugguuuuuguucagaaacauuucuuuaaaaaaauuuccccagacgcucagccuucauauucuaaucuuuauuauucugaacuaccuacaaagcuaaauauaccuugucuacaugcagugcuuauguaacaauggugcuuauuuuguuuuacauugcuucaaccucugaccagaaacuuagaggacagaaugcccugcuuuuacaaaaaauguggugaccacaacgguaaccuuaucuaauugagaccauuuuaggaaggaggggaggagauauuuuuacugcaaagacugagucauaagccuucauuuuuuacccuggguugugcagaaacuuuaaacuuucuauauuauuucauuucuuccauaccaggacauuuauuuccuauucagugacaaucuugaugucuucauccuucaaacugcucucuaacauaguuucaaaauccaagcauuaaacauuauuaaugcucaggggaugaauauguucauuaccuuuacuguagugaugauuuccuauggcaaaauguuaaaugauguaaagauaaaaauaauuaucauaguuauuaaucauagcaauaaaacuggacuaccuaaagcacaguuuaugguauaauauuuaugaauuaagagcaacacaaauaauaauguuaauugcucaccuacagaugaaugcaaaugaggauauaacagagucgaaauaaacuaagcaaaggaaacaauguuucauagcuaucguguucauuauucuaaccaaaaaaaagaacacagaaaucagauauaugcaauaggguacacugaaaugauucucaaugauuauauaaaacauauauacauuauuuucucaacuuccugaaacaucaauucucuugcucauaauguaguuaaaucgucuaagauuagccucaugugaccauguuuggacuucuuaaaaaaaucgcuucaggaacauuacauuuucaugaucagauaguuuccugaaaguauuaaacaaaacuaggaaaaguguuuaauaguuauuuggauuacauuucauuaaaaaucuuuacgaucucuguuaacaguccaguacauuugaauguuaaggaggacccugcacugaagguuuuauaaugcuuuaucuauuccaaguuauacaacacaaaaauuuucucaaacaagcacaugugacuuugccuacaucugcauuuaagauucuaauguacauuuuuuuauucuuuuguuuaaauuauuaacuaucaacacuagaauugagcaugguauguauucagaauuauguucaaguaauuaguggcuauuuuguuaauaaagaugaagcuucaauuguagauuugauaauuuuacccuaaaauuuuuaaauauauaaaaaauagcauuuuuuaaaacuauaaugguaaggcaaaauguucucaucagauucggugggcagaugggacagggaacacagcuuuccugaaccuggaacucacaguucugccacgcagcuauagcaaaagagcaaguuuuacuucucaaaggggaaugcacaggcuuacagguguacaauaugaaacugcuggaguacagaggaugcuccuuucucaaagucacagaaagauugagacauguugauauuauuuaaaccccuaaauauagccauuucugaaaccaaaagcgauuuccagauuguugcaauggugugaaucaacaauuucaauuauuuuuucccucuuuaauuuacuuuggaucuuugucacuaacaacugaaacacucugccuaauauuucgguguucauuauuuuuagauuuuguuguuuaauuuccuacuguacuguuagaugccauucagugcauaacuuagaccuuaagaauauuccgcuguuaacuugccugaaaacaagaugauucuguagcacauacgagagcuuaagaagcucuccuucagggaaaauguauccauuucugucuccuacccaagcugagaaagacuuuccccuucucagcugccauagcagcacucacaggguaacuagugauugauaugucuguaaacucccaaggaccaggaccagaucuuucaucucuguauuuccagagccuagccaaguacuugacauguagcaagaauucaggaaaugcuuguuaaauuauugggacucaacgccacacagcuaacuacuugccuggcccuauguggcuaucucacauccaauuguaaacagccauuccaaaacuuuccauucucaaaccccuuagggcaaauuaccuugccaucuuuucuuacaauucacaaaugaucuugccuccuacuuaauugacaaaauaaacaaagcaugaacucauucuauuuucuguccccguaccuucagacaccagcaaucccugcccccuucucccugccugucucagagcauaagguaucccucucucuuacauucagaauguauaccuucccauuuacaccaaguucaagaucuuauuccauuuguuaucuuccuucuuucucuagaaaaaugaaaugucuuccucucucaaaagcaauuccaacaaaaccagaaauugauguguggggucuaauuaaacuaaaaagcuucugcacaccaaacuaaaacuaacaucaguguaaacagaaccuacacaauggaagaaaauauuugcaaaccaugcauucgacaaaggucuaauauccagaaucuauaugaaauuuuaauaacucaacaagcaaaaaacaaauaaccucaucaaaaaaugggcaaaagguaugaagagacacuuccccaaagaagacauauaagcggccaacaaacauaagaaaaaaauucuccacaucacuaaucaucagagaaaugccaaaucaaaaccacaaugagauaacaucucacacuagucaacugcuauuaauaaaaagucaaaaggccagaugcaguggcucauaucuguaaucccagcacuuugggaggucaaggcggguggaucaccugaggucaggaguucgaggccagccugaccaggacauggccuccuguuguauccauguugcuucaaagaacaugauuucauucuuucuuauggcugcauaguauuccauaguauauauguaccacacuuuuaguccaacccugauuggcauguagguugauucagugucuuugcuauugugaaaagcccugcaaugaacauguaagugcaugugucuucuuggauauacacucacuaauaggauugcugggcugaauggcaguucuguguucuuucaggaaucucccaacuccuuuccacaguggcugaacuaauuugcauucccauauucuaugucaauuaaugaaggaacagaaaaccaaauacugcauguucucuuuauaugugggagguaacaaugucuauacauggacauaaagacagcagcaauagaaacuggggacuaccggggguagggaggaaggggaacaaggguugaccaacuaacuauugaguaucaugcucagcacccggcugauggaaucauuuguaacccaaaccucagcaucacacaauacaccuggguaacaaaccagcacauguacccauggaaucuaaaaguuggaggaaaaaaaauuaaaaauaagugauauuauauauacaaacuuaucuccaaauuauaaaaauuuugagauagacuauguuuuauugcaucuuuauauuuagauaaaugauaaugaagauauuauauuuaauugaaugcaaauuuguucugccaugaaaauguaaucuauagagaagagucacucaccaaacacuaaaaacauuaaaaaaucuuauaaauaaauauauuugaaaucauuucaguuuuggggaaaaucucuuugugaucaccugucaccaauaaguuauaaacauauguuaagacaaauagaguaggcaaaacuuauagucgaaaacauuuuauuucuugaaagcauguuuaccauuauaauggcauaaguaauuuuucaaauuuaacuaaagguuauucggaaauuacuggaaaucagaaugaaagauaaagaaauuuuaggccgggcgcaguggcucacaccuguaaucucagcacuuugggaggccuagguggguggaucaccuaaggucaggaguucaagaccagucuggccaacaugccgaaaccccgucucuacuaaaaauacaaaaaucagcugggcacggcggcacaugccuguaaacccagcuacugggcauggcagcacaugccuguagucccagcuacucgugaggcugaggaagagaaucgcuugaaccugggagguggagguugcggugagccaagaucgugccacugcacuaaagccuaggcgacagagugagacuccgucucaaaaaaaaaaagaaauuaagaacuaauuauuugauucuuacaaauauguccuaauucaauaugaaaucauuggcauaaugaaaagcaaauucuuacugaacacuaucaauaagaucaauguccuuagaauuauuaaauuauauuggaagugacaacuaauagcacaccacaaaaacagaaucugugguaaguuacaggcaauagacaaaaaccaucucaaagagaguuucucuaguuucauuagucuuaagagaacauaguaagaucaucacaaauagguauuggggauuuuuuuaaaugguaccaauuuaaaguuauuuuccuaaaaauuuaugccaauccuaagcuuaugccauuaacacacacaaacacuuagcuacaaaauuuaaguauauacuuucgaaugucacauaugucuuuuggauguagcagugauaguuuucagagaaaauggcaauuaaagaauugcaaacuguucccaaaccuguaaguuauuuguguacaucuguaaaaagacuguccauuuugcaauauuuuaaccaauagggaguaauaauguaaaagaagcugaguaacuuuuuaaaacaugcuguauuuauauuaugaugcauuauuaggugugacugaaauguucacaaaaguuauuaaaacacuagauguuuuagaaaguuguuauuuaauagaacauauaagugauggaaaaucaaguagguaauacuauuuuucagaucagaauuuauguuuugccuaaauuuugguuauaugcuaaguuauaagaauucucuuaaauagguuaaauguagacuuaaagauaauuucuuugccuucaaaauuagaaguaguucuuuagaaguggcuaaauuucaaaauuucuuugcaauuguggaaaauaugucaaaaauauucuccaaaugcaaaaaaagucuacaaaacuguaaaaacauaaaacaagauuuuggauuuauauauuucugcauaauuauaguaaaauauaaauauuaacacuuaauugauauucuaaaauaucaauuagauugauuagauacacuauuacuaagcuuguuuauauuuugagagcaauaauuuaagcaaaguaaaagaaaguuuagaacuacccuuuaacaaaauagacacauaugaaacaauugagaaugugcaaaaauuuuauaggugaggaaaaugugacucacagauuuuuguuucauuggucaacacauaauuaaauuuuauuuauuauuguaucaccuuuauacauuucuguuuuuaacacaaaauucaaaauaaugcuacuuguauuucauggcuauuacagggcauauuacuuuagcuugcacaguuacuauagcaacuuguuauauucugcaccaucugaaaauauuuuggggguaaaaggaaggguuuauaaagggauuuaguagccuaucacagauuuuacaaagcagaaacuguuaagcaacucaauaaaaauuaaagaucacauuucuauuuacucaugugagcugagagacugaugaugugguauugguuuaauuucaacauaauuaaaauauuguauucauaauucacauacgaaacauuaauuuacagguccuaaagcuuuacuguuguggaacauaguguugauacuauuguuuggaugacauaauggaaucaguauguuacuuuaugaacauccccucuuaauauuaaaaaacaaaacaaacgaaaaaccuucuuugccuaauguuaaccuaaaaugucuaaaaauuuuugcuugcuuaccuagaaucaacucuagagaaccucacacuacagauuaaaaguaauccaaggcgauccacaaacacagcaaauacacacacacacacacacacacacacacacacacacacacacagacauacuugcucaguucagggugucagacuugaagugauucuuaauccuucagaauuuacugggucuuaagaauccuacagauucucuccauuccagaaaaauuauacacacacagauaccuaucuaaugcuuaucauuaggccucuccuuaggggaauuaaccccacauuaauaaauuuucacuuaaaagaaugacuauuuucuuccugauggucacucaaggaguauaaggcauggcuaaauuuucauuuguuucauuuuaaugguuccaaacuaaauacuuaaaauguuucugauacuuugagucacucuaagacaucaaaucauucaugagcauuggauccuuauuucugaagaagaaauuucaaaacaauuuuaaccaaccccagaugaacaucuguaugagaccaaccuugcaguuggccucaccccuuaggcuaguucccuuacuucccaggcuucugaacaaaugguuacccagaaggacaaaaugaaaggcuugccuauacauguggcagaaacauauuuuuugaaugaauaaaaauauauauggccgggcgcgguggcucacgccuguaaucccagcacuuugggaggccgaggcaggcggaucaugaggucaggagaucgagaucauccuggcuaacacaggugaaaccccaucucuacuaaaaauauaaaaaauuagccgggcguaguggcgggcgccuguaguccccgcuacucgggaggcugagccagaagaauggcgggaacccgggaagcggagcuuacagugagccgagaucgugccacugcacuccagccugggugacagagcgagaaucccauuucaaaaaauaaaaaaauaaaaaaauauauauacauauuuuaaaauauauuugucucauacucaauacaacuuuaaacacauggcugugaagauagauaggaacuucuugcuucuuauaaucuuaagaguaagagcuaugauuuauuauuacuaauaaauuuuggaguagcauuguucucuacuauuaggcaauuccaacucaaaauuuuauugccauuaaugacugauacuauagauagaaauaaaaaggaccaugaagagacaaaaaaaaaauccaauaacuccucugugauaaugagaggagcccagaauuuggggucagaagacccacccugccauuuacuguguggcugugagccaguuguuucagugccccaaggcuguuuccucauggguaaaauaagcauaacacuaguuacuuuacagagcucuucugagguuuagauagugcaugaucuccccuaaauccuacuuuucagccuuuauaucuaggcacuuucuccaugugcaucuuauguucuguucaaaucaaacuccuaaagguucucgaaaggugucagcuucauucauccccuuggcuuccgaugcauucuuccucuauuuacuuggguaauagggacuaauucauugagacuuaaggaaaucuuccaugaccauaugagaagaucagcccauucgcuaggcuccaagauaaacuuauacaaauuuuacccuuauauuuacuuguuuauuauuccaacuccuugaccaugcuguguguucuuugagacccuaaacuaugccuucuaucucuuccgucucacgugcacuuagcacacgccuaacccaugaucgaaaaaacaaaaaaaccaauguuuaaaugaaugcauguuauacacaaagcauugggcuuaguugucugugauauagaagggauuuaguuuagauuagcugaaucuaaaauuuaaaccauuagagauggauucacugaucacaaugaugugacuucauuugugucauuuaaguuucagaacaauaacugcuagugguccugagauguguuuuauaaagaaaaugaaaaacaucaucaaaugaaucucacauauggucagcacacucugcuaagaauauuuuaucuuguuuguauuaaguuagcaucaaggucuuucagcuuacaaaucccaugaaacaugcauacugacacacaagacuccaauauaccacaaagcuaaauuguaagcaugcucuucucaaguuucaguguggucacugaacucaauugguuagcaguaguauuugaaggcuuuuauacacuuccugcuguuggucaguuugaauuuuuauuaaaacuauuauauugucauagucuaaacuauauauuauguuuagaauaacagugaaggcauggaaaaaaugauucuaaacagucauuuucugucgcuaaaaauuauagaacaaacuacacucaacuugcuauaaguuauaauuagaauuguucaaaaggaacaaaaaauaguaauaaaacaaggaacaaaucuuaggagugaauuacaguucuuccugguauaaagaaaugcauuacugagguacuugaguuagggaauugcgugacacagaaaggcagacugcaggcagaugacuacaugagcagcaaaaugcaggauagaauuuaaaggcaaaaaaauuggaaagaggugagcaauuagguaaaaaaucuucagguacugacacucuagggcuuaugguccacacugggcuaaauaagcuauguuuauacugccacauuucuggcccucagaaaagucaacuuuccuuguaccuuugaacauagaaugaauagcuuagcugguggguguaaaguuuauuuucuacaauucauuuauuagguuggugcauaguaauugcgguuuuuaucauuacuuucaauggcaaaaaccauaauuccuuuugcaccaaccuaauaacuuuacuuuuuaucauugauaugguuuuccauacaggucuucuuauacauggaaaaaaaaauccuuuaacuuuacaauuaaaaggaacauuuucuucauacuccuccuucuucccaagaggguguuccugaaugaaaaggaacaucuaguuccucucuccucuggguucucagggcuuuugcugaaauguccugcgaucugcgcagucugcuagcaauccucuccugguaacagugauuugucugcccugguuuauuaacgguacccacaccugaugaccacggaauugccacugcaccuguuggugaguucucugcauucugcauccuccacuacucagcuccuuggugcacugguccucacagaaugugaacacuggagaggagguggagaggaagcucuccacuguugacucugcagugugcaagacuccuucaagguaaccuuagccucucccauuagccaccccaaugucauauuggacauuucacuauaaagagggucuacaaccucccccagguucuggaauuuggaagaaucaauuaaacuuuuacuuguccacucccaguuucaagaucucaccuaagggugacaggauggagaaguaacacuguucugccaaauuucuugaucuucuuccccuucagugaucuuccccaguacaggguagauuugcuccuuccuauguugugggaauuucccauguguucuguccauuguuccucucuguuuuguucugcuauaagauccccauaucgaguucuaauuuguaagaauaccauaauauacaucuccuccuuuuuucuaccucaaaaaagcauggcuuuugcaaacaaaaggugcuugcuugaagacugccaucuugcuacacauguuugaaagaucaaagccaaaugaugacucuauuguuuauugucaucugggucgauccugugcaagaagcaaugaaugcuauugauuuaacgaguugggggaaucaaggaacaaguaggaacuuggcauuaccaggaaucuagacacauuauuuuaguauuucuaaaauguauaucuugaaauauccacaucaaauccaaauauacaguucagaagaaaagauuuucauaaaauuauauuuuacuugggucauucuuaagaguuucgauaucauuaacaaauuauccuuuuugguacaaccuuuccauugcugcugagaaaauaagacagaaacgaagaucauagagucuuucucccuaaaucuacuggucuaaaacagaauuuuccauucuuaauguguggagaaauuacuauaauaaagaaugauuucuaauaguagaaguguaucucuuuaaaccuaugaccaaaauaucacauauucaauguucauaaagaugacugucuaaagguauaauauuuaaggcauuuuaagucagaucuauucccaaagggcauccuaaacaucaaucuacauggagguuguuguaaucuuuccucucuagggggaacaauaagucaaacuaaguagucuagucaaaguaaauaauaaaagccaacacugauugagcaucuauuauguaccaagaauuguucuaagggcauugcagguaugauuucauucaaucuucacuguagucuuucaagguaaguauacuuauuaucuucauuuuacaaauuaggaaaugaaggcacagaaaggcuaagcugcuuucucaacaucacuccaugcauaaguagagucagaauuugaacucaggcaaacucauccuguuguacuuauaucuauccacuaggcuguacuaccucauagguaaaggaaaugcaagggcacugaguuuaaaauguaaaaagaaaaaaacuaggcauaaaagccucugcuaucuuuguaaggacaaaagaauggacugagauuccauauuuagaguuggcaugcauaauaauucccagaaccauauguuucuaaugaccugaucauugggucuuucauuucugaucauuugacauuuuuaagcaugaaucaucuaaugaaaaaauuacaggguuucuuuugaacacacuguuuauuugucaccaagagaucucagauauacuuuaaacaaauuucuucuauaaaggaaagacuacauacccucaugaauggcauaauccaaaaauagaaauuauuuaaaacagcucuaacaccuuuucuaaauuuccuacauugugaaaugacagcagugucucccuuucaacacugccuucuagucaauguaaaaagaaauaaaccauccccacaugcucauauuugguguuuacuuuuccaucagucaucuaaaaugggacacaggaaaagggaugugucugucucuguuagaaagagaagaaaagugaaggaaaaagaaucuaaugcaacaagagaguugccagauuuggaacugauugaaagaguuuugugucaccaaacauuuuucaaagaccuaucaaucugcaacucuuuuuauaaaccaaccuguaaugagugguguuuccacacauuuucuucacacaguugcuucugaguuuggcagugccuuugauuugaaaaagaauuucaaacuuuagaugaucacacagaaccuuuuuggcaucauggaaaagaauauuuagaucauaaagacuuaaaggaauguaagcuagaguuccaaguaguuuaaacuuucauuacaaagauacugaaagccacauugcugugcuuacaauaaguauguuuauaagcgaugccauuuguaacucuaauuaaaugagaacugaaaaaaaaguaagaaagaaaaguauggcuuaaaaaauuaguauuaagugaaaaauuccaccauauaucaaauagcaagauagacccgaacaucaucauaauguuuuuauucacaucuucuggcaucaagggaaaaccaccuuggaaaaaccaacaaauccuuaaaauaacagaaaagugccagcacuaacagugguauacuuaggacucucuggaaaaauucgaagaaaguagaauaaugaaauuugucaccugcugacugguuucugcugcuuccaaaaacaaagagcacagcagacuagguucagaaugugcagacagaagaggaggauucuuaacuguaaagugauugacuccauuauaaacaaaaauuuucccccaaccaaucccucccaaaccacugguucucaacguuugaucccaaacagcagcaucaacgucacugggaacguuuagagauacacauucucaagccccaaccaagaccaacugaauaagaaacucugggagugagguccaguaaucuguguuuuaauaaacccuaaagauuauuuuaaugcauauuaaaguaugaaguacauugccuuaaaugucacagcacgaucaguaacaaguagagaaguccuugaaacugugaauccugauggugaaaacaguuaacagcuauugagggcuaacugagcaaagcauucuucauggcauauuacuuauauucuccuacuuaauccuuauggcaacccuauauauaccaagucaaugcaacucauucguuugacagggcacaaugaaaagaauuaacaaagaaaaaacaaugcuauuaugagaagagugaauuuccugaaugcacaucuaucaauggcaacagaggcaaaaacccuaggaagccucaaaagaggauuuuugcauaccuuuaaagcaacauuuaacaguaaaaaucuucauaaaacuuuuccugaaagacugacagguaacuguauauucaugagucaacuucugaauuaguuccauucuugggagcuggagugaguccagcgaggcagaugcacuuaauagccuuggagacaagauggauggcagauagugcagccagauuguccccaagucugaccagcacauaacgcaaacaccgucuucugcaccucugcucccuuauguaauuaauggauauccuugaugucagugcacagaaagcauaaaagaguucaaaauauaaaacaugauugugucuaaguauuuaaaugacagcuaaaccagaaaaucaguaucaagcacuucuuuuugaucccuuuauuuaguucuauaacucuaucacuucuuuuucaguaacccaggcuuaaaacccuuaugcuuguuaaguauucauauuuucucucucucucauccaagaaaucaccggaucguaaaguuauuauguucagauucuucuaaaugucacuuucuuuccauuccaacuuccuucacacuaucucaggcccucacccucucauccuagauuacugaacaaucucuuaauccuuuuccuuuauacuucucaugacaccacugucaaauacagacacuuuccucacaauguuuucuugcacaaaacccaucaauacuucauuacugacaggguccaaacuccuaagacauaaauauaaacaucuucacagcuuggcuacaacuuuaucuccggcucuuuccuuaugugaacccuacacuccaaucacaguucuauauucacuaucuuaaaaacaugucacgaauguucauuccaguaacucuucuucaucccucuccaaaucuuuggacaaacagugauugaugcaaaaugccaacgugagaauaggcauuaaagcagagaauaaauuaaagcuugcuuacucuccaggauuuaauuauagaucagugccucuaauuucauuauucuguuauauugaauuuacaacuguuaggacaaaauaaugaauguuuaacaguuuaacaaaggucuuugcuuaaccuguauagaagcauuugaauuaaauauugagcuagugcuauuccagaagccaaagauaaacauauuaaugaaggaaaaaggcuucugccccagaggcucacaguguaggggugaaguacacaugccccuccacucucuaccacaccaccaccuuggucauccuuccugggacacagccacaaaucauugcugaaagaauaggaauuccucuuugcauuuaugaaacagcccuccaacuaccaaagcuucucaauugaauccuucaaauguaacuauuaaaaaacuacggaagccaauaaugugacaauauccuacaaauagaacuaaucccauagaaaucugaacuaaucccuuaaaauuucugaaagaaacagaaagaaauuuuaacagaauucuuauaauuauaaucaauaaagcugaagaaauacagcauucccuuaaaaacaauguucagaaaaaagcaaagaagaagaggaggaagaacagaaagaauuggagggagacaaauaauuaacauuucuggaaauuaaaagcauuguggucaaauguuuuuaaaaauaaauacacgagcaaacuagcaagauggaugagaauaaagauucaauuaaugauuuggaagaucauaagaaaucacuuaggacuaaaaguagguccuagcaaacacaagauguccuagcaaaaagacaucagauauauggcauauuuaaaaaacaggcauucuuugccaacaaucugauguccagcaaaacauuugggaaauuauuaaaauaaauaugaguuuacuaagccaguuggaaacaauaucaacauauaaaaucaguagcuagcaaucacaaauuagaaaauaaaacucuuaaagaucucauucggaaaacaaauaauacuaauaaacuaacuaaggacaaggguaaaguaaaugugcaaaacauuuuuuuuaacugccaaccuuaccauaaacguaagaaggcuuaaauccuagagaaauaccaugcuacuauagaaagauucaauauuaugaaacuauaaauuugcccccaaauuaaucuaugaauuagaugaaauccucucaugugauucuaaaaucuauauauaauagauccaugaaaucagcaagaacauuuguuuuaaaagaaaaaaauugagagaaaauuuggccuacuacuguacuauguagccacaguaguuaaaaacuagcaagaaauuacuccagaaauauauagacugguuaguaaacagaacaaaaaguccagcaaacaauccaugcaugcaugggauuuaucuugauaaugauuuucuccuuuacuaggauucucagagcucuuuuucaacuaggccauaagccaaggaaugugggcaguuuuuagaagguggaaaaggcaaagaaguagauccuccccuagaaccuucaaugggaccuuaacauugucaacaucaugauuuuagcccggugagaccuauuuuagacuucagauauccagaacuagaauaaauuuguguuaguuuaagccacuauguggaaguuuuuucuagcaaucauagaaaacuaauaaaaucagacacucaucagguuauaaaaauacuaagauauccucuugccuuugacaucauagucuuuuccauggagaaaacagguacauuuacauauuaaaauucuuaagauagauauuaaaugucaagccauaagacuuucuaauuauuugaauuauacauaauuucauuguaucugcugauagucuggcuucauaaaucuuuagauaucauaaaugccugcauguuagauaaaauucauuugggggauuuugauauaagaaauaauaauauccacuaauauccaauaauaucauauaaaaaagaauaauauccaccaauauucuugguugaaagggacuuaccacuuuucccuaaauaucucagucuuugcuauaaggacuuucuucaugucuuucuuaauuccauugacacuaucguaaaauuaccuguuaauaauauaugaaucaaaagggauauucacuucccauauuuugucagcuucauucaauaauuuggcaaacauuaauuacauauuauaaagcuuuuaugcauaaaauguauuuuuuguaacagacugaauucuaaaauuuuuuggaaaguuagcaaaauauuugucaguugaaauuucuuaagagccucaccuauaauagcagcgugaaacccucaacaagaggcagaaaaugacuugucaauaugcacaugggacaaacauuuuguauuauaucugcaauuuguggguuauucguauagcaacugcaaacaggucuacucaacaguuaaaacuaagaggaaaaagaagaacucagucuagcuacugccuggauggaaaaucuaaaauauuuaugagauguuuuccuuuauuauacauuacauauuuccuacaaaauuuuuucuccaaauuaacauuucuuucuugcacauucaauaucaggaugggucaagugaggagacagaaaacacaucguuucucuuuucagggauaguaugauagaauaauuuaguaaaaaaauuaaguuguuaaccagguaacuguaaggauaaaaagagaacucuaagauauuacaaugguagcaacuaguguaaguaguuaucaccccuauggcuggggauaaacaauggaaaacauuagaauuaauaacuuagaaacuuagagaaagggcuuuugaagcuaaaacucagaccucucuaaggaggacggguugcccaguuagaguugguuucucugagacaguacauuuugaaauuaauuugcaaguguuagagaaacuacaaguuugaauuaguugcugguacaugaaagaacugcugcugccaaggugaacaaguguuacuagggugaugacuauuggaaccauagacaaaaugaaguccaugaacagaaagcagaaaaacagaaaaggggaagucuuuucauccucuuccuaccuugccaauucccucuaaugucucuucucuguaaaauucaaacaugaagucagguugcaaagcagaaaugugguuuauagaaucccagguccaacaucacaaaacagaauauagaagaguaaauauccagccgagaaacaacuuaguaguugguauagcuuuggugaacucacaucuaaauauauucuuucauauaauaccagcaccaccaaucuauguuuccacuuaacaaagaugcaacuauuauuagcgcaaaugaagacacuaucucuucaaagugaguagacacaaaaucccagcaaucauaguauucaucccuauacuacauuauuccccaauuucagacacugucucauuugaauuuucuuaccuaguacuacaugaaaaguuaaucucuaaaaaaaauaaaaugagaaaaaaacgaagagauauaaaagaauaaaauaggcauagcugcuacagucuuuauuuaugcaaccguucaugaggcugucacuacuguuuauaacuuccuucuuucacuauucccuguuucuccuaacaucagccaagacuucacuggucaguaaccuaugccuucuuucuugaagugucugaauccuuacuacuauuuaacacggaaguacuaagagacuuccaagagaacgcccugccuccauuguguagcccaauuuuccauuagaaagggaaaauuauaaucauguggaaaggugaaggcagagccagcacuucacaugacuggagcaggagcaagaaagauaggcagggaaagcacuguacuacacauuuaaaaaaauaaaacaaaaaacacaucuugugagaacucacucacuaucaugagaacagcaucacacggggauggcacuaaaccauuaaugugaauccgcccccaugagccaaucaccucccaccaggccccauuuacaacaccggggauucaaacugaacaugagguuuagcuggggacacagauccaaaccauaucacugacaauaucuaguuuuccuuuuaucauauuuccuauaaucuaguguuuucaccuguauuccccaguguaugagaauuacagguauuuuaaauccuuuaaccacauuugcaauaaaauuauuuacuaguuuugaguugaaauauuauuuuagaaacaauauuagaaaguauaccugacaaucugaaggauaaauacaagaaaauguguccccuuuaaauaucuccauucuuuguucugccaccuaaauugcagcaauaaacacguccuucagacacucuacagaggcacauggaugugcugccaauuuauuauuuuuuuaauugaaaugcuuauucaagucauuuuaccugggucacuuguguccaugaaccagaaguauaacagaagugagaagacagaguggcaaaucucucaccucgaaugugguuugucaaggccaagaaauuguacuuuucuuccuccuauuguagcaaaugccuugaaagagugcuaauuguacagagugcuacaaccuguguuguagcauucugugggcuccucugaagguagaaguuucgcuuaaaauauaaugacuaauacauuaacagaguucuuucauauccauuauuucucuugauguuaagauaaccuugggagauagauauuugcaccacuucauaaaccaugaagcuaagcuucacgggcagacuuacucuagauuacaguacuaaaagccagauuuucugaccaaaacucuuagaaaaccacaaaaaccccuccaaaguuuaauagacaccagaauuuauuuaaccugucccaucuuuagcuuuucuaauaauauucaaugcuauuuguugaaaacuaucaaaauucuaguauuguaaggauaccauguguccuuuuaguguuuuguuuuuauuccguuugucuaagaaacuugguauuaguauguccuaaguaugaauugauggucaacucuuaagucggauuuuucuuucugucuguaauaaguaaagccaguuucccauugucuauuuccauagucuuucaaacuuugaauuuagaagcuauccaccuucuuuuuaaaauaguccaaauuccaaagcauaauaugauauaacagaaccacuugcuauugguaacucuaucauuuacucaguaucuggaauaaaugagcaguugaaaugagugcuucaacaaauuugagucuguuggacaccuuucuaaauuaucuauuuuauuaucuaucugaauuauccuaauucuccauuagaguuucacacugaaucugucuuugcaauauagguuucuccuacuggaaggaaaaguaauuuuuauuaauuauuaacuuaauauaagauuucuuuguuuguaauugugagcuaauaaaauauaucaacagcuugucuuaucuuuuauacauuggcccauuaaaauguuuauuauacuuucuauucuccuggcaauuuauuucagagauuuaauucagacauauaaugucaaaauuuucucaauccuuucucuucuuggcgccaagaauuuucugugucuacugaacauacagcauucugugccaucucuuaugcaguguuguuucacugaauauuuuauuuauuaaaauuauuuauuuagaaauaauugcagacacacagaagaguugaaaacauacuacaaaggguuccuauguacucuagcuagcuuccucuaaugcaagcaucucacauaaccaugguacaauugccaaaacuaagaaacucauauuggcaaaaugcuauuaacuaaacuaaagacuuuauucagauuccacccuguuuuacuaauguccuuauccuguaccaggaucuaacucaggaucacauuuggaauuuaguucauucuaggacaguuacucagucuuuccuugucauucauggagauggcauuugugaacagauauuuuauggaaugcacuucaauuuguuuguccgauguuuucucacgauuagauugagguuauggacuuuuggagauacuaucgcaaaaguggugugcccuuuguugcaaauuauauccaggaauacaugauauuggugucuuauuucuggagaaguuaccaagcacacagaguuaaggugcauuuguuaacuggaaaacuuuuauaaagaaaacuuauuauauucccuuauucccuaauuuauuuauuuaagcauuuauuauaucaugaauauuuauuuuauucuuuugaguuguaacucaaauaauucuggucuauuuauugucauuuggauuaucuuuugugaaauuugaucuaacuuuggccauugggaguucuuuuugguuagcuccuauauauuuuugacuuuucuggcaccacuagacuuucagacauauuuuagaugguuuccuguacccacccuggaaucaaccacuacucuaagaagcucugauacuuuuaaauaggaaaagaauauuuggaaaacaagaucugggagcuacauaaguuccugacaucugggauacaacugcuucuagaacaucauauauaugaauacuaauuaaugcaugcauaacauaucuauauuuauuucugcaucuaaguaucuguuugcauuuuaaaaacaacaucugaguugacauugguucauucuauuauucccacuugguuuauuaaugacaucuuucuacaacauaaguaaucuggcuuucauuaucuaaaauauauuugcuuauguguucaaaccuaguauacagauaaaauagucucauaacuguuagcccauacccauuugaaaaacaaauuuaccaauuggaagacauuguuuggauguaauaaucauugugcuuggccuuacaggcucuggucaaaauaacugguuucaaggcuacugcaaucagcucuuucuucccuacccauuucaguguggucauucauuugucacauucuggauuccaucuuggguucucuugguaucccgguugauuuuuucuucauauauauacuauuuauacuguaggcuugagugaauuuugauaagugcauaaaguucuguguccaccaccacaguaccauauagaagaguucaaucucccgccaaauucucuugugcuacccuucuguaaucaccgccuaccuccauucucaagcaucagcaaccacuauucuguuuucugacuccauaguuuuuccuuucagauaaugguguauaauuggaauuauauaauaugcauccuuuuguggcuggcuucuuucauacagcaauauagauuuaagaucuaccgggauggguagaagggguggcaacuuccagaaugacagcaugaggaccuucauggaccaacuacucuacagcaaaucaaccauaaguggugaaaaucauuauuaaaaacaacauguaacacuucuauaaaucauccucagagcauacagcaaagaaagacaugcuuagagagguaaaaucugcuaaauuucaauaagaacaucaauacuaggcccaaauaucacacuuaacagauaaaaucuucaaaacagucauuauaaauauguucagacagcuaaaggaaaccaacacccuuuuaugauaaaaacacucaacaacucaaaauacagaggaaccuucuaacccugauaaaagguacccaugaaaagaacacaguaaacuuuauucuuaauggugaaagauugaacgcuuuguuucuuaaaucagaaacaagacaaggauauuugcucucaccaaugcuauuuaacauucuacuggagguccuauccagggagaucaagaaagaaaaagauaagaaaagaaaagaaaaagacaagaaaagaaagucauccagauuggauaggaagauaacaugagcuuacauuuaaaaaauccuaaggaauucacaucgaaaaaaaaaaaaaugcuacuggaacuaauaagugaguuuagcaugauagaaagauacaagauuaaccuacaaaauuaauuuaauuucuauguaacagcaauuaaaauaaaaaauucaaaaaugaaauuaagaaauaaauuucauuuacaauaguaucaaaaagaaaaaauuacucagguauaaauuuaacuaaagaagugaaagacuuacuuacuaaaaauugcaaaacauuuuuggaagcaauuaaagaagacauaaauaaauggaaaaacauaucaccuucaucgaucagaagacuuaauuaauauugacaagacaucaguaugaacgaaaauugcauauucaaugcaauuccuaacaaaaucccagcuggauucuuacaagaaauugccaagguuuuccaaaaauucauguggaaauggaaggggccuagaaaaaaacaaaacaaucuugaaaaagaagaaaaaugagguacagacacuucuucauuucaaaacuuaacaacagagcuacaguaaucaagacagagugguaugggcaaaaggauagauauauaaauuaaugaaacaaaauaaacccucacauuuauagugaauugguuuucaacaagggugccagaacaauuuaauggggaaagagcagucuuuguaauaacuggugcugugccaacugguuacucacgugcaaaagaaugaaauuagacuccuaccucauacccuauacaaaaaaaagacucaaaauggacuagagacuugacuguaaaugguaaaaccauuaaauuauuagaauaaaacauauuccuaaaucuucauguccucagauuaggcaauaguuucuuggauaugauaccaaaagcacaaguaauaauguuuuuaaaaauggguaauuagugcuucaucaaaacuaaaaacuuuugugugucaaagaauacaaucaagaaaaugaaaagaaaacuuacagaauggaagauaauauuugcaagacauuuuuccagaugcucucaagaacucuuauaacucaauaauaauagacaaauaaccaaauuuuuaaaaggacaaaagauuugaauagacuuuuuuucaaagcagacaacgcgucaauaauaccuuaaaagauuuucaacaucauugucauuaguguaaugcaaauaaaaacuacagugagauacaacuucauauacaccaguauggcuauauuaaaaagaaaugaaaagaagaaagaagaaagggaagaaggaagagagggauggaaaaaaauaaagaaguguuggcaaaguuaugaagaaauucaaagccucacacauugcugguggauuuggaaaauggcgcagccacguuggaaaauauuuuggccaugguuuaaaauguucaacauagaguuaucauaugccccaguaauuccacucuuagguacauacucagaacauuggaaaaccauaugcucauacaaaagacuacaugaauuuacauagacauacuauucauaguagcccaaauuuggauacaauacaaaugccuauaacagauaaauggcugaguaaaaugugguauacccacacaacagaauauuauucagccauauaaaggaaugaaguacugauacaugcuacaacauggaagaacacugaaaacauuguucuaagucaaagaagacacucauaaaaguacacauuuucaauaauucuguuuacauaaaauguucagaauaggcaaauucauaaaaacagaaaguagauuagguuaccagcgauaaggggagggaagaagggugcgacugccaaugguguuucuuuuagcaguuaugaaaauguccugaaauuagaugguggugaugguuacacaauucugugaaugugcuaaaauccguggauuaucuacuuuaauaaaaagguaauuuuacaguaugugaauaccccaauaaagcuguuuuuguaaaaaggucacauaguguaugauuccauucauauaacauccuugaauugauacaauuauaaagcuggaagacaaauuaaugauggccguggaucaggaaugaggguggguguggguguggcucucaagggguagcaugaaggagaucuuugcccugauggaacagcuccguguuuugauuguggucaugguuacagaaaucuacacauguauuaaaaugacauacaacucuauauacacacacauuguaacuaugccagauuccuuguuuugcuguuauacuauaauuauauaagauguaauuauugagggaaaucaagugagaaguccacgagaccucucuaaccacuuucaggauauucugugaaucaaauuauuucacauuuaaaaauaaaaacauguuuuuaaaaauaacuuccauggucuuuaaaucucaucuuuaucaucaauauccugauuauuaauuuggcucuccaugaguuccuuaauaccugaaaaguaugccgugguaaagagacgucauguguugcuggcuuugaagcaaaucucucaucgcaaauacauagcuugccuuuuuuuuuuuuuuuuuuuuuuuuuugagacggaguuucgcucuuguugcccaggccgcagugcaauggcacgaucucggcucacugcaaccuccgccucccggguucaugcuauucuccugccucagccuccaaaguagcuaagacuacagucaugugccaccacacacggcuaauuuuuugucuuuuuaauagacauggaguuucaccauguuggucagguuggucuugaacuccugaccucagaugauccagccuccucggccucucaaagugcugggauuacaggcaugagcccccacgccuggccuuagcuuggcauuuuuguuuguuaauaaaucucauauuuuucuguaaaauaguaaguuaaauugugauucuuuuccccuggugcuuagcauaaugccuugcacagcuggcacucaugaaauauuugauaauaaaugaagucugaaucuucaggucucagaaaacaaacugagcuguggugacucuacaucaggacugugaagcccagccuaaaggaaacaucaacgucaauuuaaggcaucuucuuuucuaugcauaaguuucugagucacugaaaaaaaaaacaguccauauuuaauuguacuuguacuaaaguuugcauaaaaauacuucccugaugccgggcacggugacucacaccuguaaucccagcacuuugggaggccgaggcgggcggaucacgaggucaggagaucgagaccauccuggcuaacacagugaaauccugucuacacuaaaaauacaaaaaaauuagccgggcaugguggcaggugacuguagucccagcuacucaggaggcugaggcaggagaauggccuaaacccaggagacagaguuugcagugagccgagaucgcgccaccgcacuccagcccaggugacagaccaagacucugucuccaaaaaaaaaaaaaaaaaaaaaaauacuucccugagcuuaaagaucacacaguaagcauuaucucuaggagaauccccuaauuuaaauaaguccuaauuauagcucauaaauaucuucaggacgaaggucacuuuuucaaagccaugaugucauugagugccuguguaagaggaugguagaguauaaaagagcaucuugccuuacuguguuugcuccuguacaagaguaucccugagguuagguagguccuggcuucccccuacuuuagugacaauuugagaauaagugaaauggagcucucaggaaauaggaacugaaucuuaucacagaacgccucuuuaaaacaaguuuuaugauccuaaauggccaaaaacagagcucagagcagguuagcuuagcccaguuguaguucaauauagcuccccaagaugcccacacauauccauauacuaaaguagcugauuucugguaaccugaagcacaguauagcuuuuacagggcucauucauuggucauccauagcuugauuauuaucagaauuugaguuuaccagaagcugaggcccagaguucugacuaacaggguauaagacaaagguugaacaguuauggugggcaagaucccaaaaaaucacacgauguaugauuuuugguagguuguguuaaauguggcuuggaccugaagacugcuaucuucuaaacuaaagcuccaccaugggacugaucuccccuacauuugucaacuguagauguauacaggcguaucuacaucccggaucaugcugggcuccauugcccagaaggauauugauacucaggaucagcagaauccucuccugcugguaugagucuaucugcuccacuuccaguagcuggcaucauaguauauggugcuacaauuugaauauagaucaaacuccccaacauggcauacaggcauuccaaaacugacucuuagauuccccauucucaucucacuaucucucaucugcacucuauccucuggccaugcauacaaccugaguuucucauauuuccccagcaguuucacacuuaccauuucuaugccaguuacuacuucugccuaaaguaccuaccccuucaccacauuuuccacauuuuccagcaaacaucuuaccaucuuaaaaaaaaaauuuccaucauuuuaaaguucuuuaugcauguacuaucucacucguauaugaaauaaaugaaauauaaaucauuaaaauaaauaaauauuuaaagaaaacugaggcauauagaaguugaguaaugcccaaagucacccacugaguaaacgacagagcccaaagaaaaagccaggucugucuaacuguguaaaacauguacacagccacagcacucuaucuaaaguauucugugguucuagaauggaauccuugcagaaucuuuuaaaaauucagauauccauaacuccaucuuaaacuuguguuucuucuugcuggagcucugggauauguauauugggaaaguuucccaggugacacugaggcacaauguauuugagaaccuccaccucaugauauagaaggucuuagaacaaguauugacacuucaguguaccacuaggaauuggacagcaucugaaaccaauuuuggugauacaccauuuuucaaaaaaguuaaaugagacaugucuauuuugcaaaacugagaaucuguagagaaguacuuccaggaguaacugcauucugguaacauuuaauuacauuuuguaaauuagcaaaaaucuguuuuguaaagaaaaaugaauuuaaauuaucuuucauuuaaauucuugacaagggaucaacuacaauuguguggagaauagauuugauuugaacauuugauugaguguguagcugucuuagugguccucaggcaucaaaaauaaaaucucaaguaugaugaagaaauauuaauaauauuucaggcuuuauacuacucauucuuucauguuuuuggaacaagaaaaggaggauuauuguaaucaauaagugugaaaugagacaaaaaugaaaaccauggcauauauagggcucccccuuugccauuauacgcuuuaacauuuuuuaaaaauucaaggcucuuugucuuugcauuuauguaaugugagauauuugaaaugaaauuuguuuuguguuauuuuugcuuuuuauuuaaaauaaauucagacuugcaaaaaaguuguaaagugaaguuuucacauacucccaucucaacuucuacuauuaacaucuuaccuaaucaugguaaaauuaucaaaaccaaaaaauuaaaauggauacagggcuauuaacuaaccugcagacuuaguuugaauuuugucaagugacccaguaauguucucuucucuggguuaggaggcaaucuaggaucccacacagcauacaagugucaugucguucagccuucuccagucugaaacuguucuucaggcuuugucuuccauaaccuugaugcuucugaagaauacuggucagcuuagggacaauggucccuaaguuuaaguuggccagauguuuucccacaauuagauugaagccaugcauuucgggcaggaaauugagauuauacaugauaccaagggguacaugauauggaaguucgcucucgggauguaugaugacuugguuaagcugaugucuauaagauucuuccacaguaagguuauuacuuuuuccucuguaaugacgaugauggaaaaauacuaugucuaacugugaaaacuauguacacagcaacagcacucuaucuaaaauauucuguaguucuagaaugaaauccuugcagaaucuuuuaaaacuucagauaucccuaacuccauccuaaaccuguguuuucucuuccuggagcucuggaaucuguauauuggaaaaguuucccaggugacucugaggcauccaccaaugguccuuuuucccacaacaauuauuacugugguguuuaccuaaggguaaccuucuauuucucuucugccuucuaaguuuauuaauugaaauucuacauuucacauuuauuuauuuauuuauucaaccauuuacuuauuuuuguacgaccucaugaauacuuauuuuauuccgaaaaguauaauccauuaauauaauuuuguaacaaaaauggucccaaaguggcuguugaaaacgcuuaacguugccucuuuguacuucugucauguuccuaucauuuugugaaaacuuccuuacuuaauagaaccacaagacguuccaggauuauauuauauuugagguaaaguaugggacagauuauuuaguacugcucagauaccaaaaaacaagauuucuuuuuccucccucaccccgaccaaugcagacucugauacuuuaucucucuuucugaaaauucugguuucccucacacuccaaaacacuguguuuaccagagaacacggaauaagugcuagauaacuaucaaaugccuuauauagaaaaaugauauuuaaggaaaguaguuuaagaacaagcuaaccauucauuccucuauaucagauuuucucugucuuuucaacaaaaucauuuuauuuuaauaaaaaaacagaauuauauauguaauuaaaaagcaauacaguauuauuaaauauaucuauauacauuuccaaaacuauaacauucgcuuaccuuauaaucaauauaauaaauaauguuuuauaauucugguuauuuauuauuuuauacaauauauuuccauagcuugaauuauauauacuaugaaaauucaaauucccaugaauaaguacuuacaaaauaucuaaacuuuuagagcacuucaacuuaacaacuaugucaggauuuucuucaagcaaaugaucaaaaaacuuuuuucaaaaauaguaagaaaauguugcuuuaaaguuggaacauucagguugcggguacaauggagcaauaacucuacaccaucucucccacugaacacagcucuaaauccuggacagaauacaaggagcagcuauuugaggauucaaaaguaaauagcagcagauggacugaggaagaagaacagaauucaaauaccagcaaacaagugguaacaugauuaacuuuuuuacuccuguauccccuggucugaacucaacacacaacaaacaaagaagugagcccugaaaagcagacggaaagaaaaagcccaggagaagccuuuuaguucuggcuuauaggaaagggaaugcaaaacacucagagagaauguaaaaaaaacccucaauuaaaaaaaaauuauuuuguucauuugccuacccgcuggacuucaggcaauccucugcugacaaugguaacagcagcagugacaaaagagggaaugggagugaacaaaagacaaaacccuaagaaaggaaacauuccucuagguuuaaagaaaugacaguuuccaaaggguacagccaaauaccauuggucuuuuucccuuugugaucuccugccacauagccccaaagacaguguggcugcggaagugcacaguagauuaggguaaugaaagucauaguauuuuggccaaaggaccaaaaaaaagguaucccuaaaaacuggaaauaaccagggagaucaugagagaaaaacuugagaauaugacuguauaaaguugcuuaugaaucacauaguuuauaccagaauaauuucuggcaaucuacuuaugccaauuccuaagcccuaugaaagauacuagaaaucaacggacuuuguuaguccagaaacauaaauuuuaacaaagcuccaggaugauucuggcccauguguucuuugggagauuacuccaaacacacuacuguaaaacguccacacuuuucuuucaaaaaaaaaagcgagauaggagaucacagcuagcaaggucagggcaaggaggcugaacaccacagcagggcacagucagacauucuugaggguguaggaaauaacuggaaagagaauaagcaccaagcucagaguaaaauaaauuuagcacauuuauucugauaggguaaagauacauuuggguuaucuuggaaagaggcaggguaaagugugcaggacaggacuuuugaaauauacccucuucuuagcaaaacagcaauuuuucuggugaaaauuuuuuuuuuaaacugaaauucucuggaaauuacuguaggucauauggcaaaugaaaaaacauucauucaagagaaucaacuaaaucuuaguaagaauggugaggguccauggcauuugagccauggcuuauuccauuaaccuccaccaucacuaccaagcucuacaccucugcauuacaaaagcuuuaaccgaggcagucuacuccaggcaggugcagccaagauaaggagggcuuccucuccaccuaccuucuacucuaggacuauggcuuuaccccaugaggagcaggcugcuguguuuuucacuucucauagccugugcugcagaagcuauauucuaggcagacauagcaaaaaugacauggucugccuucccccaucccauccccacacauaggguggaagcucuaccuuaggcacggcaggccaaggcaccgggguucuuguugccccuguuacagcuuaauuguagguaaaacgauccacugcagaaggaccaagccaaaaagacuaagggcacucaccaccaccacuucuaguucucacucuuagagcaggaauguuacucaggaaaaguggaacuuaccccagaagucugguacaguggcaacaagguuuuggccuggcagaaagguaggucauaaggaugaagaguucuccagcucugccugaggaggcuauccuuacguggaagagagaguggagagcucuaagucuaagggcauuguugaaaacaauacagguuuuucuggggagcaauuaagagaaagauguuagcuucaugauacuagcaaaacagcagacaagcaaguuuaauagaaucaagaaaagagacaaucaagaugagcccuucugagaucacaggcaacucuguaugcaagaaaggauguacacauauguucggcuuuaccaagaagggguaaucaaagcacaauuuggggccagaccugaaaguauucaucagguugcauccugacccacccaaaacgcaguagccucacuggcacgagguacuuaaacucuaaccaaacacugagugaacaguaagcugcucugacccaagggcaaugccuagaaagcuaggcuucaaaaucacacucauccauggaagucugggcaacuauguccauaucuaaaggcuggguccucucagaagcaauggcagagggaaucuucacauuaccagaccccggcugaauguggauggguagcagggguaggggggugaguaaacuaccuuaacugugauagcagucucuaagucaagcacacacauccaacgguaaaggauaaaaaauauaacuggcuaagaacaaccuuugaucaauuaguagcuuauaacauaugaagagugaccccuagaggucaagauuaaaaucuccuaccccaagguggcagauaaaaacaauuggaaagacucagagcugggaccucaaaagcuaugcacuguagaaaagguggguggcgaggaacauuucgcagaacugguugggcaaaguuaacgucauuugaacuagugagcaacaaacaaaacaaccuuaaaggucggggaggggagaucuaaaguguucaguuaacaacaaaaaauuaugagacacacaaagcacaguaaagugugaccaacauacagaaagaagaaagcuggcaacagaaacuuccuuugaagagauccugaugguagacuuaggagaaaaaaaaacuucaaaucagcuguuauaaauaugcucaaagaacaaaagaaaaccaugccuaaagaaguaaaggaagguauguugacacugucuccuaaaggagauaauaucaauaaggagguagaaauuauucaaguuauuaaaacgaaccaaauauaaguucuggaguccaaaaguacaauaacugaaaugaaaaauuuacuugagggguucaaccauaaauuugaacuggcaguaggaagaaucagcaaacuuauaagauagauuaauagagauaagcaauaugcagaacacagacaaaaaagauuggagaaaaauaaacagagccuuagagaaauaugaaacauaauaaaauagaagaacauaaguauaauggaaguacuagaagaaagaagaauuuuuaaaaaucaaagaaaaaaauggcugaaaacuauucagauuuuaugaaaaacauccaagaaccucaaugaacucaaacacaucaauuguauaaacaauacguccaagaagcugaaugaacucaaaguagauuaacuguuaauagaaccacaaacauccagacauaucauaccaaaaauguucaaagacagaggaaaucuuucguccuugaacagaggagcaaaauaaaaaugauacauuacacucaagggaaucuaguaagauuaccacauuacuuauuaucaaacacaauggaagucagaaggcaguggaaugacauauucaaaguguucagaggaagaaacugucuaacaagaaucauacccagcaaaauauuuuucaaaaaagauggcaaacuaaaggcaaucucagaucaaaaaaacguggaaaaaaauucacauugcuaauagacuuacauuaaaaugaacaccaaagaaaaucuuuuagggugaaaguaacuaauaucaucaacacacugaauccaugcacacauaaaaaagagagcaccaguaaaaguaaucauguaugcaauuucacaaaacaauacaguugaauauuucuucucuugauugauuuaaaaagcaauuucaauaaacaauauguauauaaauguauuguuaggccuuuaacauauauaaauguaacauauuugacaauaauuacacaaucauugugaguaagagcaaaaagcuauauggaaauaagaaaaagauaccauuuaauaacucaaaucaauagcaagaaacuaagaauaagauaggguuaacaaaaagauuacuauaacaaauauuaucaauauagacuugcucuuauuucuuucaccagcuuccauaaaagauuuaacauuauaugacauaauauuaaauaaaucuaauacuauaagaguauauuguugaguuuuuaauauacauagauguguuucauauguauauaugcacacacauacaaaaaggaaguguguagcagaaaacauuguuuuguuguaauuaaaucaguacaaaacugaagucaauuucgguaaauugagaugcauauuacaaggcuuagauaaaacaauaagaaaacucaaagauauuacuuuaaaaauucuuaagggaauuaaaauuguaugcuagaaaauaccagcuuaguacaaaagaaggcaauaaaguggcagcagagggguaaaaaagacauaagacacauagaaaacauaaagcaaaauggcagauguaaaugcaaccuaucaaucaaaacauuacgaauggcuugaauaaccuaaucaaaagguagauauuuucagauugaauuaaagaaaaaaaacaggauccaccuaucuaccaucuacaugagacauacuuuagaaucaaaguuacaaacagguuggaaauaaaaggauguauaauauaaucaaccaccaugaaagagaauagaguggcuacacuaauaucagaaaauagauauuaaaacaaaaauguuacuagaauuagagauaccuucauacugguaagacagacaaagggaccaaauagacaucuacaaaauauuccaacagaauacaaauucuuccaaaaauacaugaaauauucuacaaaauggauuauaugcuaggacauaacaagacucaaugaauauaaaagagcugaaaucacacaaaguauguuuucaaacacaaugagugauaucagaaauuaacauuagaaaguuugggaaauacauaacaguggauacuaaauaagacauuccuaaaucaucaagaauuuauaaauaaucucuuuauauuaauggugaauugauuuugagcaagauuaauugacaugaaaauucacuagaaaauaaaagucuuuucaacaaugguaccgagacaacuggaucuaggccgggcacgguggcucacaccuguuaccccagcacucugggaggcuaaggugugcggaucauuugaggccaggaguucgagaccagccuggccaacauggugaaacccugucucugcuaaaaacacaaaaauuagcgggugugguggcacgcccuucuaauccuagcuacugggaaggcugaggcaugagaguugcuugagccugagaggcagagguugcagugagccaagauugugucagugcacuccagccaggacaacagaccaaggcacugcucaaagaaaaaaaaaaaucuauucuuggccagguacauaaucccagcacuuuggaaggcugaggcaggagcacaggcagaggccagaggcugagaccagccugggcaacauagugagaucucauuucuacaaaaaauaaacaaaauuauccaggcaguacagccugggaaacagagcaaaaccuuguuuguuuguuuguuuguuuguuuuuuaaaaaagaagaaggucuauucucccaacaaauuugaaguagaaaauacauuuuccuuaacuauagucacuauacuguacuuuaagucuccagaacuuacucauguuauaaguaccuuuauaaaugaaaaguuuuauauuugaaaguuuguacucuuugacgaacguaucuuuccauuuacgguuagcaaagcugaccuucauuuuauguuuauugauucuuuggauuuucugaguuuguacaaaguggcaucuuaugucuucugcccauuauucucuuggaaauuuuaguguuuucuauuguuucuaagagcucuuaagauauuuauguuacaacagcauucggucauauucauugcaauaacuuaauauugcucuguaacuaaacuuuguauuuuuaucauaccgauauguacuuuacagguuuucacuuuuacuaaccaaauuuaucgauuucuuuucuuucugacaucugcuauugcauugaugcuuagaaaaccuuuccuuuucuuaaaaucuaacugauuuucaugaauacuuucuuuuaauuaaaaauagucuacaguaaacucugaaaccucuauuaucugggcauaaagcauagauauaaucuuaagagaaaaguaacaguuaauuuccguuauuucaaacagaaaaugucucccuuucuccucuuauuugucaugcuauuuuuaucacaugccaaaucucuaugcauguuuuaaaguuuuucuuuauguuucauugaucuaucucuuuauuuuuugcuagccccauuauugugguuuuggaauauauuuaauuauguaugauaaugcuugcuuccuucucauuacuuauauuuaaacauacaaaauauuugcuauucucguccacauguuuuuuaugguagacuugaaaaaccacuugcuaaaaaauuucagaaaaauauucuaacaggacuuugauugcaauuauauuaaagcgauaaguaaucugggaauaauugauaccuuaacaauauucaguguuugcagccaugaaugacuacgucucuacauauauucaaaccuuuuaugucucucaaucaagguuaauauugauaguuuucuguaucuaggccucggauuuuucuuuucaacucccucaaaaaaaccaagccugaaagcccuaaaaucugacauuauuuguaugagaaaagauaguugcuaacuuauuaccuguuuucauuuuguuacuauagaaaucauuuguuugaguaaaagcuuuuccuuccaauacaaauuuaggagguugccaaaaagaaacggguaguagaaugcaugcuaauuacguacuccauauaggacuuuuaaaauacgaaauucuuaugccuucaaagcaaauacuaugaugauauuaagucuaaaauuauauguuaaauuuaguuggaggcuaacaaaugaaaauuaaaauaacuaaaaagugaggaaagcuggagaauaaagugaagaacaaacucccacauauuuuuauaauuggcuagcuugaucccgccaacauugcagccaauagccacauauggcuacugaguacaugaaaugagacuagucugcaacaagugcuauaagcauaaaaugcacaauggauuucaaagacuuagcacaacauuuaaaauguuucauuaauguucuccuuuaauuuuaauugcauuuauauuuugaauauuuuaaguuaaauaaaauauauaauuaaaauuauacauuuugcuauuaauuuaauauugaauuaauuuugcuauuuuauuuuuaaaauuugcccauuacacaauuuaaaucauaaauauggcuugcauuagauuuuuauuguaaagcacugugcuaaacugcuuucaaaaauuagcugguacuaauuacucuuuauucuggguugcaaaaugcccccaaauaguauaauucaguuuucuugauuuuaauuuuuuacacauuaaaacaauuaugucuuuggcuugcaaguucaaaguuuaguaaaagucaaugauuguacuauauauuuccacucugaaauauuauagaaguguucagaaaacauaaaguacauauguggagcuugaugaauaaacuauagcacaugcuagagaaagagcgagaaacagagaaagaauaauguuauaagacaucaaaauauauuuuauguaucaaggucacaaauaauuucaaaauuacuaaauaguaaaagcugaaacccuccauuaucuucuucuuagucauuaagaagaaauuuauuaauaauagaauaaacuaauuacaacaggcauuugaaaggauaaagaguucuggggcaaauaugcuuaagacauuuuaaauuuuuuuugucagauuuuaaacuuuuguuacaucauuaaacaagaaaaccccaaguuuuaugccuguuauuucuugcuauuagaaaugcucagagcauuuauggguaacccuucugugacacugaacacuuucuaccuuaaccuaaacugcaaaguccuugaaauuuugacagcuuuguccucuugauucauuuucuaccaucguaccauuccuugccaaauaccaaacacaagaccauacacauaguggaugucaaugaugauuuacugaaugaaggaagggaugauugaaugaaggaagggaugacugaaugaagaaaugauuaugaucuccuaugucccuguguguuauagcuuaaagacauuguguccauaaaaaauguguccaaauuuuguagguauauagaagaaaaagaacauaaaaugcccauaauguuauacuaaguccuugauucuuauucgacauuuuaacauuuccucuuaaauaauaacacaggaaguuuuuugcaauacgauaauuuucucaacucaagauaaaacuguacacuauugccucauacuuuauauauuaauaaaaaacugggagcuuaaacucuccauuuuuauuuuauuuaaucaccuacaucaaaaauacauuauuucuucaaauacuuaaaauauuacacccagggaugauaaaacaaauacacaaauaauaugauguaucuaaauuuguacaucaguugaaugugucauguauauucagagacacacauaaaauuuauguuuuuaucuccuugccugcuaggaauuauuuccagaccuacuauuuuacaucagaucuuuaccaacaguuuuccaguugcaaagaccacuguauauauguauuucccagcaguauuagaaacaagaauauaauuuugcuugacuuguauaacccucugagggcuaugaaacugcauuucaagaaauauuaacuaaugucauuugaaaggugaucuuuaaaaugcaucagaagugaguguggguguguuuguguguauguguauguguauguguuugugugugugcgugucugugugugugugugauagaaaggucuugaaaaauaacuguauuuugggggugcuucugaaguuugcuauaugaacauuggccuuuuuuaaaaaauaagaugcucagauauuuugccaaaaugugcuaaaacaaaaucacucagauaauaugagcuagucuagagauuaauaaacucuccaauuucaaaagcuuauacaaauaaugagaugaaaacagacaauuuucagccaucaaauauuucaagacuucacucuguuucuaugacauauucaucccauacaaaagauuugcuaaagggguuguaauggccuucugggacaggaagaauaagguuucuggagaaaauguuaaauuaauuuugauggugaugcaaaguuaagaaaggguuguuaagggauggcuugcugccacagggugggguuuuguuuugguauccuuuuagagccugcagguguuuggcacuaguuaaaaucagggccagcugugauauuucaauaguucugauauuuuccucccaauagaucucagaagugaugcuucagggugaugucuuacaccugauauauucgacuugugugguacaaaugugaagacucuauuaaauaacaccagguuugugacacccugugcccucucuucccuacccucaggucauggcauccaugacaaagaaaaacacuaaucagaggcuucaaucacucauaguuuuuaauugagcaguuuaaucaaagauggugauaugcuggaaucaccaaguaaaaagucuuaagcaaagccugaaagcagaauggcacauucccuuuucauucucaacguagacaaugaugcuuuuaaucccucucaguggugagauauauaccuauguuugcaggaauuugaauaguuucuauuaaaagcuguauuuucuuuuaaguguguuucaguuggaaacccucaaaccacaauguauuucaugcacauguucccaaggguauguuaaauaggaccauacugaggucaucuaguaaguuuuugaaacuuuuuaagaauuccuuuaauguacugcacaaucuuggcuugauuaaaagaagauauuuuaagaaagcacuuggaaaaaugacuggcuauuaaaaucuauaugcagauaaucuauauuauacaucuauaaugcacagagcuuuccacagauaauuugucauugagaaagacaauaaaacucccacucuaaggguuuugaauaaaaacuccucagaacuuucaguaaaugcagaccaaucccccuccaaccagccugcaguauucuugauugacuuaacaguguaugccugcaggaucacuuuaacugugcaaaggucugucacauauaaucagaggauaaaagguagacaaucucucauuuauccaugaaaaaaaaauaucaucuguuguuuugauugaaucgaaaaaucaaguuaccucaauccaugagacuaugaugaaauuguuaggcuagaaauaguuucuaccaucaaguaaauuuuuguugucuccaaguucaaaccacaaaugaaaugcuguaaauggucuacuugagaaguaggcacucaaauuuuucugccguuacugagucucccaauccuggcuuuuguuguuguuguuagacauaccccuuuucacuuuaucaaagucuccauuccuacgccauguuccaggccuuguacuucacccaaagcaauuuccaguugaacuagcagcugugcuggcacagcgcacauggagagugggccacacgcgccaguggugcguucccacaucugaacagaaguggccguuuccaugcaccaagcgccaagaaacucugcagcucaucagaggcaaaacaagggaggauaccuuaaacggaaaucauacuuagaaaaaacuuuuacggaaaaugaaaaauaaaaggauuuucaaucaucagaaaugaggaagggaacuucucuucuuggcauagauuuugcagauauauuuuuauaaaaggauaguagagugcaagcuuaacuuaaugauccccauccccaaagcuacacuggauuuuccucuauccacuacacaaagguaaguaaaagaaguuaaacaagaauauaaccuuaaagggcaccaucauaaccacagcuacuacuaggcauuggcuguuuaccauccugcaauccuugugcuguucccuucauaaacaguaucucagaugcuauuucaccauuuuacacuuaaggaaacuaaagucuagaaguuuauaauaaacugcccaccaauuuugacuccauggucuuaaccauuauguuacacugaguucccucagaucaccaaggguuuuacaaccagcccugaagauagagcuugucagccucacucaggaguacacaggaugauaguucugguggggaggauuuuaaaaaggggaggggggacugcagaggagcaacuugauuauuuggaaaacuugcacauuccagaguuaaacaacucauuaaccccuaccuuucuaauaaauaaauucaaaauggacuuaaauagcagguacacauuguguacugaguuucugcuaagucacaagcacuggauauaucauaaguuuguugaauaaaugaaugaacuaagucaucacaguuagaugucaucuggaggguuuucaaaaauaaucuguuuuacacaaauuuacacacagggcaguuuguagagacauuuguaauaguaugaaaagcuuguacguugacuuagguaauauaaauuuucuccauuuuggaaacuggcuaaugacugaaaauaugccauagaccaauaacaaaaauuuuuguaguuccagaagaauugagaugcaaagauuaaaguaauuacauugaaccacaagagaaaauuaguuauaaaaauccuaauuauccuauauucacuuugagcuagccaauaaagugaauuauuuuaagauagugggugggauuauaaaucuuuguuuaucaaagccuaaaaaauagguaguguuagaauauacuuaauauauuuuuaaauaauauaauuauuuaaaaauaacucuuugcuuuggugccuucaucucuaauaaaacacagauggagcaauagaaaugcugauggaaaaacucuuaggaaauaucuccagaaaaauguacccucaaacugagguaaacaugaaguucuacguacaccucaauacacgacagcuucaaaugauggcuuggccucacucaaaguuauaaagugagaaaaacaguccccuggucuacuauauucagaguaugcacaaugcuaccuccuuguaaagaaucaccaggcauuaauccacugaugguguggggucccuuucagaugaauucacauaguacacaccaaaugggccccuuuaucucaaauacuuauugaccauuauugaccaaaguuuuaacaugaacaaagccuugagauauucacaaucuuggccgaaaaaauagcacaagcagaauuccugaauucauucacuuuuuuucuccaguaaauguaguaaccauuaaauuuaaaauauuucaauuuucuuuuaagcagauauucauguaagauaaaaggcaccaaagguuuuccaacaaaggucuccucccucaaaagguguauucuaugcucaguaauuuauuucuaagaaaaaccugccacgauauaaauauaaagaacccaagaaaauauaccccaugguuuugaauuuuggaaacugacaagacaguugaauaaucauagugaaagcuuuaaaauggacucccuguacuuuuggggaucgauggaugaauuugagaaaugguaaauugcuuguaguuuuuugauugaaguaauaaaaucaaaacauuauuuucacauaaucuaaaaauaaucacuugaacaauguuauaaaguaaauauauuuucaggugacccuguuccuggagcccaaaaaggagccugauaagcaacguagagcacaaauaucuaucuguguaaaauuuaugccuuacaaauaacacauauucaucaaagcaaacaaaguccucucaucugcagaauuaaauaugacuugcucuguacauuuuaagauaaucauaugaucagagagauaaucauaugaucagagguauaaucauaugaucagagguuuaagauaaucauaugaucagagguaugaaaguucucauauuucuuccuacaaagaauagucucugaguacccaaccccaauaucucaauuguguauauuucuguuuuucaggaaaauuaaauacccuggccacagaaacuucauguaguggcugaugaagaaauacaguauauuaaaucuaacagagacauaaguaugcuuauggacaggcacuucuaaguucugguucuuuuuaucucagacccacaaacaauuuuaauaugauggugaaaauucacaucaugugacuuaagcuugcgaucaauggcaaagguaccuugauauaagucaaucuggacagaaaacagaggcguuguuaaacuucaaaaacaaaccugagguucugcaaauacauucuucauguuguugauugggccauacgggacuccacugccuucaaaaagauauaaccacuugcuggucaguucuucuucaaaccuaagaagacaaacaaggauaaauuuuuuacacaggaaggaauguaacacagccucuucuaucauguggcccucuuugaaagcaagcaauagucauaaaacuauguuuccuagucuuucuuuacaccucauuugagagaagguugucuguaugaaaugacuugaguggcccugugguggauaagaguagccacccaggugcuaguguuuaaaaauccaucauuuagagauguaauucuuccuauuucuauugcuaugaacucucugagcaauuuaugaauuuaauaauaauaauaucauuguacuuugagcgugaagucauugggcaauaugucuuuuaggucucagguaguggaaaucggguuaggauaggcacugauauauuauucuucaaaacaaaaaaaauacuaauauagcuguuuuaagaaagcuuugggaaaaguacacaaaaauuaauggucacaaccauuggccuacaaacaaccuuugcacugugauuuacuaaccagcacaacucaagacaugcaaagagugauauuucaguuuaaccaacaaaacucaaauucauccaaauccuuugucuguuuuauuucuacuauaauuuaaaauuggacuucauagacagaaaagcacauggauuuucuuuauuuucucuaauaggucucaaggaagggaagcuaacacauuuaugagauuuauuguuuuauauuucuucucuguaaaaacagugaacacagaaauaaaaucuuggaucuauagggacaccacaacacaauuaguuucuaagguaugaagaauuucagaauuauugauuauuaaaauaucaaaccuguuuuaauuaauuaauaaucuagguaaccaaagagacauuuuuaaaauauuagccaaaguagacuaaaauguuuuacuaauaugaaagggcuagugaaacaauaguagaguauucauggacuucccuucaguucuccuguacauagcuagaauuagcuucaaaucugcagacuccagaggaaaauguauuaaauuuacuucuuucaccauuaaaaaaaaaaaaaaagcauagaaauaguuucagccgggcgugguggcucacaccuguaaucucagcacuuugggaggccaagguggguggaucaccugaggucaggaguucgagaccagccugaccaaaauggugaaacccugucucuacuaaaaauacaaaaauuuagccaggcaugguggcgggugccuguaaucccagcuacuuagaaggcugaggcaagagaaucccuugaacccaggagacagacguugcagugagugaggucgcaccaucgcacuccaggccuggacaacaagagcaaaacuccaucucaaaaaaacaaacaaacaaacaaaaagaauaauuucaauacugaaguacacuucauugauugcuauguaagagaagaaaugaaaaacgagaaauaaaaagaaaaaaauggaauaaauguauguuccaaaauaaggcuacuauaugaacaaugauguucaaucauauaaguuuuuacuuaaggauauaauaaauauuuuuuauaaagguaguauuacauuucacuaggagucuaaucaauccuauccacacauucauuuacugauugcccacuauacaccaaguauugauuuuuguuuuuaaguauaugccuuccauuuucucuccaauuugauggauaaggauuuuuuauuauacauuuuaauuucagcccacuaauguuaacuaccccuauuugguauacaauaaaauacuucacuucuaaauauaguuuuaaaaaaucuuucauaagaauaacaaugcaagguuaaauguuugggcucuaaucaauucuuuacauucuuacuuucuuuucaaugacuguuccagucaucuccuggccaaggccuccuaaaauauauauagauaaauaucaucaaaaugauauaugcugaaagaauaaaagagauacuuugaaccugcagccuuuucgaauagggugucaauuacuuaaguuuucauaaauggaguguuaaaacaguuagccugauaaauuuucaagacaacagaauuuaucaccacuggacucaccaaaguggccugaaagaucuacacagaaaaugcaugucaauauccaaacaacccauggcugcagguuagccaacagaaaacucaggggaauaguugaaguuuuaguauuuauauaagcuuuucaccacugggcaaaagagagggauuuauuucauguuauggaaaacaauggaugcacucuggaaaugagacugcgggagcugcaguugugaccacuguuugcgucuuugcguggguguggguguggaaggguucugaaaugccaugaacucaaucagagagagacagaacaucguugcauuccacugcucucagaggacauauccaucauuuuuuuucuaaaaaucuaucucuugaucuaaaucggauguggaauccuuuaugcaaaaagcuguaagcacauguuuuuauuaaccacaaaaauucugcuaaaaaaaauuuaaaaagcugaucuaaaucacucagggcaauagauuucagaagauaagacaaaaagaauguccucagauccagcuuagcaagugaaccuagggccuucacugggaaauuauuuggagacucacaaacaauucaaauuuaauuggcaacuuacuaaaucaacacauauauuucauucuagauuuuuguaaauucacuuaauacugggaaugaguauuaugaaucaaaugguaucauuuagauaggugaagcacagcugauguuaaauuuccuaacaucaacauuccacuuaagaaaugaaacauuuuucucuuuauaaaaugaauuaaaguugcaaaugagacaaauacaagaccagacagaaacuaacaagagaucucagucaugaaggugagaguuggaaauaauugugacauuagugacaacgaaaugcugguuauuaaauuguuuagucuauauuuugucaauuuuaucuucacaaccacacuauacaguauuauccucauuugaccaauaggaaacucagguucagagaaauuaacuugcucaaauucauucagcuuuuagagucagaugucauguuuaaagcugagacugcuuaacuccaaaaccacguucuaacacauaaugacuguagcagaauacacucagaaugcauagcuucacauauuuuauucauuauauauggucacagcuaaaaaaugaaggagcagaggugaaacuguucauuuuuugcacuaauaauaugcuucuucacuucuaucguauauaccucaguauauauuauuacauugauacacauucauucccgaugcuuuuagcaagaguuuguuuugcaucugccauggagauugcaauaaaaaagaccgucccuguguuaagaguucauauagucuaauggagaacacagcuaugaaaauagaugaauuacaaugcaggaugcugaaacaaaguuacgaagaaacaacuuaugguugaagcaacaaagagggagacuugcacuggacccacggaggcaggaaagcguucaaaaacaacgcgauauuugagccaaguguugaaagacaaguuagaauuagacauaugaaagaugagagaaaggcucuuccagguagagagagcaauauauacaaagaucuaacuuggaaagaaucugaaaucucccgugccccaaguggcagaagaugaaaugugacagagaguuuagaaccagaaugcaaagcaacuugucugcugugcuaagaauauuggauuucuucuugcaacaaggaacccagagaggucuuuaggcaggggacugaccuacucagcacugaugcggacaaugggcugauguaggugagacuagagauguauggcugacguagaugagaaacuugacaggaggcaacauacgcuuugccucugaugcauccaaaaucugcugauuaguaguaucuuccauauuauuaucaauaacaaaaacaaguucccauuugaaaaaaaaauuguuuucuagacauuccuaacccuuuuaauuacucuuauauaucuguuuucaauccaccaucacucccgagccucugaaaucugguuuggucaugaaugccuuuucuuacccagucucgaaaggucuccagugaucauuugucaaauccaauauucuuuucaugguugucacacuacaucacuauguaguauuugaugauguuaacuauucuaccuggaguucuugugacaccauucucccuugguuuccuagauuauuauuuauuuauuuauuuauuuauuuuuggaaacagaguuuugcucuaucgcccaggcuggaguucaguggugcaaucucggcucacugcaaccucgaccucccagguucaagcgauucuccagccucagccucccagauagcugggauuacaggugcccaccaccacgccuggcuaauuuuuguauuuuuaguagagacagguuacaccauguuugccagacuggucucaaacuccugaccucaggugauccuccugccuuggccucccaaagugcuggaauuacaggcaugagccaccacacccggcccucccuugguucucuaaauacugcuuuggauauuugugcuuuuuuuuuugacacucccaguacucuuuguucucuuuuacucaccuaagccaucuugucaucucuaugcagaugacauccaaauccauauuaccagcccagaccuuuuuuucccuaguucccuuuuucuaaguaucauaggauaauuccauucagaugcauuagcauccccaugauaucaugaccacggaagauuuuaugauuuccauuuccuucauaaaccuaggauuccucacuugccagaacucacacccuuggcuaaaccuggaacuccuuccuuuucaucauuucuuacaacuuagauacaauugccuuauagaaucaacuacuccuccauucgcacuguaacuaucacaguccuggcccuugauuccgcacacccagacuauagcaauaucugguuaaaaacauauugccuccaauauuccuccuuccaaaaagucaccaauguuaguuguaucucaagucuguuugacugucuccuuccccaguaccacuaucuucucucacacuaaaaacagacuguuacuugacugccauuuacacaguaauuagaagauaacuggcacucaguauuugcugaaugagugaauauaugaugauuuggaaagaauaagagucucucagugacauuaguuugaauuaaugugguacauaauugucuccuaaaaccuuggaaagacuauguuuaaucagacccagacacugagagaaggacgacaauuugagacucuuagauuaaaauggaauagcacagcaucuccucuuaauuuuucuuugagaccagucccuaaauucuguaugucuugcagaaaaucuugcaguaugucuuagggaaaaaaaauucacauuucaaaaacugacuaacauaaaaaugcuuaaaacaucauguuucaauuuagggacuuccuauacuuuccagagucauaagaucucaggaauucaaaugaccuuaaaaauccauucuuuuagagugacagcagcaagaugaaggaauaggcauuguauagcugaacuccuccacaaagaaauccaacuaguaacuaacaucaggcaaaaguaccagucugaauauucaaggacuugagaggcugagacauccuauugcaccaaaaaacugagaaaaacuguaaugaaaugguaagaagaacaauucucuggcccugucacuucucucccaagccaaaacagcaccacacacugugaauugcccuacauucacaauuucugcagugggaaaaguggaacucaaagcagacauucagguuccccaccauuccgagaucucaugagaaauuuugagaguaccagcagggcuagaccaccuaggcucaguuagaaacaaagcacaggguuggagcucauagcaacaaauauacaaacccuggugguugcucugcauucuggccagugaagguaccacacaagagaaacuagccaaaaacauuaugcugcaggaaacacagaccacaggucuuccaggcuugaacccacgaacagccuccacacaaagcuggugcucucauugagucuuccucagauugauuccagacagcuucuguaccagcuguauaagucaaggaacucaagccuggguggcacuggccaugguuguccugggcuuagagcuccuucuagugcugcaauagcuauagugaucauaggcuuugggaccacuacagugggucugcucaagauuucuggacagguuuacuguugaggaacauuacuaggcauaaccagauggugaggacuguaacaaauaucuccuucaauucacaggcaucaaaacacaaccacaaggaucaggaacaaucagggaaacaugacaucaccaaacggacaaaauaaggugcuggggacugaccuugaagagauagagaucagugaagugcaugacaaaguauucaaaauagcaguuuguguguguguguguuuuuuguuuuguucuguuguuuguuuuuguuuuuuguuuuuuguuuuguuuuuugagacagagucucgcucugucaccaggcuagagugcaguggugugaucuuggcucacugcaaccucgaccuccuggguucaaaugauucuccugccucaaccuccugagcagcugggacuacaggcaugcaccaccacauccagcuaauuuuuguauuuuuaguagagaugggauuucaccauauuguccaggauggucucuaucucuugaccucaggugauccuccugccucggccucccaaaguucugggauuaaaggcgugagccaccacgccuggcccaaaauagcaguuuuaaggaagcucagugaacuuaaagaaaauacagagaaacaaauaucagagaaauguaacagagaaauuaaaauaauuuuuaaaaaucccaaauccuggaggugaaaaugaagugaaccccaccccaaaaaaaaaaaacugcaauagagaacauuaaaaaaagaauuaaccaaguagaagaaacaucugugaauucaaagucagauuauuugaaaauauacgggcaguggagaaaaagaaaaaaaaaugaagaaugcuuaauggagguaugagaccacauuaaaagagcaguuguuggcauucaagagaguggagaaagguaaagggguacaaccacauuuaaagaaauaacagcaggaaaccucccaagccuggagaaagauauaaauauuuguucauggaaaaaucaaagaucuccaaacagauuucaucaaaaucaggcuaaccaaauauauauuauaaucaaacugucaaauaucaaaaccauagagaggauacugaaagcaacaagagaaaagaagcaauuaacauauaagcaacuuucaauacaccuggcagaagauuucucaacagaaacauuuacaggucaggagagagugagaugauauauuuaacacauggaaggaaaauaaccaucaaccaggaauacuguacccagcauguuauccuucagaaauaaaggagaaauaaagacuuuucuagacacauaaaagcuaaggaaauccauccugccuuaccagaaaugcuaaagaucguucuucaagcugaaagaaaaggacaugagugaguaauaugaaaaaucugaaguauaaaacucacugauaaaaguaaguacacaaucaaauucagaauauacucauaugguaaugaugguguguaaauuacuuauaucuuuagaaugaagguuaaaagauaaaacuauuaaaaacaauaacaacuaugauaauucguuaaagaauauggaauguaaugugaugaauguugugacaucaaaaauucaacauguggagaagagggagugaagugaaaauguagaguuuuuuguuguugcaaucaaaaauuguuauuaacuacaauaaugugcuauaacuauuguuacgugcuauaacuauuacaaaaaucauaaguucuuguaaacuucaugguauucacaaagaaaaaauacacaaaaaguaaaaaacaagaaauuaaaacauacuacuagaaaaaaauucaaauaaccacaaaggaagacagcaagagagaaagaaaagaaaaagaaucuacaaaacaacuacaaaacaaugacugaaauggcaguauuaacuccauaccuaucuguaaguacaucgaauuuguuggauuaaauucuuccaaaaaaaaaaagagcagaguaguugaaugaauuaaaaauaaauaaauaaauaaaaguaaaaggaaagaaaaaccaguugguuuucuuuucuuucucuuguaguaugcugacuagaagagacucccuucaucuuuaaggauacccacagacugaaagugaaggaauggaaaaauauauugcacacaacugaaaaccgaaagaaagcaagaguuccuagacucagaaaaaaauaggcuuuaaugcaaaaacuguaaagacaauagagaaggaccuuauauaauaauaauggagucacuucagcaagaggacauaacaauuguaaauacauauguacccaaaucagaacaccuaaauacauaaaguaaauaugaauaguucuaaaaggagagauuaacggcaauacaauaguaguaaaagauuuuaauaugacauuuuaaaaaauaaacauaucaucuagacagaaaaucaacaaggaaacauuagacuuaauaaugaucuaggccaaauggaaauauauauauguagaacauuccauccaacacauucuucucuacuacauguaaaauauucuccaggacagaucauauauuagccuacaaaacaagucuuaaaaaauuuaagauucagccaggcaugguggcucacgccuguaaucccagcacuuugggaggcugaggcagguggaucucauguggucaggaguucgagaccagccuggccaacauggugaaaucccuucucuacuaaaaauacaaaaaaaaaaaaaaaaaaaaaaaaaaaacagcugggugugguggcacaugccuguaaucccggcuaccuggaaggcugugguagaagaaucacuugaaccugggcgguggagauugcagugagccgagaucgugccauugcacuccagccugggcaacaacagugaaacucugugucaaaaaaaaaaaaaaaaaaaaaaagauugaaaucauaugaacuaucuuuucugaccaaaauaguauaaaaauagauaucaguaauagcggaaacuuuagaaaauucacaaauggaaauaaaacaacaugcuccugaacaugcuccuuaacaagaguuaagagcagccugggaaacauagugagacccuauuucuacagaaaaaaaaaaguuagccaggugugguagaauuuguagaauuugcuuauaguacaaggaggcuggggcaggaggagcgcuuuagcccaggaguuugagguuauaguaagcuaugauuauaccacugcauucuagccuggacaacagugcaagacuucacuucaauugaaaaaaaaaaaaaaggaaggaagaaaaaugaaagaaaaauuauaaaauuucuugacgugaauauaaauggauacacaacauaccaaaaccuaugaaacacagcaaaagcaguacuaagagggaaguuuauagcaguaagugucuacaucaaaaaguaaaaagauuaacaauaaacaaucuaaucaugcaccucauggaacuaaaaaagcaaaaacagaccaaccccaaaauuauaaaucaauggaaauauuaaaaaucagagcagaaauaaaugaauaggaacuacaaaaaauaaaaauaaaaaagcaacaaaacaaagaauuggcuuuugaaaagauaaacucaacaaaucauugagggguccaaguucuuuaaagaagaagacucaaauaaauaaaauccaaaaacauuuaaaaagacauuacaacugacaucacaaaauacaaaugaucaugagagauuauuacaaacaaucaugugccagcauauuggauaaccuagaagaaacagauacauuccuaaauauacucaaccuaccauaauugaauuauaaugaaacaauaucaguaauaaaaagucugccaucaaagaagagcccaggaccugaugguuucacagcugaauucuacaaaacaguuaaagaacaaauaccaauuauucucaaacucuuccaaaaacugaagaggaaagaauacuuucaaacucauuuuacaaggccagcauuacucugauaccaauaccagacaaaaacacaaaaauaaaagaaaauuacaggccaauaucccugaugaccauagaugcaaaaguccucaacaaaauacuagcaaauggaguucaacagcauauuaaaacgauuaucccagggauacaaagaugguucaaccuaauguaugucaauaaaccugauacaucacacuaacagaauaaucauuucacuugaugcagaaaaagcauuugacuaaauuugacaaaacucaacaucccuucaugauaaaaacccuccacaaauuagguauacaugagaccaggcacaguggcucaugccuguaauucuggcacuuugggaggccaaggcaagaggaucccuugagcuuaggaguuugaggcuagccuggcaaaauccauucucuacaaaaaauacaaaaauuagcuaggcaugguggugacugccuguagguccagcuacuuggaaggcugaggugagagcaccacuugagcuugggagguugaggcuacaaugagccaugaucaugccacuacauuccagccugggugaaagagcaagaccgagucuccaaaaaaaaaaaaaaaaaaaaaaaaagaauguauauagauauauauauaccuauauuaucuagauauauagacagacacauauauuugaaaauaaaauuccauuguuuucuacauuccuucaaagucauugucugauguauauuaaaaauauuacuaauaauaggaaauucacaggcagucagguuacuggaagucuucaaacaaacacaggaagugugcuacaauacacaugaguuuugaauagauuuggguuagagucacaagcccaauuaucaauaggaucuucauaaaaaucuuaacuaauuaagauuaacuuuuuaaaaaugaaccauuuauuaagcauuuaguaaaugcaaggcucugugcuaagcuacuaguacacauuacuucacuuaauucuuccaacauccugugggguaaguauuaauaccaucauuauguucacuuuaaagauaagcaaaucaagguuuagaaaauuuaaguuaccuuuuaaauucacguaaacauuaugcaccaagcagaaauucuaucuuggguccaaugcucauguguuaaucaccaccuuguacugcuugacuucugguggugaaguucaugaaaguagaccacacaaagcucuguaagugauguggugcuaaaggccagucccacagagggcuuaaaaaggcaguagguuuuuaaaauacaguaucuuagugcuacauuaacugaagccuuuuauguaccaggcaccacaagaaauacuauuucuaguccuccuaugacaugaguuuuaugaucuucaugauuuaggaaacugaggcuuagagaaguagauagggcaaugucuggaucugaaggcucaaaucucuuagcuggaggagaucuugaauugguauuucucuagguucauucaguaggguagacucauuagauauuaacaaaaaugcaaacaaacucuaagauauaggaccacccuuaggccacuggcaauugagcuacuguccgcccccaaggccacuugggagcacugggaguguugccugggcucuacccaucccugacuucuuuccaacuaaccacugaucaacccaaugguuccaaaaugucucauaauauuggcaacgauuuuaugaacugauucuuucaagaaugcugugagaaaagacaaaugcuuccuauuuggaauaugaaaaauugaaguauuaagauacucacauucaagucuguacacuccaggcccauagcccaucucacuacacacugcugccuuauauagaagauaaucaauaaaucaauaaauaaaauucauugagaagauaagucugacauuuaaucuuaaucuacuuuugugaccaugggcaaguugcuuaauuucucugagcuccaauuuucucauuuguucuaaggaaauuauaguaguuguaaauugcuuagcacacugcauaguaacaguaaauaucauuuacuuaucagugauuuccuaaggguagacagagaaagaagcagagccucucagucagaaacuagacacauuuucagcuguauuagauuuugcccaauugcacuuuaaaguaauugaugccauucacuacuuccaccaugcucaauauucucaccaacuuuugcuauuguccgauagagggagcaugguauaucucaugguuauuuauaguucccacaguuggagaaauuaagcaucuuuucaugggacuaagggucaucagauguugaggguuguccuguuuuauucuuuuuuuuuuuuucagugaaacugucuucuuauggacuuacaggaauuuuguacuagucuagaaauaaauccuuuaucaguuacauaaauuacaaauuucuucuccuggacuauagcuucucuuuuaauuaccuuuuucauauaggagcuacuuuaauuccacaaauuauuacucuuguccuucaagguuuuugcuuuuguguugguuuaaaaaauagugccuaucucauaagcuuauuaugauaaguuaaaugaauuaacacuuugaaaguauucagaacagugcacaguacaaguaagugcuauauaaguguuaaauaaacaaaacuacacuaacauuuguggggaggcaaacuguuggcagggaagcagaagacacuagagaagaagaaguuuuuaggaacaaaaacuugguacaggggugcauuccauacaugcauuaccuauacgaaaugucccuuuggacaaaucugaguaaauccaaaucaaaccaacaaggcucuguaagauccagccucgagucuacaauucaguaacuauaaacaggccugugacacuucuguaacccacagagaaacagcuggaauuuguuggucggcauuucuaccguaaacagaaucacagauuuaauauuuccuguaauuuccucagaucuuauuuccucuuaggaauuaucucuacauauuacugauaaauuaugguuaaaguuaucuuuucucccccuagcauuuaugagcucuccauugucugcaugucaauuugcaggccacacaaaagauggaguaagaguccaacaaggaaucuaggcacugcuuucaaucucaagauggcucaguacauuccauauaacuugcucuuaaaaacaacaguuauguggguuaauguauuaagauucacaguuauuaugaacacauuaacaauucucguccauacuaaucauucacaguucagacguaaacuguuuuuuguaaagauucugaauaaaauguggaucacauauuacaaugguuuggccugaccagaauugcuaugaccguccauacaaccuaagcugugugaauggaaacauaauauaggaaaguuacccacauuaccgacgucuggucacaccucacaccagaggcugcuuauacuaaaaaauaagucuuuuuaauuaggaccucuuugugaagaacuacugguaaaguaauaccaaauuauuaaagaaaaaauauuuaaauaucgacagagagaaaagaagaaauaaaaucaacuauaaccuuaccacauagaaauaauuuugguuuaugcauaauuuuagcauuuuuguauaaauuguggauguuuacuuuuuauucuuuucuccauaccaugauucuguaacaaauguauauuuauaacauuaaaaaaugaucauaauguuuuguaaccauuuuaaacuuaccagucauauguucugguccagaaauaguuaccuacuauggcugaagaauauucacuauaagggucuaucauaaguuacuugagcuaaccugugauauuuacauuuuauuuuccuaaaauuucugaguacuucuucaauaaacaucauugcagauacagcucuauacaugaucuuauuucacuacaauccauucuuggaaagggaaaucuuuuaaauauguaucauuuuaaaacauuuuaauauuuauucacggaacaaguuucauugaauuccuaguaaauacaaggcauuguguaggguuacagcagugaacaaaauagacaaaaguccucaucuccaagauugccaaaaagagagauaaaugaauaaaaucuguauuaucuguggaacugcuauggaaaaaaguuaagcagaaaaauaaagcccuuugugaagaguugcacuuuuuaacaggguaacuuaaggucucaaugagaagaguaagugucaaaugcauuauauaagcaguuucucucaccaaaacucaguauuauaauuuuuaucauugauuugauuauuuuccaaguguuauagggaaaaagggggcaucucgcugauuacuaaugcuuacaguuauuuacacaucuuauuuuacaaaaucccugguuauaucuuuuugaugauuuucuauuggguuauuauuuucuuauaaauguguagaugauuuuuauauuaaguacguuagaccggcuuuguauuuaccuuaaguuuuuauugauggugguuuuuaaugugcagaacuucuagaauacuucuggcucucaaggacauagguaaugauaaaauuagaauaucccacaauuucucauuugcuuuauucuacaucauauacauaauaaucucauaauaaauaucuuaauccuaccacauauaggaaauauuauauauauauaauauauauaucuuuucuugagguagggucucacucugucaccuaggcugcagcgcaauugugcaaucauagcucacugcagccugaaacaccugggaucaagugauccucacgggucagccucucgaacgggugggacuacaggugcacgccaccaugccuaguuaauuuuuauauuuuuuguaaacacagaguuuugucauguugccuaggcuggucucgaacuccuuccuggcuucaagcaauccuccuggcuucaagcaauccucccaccucaaccucccaaagugcugggauuacaggcaugggccacugcaccagacuugauuuuuuaaaaaauguugauuaugcugcccccauguuuaauggucauauuauaucuaugugucuacaugaaguauaugcucauugcauauucuguucuuacucuuugacucuuauuuagccauucuugagugugugucucuggguguauguauguguguauaaauuaaacacaccaccaaucuauagaucacuaccucuccgggcacuuuuguggucugaagcuuauucuccaauacauuacucaguuauaugaacaguaguaacaaaaaauaaaauuaaacaauagggaaaaaaaaucaaccagaaaauuaaaagacguguacacuaaaaauuauacaacauuaauguagaauauuaaagaagauacagaaauacacccuauguucauggauuagaagaaauaauaucaauaaaaugaguauuuuauccaaaguaaucuacagauuuaauauaaacccuaucaaaaugucaacggcauucuuuacagaaauagaaaaagaaauccaaguauuuauauggaacuaugaaagacuauagccaaagcaaucuugagcaggaaaagcaaaacuggcggcaucucacuucccaauuucaaaauagaucacaaaacuacaaaaaaucaaaacaaugugguaauggcauaaaaauagacacauaaaucaauggaacagaauagagagucuagaaauaaauccaugcaucuacagugaaaugaucaucacagggaugccacgaacauagaauagggaagagauaaucucuucaaaaaaugguggugagaaaacuauauauccacaggcagaagaaagaaauuugacuuguaucugacaccguacacaaaaaucaacucacaauggauuaaagacuaaaacauaagacauaaaacgauauaacuaauagaaaaagauggggggaaaguuuccuaauauuggccugagaaacaauuuuuuagauuauggccauaaaagcacuagcaacaaaagcaaaaauagacaaaugagauuauaucaaacuaaaaagucucuguacagcaaagaaaauaaucaauugagugaagagaugauguacagaaugagagaaaauauuuacaaaccauauauuuaagggauaaucuuccaaaauauauaaggaacuaauacaucuccauagcaaauauaaauaaauaacccaauguaaaaacaagcaaaggacuuaaauaggcauuucauaaaagaagacguacaaaugaccaacagauauauaaaaaggugcucaacuucgcuaugucagggaaauauuaaucauagucacagggagauaucaccucaaaucuguuauaaugacugcuaucagaaaaaaauaacaaguguggcagggacauagagaaaagggaacucuucucacuguuggugggaauguaaauugguacagccauuuugacaaacagggaagcucucaaacauuagaaauagaacuacuuuguaauucagccaucucacuucuagguauacagucauacaucacuuaauacagaaaugcauugcuaaguaauucaucauauaagaacacguacauggaguguacuuacacaaaccuagauggaacagccuaccacacaccuaggcuauaagcuauagucuauugcugcuaggcuacaaaccuguacagcauguuauuguaugaauauugugucuaaacauaucuaaacaaagaaaaggaacaacaaaaauucauuauuauaaucuuaugggaccgcuaugcuacauucagacugucauugauugaaacacuguuaugugguacaugauuauauacccaaaagauaugaaccgguaucucaaagagauaucuucacucucauguucauuucagcaugcuuaacaaaauccaagauaagaaaacaaccuaagcaaguguccaucaguggauaaauggauaaagaaaauaaggugcacaaacauauauauguguguguauauauauagguacacauacacacacacaguggacuaucauucagucauaaaaaauaaagaaauucugucauuugcugaaacacagaugaacccagaggacaauauauaaaguuaaauaagucagacacagaaagacaaauacuauaugaccucauauauauguggaauuccauauauauaucgaaucgauuugauuugacauuauaugguauauuaacauggauuagauuaauauuagauuugauuaugggagagggauaucuugcucaagggguacaaaguuucuguuaugaggacaaauacguucuggagauauaguaaacaacgugacugcaguuaacgauacuuuauucuguacuugaaauuugccaaaagguuagaucuucaguuaacuacacacacaaaaacagugcuaaccugcugcagugaaaaauguguauauuagcuugauuguggugauuacuucaaaaugcauauguauaucaaaucacaacacugcaccccuuaaauauauacaauauuuauuuguuaaauacaccuuuaaaaaacccagcaauacaucuuuaaauaggcgagccaggauuugucuccaucaugaccuuacaguaucuuaagucuuuaagccuuaguuucaucaucaauaaaagcacauaaugaugauuccuaccucgcgcaaguuucgugaaguuuaaauaaaauauaugugauguaaauuaaagccuuauuuuugugccuggcacagguaguaaguacuagauagaaauuaggaggccagacaugguggcucaugcccauaauuccagugcuuugggaggcugaggagggaagaucacuugaggccaggaguucaagacaaagcuaggcaacaaagcaagacccugucucuggaaaaaaaaauuuaaaaaauuagccaggcaugguggcguaugccuguaaugccuguaguaccaaugacucaggaggcuuaggcaggaggaucccuugagcccaagaguuugaggcugcagugagcuaugacugcaccucugcccuccagccugggcaacacagcaagaaccucucuccuaaaggugggggaaaaaaaagcccaaacaauaauuuguuggggaugcuguugucagacuucuugcccuaaaaucuauuuguucucuauugacauacuggaaagauuaauaaucaagcuaaagucacuucaacugcacauucagacucuaagcaacauaucaaacauaaccuaaauucaaguauaugguaauggaaagcaacacgccagaauauacaagccuacaacuucucuuugauuuuucuguuuugaaacccuauuuuuaauauguccccacugaauuuaauuuaaacuuauuaaaauaaagaaauuuucaagugaagcauaaaaauuuacuauuuuacauuuacccauuuucucauuugcugccuuccaugcauaaauuagucuuaggaaugggaacauuauuuucuuacuguacauaauacaccaacaugaaaaugguauacagaaaagaggcauaggauagaaaauguuauuuuuuauuccaaaagauuccaaagguagaauaaauuuugccgacaaugucauuccacccaaggaacccugaagagagguaauccaacccgcuuuugcauguauacaguacaggaagugcucuuccaggaaauacuacuacauucagaaagaagucacuuuuggaaaucucuaaauaagacuccaacuccccagucuugcugcucucuguccacccucccuaacuccacccagacuagucuuguuuccuuuaaauuauucauuuccuuuaaaugacuccuaaagaugauaucucuauuuacagaacuaucacucaaauaauucaaauauuuuauaaauaugaauguauaauaugauaauaaaauccaauaaaauuggccuugaggauguuaucuuuccuauacauauagcauuauuaugagaaacauggaaguaauuuaucucaaauacuguuucucuauauuaauugaagaauaaacacauuaaagcuaagaugagugcucucauuugcaaaaacuaguuuaaauguuguuugugauauuaaaagccgacauuuggcugggcgcaguggcucacaccugucccaggaggacuccaaguacagggacuacugaggaggcugaggcaggagaaucacuugaaccugagaggcagagguugcaguaggcaagauugugccauugcacuccagccuuggcaacagagugagacugucucaaaaaaaaaaaaagaaugagaacuauaaaucuuuucauucaguuugauugaaucauuccauuuguacaguaauauucaauauaauaauauucucaugacaauaaaauucuaauaacaauaaaaauuuuaaaugcccuaaaugccaaaaaaaaucaaaaucccuuaguauacuaugaaauauuuauacaacaggguaguauaugagccaauugaaguaaaaaauacaaccaauguacacaaaauacuugauaccauauacacaaagaacguuaagcaaacgcaaaaaaagaacucacaauuguuaugugcauaugauuacaucuaacuaugcauauaaauuaagagaacuccaaaaacaauuugugaagaaauuuuuucccucaucaucauauuuuuuuuccucaacgguuuccaaaucuuuuaaaaaaaauggcagauaauuaaagcagucucauggcuuaauagagaguauguggugcuccacuaacuguaagcacuguggggcaggaaacagccucacuuguucccuguuccacauagccuugacacagagccugacauuugacagcugauauuguuauagcauauacuauguguaaggcacuguuuuaaguacuuuacauagacauagacacagacauauacauagacauagacauuuaauuccuauaacauaaguacuacuaucauccccauuuuacauaugaggggccugaagcauagagacauuuaaaugauuuaccaacaugacagaguuagcaagagccaggauuagaacugagacaguacgagccccagaauccaugcucuuaccaccccaucccaccccccugcuauaccaccucaguaaaagaggaggugagcaauaaaggguggaugaauuuuaggauggauggaugaaugaaacaaucaauugauggauugauagauaauuugauagacuuauuuauagaucaauuauuuggguucacucucucugaacaugggaaaggaaacugacuuaguagugagcaccucucugcucugacacuguuaggugcuuucacauauuucuuacugaaucauaguaacaauccuguaauaugccucauauugccucguuuuaaagauguggaaacuggauuuuguaaauuugauguuaauucuuggaaaaauccugggauucgaaaugaugcuucacagaguucaagcucaauacauacucauugaaugaaagauuguaaaguacucuuuugaaguuuagaaaaggaaauaguaagaauuagucaccaauaugguuuccuuaaagcaaauaaugccaagccaaucucauuuucuauuuugcuugguuuuaaacagguauaugagggauauacuauggacaaaguauuccuggauuucaccgaaguuacuaacaaggucauucaaaauaucuucgugaacaagacggagaaaugcaguuugcauaaugacacaaaugugugaauuugaaggcagucaaauaauacaaccagagcuuucaguuucaaccucagguagugaggauggugucuauugcugaacccaaacaaggacuuggaugaugucauguuggucagauucgugaaaaacaagaagcuagcagagacagcaaucauguugguuuaaacaaggaugauuuuauuuuaaacagagugaauaaaaaauguacuuuaccaugaaggcacaggagaaauacgguuuaggaacugcuaagguuuuguuuaaaaggugauuuaguaaugggcacccaaugcaagucaacguggcacauagcuuccaaaaagagugaaaacuuagacuucauuaagugaacucuguuacucaagacaaguuaacuaccaucacacuaugcugcugcccuggcagaccccuacaauaugcaguacuuaucaagugcuugccaugugccaggcccucuacuguauucacacauuuaauucucucgacaauuuuaaagguaggaauuacuauuauaagcucauuauccccaauuuauagaugaaaaaauucugaaacacagaagucacauaacuaaugucuuaauaggacagggcaaguauugaaagcugagcaguuugauucaagcuucaaugcuaccaugauugcauuuagccuuucuugucuucugacacucagagcuguagaggcuacagaugccccaucccacauccccugaccaaccugagcuggucuggguugucuauuguuuacuggaaguauaaacaguuccaugcugcugacagcuuuccuuuccaaacgccugcaccucuucuuugcauguggcuuuucccaaaacuaugcgagugugcuggauggcaccuccaggggaaaccaucaaacacuggaggauaguaguugggggauaaaugcccuaacauccacacccucugguuacaugauuccaaaguauguacacacaguuuuuagacuguucccaacaugacugagccccagcuacccaaaauggcaaacuguuuaucugccucacuucccugccccucugccccccacacucaauaccauuucuuggaauccucucccuaaaaaauuaaugguacccaagaccccagauucguuuugcuucuaggcaaacccuaacauacuacucuaugcuguuucugaaucuucucaaaucuucuauuaacugugucauuuaguaauuaaguaaacuacuuuaaauaauuuauauuuuucagcauaacauggguaucccugacauuaauuaaacauuccuugauuguuuuauguuaccagcuaaacuacagcuugacauagggaaagggggagaagcgggcaugauuuuccuccagguggccuaccaaacauaauaguagcugagagagagagagagaaggggaaaugguaaaagaaugggggagaaauaugagacagaaauuuuacauuuaaucacuauaacucaaguaaaaguuagguuuuuacccacccugucagccacccaaggacucuuacuuaccugauuggccacccuuggacuccaugcaccaaauuauaaaacuagaccauuugcaauaauaucucugagugaguuccuaaauuaauuucuuuuuggauaugccccaaggggguuauuugcauucaaacauguaacucaaacugagcuggcaaauuagaaaacaauuacuugucccugguuaaaucaugccaccauuuuuuuuuucugcuccuccuagugcauuuguggaucacagccacacucuucuaacuuucagaggacuuuugggagggggucaaaaguacuaucaaaaacucagucccugcugcuaaccgauagaaggaacauuucagacucagaaacaccuuaggcuuagaaacauggagugggaaaaauaaaggcuacuuaagagaguauacuaaaugcaaucuuaacuuuuaacuuuaaugcacugaaaaauaauauuucaaucaaauaucacauccaacuacuauugcuauugggauaaagugauauauuuaguaaaaaugacguaaccaacuaucagaaaaugauugacauuucucaaauguacagcuuuugcaugugcauguugcuuuaagaugcuucauaugauuacuguuaaaauaaguauguaagauuuauugaacaauacaguaaacaaccacaaacagcaugcauaaauuguuaguggauucggcuacuuauggcagaagucauugguggacuguguuucaucagaacauucacucucccacugaaaaaugaaacauuuuguaauacacaaacaagaaacaugguucuuuucccucuuacugaguuuauacuuuccuucccauagaaaaaucaaagaaagaaaaauauacaacuuucucaaugcauuuguaaggaagaaaacuacaacugaaaagaagucaauuguauaacacauuauuauaagaauuuagccauuucuccugaguaacauaaagcuagaaaauacucagauacauguggcauugauauucacgcaaagugaaagucaagaacaugaauuaauaacagaaggcauuuccauaaaucaauaacagaaggcacuucuuaccuauauuuugaccuccauguucugugccauuaugggcucucaacgacaaaaggcuacaaauaaaacugcugauagugcucaucagcuaugucagaucccugaaguuuuuauuauuauuauuauuauuauuggcauuaugugguuugcucucuuaaaaauggauguauauuccaaagcuauuuguuagcuucaucaauucauugauuacugagauguucacauuaaaaaacguggaaaacagugggaaauauaaagaugugaaacaauuaccuauaauucuauggagagacaaccacgguuaauauuagcuuuacuuccuucuuuggugcuauuccuuuaugccguugcuagcauaguuuauaauuaugccuuuaaauuagucugauguaauaagcauuucccaugcaguaaaaaagaucuguggcaaauuuaauuuuuagugaauacagaauauuccaaaguaagcuuuuauuuguuucucuaaugccagauguguaugugcuuugcacuauuucaugauugugaacaacucugcaauuguguacuuaucauugucuuuaucuugauuccucuaaagacauuuacguaggacuccaagaaugaauauuucaaaauagaauuaucgagucacuaagaaugacacuuuaaggcucuauaugccuauugaacaauugcuuuuugcacagcagggaaugaaccuguaugucuuacuaugucuuacgcaacacuaauuauuauucauuuuuauaagcaugugaaugauuaaaaagagaaaaacauguuucagccauuuuauuugguuauauuuaauuucuaguaagacaauacuuuucauacaugaauuugaccuuacguuuucaguuuuugugaaguauuucaaguuaauacauugagguuguuauaauuuuuuacugaccuauuuuaauagucucuuuguaaaauaacuacuauuaucugcaguuauucuuggaaauauauuucccaccuuauauuuucaauuuauuuauguugcuuuaacauuagaauuguucuaccauauagcagggauuguuaucuccaguacuuaaaaaacaauuucauguauacuugaagauaaacuuuagaauuuguuaaauucugaagauaauccucuugaaaugguguuuugaauuuugugaaaguuaauaugagaaaauuuuacaucuucacuauaauauuuagucuuccuagccaagaaaguuguauagguuuuuuguauguaagccccauacacaucuuguuacuguuaucccuagauauguuguauuucauugcugcuguuaaccaugcauauaaucucuucuucauuacauuuugaauuauauaggcaaguacauugauuucauauuuggucagaugcuuaacucuauaacuuauauacaguuuaaaauuuuuauuuuaaauauuauuauuuuaauuuuauauuuaguauuuuaguacuuuuuuuagucuaagaaauguaaccauuuaaguaaacaaccugugcuuguuagugugcauucagagacccauuuuauccucuauuuuagauaacagaauguuaaauuauauacaauuauguuuuucacaauuucucucacuuucucauaauuccaaauuucuguguuuuagaauauauuuguauauuuugauguguuuaaaaaguaaguugaaaccaacaauuacuccuauuuuucaaauacauuaucuaucaauggccaccaaaaagggccaauccuggagccacaaagauccaggccagcauuuugauguuccuuuuuuguuuccguucauuaaauugaacagaguacugagacuuaaauaaacucagacauuccaaugucuggauuuuuucucuuuccaaaguuagcaaaugagaaaagaaaaacaauucacaauagaggaaagaaaaaucauuuaaaaaggaaaauguaaauuuauaaauuuagagauuuaaguuguguacauaugauucuguguaugugugacagagagagaaagacagagagagagagagagagagagagagagagagacuguucacuuaguuucuuuuccuagccaggaauauuguaaacauaaaauguguaguuagagaaaaggagaauaagcaauuauuccgugagugcuauggaaaagacauugauaaucagaagauagcaaucugagccucaucaaugagcugugugaacuggggaaaacaugacaaacuagaacuaagguagguaccgucagccaauggaagcagugagcaacaugccaaaacuacugcagauuguccaggugaggauggccagaagcagcuggucaacagggaaugauccagaacgcuaaacagcugguggaaaucgggacucagcagggaugucaucugucagcacugggagagagguggugucggcccuuacuagaaacaucaguugaugcaagaucaaagacucaagcaaaguccaugcuggagagccaaagcuaagaggagauaagaauagaacccaagugggcaaaguacagagcagaacucagucugacccaaaggcaagcaggaaauugggcaggacagggaugagucagggaguccgaggagcaaaccagauuugacugagucaaacuccagauucuccauccauuuccaaagucaagagcgaaauaaggucagccagaaaagucuggagagcuguaccuucccccucccaaaaaagaaggccuuuagcauugacuuguggagucuuccaccacguuucaagggaucuuuggcccgugauacuauuaauucuaaguucucacauuuaggaagggguuaaauuugaugauauccaaacuucuauccagcuccccaaguguuuaggacucuaacauucuauaaaucuaaaaauacacauuaaguuccaaaggagaaacgaggguauuaaauguuuuauccagggaaauagaguuuacuggacucccucccaucaccaucauccccuccguauacaaacauauaaauaucccacaaccaccaccuaauucuuccuccuaaaagguaguguggaaugguuuauagcccucuuggaaaaaaaaaacugagaugacauuccauuccauacugacucacuuuuaagucuuuagacaucauuugauucucagucacaaagaauucuccuaacaggguggaaaaagcccuggucacgaggagauugccuggaguugcagugguucccuuugcauucucuaagccaaagggaugcuuuccagagcuguguuucuuucuuucuuuuacccuccgggcugauuuuauaguaacaaaacacagccacuuaaaucuaucuccaaauaaccaacauucagaaaauguaccacauaaaauauagacauuuuacaagggaccaucuauuagcugauaauggcagcacugccaaggaaugcauaagaaaacaaaugugacccucaccaaacaucagauccauuuauccaaauuagccccucuacagugaaugccaugauaugauucaaagaauuaugagggguugggaggagguuacaauaaacuaaauauguagguugaggauacauauaaagcuuaugaaaugcagccucauaagacauuaauagaagucagaaaaaaaaguuggcagaagagauuuuaaaaugugaucauauggaaaaaagaauauuaaaccaacucaaaaaguuucagagggugaaaacaauaaguuucucuauguauauuaaaaacauguagauaugggagaguggaugguugccagguugagggaaagguggaauucaucggauuuaaaagacacuuccauaaccucucagcccuuggcaaaugugucaggaaggggaucuucaucucuggggcuccuaacugcucucagcuucucauuuugucccucuucacuuaccuuaggcagccaguguuuggaagauuccucuguuuucuccacauuaaaaucuaaacugaggcaaagaucugggaaaauguauuuacacuaaggaaucagaguucaagcuuuaacccucccugcgcuguuugaaacuuaagaguauacagacuuuuaacccacccccacucccccacaaaaucuuuaaugguaaaaccucugaaaucagcaaacuauguguaaggaagaauuaucuuucauggaauaaaguuuccuuccaugccuucuaaacuguauuacauagguaaccacugauaaaaauccucccuguucucuaagaaaacuugugcucaauaaagccuucaugcaaauaagugaaauccaauuaagacuguacuacauaauacccauuuauuguuuaauuuuaaaacaguucaaagugugaaaagcagaguaggggcagaaagaugggguaggccaaaaaaggaaggagggaggaauaaaauugaggauuuaggaaagggggaaaggccaaggaaggugacacagauguuagaaauuaaacaugagaaaauaaaaaauaaggaaauuacagauauuacuuaacugaaaagucaaacaguuuucaggaaggcuagagauaccaaauaaaacagugaaaaacguacacauaaaaauggcacaggagaagucauggguguauuuuacuaaagugcuuaaagauaugggcugaagcuuuucguggaggcuauuaacacaggguagcaauuaaggaacacgcaaaaaguguuucauucuuuaugaaaguacagacacaagugcaagaaauaacucaaguggaguguucacaaauuccaaguucauuacccacaacgcagaacaagugucucuugaaagggaauagaauaggggcuauuaagguacucuuuuaguuaaaaaaaaaaaaaaaaagaaaaugaguacuauuaauagucuuaauuaggaaauuaguacaaaguaaaauguauuccuaaguccuaugagcuauuuuuauuuuuucaaaaaguugaacaaauuauuuauccaccuacaaaaaggccaugcaggcuaaugaaaaugucaugcuuugcuuuugguagaaguaaauuacuacuauaauacuaguuacgucauccuuauuaggaugucugauuggcaguuaaaaauaacuuuguaaacacaaauugugaaaguugagucuuauaagaauuacaguuuggcagaaaaaaaaaucuuggaaaugagguucaugaauuuaaaacuaauauagaaauugcuaaagcaaacaauuggggaaguaaaguuuaugauuuuccaggauuaagaucuuccucagauaggucucaaaaauagaaagaaugaauaagaccuaguauuugcuagcacaacagaguagcuacaguaaaauauaauuucacuguacauuuuuaaauaacuaaaagaguauaacuagauuguugagacacaaaggauaaaugugugggcugauggauacccccauuauaaugaugugauuauuacacauugcaugccuguaucaaaauaucucaugcuacccauaaauuuauagacguacacuagguacuccaaaaauuaaaacuuuuuuaaaaaagauuuuccucaaauaggcugaguacugcugcaugcucaaacugugcuggcuguuuucaugcuuuuuuuuuuuuuuuuuuuuuucuuuuucuuagagucuugcucugucgcuaggcuggagugcaguggcacgaucuuggcucacugcaaccuccgccucccagguucaagcaauuccccugccucagucucccaaguuguugggacuacaggcgugcaccaccaugcccagcuaguuuuuuguauuuuaguagaggugggguuucaccauguuagccagcauggucucgaucuccugaccucaugauccaccugccucagucucccaaagugcugggauuacaggcguaagccaccgugcccggcccgucuguucugguuuuuaauccucuuugugauguagguauuuuuacacguaugauauaugagaaccugaagcucaaggcugaucacugaaagacuaggaucucaaauucagaucuucuuauauuguaugaccacgauacagguucucuaguucauucaaaguccucacuuccagcuaccacugcucuuuucuguuuuguagaaccugacaucguggauccuugcuuuuucccuuuggucaguucugccacacuuggauaccuugcccaucauugcuucacauguucacugacugagagaacauuuacugagugccaaauaggugcuagaaauaaaaauccaaaggauauauucucugccauaagaaauucacugucuugucaaggaggaagagaaguaaaugacugaugaaaguugagugggguagaugcugugaugcagcggcacaggaggggccccuuggaacagacuagcgaggccagaaaagcuccuaaaacuugugcuuauuuuaaaggacugauagcagguagugagauuaagaagcuccaucauuugagugucaaguaaugaguauauggggaaacauggaggacugaaagauuaggccacauuaaaaguaguagcacuggguucugugugacccaggcaaggcugacaaggugggaggugcauguguucagguaaaaugguuugaacuuuauccuucaagcuauagaagccaggcauagugacucagagcuauaaucccagcauuucgggagguuggagcaggaggauuaucugaggccaggaguucaagaacagccaaagcaacauagggaaaccccacucccccacccaccaacuaucuuuuuaaaaaaaauuauauuuuaaauuaagcaggcaugguggcuugcaucuguaguuuuagcuacuugggagacugaagcaggaggauuacgugagccuaggaauucaaggcuaaagugaaccaugaucacacuaccgcacgcuagccugggugacagagugagaccuugucucaaaaaaaauauauuuauuuauuuuuuuugaaaggugaagagagccccagaaagaccuagccagggcagugaaauggucauaguggcuuaauagugccaagaugucaguuuuuuacauugacauucaguauagggaccuuugaaguuacaauugcuccaucaagagccaagaaauguuccagguccaauucuccaguauuuuguauaaaucuauucaaaauaauuugauaucaaauuuuaaaaaugaucaacuuagaggaauguaacuaauaaacuuuuuuuuuucuuuuugagacagagucuugcucugucaccuaggcuggagugugguggcaugaucucggcucacugcaaccuccgccucccggguucaagcaauucuccuuccucggcuucucgaguagcugggauuacaggcgugugccaccacacccagcuaauuuuuguauuuuuaguagagacaggguuucaccauguuggccaggcuggucucgaacuccugaccucaggugaucugccugccucagccucccagagcgcuaggauuacaggcgugaaccacuguacccagccagccaccgcacccagccuaaaugcuugauucauuucaacaaauacuuguuuggcaccucuguuaaaaggcccugauauaggacauuuaacuccacaaugcaguaaacucugaaaauaaguaaauagacaauuaaaaaucaaaaacuuaauuuaagaaauaaccaaaucauuccaaaccaaaacuauuuauuuuacuaaaggaauugccacaguauuuuaaaaggcgaacuuaucuaaugcuguuaguuuuauuuaugaugacauaacguaaacaacuuuuuacaaaugccuucacuaggacuacauugacauauacuugcuuuacauauguaacauuuuuccaaaagcagcuugaaaauugucaacugcaucucuccaaacuauagauaauccuuaacuuaugaagguauuaugucccaauaaaacuaucauuaaauuguaaacaucauaagucaacaaugcauuuaauauaccuaaccuaccaaacugacugagagcugcagcucacuacugcugcacaacaucgcaacagaguauuuugcugcauauauggcuacccuggaaaaagauccaaauucacaggaugguuucuuucccaaaguagcugggacuacaggcacaugccagcagggccaguuaaauuuuuaauuuuaauuuuuguagcaacauagggucuugcuauguuguccaggcucacaguacaguuucuaaugaauguguaccacuuuaccacaugguaaauuuaaaaaauuguaaguuggggaccaucuguacuuuuuuucugcugucaugauuuuauuuucaugcuacaaaaguacauucacaucaauauuuccuucuuugaacuuuuuucuuuaccugccuaauucuguuugucccucaagauuuaucuuagauggcaccaucuccaggaagccuucccugauuucccagauuaaaggaguugcuccuucucugggcuccccaauccacugugcauaugauuacccagguaauucccacacucuacuuaaaucaaugcuuucuguguuuauuuuccuaauuagaccaugagcuccuuaaaagcccaggcuucaucuuucagcucuguaucugcaggacaaugguacacagucaauggccaauaaauguuggugaagagaggaagagagagagaauaaaauaaauuuuaugucuauuuucuccaucaauucucuucuccuucauccucauuucauguuuuccuauuauuucuccccaaacacuaauacaucaucuuuaucccucucuuccuaguuucaauucacaacuugcaauaucucucuugggguccuaacuauugcaaaaaugcugaucuggugugugaguagcacagguuuaagaguuuguugcuccuuagcauugcaaagaaggggauuguuuuaucuggcgcuggauuagucuccauuauaucuccucuucuguuuuagcuagggauuuuuaacaugauugaguuuuaccuaguuuucaauguuagcagcuggguaaacauacuuucugcaacacccuggauaaaauggcaaacuccaggggaaagucuucuaccuuuagauuaauaaaaaagacuugcucacagcccugguuggggaauaguaacacuugagagcauuugaggggaaucgugugugcuggcuguggaaaacgcagcugaugaccaaaacaggcagcugccguccugagugaggcugaucgcccucagagaguagcuucaaacuguacuuagcaagaauaacagagaacugagguaagugacugacaacucugguagguacuuccaaaaaagccuggacuuuucauaggagaaucaccugauucuaaaaaauauaaaugaaggcuuacaagggacagggaggggaguacucaaaaauugcucaaggaaaauacuuuggaaggaagauuuugaaacacaauaggaaauucacguguauauuuacaagagccaacuuuguaaaaauccauaaaugcuucuguuuucacugucuucgaauuggguguaaaggaugagaaaacuuuuuaaaauaaacacagugaguucaucauuccuagaguuuguuuuuaaaguuaucugcugugcaaauucacucucaugaaucccuccacauuuucacguuuuaaagauuuucuaaaauaaaaauaucaggcaaggaaagugucuauaaguauuaaaggaaagugccugcgauguaagguuuaacagaagacaacaggcaaaaacacgauagacucacaugguaaagucgauuauuugugaguggcuacuguuacuaaaaauauguuuuuacuauggaaauggcuggcaaaccacauuuuaaaaacuggagcauguauaucaacauguugaaaaaguacaauaaaugaguaacagguacagccuauaacuguaauaguuuugcaagagaaaaaauuuuuuaagugguuauuaugaaaaauauggaaaacuaacuucuuaggcucaccgaaacaaauguguuaaguaauaguucaaaaacaaccacuaccaaaaagaaguaugucuucuagaaagucugcaaugguuaccaaaugaaaauucaggagggcaggaauucuugacuguauuuuacugcuauaucccuagugcucagaacaguucauggcacauaguagguguucaacaaaugcuuguugaauaugugagagacugaauaaauggagaagcauagaccacuucaaccuggcccucuggucuuccuaggugagaaacggggucuuccugacuccacguugcugaaaugcuuugaccucuucucuacuagguagagcacucccucccuugacgcucucucuucaaguuagaaaaaaguugcaauaagcaaauccauuuuauggccagaaaaaaaaauccuuuauuucacaaguuuaagaaacuacuuugucauaaaggcuuucaugaguucacgacuugaucugccugccaugggcucccacucucucugaaccaaccugacaccccucuucucuugcucccucagauccaagcacacuguccucugacuuacuccauaaacucugccuggaauucaucucccagaugccugccagccucccucagacauuuucucucauuucuugcaagcuucugaucaaaugucacuuucacagagaagcccucugugaccagacuaaaugaaaaacccagcuucacacuuaacuucuggcauucuuccuuguccuggccuguauuauuuuucauggauacacuuugucuguuucguucacuucucuauccccaacuugcaacagugccuacuacacaguuagugcucaauaaauauuucuugagcgcauaaacaaacaaggacacagucauauuucaugugccacuucagggaggcaauaugagagaugaaaaagguguagccuuuugaaucccauuucuaacuauucacuaugugccugaccuggagaccaccucccuaaaugucagaauuuucauaucaagugggaauaauaacacuuaucuggcauguacuuggcagccaccaaaggcugguuccacuccuuccuuucucccuggcuccuuuuuuguggcuaugagcuaauguaacacuuuuguuaggaaauaaaaugccugcaaguucugagguggcuguguaaugcaugugcugagcaagacgagaauguugagaaggcccuagagcaguaucauucauaaugacaacuaacguugauuguacuucuguuuggcaauggcaacggacaaggcaugaaaaggacaauguucuuuccuaaaggugccaacaucuuacugggaacagaggcuucuagaacuggccuugaagcaugacuaaguuucagaauagugguaauucugagaagcauuucagagaggaaacuaaaccaauugggagggugacuauagcagggccguccuuuggaaacauguaagaagaagaguggacaggaaaggugaugucagauuauggaagacaccgcaugccaggcuggaggcuacgucuaaucauguaacuuaugaagcaccacuaauauuuuugaauacuggaaaaacacacaucauauaaugaaaaugagaaauuuuaagagacuucucaaagccaagcacuaagcaguacuaaugauuccagugauauuuguucagaaaaauaaaugauaagcuuauaaacuggaaugaaucaauauucuaauucuaaucuucccaggucaucacuauuugaacuaccguggaggaagagagacgugcuagaagagacuuggagaacugcaacucauaagaagguaccaaaaaaugucagcgcacuagcagaagagagcacaaaagcuagccugcaagcagccaagggcucuaucuguggucuguguuuuaacggcaguaccaaugaugaugugaccuccuuaugaaauuuccucuccuaggacuacccacgccugccccgucucuuccuugcaggucgauuccuuacuuauuguuaagucugaauaaaaauauaacaaacuuauagauaccaaaaugcugaaacuucuacuucuguguauaaaagaacagaaagaagaagguugcagauuauauaauucaccccaaagagggaaaauggcaaugaguauguuacagaugcuacuaaaagucaucccacaguugaacucuauaacauaauuuagcaaggaauaaaaguuuuaaaacacaggaaaccaaucuagguaucauauuuuucuugggaucuguucuucucgcaguauggucaugauuuauucaguuuaucaaagagcuucugauaagguucucacaaguggcuauuauugaaacuugguaaccaucgugugaaaggaaaaagcuuuaucaauuaauuauaugaauuacaaaugcuugagaggcagagaggcaaaaagaagaaauaaaugggcacuucucauguggagaaaaguuaaucauugagggcucuggggcuucgcgguagaaucagaguuauauuuaacuagggaccagaaaagggcacccaguucuccaucccccauucugugucuaucagucccacaacacacagucccuauugauaugaauagcauuuggcacauggaaaagauacaggcaguguuuaaaauuauaaaauguuuaaaguuacaaaaguauuucaaauccaggaaaaauagauagaugaauguugauucagauauuccugcagacauccccaaauacaaagacaacaaaaauaaaaacagcggaauuuuaguucuuauaacuuugauguauacuacauagaaacacuugagccuuuucaaaaggcuaaauaugguauuuaaacaaaauuaccuaauuuauuggcaugaugagagcaaauuuucaauauaaaagaaaaguucaugugggcauuuagauccacaaaagccacaaagcccauuuguacagauucagaagacauguaaaggcaaacaaaaagugaaacugacaugaaacaguaagaauaauuauuuucuucagacaaacuugaaaaauugguacagguauuacaaaaaaauaaccugacauuaauggaaaaaaauggaaauaaaauauucuacuuaauuaacauuaauauuuuaugacccauaacucaauguggcaucugcaaugauccagaaauaacaucaagauucacaggaguggcucagaaaugcaaaccaacucuugauuucaccucucuuuaccuugcuuuccuuacauguaaaauggaaauaacagaacuuaccucacaggauaauuaugaggauuaaacgagacaauguaucuaaagcauuuaacaaagugaaaguaugaaauaauguuaaauuauuauuguuguuguuguuguauuuaugauaaacuaaacccaaacagguacaggacacagagaaacaaccaaauucaagucauggugacuuucuuauuuauaucauuguuaugacucaguacuuaacaaaacauaaaauguguucaagugcuucuaaacaaacaaacaaaaaaaccccacagcuuuaaaaucucuccaccagccaguuuuguaaaauggaagagaauuacaaauugaucucaaauaagccaagaaaaaaacauauaaaacaccagauaaaugcuuaucacauauuaauucuuaaauggaugaauacaacauccaaacuuaccguucagauaauauuuuaauaagcucuuuucuauuguguacccgaaggugguuaguuuuauacuuggaauuaucaaucaacucaggcaaauccaagaucuaaaagaaaaaaauaauuuuccaguauaagaaauagguaguucuuguaccugccugugggugcuaguguucagguccuaucucucccuucucaagaacauuccuugcuggucuuuaugccccucaacaaggacauauggagggaacaagcacacgauuaggauggaacaugcuggugaaaggguuugucauucauaagaggcuuuuacuacauuuaagcaaauauucuuacauauaggagaccagcaaaagaugcccauaagucuuauaccaaauaugagaauauaggaaacauguuagcagauccccacagaaaaaaaucuuguuuagaggaaauagggagagagaugcuaaacuggguaaaacggaccaaauuuuaaaaaccaauauccuaagugcauaucuacauguaucuuguauacagucaacauguaccuuguagauauauucacuuauuuauaccauauguaaauaaaauacugugaucuucccagguuguccuaugcagaauguucuaaaagcugcuaaaauaaaguaaaagcaaauacauuuacccaaauucucaccauuuaaacaauagcaaauuaaaagaucuucuuccuauagaaguaucacuauuuuuuaugaauauaucucccugaaguaauaccaacuagaaaugcuuuuauagauuuccucuuuugcuccuccucaauaaggggaaaaucuaucuugcaagucccuuuggacaacauucaacguuaacaagaccauaaugaaaguaccaaguggauuuggaauggaaaaguuuuacaaagacuguguagaggcagugcuuggcaguuguauuggaaagucacaaggaguauuuacagccugggggcaggccaugcggccuacagaaagcuucauugccuuuauuaauauauuuacuuucaauauaaauauuuaaugguuucauuuauuugccacaguuuaaauaaaaucuaucuauuaaucaucuuacaaaggacagagaagugaagaagauucccuugaguaaagagaccaucucagugguguaauuuuucuuucacauguuucacuuauuuccuuuaggaauaauaaagacugcauuauucucccggauuuuaaaaaccaacaccacauacagcacccuuucuagaaaccucccugucacaacaccugauccaagaauuggccucaagcccugucuagcaguuagacacccucccuccguaagagugaauaagucauuccaagaaaaaaccaagcgucuucacuaagucacagguuaaauuuauaaaccuggccucacccaaaaagcaccaucagcaacaaaaaauuacacagugaccacacuuaaggguaacuggaaugcccauguguccucuguauuugacuuacuggaacucuuuuuuguuucaaagauggugugaaaucguuggccaaaguaaugauccuuccaucuucagcuaugccagcuaacauucaaaauguuucgagagacaacuucaaugacugugaucauaacuauuauuuuggagcuuaaauuaaaaaagagugcugccugggauaaaauaaaacaauguacaugaaaaugcuugacauauuaagcacuaaauaaaugugaaauauuccaacuagguacuguuucccccaaaagauauuuuuuuuuuugagacagucucacacugcugcguaggcuggagugcaggggcacgaucucagcucacugcaaccuccaccucccggguucaagggauucuccugccucagccuccugaguagcugcgauuacaggcaugcgcaccaucaugcccggcuaauuuuucuguauuuuuaguagagaugagguuuuaccauguuggucaggcuugucucgaacuccugaccucaaaugaucugcccacuucggccucccaaagugcuuggauuacaggcaugagccacagagucuggccagaaaaauuuaaaaagcauauauugguacaaaaaagaaaggagggagggcucugcaaaaaaaugaagagacauuggcaaaaacaaaaaaaaaagaaaauaacaaaacaccauaaacugaguagcaaacgaaaggagaagagaaaaaauaaugaagacccaugauaauaaaaacugcaaguguuuuaacaugccuaucaucuaauguuccccuuaaagcaaaaaccaaaauccuuaagauagucuggaagguucuacacaauauggcgcuauuaccucucuaacaucaccuguuaccaugcucuccucccuugcucauugcugcagccauuucaucuucuugcuggaccagaaacaugucuauuccacuucagccucaguaguuuuaaaauagcuauuccuuugcuuggaacaucuuccaccagacaucuaguuggcuagcuccuccuuuccuugguugaguaggcucaaauucaacuucuuaaugcaacuaccuugauuacccuacccccaucacaggccaccccaccccacucaacacugacuccccugauucccucuucccuugaccacuuuuucccauaauauuuaucaccuaacauauuuauuauguuuauuacuccauaucugucugcccugcuaaaauauaagcuucacaaagucaaaguauuuuaaauguuuuguucacugguauagcccaaaugcugacaacacauucuucaacugacaagcucacagacaaacaauaugaacaauuucagguguaugauauugcagacauuauucuaugcauauaccuuauucaauuaugucuaaaaucacuuuuuaguugcagccaggggcgguggcucaugccuauaaucccagcacuuuugggaggccaaggcggguggaucaccugaggucaagaguuggagaccaaccuggccaacauggugaaaccccaucucuacuaaaaauacaaaaauuauucaggcaugacggugggugccuguaaucccagcuacucaggaggcugaggcacaagaaucacuugaacccaggaggcagagguugcagugagccgagaucaugccacuacacuccauccugggcaauagagcaagacuccaucucauaaauaaaaauaaauaaauaaauaaaauauaaauauaguugcuucuuaaaagcuauauggccucugaaagagcuguuugucaggagaaaauuaugaagaguugucauugccuguaagucauaauguucauauacaccgccaucacuuuaagugcauuacuggcacaacacauguuaaguuuaauugccauuuaaaauggcauccaguaugauagaaaauaugauaacucaguacugaaauaaaagaucuuugcauaugcaggaaggugcagaaacagagaaucacuuguagcauaagaacuacuggaaucuagcuuuuagauaaaggaaaaggcaacaucucuugugaaaugugagguuucacaauuucucaacaaauucagaucaucugaucuucccucugccagcacaaauguuaaauaaguauuugcacaagaauuuguugcaaacaaguuuucugagaugacaaaaacugguccauaauuaauauagccccacuccaguuuucuuuucauuaguguuugccucuuuuguuuguguuuguauauuuuuccaucuucuuacuuuaacuuaacaguaucauuauauuugaagugaauuucaaauaugaauuggacagcauagaguugggucauuuuuuucugacaacuucuguuaauucauauauuuagaccauucacauuuaauguuguugauauuuuugaaugacuuagaucaguuuauucuuuuuucuguuuaucccuguuuugcuuucugguauucuuuagagucauuacuauuacacuuaccuauuuugauuuuggcuauauuuuugcauagauguuuaaugauagauguuuaaugacugcuuagggaaucauaaugcauauacuuuucgcauuguaguuagaaucaaaauuuuaccacuucaaguggaauauagcaaacuuacuacaauauagucccuuuacucuccccauuuuauguuguauuuaucuguauguuagaucuacauacacugaaaaucccaucagacaguaucuuaauguuugcuuucacccaucaaauauuucaaagaauucacuaggaaaagaauagaccauuauauucacccagauauuuacuauuuacguuacuuuuccuucauuucugauguuuccaguucccuucugacaacauuuaccuucuguaaaugaaaaauuccuggaaaaauuauuuuagaggaagucagcuggcuacaaauucccuuaguuuuccuuuauacagaacaucuuuauuuaaccuucauuucuuaaggauauuucuacuggauauugaaaucuagguuggcauucuuuccauucagccuuuuaaacauguugugccacuucuucccuagcauuaauuucugacaaaaaaauaugcaguuaaucaaaucacuguuuccccauggauaauacauuuuuucccccucuggguguuuuucuggaugauuuuuguguauccacuguguuacaauugccuauaguauugagugcaguaacauguacaugcuguacagauuuauagccuaggaggaauaggcuaucccauauagccuauguguguagcaggcuauaccaucuagguuuguguaaguacacucuaugauauucacacaccaccaccaacugacacauuucucaggacauacaccuguucuuaaaggacacauuauguauucaugcauagauuuuuuucaguuuaucccauuuaugguuugcugaaauuacuaaaucuacgggcauuuaacuuuuaccaaauuugguauauauacaauuguuauuucuucaaauauuuuucagcauguacacuuucuccccucauucugggacuacaaugacauaaauauuggacuuuuuguuauuguugaauagguuccugaggaucuguuauuucuuguuuugaguaggaaggagcuaucuuuuguucucucucuucuucagauugaauaauuucuauugaucuaucuuuaaguuccuugucaucuucauugcacuauugagcucaacgagugagguguaauuuuuuucuugguuauuauacuuuuaaguuuuuaauuuuccuuuugguucuucuucauaucuuauauuucuuugcuaaauauuucuauaucccauuuauuaaacaguguuugugaugcuuguuagagcguuguuauaauagcuauguaaacaucuuuguaaguuaauuccaacaucugugucaucuucgcguuggcauugauggccuguucucaugcaaguucugguucuucauaugcucaguaauaauggauuguauccuggacauuuugaacauuauauuaugagccacugggucuuguuuaaauucuaaggagaauuuuuacucuugcugguuuagcagacaauugaccugguuacauccaggcugccaguucuuacccaccuucugugggcuuugauucucauuuugauuaagguuucaaagccuuugcaguguuauuugaaucugacuaguaagugccaaaccuaauggucauaugacaaccugggcaguugucuauuuacuaauucaguuccuaucaucuuugguaugcugauuaggaucaaauuagugcauaugcaaguaaggggugaucccaagaguucauaaacaacaucaaggauugcuuugucaagaucuucucucugcaaucucucuagcauuuuccaguugccuggggcuccugcuuuaguuaucccacuccccagcaugguuccagggcagaggccaugcaacaggagaauggagggggaaaaggaaaggagauucacuccuuucuuugggaucacagcucagcaaugaagaaaguucuucuuucucagaguuggcuccugcucaucugcuguuuccaauacaggauuacuuggggucuggggcauaagaaaauggaaaggaggggaaaacaaacuauuuccacacucucucugacauuacagcucacuuuuucauguucuuugcaccgggaauaaagagcauuuccuggauaucugcugcacugccuggugcucacuuccagguuucagguucaacuauacucaagugaaggaauaacuagagggaaaagcugguuaaguugacugccaguuagagguacuucaaauucagguguucuccccuaaaucucuuacuauuuacuuuucaaagucuuuuaauacaugcuucauggauucaugcaauucuguccagguaugaucaccgugcucgggguaagugggaaaaguguauuuacucucuccuccucagaaccagaaucuucauaucuaauuuucauagaugucauuuauuaagugcacaugagcaaggccuauucuaagugcuucacuucucuaacacuuuccaaaccccuaaguuguauacaaguauaauuacguauuauaaucuucauuuuauacauaggaaaacagaugcuuagaaaagauuaaggaccgugacagaguucaccuaccaauaagacuuacaguaggccuuaaacauuauaccuuggauauauuauauuuuggagcagguggucuaaaaacuugcuccaaaaucaccuacaguccuucuuaaaacugaaguuuccucuaccucaccccagacauacuaaaguaaaauguucgggaauggggcuaaaggacauuccuaugcauacuacauugagaaccaauguauagucucuccaguaaaagaagccuucagucuacauuacuuucaaaaggaugucaauauucaauauuucauauaggaauacccauuuggguggcauccaucagcuuaaaauagcuuacauaugcucacuuucauacuuugcuguaucaugguaaggaacauuaaguaggacuuguuaugaacaagguucacuuuauacacaacaagauuuucuggaaccucagacuugaacccaauauucuugcucccacuccaacuccuuacagugaaagcucacuaauauagcuccuccccaagaauuaucaaucaaccacuauaucaauucuauuuugggaagagacuaggcauaagucaauuccauucauuugucacagacagugcugccacauuucucaccaggaacuaaaguugucccaucuuuccugauggaguguacuugacgaaagaacaguuuugaggggcucacugugaagaacugggaaccccaucuucuauaagcccaguuugaauaacaaggcucugaguaauaaauaaauaugaguaaaaaaaaaugcuuagaagacauccacacgcuacacauaacugggaagggaagaaaaccuugcaucagaauggaggaacagaugauuuuucuuagguaagaagguguuuaggacaaguuuacaugugagggcauaauuacaaagauuugaaaaagucaaucagauugcagcauucacgcaggaugcuuagcuaauaauguaaauaacucaagaaucccguacacauaaaucuucugagaaucucaaagaguuuuacagacauuggauuaauggcucauaacagggauuaucauuccuaacucucauaugagaaaaucaaggucaagugugccauuccuaaggcccucugauagucuccuuuauaagcaaugucuuauaacacaccauaacaauaagucauauuucaguacuaaaacuucuggcaaauauucugcuuugaaauaagaaccuuuguugaaaacuguucuuauggauauuuaugaggaaguucaaaaguguuaacuugaucggcaguaaugaaucaaaaauacaaagaauucaguacaguuauuuucaaaacuaaagaguaugucaaacaguaauuuucacugccagguccucccacccccaaccccacgacuuucuggagaaagaaaacuccaaaacauauggcccaggaagaaaaucuguacucguuuauagcaaugaacuggcuuauacaucucugcaguuagaguacgcaaaugacuucacaggcaacagcuuccguauguuucauauuuuuaacauugaccguucauaauaaagauucuuugaucccagaucaaauguuugaaucgauuuucccuacacuuacucagagucaccauuuaaaaggcuccccucuuucccaccucagauguuucagcccuuccugcaaucagaacuaucuccauuugucagcuucucccugguccuucccaacccuuugcugugguuuuuagcucugcucccuaccuucucauacaaaagaggcacaguaauaaguaauuucuguacauaauaaguuaacuacaguaaaugagauucaggauuucauaggcaucucuuuuuuuuuuugagacagagucucccucugucaccuaggcuugagugcaguggcgcaaucucggcucacugcaaccuccgccucccggguucaagcaauucuccugccucagccgaguagcugggacuacaggcgcauggcugccacaccuggcuaauuguuuguauuuauuaguagagacaggguuucaccuuguugcucaggcuggucgagaacuccugagcucaggcaaucugcccaccucggccucucaaagugcugggauugcaggcaugagccacugcgccuggcccucauagucaucuuuaauaacacugaaagcucaugguaaaauuuaguauaaaagcugauugucucucaaaaaaaaaaaaagaaaaaaauccuuaacagguaaggccuuuggauauauuuaagaaaaauaaaaauaaaaaugaaauucuauuacuuggauuaaaaccagaaaaaaugaacagauaccuaaguucuaaaauuaaaacaaaacaccaaagucuugauaacuaauauaaacaucaaguaaagaaaaaaaaagucuaguaggccgggugcagugguucacgccuguaauucuagaacuuugggaggccaaggugggcaggucgcuugaggucaggaguucgagaccacccuggccagcauagugaaaccacaucucuacuaaaaauacaaaaauagccaggcaugguggcacgcaccugucaucccagcuccucuggaggcugaggcaggagaaucgcuuggagcaaggaggcagagguugcagugauccaagauggcgaaguuuaguaaaugcuacaaguuuagaauaucccuaagaauaaauuauuuuaaaugauuccaaggucuuuauuuuaaggccuuguugagaaggaacaauuuaauauaaucuuaauuccuaaaaccuugaaacauaaauucuucagaaagguacucauuaaauaaagguuaaguugaaaaaaaguuuuaaaauuuccaguaguaaauaaaauaaauaugggaguagcuuaacuauauaugguuccaauuaaccugauauaguaaaagagaaggagggagagaacgaaaggaagaaaggaaggcaggaagggaaggagggaggugaaaaaaagaaaaaaauaccaguguuaaaggucccucuaaaaaugauucccccauuuuguuuggaaugguaggcaggucaaguuuuaggacaauuuaagcuacuacgauucuucacuuuaaaauacagccaaauaccacaaaaaacacagaaugcuaauuuggacucugccuuauccuuuaugcgcaugaauauccuauacuuuuaguugcuaacacagggggccuaaguugguugugaccugggcaaaacugaacuuucccuggcuuuguacaaaaucaucgaccaaucccaauaauuauagauuaccuugcagacgguggcaaacugcugguuauuuccugcuccaacuacaauauagccauccuugguuuuaaaagccuaaaagaaauaaauacacagguaaauauuauuuauauguugacaagaccacaaaaguuuaauuucuaaaauaucuauauagaaagcuuguucuaaagcaauguuauuaauucaauaucgauuaauuuguaucuuuuucauauauguauacauauauaucuuccacaaaagauauaauauauauauacacacuaacuaaaugucaaacagucaauagccacauguggcuaguggcuauuguauuagccagcacagacggaauauuuccaucaucacagaauagaucucucucucucucucuuucucucucucucucucucucucuauauauauauacacacacacacacacacacacacacauauauacacacacacacacauaugugucuauguauguauguauguauauaugaguguguguguguguauguauuuggugacagggucugucucugucacccaggcucccaggauggaaugcaauggcacgaucucagcuuacugcuccaccucccagguuuaagcaauccuccugccccagccuccuguguaucugggacuacaggugcauggcaucaugcccagcuaauuuuguacuuuuuguagaaauggggucucacuauguugcccaggcaggucuuaaaccccugggcucgagauccgcuuaccucagccucccaaagugccgggauuacaggcaugagccaccaugccuggcccuuuuucuuuuauauuuggauaguugguuucauuuagaugguucuaagcauuuccuaacucuuccacuguuacaacauuugucaaaaaaacaaaaaagagugauucaaaaaaauaaaggaaauccauuauaauguacaaaauaaaauacucuauucauuaugguuuggaacaauuaagaauuuuuuuguuuuauuuucauuuuuucccuguagggcaaaaagcauuauaaggcaaaaagcauuauguuucuacaaaguguaagaagcauagauagaaagaagggagaagcaaaggaaggagaaggaaggaaggaaggaagggagggagggagggagggagggagggagggaacugggagagggaaggaaagugaccucauggagcuacauugcuucuuucaagaacucaaauguaaucuuuugggcacucuuuaauuuuaguggcaaaaauggacacaucaguaucucucuggaccucauguggcuuuauguaccuaaaaaugucuguccuuuuuuggugacagguuccuguggacagcgauggacacucuaaccacccacaguccuagcccauuggaggauguuuuagcacuucuuucuccacauaugaucacagugaaauuggaggaaccaaauuuuacccucagaaggccucauuccuacuuccccaaaguaaauuagcuauuugaauuuucauccuuucuacauaaaaacugugcuguaucuccaccuacuuuuucuucacuuccuccucccuuuaagaaaaaagacuguuuuccuugacuggacuuacuccugggcugaucaccuccaccugcauccuccagaacuugcuuaaucaucuguaaguucuucauuuccacugaauccuucucuucugccuacauauaggcucaguucuccauaaaaauaccauuaacaacaacugaagagaauuuugaucaaucccaacaccccuuucaagguaucuugaauguuccuuuguucccuucuucuauaaugacauaagagcgccaccugcccucacuuccccaccaagaccacauucuagugaccucugucaucgggauacuuacuaucacacugaacuauacuuuuugaacccucuguauuauuugguacuguuaaccauucccuccuccaugaaagucucuuaucuucaggcucuguccaaguucaucuccuagcucucuguuuuacacauacccuuucugcaggauuuucuucuccugagccuucagcauuccuuaagcaucugucuuuggucuuucacuucacuugcuucuuacauuagccacuagccgcaugugaucauuaaauuuaaauaaacugaaauuagccagucacuaaaggccaaauauugugauucuauuuauaagaaaugucuaaaauaggcaaauccaucaagacagaaaaaaacacuaguggcugcauaaagcaguggaagcugggggaagauggggagugauuguuaaugaauacuggguuucuugucaggguaaugaaaauguuccaaaauugacugaugguugcacaacucugaauacacuaaaaaucacugaauugugcacuauaaaugggugaauuauaugguacaugaauuacauuccaauaaaccuguuauuaacaauuaacaauucagauccauagucacacuagcuaaauaucaagcauucaauagccacguguggcuaguggcuacuguauuagccagcacagacacagaguacuuccaucauaacauaaaguuauuuuauacagugcugguagaguggaacugggagauuguauuggucaugucuuaauuucagucuucaucauccuaacaugauaucugaagaauguuaggcaauuaauaaauaguugguaaaugcuaaugaaucaaccaaaugauugcuuccagauagcacaaugguaacuaaaauagaucccaagaaauacauuauaaaaagguuuuauucuauuuacauuguugcuugauuugguaaggaaugcuauuaaggagauaucacauaaacucuuucaaacauucucccuuguccaugagggcaaaaguaaaguuagugucauagacaaugcauuaguguuucucaacuacagaaagaaaaucugcaacaaagcuguaggugagguacaaaagauuuugagcugaaguauugcaaggaaccauugacaacugugaaguuacacagguuguuugcuugcuuuuuuguggagaagggugagauggggggcgaauaaguaaaugugaaguaacaaucuguguuggaauauauaaugugaagaaaggcuugccaaauuuuggaucagugauauguccaauaaguuuauauuuucugggcuguucauuuccuuuuaauaaguaaagaaaugcauauuuuucccugcagccgccaacauauauuuaaauauaucuuuuaucaauauaaaaguuuaaaauuuuuaagaagauucuagauagcugaacaugcagagguuccugaaggauggcaugcccugggaggaaauggaagcuccauaccccucccuauaccuuacaauacacaucucuucaucuguacccuuguuaauauccuuuaaaacaaaccaguaaacauaauaauuuuaugcaaagguaacuagucaaugaucauugaaaagugaagaacucauggcaacugagccucagaauauaaucagccuaaagauuaucaaauagauuuuauaaagauucagguaagauuaggaguucuuuuuaauaauuauuuguucccuguuacugcuacaguauuuauuuaauaaacaucuuaaauaagaacuuuaaaaaauaauauguuauugaggauuuuugcauagauguucaucauggauauuggucuaaaauucucuuuuuuuguugugucucugccaagcuuugguaucaggaugaugcuggccucauaaaaugaguuagggaggauucccucuuuuucaauuguuuggaauacuuucagaaggaaugguaccaguuccucuuuguaccugugguagaauuuggcugugaauccgccugauccuagacuuuuuugguugguagacuauuaauuauugccucaauuucggagccugauauuggucuauucagggauucaacuucuuccugguuuagucuugggaggguguauguguccaggaauuuauccauuucuacuagauuuucuaguuuacuugcauacagguguuuauaguauucucugaugguaguuuguauuucugugggaucaguggugauauccccuuuaucauuuuuuauugcgucuauuugauucuucucuuuuuucuucuuuauuagucuugcuagcggucuaucuauuuuguugaucuuuucaaaaagcuagcuccugaauucauugauuuuuuuaaggguuuuuugugucucuaucuccuucaguucugcucugaucuuaguuauuucuugccuucugcaccaaaucaagcagcacuucaaaaagcuuauccaccaugaucaaguuggcuucaucccugggaugcaaggcugguucaacauaugcaaaucaauaaacauaauccaucacauaaagagaagcaaagacaaaaaccacaugauuaccuccauagaugcagaaaaggcuuucgacaaaauucaacagcgcuucaugcuaaaaacucucaauaaacgagguauuggugggauguaucucaaaauaauaagagguauugaugacaaauccacagccaaugucauacugaauggguaaaaacuggaagcauucccuuugaaaacuggcacaagacaaggaugcccucucucaccacuccuauucaacauaguguuggaaguucuggccagggcaaucaggcaagagaaagaaauaaaggguacucaauuaggaaaagaggaagucaaauugucccuguuugcagaugacaugauuguauauuuagaaaaccccaucgucucagcccaaaaucuccuuaagcugauaagaaacuucaguaaagucucaggauacaaaaucaaugugcaaaaauuacaagcauucuuauacaccaauaacagacaaacagagagccaaaucacgagugaacacccauucacaauugcuucaaagagaauaaaaugccuaggaauccaacuuacaagggaugugaaggaccucuucaaggagaacuacaaaccacugcucaacgaaauaaaagagaacacaaacaaauggaagaacauuccacgcucauggauaggaagaaucgauaacaugaaaauggccauacugcccaagguaauuuacaaauucaaugccauccccaucaagcuaccaaugacuuucuucacagaauuggaaaaaacuacuuuaaaguucauauggaaccaaaaaagagcccgcauugccaagauaauccuaagccaaaagaacaaagcuggaggcaucacgcuaccugacuucaaacuacacuacaaggcuacaguaaccaaaacagcaugguacugguaccaaaacagagauauagaccaauggaacagaacagagcccucagaaauaauaccacaaaucuacaaccaucugaucuuugacaagccugacaaaaacaagaaauggggaaaggauucccuauuuaauaaauggugcugggaaaacuggcuagccauauguagaaagcugaaacugggucccuuccuuacaccuuauacaaaaauuaauucaagauggauuaaagacuuaaauguuagaccuaaaaccauaaaaacccuagaagaaaacauaggcaauaccauucaggacauaggcaagggcaaggauuucaugacuaaaacauuaaaagcaauggcaacaaaaaccaaaacugacaaaugggaucuaauuaaacuaaagagcuucugcacagcaaaagaaacuaccaucagagugaacaggcaaccuacacaaugggagaaaauuuuugcaaucuacccaucacacaaauggcuaauauccagaaucuacaaagaacuuaaacaaauuuacaagaaaaaaucaaacaccccaucaaaaagugggcaaaggauaugaacagacacuucucaaaagaagauauuuaugcagccaacagacacaugaaaaaaugcucaucaucacuggccaucagagaaaugcaaaucaaaaucacaaugagauaccaucucacaccaguuagaauggugaucauuaaaaaguuaggaaacaacaggugcuggaguggauguggagaaauaggagcacuuuuacacuguuggugggacuguaaacuaguucaaccauuguggaagacaggguggugauuccucagggaucucaaacuagaaauaccauuugacccagccaucccauuacuggguauauaccuaaaggauuauaaaucauacugcuauaaagacacgugcacacguauguuuacugcggcacuauucacaauagcaaagacuuggaacuaacccaaauguccaucaaugauagacuggauuaagaaaauguggcccauauacaccauggaauacuaugcagccauaaaaaaggaugaguucauguccuuuguagggacauggaugaagcuggaaaccaucacucugagcaaacuaucacaaggacagaaaaccaaacacugcauguucucacucauaggugguaauugaacaaugagaacacuuggacauuggauggagagcaucacacacuggggccugucaugguguggggggaagggggagggauagcauuaggagauauaccuaauguaaaugacgaguuaaugggugcagcacacaaacauggcacauguauacacauguaacaaaccugcacguuguaaacauguacccuggaacuuaaaguauaauuuuuaaaaaugagcuuuuuauaagaauuugggacuuuuuaagcuuuuuaacaagguuuggaaacuaccaaauuaagccauuuugcaagucccaacucccagguaaaguauaugagcuagauuaccaucaacaacuuuucuaguaaagaaggcauuaaaugguccuauguaaagacaaaaauaaauaaauaaaacauaauauguuaucacuguagaaaauuggggaaguacagaaaaauauaagacggaaaaaaaaacugcaugauaucaucacccagaagaagcaacuauuaaguagcauucuucuuucuaguuucuuuguauguguuuuuacauuauuaaggaaacuacuuuugagagaaauaugacagaaaaauuauuggugagugaaaucuaaccuaacugacuccaucuuguuucuaauuucacaagcuaacugacuucuuuaacuuuacagucccuuccaagagcccuccuugcucagggaucaaaacugccuuuuaagaguaaugaaagaauacaauauuagcauuagagaagggacuugaauucugcuaagauauggcuuaaugaaaugauaaccagcauaguucccuugcuuaccuuucuauaaggauuuacuauuucagaagucaaaagacgugugacuuccuaagugcuccuauagauaacaucacuaucgucaaaaccuccuaagauuggucuuugaaauauuuuucagacuuugacauucuggcgaaugacuuaacucuacccagacccaugagucauaugaaggaaguaauacaaccaguccugagaccccccacccagaaacucacucagaguacuaagauaauuuggacacugcuaagauuucauccccaaccaaucagcagcaccaaaucccucucccucagccugccaaauuacucuuuaaaucacuaaacuccaagcuguuugggaggcugacuugagaaaugucucccauacuuccaaacucccauacucccauacuucccacacuuugcuggcccugugauuauuaaacucuuucucuacuguaacacugcuguuucagcaaauuggcuccaucucugcaacaggcaagaagaacuggucaugcaguuacaugaauaucuuacuauacaugaauuucuggacugcauuuuuuuaacauccuaucacaagcauuuuuaaauagcauuguuuuuaaugacacaaaauaucuuuuucaaaauuugcuucaacauucuaaguucauuuaaacuggagggguuuuuuuaguuuguuuuguauucaaaucaagcccuauuucauaguuaauaucacaaauaaaaaauuauuaaauuucauacugaaacucugaagaaaaugucugguccaacuaagauccuuaaaaagccaaccuuaccccaguaaggccuggaggauaaaauagcaaaaugaaucccacccaagacauuuauuaauaauuaaccugugugauauuagacaauuuacauaauuuaagagccucaguuuugacaucucuaaaauaggaaucaucaguacuuaccuuuaaaauuauuuugacuaaguucauaaaguacauugauucauguacuuggcaaauauuuguugauauaacucacuaugugcuaggcucuggguacaauggguagaaaaugacaagacaaaugagacauacauucuaauaaaguagcagacacuaaucaaacauucacauaaguaauuacaaacagugacaggcacuggaaaagaaaaguacaaaacccagugagaucuuuuuuuuuuuuaaagacagcaucucucucugucacccaggcuggaguaaacuggcauaauccuagcucacugcagucucaaacugcuagguuuaagagauccuccucacauagccuccugagucgcugggacuacucagauggagucucacuguguugcacaggcuggucucaaaauccuggcuucaagcaauccuccaaccucagccccccaaacaaugagaucuuaggagagguggacauaauguugucuugguugggagcgcugaagccaggaaagagucccuagaaaagugauccuagaaaagucccuagaaauagauugagaugguaaaauuuacugacuugguaaauaucaugaauaucaugguugagaguugaaaucuaagggggaaaaaggugucaugaugaugcuuaaguuucuaaggagcuuuugagauaguccagugacaaguucacaugaguaagacuuggguaccaggugaaagucugaacuguggauaaaaacuuggcugggugcaauggcucauuccuguaauccuggcacuuugggaggccaaggcagguggaucacuuaaguccaggaguuugagaccagccuggccaacauuagcgaaaccccgucucuacuaaaaauacaaaaauuagccaggcguaguggugcaugccuguagucccagcuacuugggaggcugaggcagaagaaucacuucaacccgggaagcagagguugcagugaacugagaucaggccacugcacuccagccugggcaacagagcaggaaccagucuuaaaaaaaaaaaaaaaaaaaaaaaaaaaaaaaacacacacacacagacaaaaaacuugacucauuugcuuauuaucuauaauugaagucaucacauggaccaaaucauuuaggaagaaaguucacacugcagaguaggaaaaaaagggaguuaagugaggagucugaaggccucucccauuugaaauccaggcagaaguacucagagcguaagaugaggacugaagaaugccuacaaaguagacuuccauuacaucagcaagaggugucuggugucaugaugcgaacagaaugcaguuugacaugaaucacggacuccauaacuguuaaggaaagggagcaagcacacacagacaucuguuugagcagucuggcugugaagcgcagggaugagcacggacugaaagcacagcaugagcauggcugcagauggaguucccaugucgaggaggacucaggaaguucccacuggaugcuucuaccuucuuauuaacugagagaagauuggggaguuaugagaaugaaagacuaaaaaagaguagagaaguucugacauaucacugaagacaguggcguagcaccgggaccaguuaacacaacuggaauacugacauguugagagcccaacugagugacuuucucuaucaucucucagcuauccagacauagacuaaaguauauuuacauucacuagcuuuaggauguugccagauggauaugacaaaaagauauauguguaggaaaauccgccagaauguuacugagcaaugagccacagacuagcugcauaagaaagaaagugguaaagauaggagauuauggcuaggcauggggaggugucucagugggucagaaguccugaugagguguaggaguagucacgaugggaguagcugaauaaguaaggugaaagaacaagagacgauggaugguuagaauguagaaugcuucaaucagugauuaaaggagugaggcagguucggguuaugccuagagauccacagugugaaguacauaaaauaguugcugcuaugagacagcagcaacucucucucucucucucuauccauauauauauauauauauauauauauauauauauauauauauauauacaccauauauauaccauauauauauauaccauauuauauauacacacacacaauuucuacauauauacuuucuauauauacaguaguauauuauaguauauuauaauuauuauauaauuacuacuguacuuggucccacaagaaaggaacuccucagugaauucuaagcccuuaggucuugacucccaggccuucacuggcccugcaaaucacuccuccuucucuucuccucauucuguugguugccucacucuaacagaaagcaaaccaggugauaacaugccgugcacacacaccacuaccagauucuuuaucacagggagagcucaaaucauacgcagcgaauugggcuguaaacagucaggacugucuccuguaagaaauucaagaaacaauugcuucugaaugaaaugauguggggagacagcagcaagggcaagugucuagaauuuuuaaaggacaaggucaaaaccaagcauugccucacaggagaccagauuguauuacucccgaagaaagacauccuucucacuagaagcugugcaaauucuggcacaacaaaauucacugauagggaaaccaaacacaaaugcacauuuucaucauacgcucaucgugagaaaccuccucuccuggagagggagaucuuuuacaagacugagaaaauaaugaugggucaaggaauuugaugacacgacaaaacuaaagaacuucaugaucaaacuaggagacacaaaaggagagggaauggagguucaguguuuaguuucucuauuuagagcagcuccacacagaagaugugaccaccccugagauauaagauacagaagugcagacuguggagcagaugugaaggcggggaauugagaaggucaauugagaauuucugcugcuccuggaaguuucuacuccuucccagggacuuugcuuucugggcuuccaggcauguuagccucauuugaugacauccuaauuauaaagcugacuaaagaugaaaacauagggguuucagaaguccaugucaacacaauauaucauauaaucaagugggaaaagaaaaaaauguacaacucgaaguuccuauguuaucuucuuaaguuacuucaucagugcaucuaguauuuucccuggcuuaaauaaaauacaaaaaauuuguaguaugucuacuucaaaacaagagcauaaacuucaaggcuucccagggcuacuuacuuuuuaacaagauuuucuuccacaaaagguaaccauugcuaaaugacuucaucacccacuggaaaaagacauuccaugaaguuuaacuuaccgccaugagaauguuuucuggaaugccaagcaguuauugacuucugggucugugcuaguacaucaugacaaacauagagcacuauuuccuaccacugacaguucaguucaccuuauggcacuggaacugggcugagccagauggcaaugaggcacagacugcucugcuuacaaauuaagaacagugucaucuauggauggaacaaugccacaaaugguagaugagcccuggagucuccaacuucaccuacuaccaauuuggcauuggcaggacauuuuuuacauggaacaaaccauguugagagcucauugcuaaauauaagcccuugcuuugaauuagguaauucuagaguaaccuugaaagcaacauuauauacugauuuccugccccagauccaggcuagguuuugcuaauuccauaauaggaaauuggaaugcucacauauauccuugagguuccucaaauaaauuaaauuuuacuuccaauccaacauauguaggauuuucaaucacuccauuucugauacuggguguggagguaaugacaaggagggaaaugggcaacugccucauauauuuucuauucuuuacguguugucaauggauauuauuuuucucauaaagaaaacuuugugugaagaaagccuagaaagccugcuguuauucaagaaggcaguuaucauguaucuugggcacaagguaaaaugacacagaguuuuucuuccugaggaauauaggccaaaaacugguuuuaagaaaccugaacuaacuguauuauaaagaaugcuaagccagauuauuuugaauagccugccaaaagcagcuacugcuucacagaaacuaugcaaaaaaaauucuagacaagagaccauauugauuuuucagcaacaccccaagguaaaaauuccaaaagaaugcuaagccagauuauuuugaauagccuaccaaaagcagcuacuacuuuauagaaacuacacaaaaaaugcuagacaagggaccauauugauuuuucaggaacaacccaagguaaaaauuccuugagcguaugaaauauuuuuaaguacucuuuguuguaucucaaacauguuacaauaaucacaguucuguaccaucuauguaccauauaugaaaauaucauuucugacaaagccuacauuuaccucagacuaaaggcauuuauagaacagagcuuuagucaagcugucaccacauuucacuaccuacaagcaaagaaucaagcuagaaaaaaauaguaacuauaguuacaauaaaaauauucuaaauuggcuuauauaguguauugccaauaauguuucccaagcauaucuguucaucauaucucuggauuuaucaaugagaaaacacagaguauacauagugagacagagauugggggaggcccugaaauuaggccugcccacuagaccuaaaguggcauuagaguacaggcccaggugacagcagaguuucaucccagaguauggaaaauuugaguaagugcaguacuaggaagcagucauggccagguaugguggcucaagccuguaaucccagcacuuugggaggcagaggugggaggaucaccugaggucaggaguuugagaccagccuggccaacaugacgaaacccugucucuacuaaaaauacaaaaauuagcugggggugguggcgcgcaccuguagucuggcuacucagguggcugaggcaggagaauugcuugaaccuaggaggcagagguuccagugagcugagauugugccacuguacuccagccuggguaacagagcaagacuccaucucaaaaaaaaaaaaaaaagaaaagaaaagaaaagaaagcagucagcaagauaaaguauggcauaugggagaugaaaaauuuugauagcaaaagucuugaaacucacaguaguuaaauggcccaagagauauauagagagucacaggcugcaggaucccagauaugaggaugaggcucagaaacucagcaccaaauucucauauaaggaauugugauagcaaggcaaagcguggagggacaggaaccagacaguuaacucaaugagaaacucagagaauauaggcaaaagcagaagcccaagccauugaacaaagguagagcaagcauggagagugagcucuggggaggguagguggcugaauaucagauaagagcaacuuaaaugcuaguucaagaugcuaguuaguuaagcgucuaagacaguaucugggauauuagaacccaauacacuuuuuaaaucaaugucaaugugucacagcaacccagguaauucaggaaauaugagacauuauaagccuugguggcaaaacuguaagcauaaaauagaggagaguuucagagaaucaaagauaaggaccaacugaaaaaggcaagcaugcuaacaauagauuccccaaacuuccuuccucacagaugaucacccaaguuuaaggaugaauauuaguuaaagugacaugcugaauauacuucuaucaggauuuauagguauguccuauaguuggaacaaugaggaccucaguccuucuuauuagauacuucucauucuucuuaccauggccaaaaguuggccuugaagcauagagggucagccuuuguacccuuuccacauagcuacuaccaaguaauaggauauacacugauaauaaaauauauuugccauccaaauuuggguuccuguacagaggguuggaaucuaaaguauacagacucucaaaacaucuuucggcuuggcgaacuaugggaagugugaauggcuacucagcucauucagcagaaaaugaguccuuaugggaggguccugcugacccacagcagcaggugaaauucucauggaguaaccaaauauuaaaacaagucaaccccagcaucagaaaaagcauaggggaaggcucuaucugauauauguauagacauuuauaacugaaaaaaaugauggaaaagguagcaggcaacaagcaccuggcaggaccuugaggagacugccauauuccagggucuggacuuguucuuuauaggacucacuucuuguacuggaugaucagaucuggaagccuaacucaaggcaucuaaaaugcaugugagauuaagauagauaccagaaggauaaauuacuacuauaugauuagaaagaacuauaugauaagccacaauacuuaaagacuauaugacuaauucuuuucuugggaaacuaauaauuagaagguaaaagaucacagacaugagcaugguuuaaguucuuccuucucaaguccccaugaaucuggauaugaaguucagccugaaucugccaaugaaaaaaucauuacaccauucuaugugugacuauaggaagagaaaaaaaaaaugggaccagccuuauucaacagaaggaaccaugauaaacugcuagaagauuaaggucuccaaauguaccucaacuauugaacucuaugaaauacaagaaaaaacaagauacaaucugaauaguauucuguacauaccuuucaaucauuaguuacucaaaagaauuggacucacaugggcacaucuaccaugauuaaggucaugagaguguuauguaagguuugcaacaaaauuuagaccaacuaggaaguuaucccuuccaaaguaaguuaacagcagaauaaaugggaacauuccuccaaaacaacacgaaaaaaauuuaguaagucauccuaguaggucacaaggugaagaaagcaauaauuauuuccagaucucuaaaaccacuuauaauaacauaugugguauguauaugcccgccccaaaguuauuauaacagguuauauuaguuaaaagaucaaggguagccaagaaauucuguuugauuuuagaguucauuuaucugugugaguaauuauuauauuucaguuucucugggauuccuguucuauaaauaaagguggagaauauguaaauauuuuuaugcacaauaacagaaugugcugaaaauaauuuaucuuugcaugccuccccaaauacuauaauucuucuucccaauuacauuagauacguuuaauuucuauuccaccccaaacaccuuaaagaagcagcucuauacaucaugcaacugagcauuccucuucccugguugaagagaauagcaugagcaccacucccaugccagccaguagguuuacuuggcacaaaucaacugcaucagcuugaagauucaaaaggaaacaggaagguggagaugagauggccauauucggcuuaacuaaguaagaccaaaagacuaauaaacucuaaaacugagacaagacuacaaaauagaaauagagauauggacuaagcaacugccucauuccuaauggcaucuuacaucuugugaaucugaauuauaugucacauacuuuuugaaacauguggauaucaacaagaaguuauaagacaaaaaaaaaaagaaaaaaagaaaacaugacccaaucaaaggaccagaauaaauaacaaacaaaccuaaagaagcagaggcauaucaauuaccugacaaauaauucaaaauaaucaucacaaggauguucaauggccucaggaaaacgauacauaaacaaaaugagaagcuccacaaggagacacaacacauaaugaagaaccagacauuuuggaccugaagaaaacaaucccuaaauuggaaaauugacuacagagauucaauagcagacuugaucaagcauaagaaauauucagcaaacucaaagaugggucauuguaaauuaucacaucaaggaagcaaaaagaaaaaagaaugaaaaaagagaauaaagccuagggacuuacagaauaccaucaagcggauccauaggcacauuauauaaguucacaaagaagaaggagagagagagagagaaaggauaaaguacuuauuugaagaaauaauggcuaaaaacuucccaaaaucagggaaggaaauagacauccagauucaagaagcccaaaacucaugaacuaaaauaaacacaaagaaaucuacacugcaauacauugaaauuaaauuguccaaagaccaagacaaaaggagaauuuugauuuuuuuuuuuuuuuuuuuuuuuuuuuuugagagggagucucacucuguugcucaggcuggagugcagcggcacaaucuugguucacugcaacauccaccucccggguucaagcaauucuccugccucagccucccgaguagcugggauuacaggugcccaccaccauacccagcuaacuuuuguauuuuuaguagagaugggauuucaccauguuggucauccuggucucaaacuccugaccucgugaucugcccaccucggccucccaaagugcugggauuacaggcguaagccaccgcaccuggccaaggagaauuuugaaagcagcaagauaaaauugacucauuauguacaaaagagucucuauaagacuaucaguggguuuguucagcaggaaccucacugaccagaagggaauaggauaauguauugaaagugcugaaagaaaaauucuaaccaagaauacuaugucagcaaaaauauccuucaaaaaugaggaaaucuauagaaggaaaguuccucaacauaauaaaagucacuucacuuuugaaaaacccauagguaaaauuauaaucaauugggaaaaacugaauguuuuacacuaagauccaaaacaaagcaaggaugcccaaucucaucacuucuauucaacauaguacugaaaguacuagaaaaaacagucagacaagaaaaagaaauaaaagacauccacaucacaacagaggaaguaaaaauaucccuaucugcagauaacauaauccuauaugggggaaaaaaccaacaaugauuccaccuaaaagaaacuauuacaauuaauacacaaauucaguaaaguugcaggauauaaaaucaacaaacaaaaacuaucagcauuuuauacacaaauaacaaauuaaaaagacauuuuuaaaaaucccauuuaugacggcauaaaaaauaaaauaucuaaauagaaccaacacugagaaugccaauaaaauacaaacugaccuuuaaagaguuuacaccauuuacaauaacaugaaaaacaacaaaauacuuaggaauaaauuuaacaaaggcagugaaagaacucuacacugaaaauuauaaaauacugcuuaaagaaacugaaaacagaauaaaagaaaauauagccuaugcucauggaucagaagaauuaauauucuuaaaauguacaugcugcccaaagcaauauacagauuucaauaaaauuccuaucaaaaucccaauggcauucuucacagaaauagaaaaaaaauacuaaaauucauauggaaccauaaaagaccccaaauagccaaaacaauucugagaaagaaaacaaagguggaagcaucacacuuccugauuuaaaauuauauuacuaaucuauaguaguaaaaacacuagauauugccuuaaaaacagacacacagaccaguggaaaauauagacaacccagaaauacugaauaauaccaaacauaugcugucaacuaauuuuucccaagggcacagagaagacaaaauggggaaaggauagucucuucaauaaauggugccaggaaauucaguauccacaggccauuaacuuuuuuuuuuuuuuuuuuuuuugagacgaagucucacucuguugcccaggcuggagugcagugcugugaucuuggcuuacuguaaccuccgucuccuggguucaagagauucucgugcuucagccuccuguguagcugggauuacgggcaugugccaccacgcccagcuaauuuuuguauuuauuuuaauagagauaggguuucaucauguuggccaggcuggucucgaacuucugaccuccagugcugaggcccgccucagccucccaaagugcugagauuacagguguuagccacagugcccggcccacaggccauuaucuuaucccugaaaaaaauaaacuaaaaauggguauaagaccuaaauauaagaucagaaacucuaaaacuccuagaagagaacauaggcaguaauuuguuugauaucacaccaaaaacuaaggaaaagcaaaaauuaauaaauuagacuacaucaaacuuaaaagauucugcauagcaaagaaaaccauaaacaaaacagaccagcaacuuagagauugggaaaacaaucuaugcaaaacauauaucugauaagagguuaagaucuaaaauugauaaagaguucacgcaacucaauaauggaaaacaaccugauuuuuagaaggcaaaaagcuugaacagguauuucucuaaagaagacauaaaaauagccaacauguacauuaaaaggugcucaaaaacauuaaucaucaggaaaaugcaaauugaaaccacuaugagauacugccuuacaaccauugggauagcuacaaucaaaaugucaaaagauaacaaauguugguaagaguguggagaaaggagaacucuuguauaccauuggugaaaauauagauugguacagcuguuaugaaaagcaguauggacauuucuuuaaaaauuaaaaauagaacuagcauaugacccaguaaucccucuucugagcauauacccaaaggaaaugaaaucaccaucuugugaagauaccuacacucccauguucauugcagcauuagucacaauagccaaauauggaaauaaucuaauguucaucgauaaauaaagaaaugguaguaccuacacaaaauauuauauuguucagcuuuuaaaaaagaacaagaacuugcgaaaugccacaacuuagauaagccuggaggauaucaugcuaagugaaauaagucagacacagaaagaaaaauauugcauaaucucacuuaauauguggcaucuaaauuucuaaaaauccaauuauauacagagauacagaacaaaagagaggguacuaugugugaugguuaauauuaagugucaacuugauuagauugaaugaugcaaaauauuuuuccugggugugucugugaggauauugccaaaggagauuaacauuugagucagugggcuaggagaggcagacccacccucaaucugggugugcaccaucuaaucagcugccagcguggcuaggauaaaagcaggcagaagaauauggaaggaauaaacuggcugagucuccuggccuccaucuuucucccgugauggaugcuuccugucgucaaacaucggacuccaaguucuucagcuuuuggacucguggaccuuugaccacagacugaagguuggcugcacugucagcuucccuacuuuugagguuuugggacuugaacuggcuuccuugcuccucagcuugcagacagccuauagugggacuucaccuugugaucgugugagucaauacucauuaauaaacuccccuuuauauauacaucuauccuauuaguuaugucccucuagagaacccugacuaauacaccaugcaugggaagaagggaagacaauacagagaugcaguucagaggauacaaaauagcagauauacaggauuaacaaguuaagagaucuaauguacaacauaaauacuauagguaauaaaauuguacuguauaugagauucaugcuaaauguguagauuuuagcugcucuugccacaauaacaaaaaaaaaacgguaauuaugugagaugauggauauguuaacuugcuucacuauaguaaccauuuuauucucuauauguaucccauaacaucaugcugcauaccuuaaauauacacaauuaaaauuuuuauuuuaaaaagaaaaaaaggaggagaaauaagaacugucccagauaaaagcugagggaauucuuuacuacuagaccugcguuacaagagguauccucucaauaucugccuuaaauggaguccaccaagguaaaaggaaaggacauuagauagcaauaugaaacagugugaaaguuuaaagcucacugacaaacauauagacaaacaaagaauacuguaauacuguaacauugguauguaaaccuuuuaaugcugguaaagaaguuaaaaguuguaagcauaaaaaacaaccaugacaauaaaacagguuaauggauacacaguauaaaauagcuguaaggugugacaucaauaacauaaauggguggagacaauauaguuuuaguaugcaauuaaaguuguuaucagcuuaaaauguauugcuauguuuuacauaaggcccacaggacacacacacacacacacacacacacacacacacagcagagacagagaaagagagagagcaacuacaaaaauaaauuaaacacaaaggaauacaacaagacaggaaaacacggggauaagcuacaagccagacagaaaacaauuuaaaagugacaagguaaguccuucccuauugguaauuacuuuaaaugucaauggauuaaacuccccaaucaaaagacauuaaagugccugaauuccaaauuucaaaaauccaacuauaugccgucuacaacagauucauuuuaaauuuaaggacacacauaggcuggaagugaauggaugaagaaaggaauuucaugcaaaugucaacuaaaagagggcagagguagccauaauuacaucaggcaaaauagauguuaggucagaaacugucacaagagacagagaaggacauuacagaacaaaagggucaauuuaucaggaagauacagcaauuaugaaaauauaugaaacaagcacugauggagcaaaaggaagauaaagagaacaccacaauaauacuagauuucaauaacccauuuucaaucucgaauagaacauucagacagauaagaggaaacaagacuugaagaacacuauggaauaaauguaccucacaggcauacagagagccuccuacccugcaucagaauaggcauucuucucaagaaccacuggaauauucuccagaguauguuagggcaugaaacaaaauauccaaaccauaucacuccccaucuuccuucuuugacucucccuucccagaugucauauccugcauuacaaucggaaggccucucugccuauucuugcuccauaggaauuccucccagugagccccuggcaugggacauucagccuugucgucuucugcuucucggagaacccaaaccaccacaaugacugauuaugagguuaaaauaaaaaccgagguggaacuaaauacugaaaaacaacaauaugcaaacugaggaaugaguggaguucaaacauugcucauaauguuucaaaggaacauaaagacaacuauuuaacaauuaaaguuuuuuaaaguaaucacugaaaaauaaacagaauauacaauguccacacuauguuaagggggaaaugacauugacuuugaaguuggacagagcugagucugaaucccaguacugccacugacuuagcagugugacccuagacgagucacagaacuuuaguuaugucuuguauaauauauaaauaacgaccaucuuauagaacuuugugagaauuauccauagaggaucauaauuauuaucacuuguuuucauaaaauaaacccaaaucccuuaacuagacauuuggaacuccccacaguuuaaucuugauuagccuguccaaucucucugcucaaaauuccuggacauauaugucucaaucaaaauuuaaaaugugcuauucuuagcuggguuguauggcucaugucuguaaucucaaugcuuuagaaggcugaggcaggaggaucacuugaggccaguaauucaagaccauucugggcaauaggguggagacuuugucucaaaaaauguuuaaaaauuagcugcaugccuguaauucuaacaaguuaacaagucagaaggaugaggcaggaggauugcuagaguccagcaguuugagguuacagugacuuaugauugcaacacugcacuacgacuugggugacagagcaagacccuaucucuuaaaaaaaauuaaaaauuaaaaaauaauaaauuaaaugugccauucuuaaaauauauauauucuuuucuacuucuguaccuucuacucauacuuuguccccaacuauuuccauaaacuuucacuuaucauaaacccagagauucuguaguauuauaaaaccuuaagggccugaaaucuaauuccagaauccccacaguguggcugucuuccaucuauggaaacaccuucggugauguaaaagucaauaccauccaaaguaaccaaguucuuaaacggauauuucugcucaucugaagaggugcuuuauuuuaaauuaaaaucagccucuauguagcuucucuuccuggaaguaguuuuuaauuacuugaggacauagagaauaagucaucuuucuaaaagauuccagaaugaaagcccacuggugaauguugaaucuaaucaggauagggucacugaaauuugucuuagagccugguaagucugagauauauccagcugacacgcauauaccauaaaucauaacagucuccgugcuauaaucaaaccaauuaucuaccuuguugguuccuucaugggagagguuucugccucaguuucuccaguaaguacccccaagacuuguuuggacuaaaauguuauccuaaauugugggugacugagcuuggacucugaauaccgaguaacuucucucaguccuuucucaaggaauagagcuuaucucccuguaacaagucucuuacugugaagagacugaucaccuggaauuauagugguagcuuuaaguuauuaagugauuaagauaugugccagacauuauaauaaauucauuuuaucaauuacuuugcaugaucaucagcacaaccauaagauauauguauuauuauaaauuuacuguugaggaaacagaagcgcugaaagauaagcaacuuccccaagcauucauuaacaaggcuucccuggaacuaaggugcaauugcuugucugacuuugaaucugcuaucccacuacuuggaaccccaccagauacugccuuucugguuuaaccugauauccuuggauaauuguuaugugaacauaccugagaucacaauauccauuaucaauggcguauggcuccaucuagguaauuccacaagggcagucucuguuaccagguaaggauccccacaacuaaggcuccccaccaaucuuuccuuucagcagaaagcugagagucacuuuguagaccccagcaccgccucucauaaguuuuaaaaaaacaaaaaagcuuaauugugucugaaacagguuuucauuucucuucccaaaauguuauggaguugaagacaagagaucaggauuccgacacuaacuuacuauauggccuugagcaaaucacuuaaauuggucagguggcaguuuuuuuaccuauaaauuuaggguguuagacaagucccuuccagcuauaaaauucugugauuucacgaucaaacaugagauccugauaggaggauuguaauaaaacaguaaaaaaauaaagaaaauggucuggaauagaagaucuugcuuauuuuauuaugaguguuuggggccauguuuacaugcacuuagagacauuuaaaaugaggacauuuuauaagguaagaaacaagaaggcccucacacacacacaauauuuaaacuguggcuccacaguucacaacaccuucaucauguauaaauagaacauagcauuuacaaccacuuacacuguaauauauuucuuuuggcugagagaaauguucaacuacaugaguuucugagaacacugacuuuuuucuuuauguuguuggguaaaguaaugcuauuuuauaaagacaugggguccuuacguacccacucuauuacuguguuuuuuguaaauaauuacaauagcucccauucauugaguaccuaccauugggucugacucuaugcuuggcaauuuacauacauaaucuuauucuucaauaagucuacaaaauauguauaauuaucacacuuuccucauaaaaaaaccaauccucagaaagaaugguagcuuaguugaacaacuguuaaauaagaaaccaggaugagaaccuaagucugucaaacucugcucugccauuuugccuccaaaacaauuuaaaauaaaucuacucacuauuuaaauaauaauaguaguuaaauuuauuaaaucauuauuaccugauaaccgauuugagccccguggcaacuucaucggcuacgaauuauuauagguauggaaacugaaacauauagaaguaaagugacuuguccagaguuacacagcuuaaaaagauuaaugcucacaaaccccuaccuccaaaucaccuaaaaucugauagaaccucaagauccagaagaaaaguacucauuuauucucauguuucacaaauagauaccuaggauucuuagauuauucaggcagugcuuauagaauuucaaauaaaucaugaaauucuucuacugcucuccacacaccuacacacauaucaaguaugugcaaaaagaaauggccuuccaggcgcugacauacuccaauacuuuugucaccaucucaauucuucauucuauaccuugcucccuuucuuuaugaaaacuacauaagccccugugcugaaaacagugaggcuaguaauaacaauagugcuuauuuaaaugauuuuaacugauuaucuuggacucgacuguuuuuaacauuugaggaacuauccaaccacggcagaguaugccuuaaaauguaaaugccaaaaaauaauuuacaggggaaaguaugauagauugaccacuuuaagauccuaaaacuuuuuuuuucuuauugaaaaugauuaucaguugucuguuaccaguccaaagagagacacauaacaaauauuuugucaaaaaaauuagaaaaacuugaaaacagggaccugaaauaauauauggccaguuguaauguguuuuaaauaucauaaaguuuaugauaaaccuuaauuccaaauaaaccccuugauguuguaaacauacacuguguugguguguuuaaaaaauuuauacacagaaucaaauucuccauugcaacauuaauuuuccauuaccuuuucaauaguauccugugaaaacauacacauauagaagauggauaguuuaugauagcaacacauuggagccaguguaaugagguuuaugucaauguuuccauuuaagcuacuuuuuuuucaguagguuaaugacuggaccauaaaaaugcaauuaagugaaaucuggcaaguguguucuuaguaaaaauuuuuuuuaagugaaaagaaauggaaagcaacggcugaccauuuggaaaaagauuuuuaaaaauuauguugaggaacagguacuguaaagcaaaguuauauaauagcuuuugguuacuuaaauugauaaauauauucugggaauuuauugccaaauaaauuuagucacaucucuuccuauaaaauagucuaugauuucagacaguuugacauguacuuucuuagugaauaugacaugcaucagcaguaacauuaauaucuuuccacagacacuaaucacaguauuuggaaguccagcuauuccuaaaaggguggguuccuaaaaguaauaaugaaauuaaauaagaaaugagacuccauuuaaaauuauaccucugauaacuguuagcagagaugggaauauaggccagaaguugaagccacauagguaaagcugucaguucugccaacugauaguuucugucacccaggcaagcuauuuaaccucucugugccucaggcaucucauuuugaaacugauaauaaaauuauguagaaccuaucucauaggauccauucauucauaacauucagcaucuaugagcaaguagcacuuaaauuaguuuuucugaaacuugcuuuauuuaaagauaauauaaguauuauuaaaucauggaacauuucucaaaaugaagaaugaaguaguagagauucuuagugauuauauguuuuagggaguuggugguuuuuuuuuuuuuggacaacugguuaauucucuaaaauggcaaggauaaagaguagcaaaucaucucaaaucacaguaauuacauggcuauuacaaaacaucugcuuaguuuaaaugugauaaauuaacaaaucuacccaagacaccugauguuuaauucaacaaauauucauugagugccuacuuuauuuaaggacaacaccaaagguuacauuguauacagauugacugaaauguccuggaaagaguaaaaacuacaaguuuaggauucugaugugaagagaaaagaaugcauucuaaguaaagaaaaaagacauuugcaaauguggcauauacaaugccagacaaaaggaugaaagauagugggaaaugaggcuggaugagaaggcauuggccaaauuguaaaacgaccaagaaaauuuuuauacaagauuccauggaagacauguugagauuuuccauaggauuaaaugaaauaauauauaugguaacuuuuagcagugauugccccaauaccaacaacucaaaaaugcuagucaauaaauaauugcuuuauugaaaauuuaauuacacccuauucuaaauacugacaaaauacugccaacauauaaacacaggaccacacaacagaauuccaccccacccccaccacauugcaguuagcuuauauuacaaauuuaagacugauuuagaagccuuuaaauccaccuuaauuguguuccacgagauuuuggagauuaaaaaaaaaaaaaaagguacaaacagucccgugaaacauguaggccuggacuugaucugaggacaaaugacauuaagugguagacauuagagggaaaauguuagacaccggaucaccaaaacaucacuaaugucuuaacaccuaagggaaagaguuggggcaagguaaauggcccaaagcuagaaggucggagaucucugagaacuguucagaaggaccugcaguggaugaaccacagcucaaaguuagugcacagucuuacuaggugacaaguaucagugaguacacaguccuaagagugauuacaaguaucagcgcuggagacuucucaaggaagcauuuuuuuaccacuuaguuaggucccaucucccacugguaagcagucauggcaucauacacucucuaccagucuuacauuuauuuagaugguuguaaauugcucucuuuccauagauauguuuaacaaaaaguaggggccaugcccacuguaugacucaccacuaugccuccagagucugacacaaaguagguaauuaauaaacauuuguugaagggauaaauggcaaaauaaaucaagaagcucauggaauucagaccaaucauccuugaaaauuggaagucaaaagggaugcugagcuuggauuaugauaaaguauccaggagccuguccaggacgcaggagucaggagccacugguccugaguccucucagugcaaaugcuaaugaggcaagaggugggguauugaggagaaaacaacacaaaccccagcaacagaucuccaggaacuugacaacaacauggagacuuggaaaacuagaugaguaaaaguggaaaguagaagguagaggcuaggaaaguccccagaacugaaaaagcaguagcucaagaccucugaagggugccaacggucucacuaguggguuaagaagcagccgucacaguucucacuaggccugacaagguagacuuugcagauccaaauauguggcaagguaaagaaccccaggaauuccaugagagaacuauguaaauaaaggcacaggaugggaacaggaacaaguggauuggauaaaaauacaggguaggucgagggaaauauuggaaacacaguuggaaaagugggguggaaccuuaauagcuuccaugauaaagaaagugggcuuuaaucaauaaaccauagaaaggcucuacaaacuuggugaacagagaagagaccuuaucaaugcucugcuuccagcuucaagaaaguauauauauagugugugggugugugcaugugugugugugugucuguguguguauccugggguacagcuuauacaguaguccaggcaagugaaaauaagguaggaucauguguccauggaaauggagacauaaaccacagcagcacaaagagccagaaagaugaucugccacagcacuuagucuuccuuaaaacacacacucuuccuggccaggcacgguggcucaugccuguaaucccagcacuuugggaggccgaagcagguggaucaccugaggucaggaguuugaggccagccuggccaacauggugaaacguugucucuacuaaaaauacaaaaauuagcugggcaugguggcgggcaccuguaaucccagcuacucgggaggcugaagcaggaggaucacuugaacccaggagauggagauugcagugagcccaaaucacaccaaugugcucuagccugggaaacagaguaagauucugucucaaaaaacaaaaacaaaaacaaaaaacaaaaaaaacuacauacucuuccuuaaaagcaacuugcauaacaugaucugacuauuucacauaccuuccuuucccacugccacucucaagacacuuucacugcagcuaguaacagcaacauaccccaaugugccuuugacacuuucuuccuuuaucaacucauucucacacuucaaaaaucacccagcugcugauacuccgaagguucuccucuucucucucacccagguacucacacagcagccugcaguaucucaacuacaacacuuaccacacaguaagugcugauucagauuuucuguuuucccuccugaaacuauaaccagucacagggagaaaaagcacaugguuuggagcccagguuccuguuucuguaacuugccagcuacauaucauccaugguaccucacaguacuucugcaaaauguauaggagacaauacaugcaagcugcuuagcacaguguuucacaugacagaagcacugaauaauaaaguuuuuuucuuuuuauuaaccauucuugugauacugcagacaaaacaaagaagcagguuaggcuacgugucagagauaacacuccaagucaaugaauagaaccagguuuucccccacuaucucugggaucucauccccucuucccuccaaacaaugccucuuagcaguggaccucaacaguggaccugagcuacaacuucacaaagagaugagcacgcucuugaacggauucaucauuuccucccacagauaccaaagaagaagaaaauauggagagggagcuacccaaacugcagacugaacuuuguacagcuuuguagccagaaauaauaaagaaauaaauaaaugaggaaaguagcuuuuuacugaguaauaauuagaacucuccuucauuuccuuccaauucaagccaaaauuauuuuuucccuuuucaguaaugaaucaagugauucaugaguauauuggggauuuugucuaggcuuagaguuggccaguaauauauagaaguggaugugguuaauuaagaacaagaaaaaaauugaauuccugguaucagaucucucauugcacuaguuuuugguaccucugucaucagccaaggaaauucaaucaaugaaacccaugaagaacuacccauuuacaagauccauuuacaauauguaaacaugaacuuugccuuuuguuccaugcaacaggaauucaccgccccauaaaugagcacauauuuuuauuauucugcugcaucucauuaagacaaaaaacucauuuaacauacuuuauagcgaauuucuucuuuaaagcuauauuuaaugccaucacaauuuccaaauacauguacagcacucuaccguaggcagagaguaaagaaaagaagaaugcaucauuucaagaccuugaugaauauuaaaaugcugguuacaaguacguuacaguuuaugaauuauagugcuuaauauggcauuuuuacuuauuuucacuauccuagaauuaagcugcccaacacugacagggcagaggaaaaaugucauuuccucuguuuugaaacugaaaagaugauucucuucauuuaaagacccucaugguaaccaguggauuacaggggagaagcugucacugccuguccaggccacaucccgcuuguaaugggccugcugagaaccccugcagcccaaguggccuacuccucuaucacaugacucccucuuguugcagcugguaggggcuaagacagagggaccugaucaaugucugcucaucugcaggccagccaguuagccugugccugacuaaaauuugagcugguacaaacucauuauucucccaaauacuugguauugggaaaaggaaagacucagccauuuaaauguaaagcugguaauaaaaaugugcagugagggugaaucaggaacauggcaaggcaacaauccaugcaacccaaaauaaugaaggggcaaaaauuccacugaguagcugcaagggcagauuuuaucacccaaccaaggagaagcagagggcagguagacccauuccuagaaaagacaucauuccugagauuucccaucugaauccuuacaguaaaccuccuuuuacugagggacuccuugcaaucaaacaaucaggaacacaaugacugcugacauagugucuauugaacaauuagugcagcucuuuuaaagcuaagaaaaagaaacuauuucacagagauguaauauucaaaaaccuaacaaaaaaagaauuuauccuguuuaaauaucaaaagauguguaaaaauuuagggcuguguucaaaaaaccauacacaucugucugaaggcagcugacaucacaugaagcuuugacucgugugaaauauauaauauuuaucacauguauuguuuuucuaugcugcauaacauauaauauaaaaguuaaauaauguuaaauaaagcaaaauaacaaauuaaauguaaguguaauaaauaaagcaaaaacuaauaaaaauguaaugagaaauuaacaaauaaaacagucaucgacaaagagauucauacccauguuucaaaauaccauacagcuaguacauuaaaaauauguaagcacaugaaaaaauuuaauaauauaauuaauagcaugaauaauacagucaaacaagauuuuauauaaauacauaaauauaauuauacauacuaugaaaugagaacaaauauuuuauucaggcccauagaacauuuuuuaauuaaaucaugcacuugaacaaaaaauaugcuuaaauucaacacauggaaaaucauauggaucacaucuacugauaaacccauaaauuuuaaaagcacaauaaaauguucacaaaaaugaagcugacuauuugggaauugcuaaauauuuuccuaaauaauccuuaggucugaaaauaaaagaaaacugcuauuacuaaggauuuacaagacaauaaaaaagagacuacuucauaccccaaacauuaggauauagauaaagucuugcuuauagaaaaauguaugcccugaaaaaucauuacuaaaaaagaaaaacugaauggaaccaaguaaacauuuuuaaaauguuaaagguaagauacaaaauaaaccaaaagaaaacagaauguagaaauaaacaaagaaaaaagcugaaauguaugaucuaagaauucaaaaauucacgcugccaggaugaauaaaaugcaaaaauucucacaggucugauaaggagaaaagagaaauaauaagaaaggcgagcagaaaauaaaaacagauauaccagauaaagaguuagaaaauuuuaugaaaauauuauaugcaacucuaugaugacauauucgaaagccuagcauuaguggauaauucucuagaaaaauacaaauuaccaaaacugauaaaaauagaccaaaugaauauacaaaccacuaauaauguagauuaucaaggcaauuaaagccuuguuuuuuaaaggcacuaguuccagacagacuuacagcugaauuauccaacuuuugaaagaugcauaauuucagugaaauuuaaauuauuccagacuauaguuaaaaauagaaagccuucuaauuuguuuuuuaaauuuuaaacuagccagauguaauaaagcucaaaaacagaaaaucacaguccaacuucacugguaaauauaugugcagaugaugucaauaaaauacuaucaaauuaaaucaauauucgcaagauuucuaaagaguaaugcauugucaucagguacaguuuauuucagaaagccaaagaugaccaauaaacauaaugacaaauucauuacauugaaaccuuaaagaaacaucucuauauaucuaugauuucauaaaugguacuaaaaguaauuugauaaaaugcaggcauauuuucuaauaagaauuccaagucagauuggaagaaaauaaauauaguauuuauauauaaagaaaaacaucauuaaaaucagaaugacccuuuauuaccacuauuauucaaauuugggcucugagauucuaguaaauaaggauaagaaaauaaaauaauuggcuuaauaauuauaguaauaaagcuacuaaaguucauaagggaacuguacaaggugauuacauacacuauaugcaaaaccaauauuuuuauaucuaacaaaaacaagaaauuaaaacagaaaauugcuauucacgauaguucaacaaaaaaaacccucuauuuuguuguaaaauuuuauuguuaaauacaaaauaauauuugaacaaguacauaggcaaacaauguccuuggaaaagaagacuucaugccaaaguauuauaaacaaaaauccuccaaaaaguauaugcuucaaaguauacuuauaagcaauccaguuagaaucacaaccauuuugaaaucaguuaaaaugauguuaauguucauauggaaguauaaauagcuaagaagauuaaaaaauauaaaaacaauaguaaguugaagacucccaucuauuaaaacucacuauaacagaaucuuaaacaaauaagaaauaagcaaauaauugagugguugcaauagcguccaguaguaggucccaauauauacauguaauuaauauauuccauguagaauucuauuuuaguaagaaaaaaguauuuauucaaaacacugucaaaacuaguuaucuaucuguaaguaaauuaagucauuauuucacaucauguuucauaugaguggaguaaagacacaaaugugaaaauaaguaaaaauagaauaaaauuuaggagaauaaauuuugggggagacuuuuuacucaagguuuuuauaaccaaagguagaaaacccaaaaauucuagaagaaaaaucagaaauauuugauuagauaaaaaauaaaaacagagucaaagaugaauagaggauugggaaaaaaaauauuaacauuuuaaaaagaguuucuacauauuaguaaaaaaaaaaaguauaagcaaccaaaaaagaacaggaaaugcaaauguccaauaaacauaaacagagucaaacucaaucugaaucagagaagacaauacuaaaauagcauugcuaugcauuuuuuuuacacauuauguggccaaauuuuuuuuuuuuuuuuuuugagauggagucucauucugucuccacguuggagugcaguggcaccauugaggcucauugcaaccucugccucccgggcucaagugauucuccugccucagccucugaguagcugggauuacaggggccugccaccacgccccgcuaauuuuauauagauagauagauagauagauagauagauagauagauagauagauagauagauuuuuuuuuuuuuuuuuugugacagaguguggcucugucacccagguuggagugcaguggcgugaccucggcucagugcaacauccgcccccagaguucuagcaauucuccuaccucagccucccgaguagcuuggauuaugggcgccugccaacacuccuggcuaaacuuuuuguauuuguaguagagacgggauuucaccauguuggccaggcugguguccaacucuugaccucaggugauucacccaccucagcuucccaaagugcuggaauuacaggcaugagccaccgcgcccagccaauuuuuauacuuuuugguagagaugagguuucaacauguugacaaggcuggucucgaacuccugaucucaaguggucugcccgcccuggccucccaaagugcugggauuacaggcaugaaccaccacgcccagccaacauggccgaauuuuuuuuuaaugugacaauacccauuauuauagaaaauuagauguagggcaggggcacuuugauacauuguuguuaaaaaugugaaugacugcuauuuuuggaaauaagucuagcaaucagaguaguccccccucaucugcuuaggacauguuccaagacccccagcgaaugccugaaaccgcaaacagcacugagcccuauauauacuauguuuauuugaccugaaaaccuagauggcuauggcaauugaguagcauauacagcauggauauguucgacaaaggaauaauucacauccugggugggaaaaaggagaguaucacaagauuugcuacucacagaaacaugcaauuuaaaucuaaugaauuuuccauuuaguauauucagaccacauuugcuuguggguauguaaaaccauagaaagcaaaacugcagauaaguggggacuaguguaguucuuucuuuccuuagugauagcaaucucauuccugauaaucuauuuuguagauuuaaaagccauauguuauucacauauaaaauaauguuuagugcaguauuuauaguaauagcaaauaacagagaaauaauauauuguccaccaauagggaaauuaaccaaguuacauccaacccaugaaauaguaugcagcuauaaaaaaaaagaaugcagucauggaaagacacuuucccaaguccugaacuaguauuauuaucuuuucuucccauuuaucaauguaauaaagaaaacuguaauucauugcuuuuauuuacauuuauuugauugcuaaugagauugaaaguuuuuuuuauguugucacuagccauuugugcauucuuuuuauggaucacaucaauguugcuuguuuuacaauuaggauuuuccugcuucccuuauuaauuuguaaaaauucauuauacauaaagacucaaucuuuggccaucaaauuacauuauaaauauuucuauuuacuguauaauacuguauguggagugagcuuucucacauacagauguugugagaaauaaauaguuaaaccuaucaguaauuuaauuuucccuuguauugcauuuaaaauguacauuccugcccaaauaguauauaaauguuuuccucuauuuucuuaaaguacaugcaaaguuugauuuuuuuaacauuuaaaucuuuaauccaucuggaguuuauuuugguggaugaagugacuuaggaaucugacuuuccccauugaaguaggguucuugccugaaacagcaggcaggagcuccaggaaggaggccagacacagccaagcaguauucuugaggagaugccgggaggaaaagaaacuagcuguggaaagcuggcccauggaacagcaguuuccccauguacagagaguaaaccaaccagaaaggaaaucuuccagccuagaugucccaugucuccaccuucuccaaauugcuuggucacuaauauaaauuuacacuaaucagccauucaauguuagaugugaagggagaauacuacuguacaagagaauauugaggagauacagaaacaaaccauccauguuauuuuugggcaaauacaagaucggaauaaaucuuuuuucauuuaacaaugaaaaagauaagaagauacaauaauaaccaugaagauauuaugcccuacaaaauggaauaaauauaaaauguaagagguaaagagcauacuuuuaacauaaauauggcagaaaacagguaaauuuuagaaagcauuuauuuauccucucauauauuaaagaaaacucucuggacccuccaaacagagaaaguaaagaugagcuaagaaaaaacaaacaaaaagaaaauuagcagaaccauuaaaacaaaguaaggagagaagaaugccuuaauacagucuaaaauuacaauaaaacuuguaaaggucagaaccaacauugcagaaaaucaauccaggcaagauugaugaaaaaugggaggaacauaucaaaaugccccccaaaacugauaagaauuaugggagacauaaaauggagauucaauauauaaauaauguauuuuaauaaagaagaaaucuaaacaaauucgacaaaacaaaauauugcguaagaaacuuuccuuaaagcuauagcuuguaguaguuguuguuuaucuuaucuugaaaagaugaagaaaggagaaaaagcaucagcuaauuuuacaaaccauaauuccuccuagcaauaacaggaauuuguauuggacagcacauuuuggcuaccaagaaauguuaguuccuaguuaaaguuugucuuccuaacaaguuaaggagaugcaccaauaagaaacaagcagucuauuugugagugagaguuaugagaaaagaagugcaugaacagugaguggcuucugaagugaccacugugaggacuuggacaagcagugcagucucuggucuaauggacaagauuuuguggauugggaacacuacacaaggcaugauugaauaggaaaccacccuggcagccucugacuuccaccuuugaacaagaagucauuuacaucauauuugccaucaagaaugcccagccgaagaaagaacauuugagugcuuaaacaggggugggaaaaguggauggcgugggccuaaaggaggcaggaaaaaaugcccugccucguuuuuguccaccaccaucaaaaaaauuauguucuuuuccuuuuuugaauaauuuacuuuuuuuauugagucauaauagauguacauauuugggggcugcauauguaaauuugauacguucauguaauguauaaagaucaaaucagggcaauugggauauccaccaccuuaaauauguaucuacuguaugguaggaucauucaaauuaauccugucuagcuauuuugaaauguacaauagauuauuguuaacuauagucaaccaacggaucuguuggaaaucaggucuuaacuucuucuaucuaacuguauaguuguacccauuaauaaaucauuguuuguccccccucucccugcuaccuuuccuggccucuggcaaccaccaaucuacuucuaucuucuuaagaugcaauuuuuuaacuuccgcaugucaaugaggacauccacuacuugucuuucucuauuuggcuuauuucauuuaacauaaugaccuccaguuccaccuauccugcagcaaacagcaggacuuuuuaauuuguucuuuccucaaauguauaauucauuggcuuuuuguuuguuuguuuugagacacagucucacucuaucgcccaagcuggagcacaguggcacgaucucggcucacugcagccuccgcugcccaggcucaagcgaugcucuugccucagccuccuaaguagcugggauuacagguaugugccaccaugaucaacuaauuuuuggauuuuuaguagggaugggguuucaccauguuggccagguuggucuugaacuccugaccucaagugauccucccaccucagccuccuaaagugcugggauuacaggcaugagccaccgcgcccagccaauucauuggcuuaugacaguguguuagagaaaagugagaagagccauuuuucccacucuauauuuuuuuagcuuaaucagacguuuucuguaacaaaauuaccaagaugaauaaaaaucuaacuaaaucuaacccuuuuugugcugaccaaaaagauucaccuuauauaagguguaauucauuaaaccuagacaauccugauuaauauuuuuuuuguagauaaagacauaguccuuaaaaaagacuuaaaagucagacuggccuagaucacuucacaauauuguguauggaauaaaauuacagcuuuucaauggggaaagaugcuuaccaagaauucuauauccagacaaauuuucauucacuuguaaacacaacagaaugauaucuucagauacguaaggacuuacaaaauaugccaccuaugccuccuagagaaauaauaaaagguuggaggcauauuccuaccacaaagaaguuagguaagacaaaaaaacucaugaauaugcaagugcuaugaaagaaaugggaauaaauauugccacuacucgaucucagaauuauauccaaaauagcugcuaaaauaaaauaauauaaaaugguauaauaauuauugaaagaaaagauauaugaguuaaaaauaguggcugagguaguaacugagauaaaaacaucaaauauacaacaaaucuggaagcugaaggaagaaaaaaguagaagggagcaaauagugucucccuauugccuucauuuauggucaaaguuauacaaagaacuaaaguaauaucaaauaaacaaauaaauauuguaguauucaagacaaaaaguauuaacuggauuuaaaguaauaauugaaaaaacuaaauaaaauuaaagaagguuauauaauacagcagcucaagacaugugaauuucaacuacccagaaguaacaaaugauuuuggugauguggccaguuaugacauauauauaauacaagcauaguaauacaauauaagcaugguaauugcauaucuaauauaagcaauuaccaugcuuagauuauauacgcucgugcuacacaaggggcaaagauucuacccacuacagcacccaaaagauguaaaauaucuagacacagacacuaagacagguauacaauguauacgaagaaaucuacaaaacuugcuauuaugaggguucacuagugcuaugcuccuggaagggaagacucaacuaugaugaacagaucaacucuaaucaauuuaauuuuuauauuuaaaucaaugccaaucaaaaucugauaaacuguuguuuacuugacauuuucccucaaaauuuucuccaaaaguugcagugagcugagauuaugccacugcacuccagccugggcaacaagagcaaaacucugucucaaaaaaaaaaaaauuauccaaaauaauacacaggaaacaaugagcaaaaaaaauuaaaaaugaagaauacuauaggguuuaugaaaauagaugucuaaauuugcuauaaagccaaaacaaugacaauagaauugaacugagguaguaagagacaacaggggccagguaugguggcucauaccuguaaucccagcacuucggaaggccaaggcaagaggguugcuugagcucaggaguucaggaucagacuggacagcagagugagaccccaucucuacaaaaaauaaaaaauuuagccaagugugguggugcacaccuguagucccuacuuggaggcugaggugggaggaucacuugagcccaggaagucaaggcugcugugagccaugaucgcaccauugcaauacagcccgggcaacagagcaagacccugucucaaaaaauaaaaauaaaaaagagagacagcucagcaugauggcucacaccuguaaucccagcacuuuggagaggccaaggugggcagauagcuugaguucauaaguuugagaccagccugggcaucaugguaaaaccccagcucaacaaaaaauacaaaacuuggccaggugcaguggcuugcgccuacaguuccagcuacucaggaggcuggggugggaggaucacuugagccugggagguagaagcugcaagugagccaugacugcaccacagcuuccagcccaggcgacacagcaagaugcugucucaaaaaaacaaacaaaagaaacaaaaagcagagagagagagaacagaaaauaaaggccaaaaccauguaggccuuuguguaucuguucauaaaauaaguucaaaucacugagguauuauuaacauaaaugguuaaaggugaauggaauaacuauuugaagggcccacacuacuuaucuuugggcaaaugacuucauuuugcuucuguuuguuuuguguuucccugucauuuugguauuuuccugagcucuccaaauuuccaacaaugagaaugcuuccauuucguaauuagaaaaagcucauaaauguuauuuuaauaguauggguucaauggaaguuguaauuagaaaagaaaaaaaguuuuuaaaaauucuauaaaucugagauucccuccacaaugaugcaacugugggaaaaauugcuuugguaauaaacuauaacccagguaaacugugaaaaagaaaauggcugaaaaauauucuuagacaguuggguauugacuuggaaaauuaggacuucaugaggaguuccacgaggucaccaucuaaguaagcagaaagcgggaggcauacuaggaugggauaaaaauaaucaagucaauccuucgguuugcagaagucaguuuuuaacaugguuucaggaacaaaaguguucaaaugauaaggacuagguuuccuaaauuacuaguaauauagaugaguaucucuagaaaaguaacuaaagaauauuuucucaauaguagcuccaauauauaugauaaauagaauaugcacauauaugcauuauacauuaaccaagagcaucugucauuuaaacaaaaggagguaacuguaauuaauguugcuuucaaguuuaagaaaugcucuagcaauacugucuuuuaaauaaaaaagguaucaucuucaauuugccuuccaaauuuuuuuacauaaugacuaccaaaagacuacagaaaaguacauuuaaucugaaugacuuggagaagcuuggcggcaucgaaaucaauaaaccauuaauauccuuucaaagaaaauagguaaaauagaacuaaagaaaacgucugaacucagggguaagguaguuuaugguaauagaaaacuauuccagcaucacuagggaaugaauuggauggcucuuauuucagagaauauguccuguuuuaagcuaagauagucucguuuagaggaaauauaaaugaaaauuuucuucuagucuauguugccaauucguaaauugggggagggggggacucuuaauucauuccuaagaaaagcuuucuaaaagcucagaucugccaaauccuuuugcagaggagugccaaaauagaacgagggaagaucaaaaacaaaguuauugucaaugcuguucauucuucaauacuuaacacugaacagaacaauacucuuuuuuuuggcaugaucuucuucuuaguacugaagcuuacuauuucuaucuucuuaagacuuaaagaggaccauaaaugaugacguacuucuuuuuuuuaauuuuugccaguuuuaauauaauauuuuauauuuucaucaacuuuaaagauauauaaauaauugaauauuuacauuaauuucagauaauauccugacaaaugcuaacuuucauuguuuuauuaaaacaaaauaucuggaauuaugcuuaaauacuaaaagccauuucauccagcuuuuggaauaucacacagcuacauuuauuauauuucuauucauagagccaaucaggguaaaauuuuccuugaaucaacaaagauacgugaacggcaaaauuuaucugaugacaauaaggugaauugcaagcauuuuuguguacguuugugcauuugaauucuuauauucauucauauuuuguuuucuuuguuguagucuucaaagaaggccuucaagcucuuuguucuuuuuuuuaucuuuuuugacaaaaaaauguauuuaaguuuuuauuuuuguaagguagacuuuauuucgaaacuuguuuucaaccaagaaccuagacuaucaucauauuucccaguuuucuguccauauguauaauuuaaagcuuagcaaaaauagcugagggauccuuuguuucuagucccaugccaaaugaucauuguaaaaauucagaauucucucagcugucauugaauaugaaugagcaccuaaaaaaccaguauacuuugcaauauuauuuacucuuuuaaaaacuucucaaaagucuaggacagauuuuuggaauacuuaucccugagauacauucuuaugauuaaauuacaacuuuuugaauaaagagaauaguguacauuaacucacaauugaacaaacccuaaucagguuaacucucuaguuaaccuaaauaaaucaauuuccuugccuaaugaaaagaccuuugaaaaaauuaugacagugagaaaacucugaaagugaaagaaaucugaccugucuccaucuugcuucuaaccuccaaguugcccucguucauuccucuguguaggccaaacuugagaggaauuuacuuuauaguuuaacuuugaaacaaagaugauaacagucccuccccaaaaugaacccauccuugcuuggggaccacacugccuuugugaaacuaauaaaucagccacaacauuagaaauuauggcucacaagucacacagccaaaggccacaagauuccuaaccuccccaguuacuccuauauauaauauuaccauugucaaaccuaagauugguauuggagguauuucucagacccugcauucugaugaaccagcuggcgucauccagacuaguacacuguaucaucucaucuguaagaacugacucagcaagaagacagcuucagcucccuaugauuuuaucccccacucaaccaaucagcaucccccauucccuagccaccugccuaucaaacuaccuucgaaaaacccuaugcuccaaauuuucagggaggcugauuuaaggaaugauaaaacuccugucucccauuuagcuagcucuaugaguauuaaacucuauugcaauucccauguugauaaauuggcucuaucugggcagcagacaagaagaacgcacuguguggucacaccaauggcaucaccaugaaaaucugcauuauaggauuucauaaauugaaacuaacauuuccucauugguuuuucuuuuuuuuuuuuuuuuuuuuuuagacagagucuugcucugucacccaagguagaguacaguggcgcuaucuccgcucacugcaaccucugccucccagguucaagcaauucuccugccucagccucccgaguagcugggacuacaggcaccuaccaccacgccuggcuaauuuuuguauuuuuaguagagacaggguuuugccauguuggccaggcuggucuugaacaccuggccucaagugauccaccugccuuggccucccaaagugcugggauaaaggcauaagccaccacgcccagcuccucauuguuaaaaacauuaauuuuguaaaauauuuucuauacuaaguagcugauauuauaagaagcaaaguaaaugugcuuuguaauaauuaaaacauguucaaaugcuaauuuuaaagaaggaaacauuaucuuagcgguaaagaaaaagaaaaagaaaagacauuauccccauuauacaaauggagaaacuguggucgauauuuauauaacauauccuauaauacauauacuacaucacuuuaaaagagcauaaaacacugaauuuccuagggauaaggucacuguauacaugugauugggucucucuuacuucuuccagccaugaguauacugacacuuuagccuugccaaaacagcucaggagaaggccuggcuauuuaaacacuucugcuguugagggguaucugccaggugaggcucucaucucuuugauuugcuaugcagcuuacagaguagucauaagguuuagguuuggguuucagguaauaaagaggccuaaaaauugaaaaacauucccuggcucagcauaccagagagcuuugguauuguguuucaaccuaaagcccagcuaauucuauaaagacaccagaauuaggaauagaaaccacuauucccagcacugcuagggcacaucucucuguaaacauuaagaaccugucagagaauggaaucauacugaacaggcuuuguugaccugagaagcauuuuucucuacgagaaguuaugcuaucaaaauauggaucaaaaucuccucuaggggcaaagagauagcaacaaauucaaguggagucugagcaugguggcucaugccuguaaacccagcacuuugggagaccauggugggcagaucacuugaggucagggguucgagaccagccuggccaacaugguaaaacccugucucuacuaaaaauacaaaaaucaccugggugugguggcacaugccuguaaucccagcugcuagggaggcugaggcaggagaaucgcuuaacccaggaggcagagguugcaguuagccgagaucgugccacugcacuccagccugggugacagagugagacuccaccucaaaaaaaaaaaaaagucaaguggauccuucucugaaaguaugucuuccucagaccaaggaagacaaauaaagacuagagaaugucauugucucgguaccaacaccuacaagaugucaggagccuugccuaacaaguaaaaccaauaucaucuuccaucuuuugcuuagaauugugcaauagcaacuguaagaaacuucaucggcucuaauuuuuuuucucucugaugaggaaacugaagcccagcaaaacugggcaacuugcucaaagucacccagaaguggaguuuccugagguccuggcagaggcccuuuuccugcacauugcagugcucauccaucuccuuccauuccuaagugaccuguaccagucaucuucacauucagugccuuaguguagccaguguguuccuuuuccugaucccuuccuuaucuccuuuuccuauauggcuacagcguggaaaaggaaacccaccaaagaauacaaaugcccaagaauguaaugcacaauuucaucuagauugauuacauugcaucagccagcaagccagucaaaaagaaucccagaagcagaugcugcuuccaaaacuaauccucaaagagauuaaaagggcauguuugcacuguaaacucaaccuguuugccauauagacaaagaaaacaugaaaacaugcuugccaucaaacugcaugaaauuaguuccauucuacuaugaagaaauugaguagacagaaguugugaaucaucuaaucacauggaaagcagagauauggcagccucagaaacucaaaguuuuaauuacucuguccuguguucaagucacauugacagguuuggguuaugugaacauucuccugaauuuucaaauggccccucccauuuuaugucuguuguaacuuuucucuuuuuacccaacauacugagaguuaaaaagauaguucuuauucccguuauucccguuuuacaaauguuccuccccugccccuuuaggcuuacagucccucuagcaaauucagugucccugcaaguguuaccacuguuuuuaauacagugagauaaauuguacccuaaucaaauguguuuuggauaaaauacuacucagcuuucauucuucaugacaagucuuauguuauguaucugugaauaaagcuugcauggaacucucuauuuauugacagauuguaauguugcuaagcuuaccuacuucuuuauuuuugugccauguaagcaacaaaagcacuugcauuuuuguacaaaaccuaauaaaaucauggaaaaugacagcaaaaauguguuuaacauauaguuuacagucaucuacuccccaaaggcaaaacaaggaaaauggaaaaauaaauauaagaauaaagauaggacaugaggaauaaggguacaguuuaaaacgaaguaaguaacacagauauugagaccagacaaugccccugugcacauaaucaugccgugggcugccucuaaccuauuggaaauuaagugaagugcaacacgagguuuccaguaaaaagucucuuguguucucaccuaaauacauggaagacaguaguccucaucacuaaaaccacacauaaaucagaaaguuggcagugcuugcucuggagaguccagaaacuuaagcuuuuuggagauugaacuuccucucacccuaaaaaggaugaauccuacccgaucaggaugaagcaaugagagcggacuuucuaaaagcugagagagagacagacauuugauuuccagaaccauuuaauauagcucuuauuaaaauacauacauggauucccauuccaacacauuuaagccaaaaagagaaaaccuagauguauuuuuaaaaguggauuuuuaagaaagaacagaaaaaaaaaacagguaccaauaaacaguaucuggaaauuucacugacuuuguauugcauauuguuaaggggauuuauuuuucuaauaauaaauuuucccccauagaaguuuaugaaaagaaaaagaaaaucuuuuccucuuauaacguaaguugacuuucuuaauugaggcaguuguuuuccaggccauaggaugucagauagcacaguaagagaagacagcuugauuuuuaugucagccauaaacuaaguuuggauaacuuucccuguucacucaucuugacaaugaaaauagauucuaucaaaucaucuuuaaugucuccagcaacucaaaagaaagacggggacagaauuacagaaugcuuaauagcacacguucuagaacggccuuuccuaauuguguuaccuuugguaagauaucuaguuuccaugugucucauucauuugaaaaaaaaaagggauaaaaauaccuauuuuaccaaguguauauaagggguaaagacauuuagaauaguaccuggcacauaaacgcucaauaaauauuggcuauuauuguuaugcguguuuaauaaauguguuuuaaugaaacaaucuggaauguuuggugcaaaaaaacaaaaaaguuguugaaacccaaaauauuaagagagaaauuuggagcauuuugaaaaguaucagaaagaaagaaacagaaucauggucaagaggagaggaccccuaucuaaacaagacuauccaaaaauuggaaaaggcuuuuccuuggggauccuucuuuguucaaauacuaaauauucaccaaguuguuuucuugucuugauuuauagcucuuguuauuucuggucuuauguaaacuucccuucuaggaagagguauuuccuauuuuagauuauuaaacuaguuucuaacuaaaaccagaauuuggucauugugagugcauuuucccuagggcuuaaucacucuucagauuaaaugaauggucaguucccagacugcaaaguuggaagggcaaaccucagagaauacagaguccuuaaccuaccuuuccugaaugcucacaguuuaacagaguauucucugcuugggcccuaacagugucuugccuacguaaauaaauuaguagccucuuaacaugcuauuccacuuccauguuuccuuguccaguccacagagccugacacuucuacuuaacagaguuguagagcacacagagggcagagcccuucucugaaucauuucaagauagcccuauuggaccuaguguauagcagaccucuuaaagucuaagguaauugcacaagguacuacuguaacuuauauugucauauaauuauuucucagguuugguguaauaagagcccaaggaaauuuuuggucagcuuguaaugacaguaaauauuccuucuuaaggccagacacuauaauuuuuauaaauauaucugaggcuuuaugagauacaggcuauuccacaagaaaaaaagaaucaaaccaguuauccuuccuuaaucucaaaaguuaagaacaauucaugauugacaaaaaaggaguaaauuacagcuaaagaguaacaugaagaugaaaggauauaaaacaaaagcauuuuagcaacuuccaaggguuguacugggaugccuuccugaugauuauacggauuggaaaguuccaucuggccuuguucaaaaccauucaaguaagggugcaaaaaucuuuuccccaccuacaucuccaucacuccuuuaggguacaggcucauauucuuuaucucuggcgacuggccugagaugagcuaugacuaucgaaggacccugaaaguagguucucauuacuuaaguaagguacaaaguaagcaaaaugcauaagcacagaaauccaacacaucagcaaaaagucaauagaaauacucugguaggugguuagauucucaccaaaugccaguuagaggagcaguuuaugcacugcuccugucacagaaguccucgucacaggagacacauuaauaaaugaugccaagauggagauagaaguuggcucucaugaagauauaugcuucaugaagaguauaucgccucuuaacuaaaaauagaacugucacucaauccagcaaagccauuaaugaguaucuaccccaagggaaagaaaucauuauauuaaaaggauacaugcacuucuauguucucgcuaugugaccugccugcuccuccuuugccuucagccaggacuguaagcuucccucaccagaagcagaugcuguugccaugcuucuuguacagcuuggagaaccauaauccaaauaaaccucuuuucuuuauauaauaucuagccucacuuauuccuuuauagcaauggaaaauagacuaauaaauucaccauacuaacaggaagaaagaagaaaauccauauuaucaucucaauugauaagaaaaagaauuuaacaaaauucaacccaauuuaugaaguaagaaaaaaaaacuuagcaaacuggaaauagaagacuuucucagucugauagauaaaaucuauuuauuuuuauuuuuguuauuauuauuuuuugaaauggagucuugcucugucaccagacuggagugcaguggcacaauuuuggcucacugcaaccucugccuccuggguucaagcaauucucaugccucagccucccaaguagcugggauuacagccacauaucaccacacccagcuaauuuuuguauaaaaaucuauuuuuuaaaaaaacccuacaacuaccauuauaauggugaaacacuaaaccauuuuucucuaauaucaggaguaaaguagugaugugcucuuacccuuucuguucagcauuguacuagggguacuagccagugcaaugaagccagaaaaagaaauuaaugacauacagauuggaaagcaaaaagcaaaauaagcuaauaugcucauuucauuauccaguccuuuguuuggagacggacacaugaaccaaaucaggcuaauaagacccaaggagaaacaauuccuaaauuuugguacgaauucucuuuccuguuguaucuuuuauuguggugaggaaacucucaaucuccuggugaccacccuacccuauuagaagcugggucugaaaaugauccuagugacauugaaccaugaaucaagcugguuugagaguaguucuaugccuggaccuccuaguuacauaaaacaauaaauucucuuuuuggcugaagccaauuuggguuagguuuuuugucacuuaucaccuaagagucuuaauuucuuccucauauauuuuuuaauaccuuaaauccucucaggguuuagauuuuuuaauuucuuuccuuccaacauuuuuuuuccuuggcuuuucuucccuuaggguuaaaucaaaaucuaccuucaaaugguaaaauaauuauuuucuaauaagaaauuaguauaaauaccauccugccacaaguuaaauuuuguuuuuuaaaaaaauuuccugacugaugcaucaaaaucaguccuuugcaaaccucuucacuaaugcagcagggugauaauguauaaucaucuauuauacuccuucuagauucacuuuccacauugcaguggcagugaaacagcaaucagacaugucagaugugugcaguggaguuauaaaacauguugauuuuauuuauacugauuauggacaaagucaacaggagauaugagaaguauguaguacacauucaauuuucaagcaugaaggcucaauacaaucacuuuuaucuaugccccaaggucauccuucuuauaauucaauccuuuguucacugcacaaauccccuccagaccccuccaaaaauucuucuccaaaaucaugcuaaauaaauuauaucuuucucacucucauuacucugugguuauuuuaccuauagcuguugugauuaugauaucacuaauaaaaagauugggccuuauaacaggacuaauuuauucuuugccaagucuucagcuacacuugauuagaauguacuaggaugagaugauccaaaacaagacccuauuugauacaugaucccgggaagcauaauuuagggagauauaacaagaaaauuagaaaaaaaaaaaaaaaaagccaguaaaguguuaccgaucagguuacugcucuggccaaccgagaugcaauccuacuggggcuuucugauuaaugacauaugauauaccucagaauugucuuaucaagaaauagagaauguggggccaggcaugguggcucacaccuguaaucccagcacuuugggaggcccaggcagguggaucacuugaggucaggaguucaagaccagcccggccaacauggcaaaaccccgucucuacuaaaaauacaaaaauuagcuggucaugguggcaugugccuguaaucccagccacucaaaaggcugaggcaggagaauugcuugaacccgggaggcggagguugcagcgugcugagaucgugccacugcacuccagcuugaugacagagccagacccugucucaaaaaaagaaaagaaaagaaaaaagaaauagagaacguggaauauucaacccucugacccccacaccucacugguugaggguuguccauggagacauaaaaucucuggaguuucugaacuucccuguguuagguaagcuagaaccugugauuugaaagcaagaccucagucagagauugaggagagacagauauuugagguaggcagccaucagugagugcagggcuaucucagaaggaaagaaggaaaacacagaguggacagaagggauauggaauggaccaucaauagcaucaguuacacuguccaaaacagcuugcaagucaccucaucuuccugaucacaagaauaccagcaagcucuuucuccuccucauuaccucauggauuucucugcagucucuauauacauuuucauucaccuacuuaacauauuguauuacguauucaaacauagguacaauccccuuauuaaauauaauagauuccccuuugaugaauacuauccaaaagacaaaagcaacuuagacuggauauaaugucccuuuucuaaccagucugucuuugcucuccuccacaaugaucuuugugaggaaauaggagcauuaacuuucaagaguuucaagaauaaacucccugcuguccagaagucgaagucacaaauaacuaaaacauaaggcaaaauaagcuaagugccauaagagagguaaauacaaagugcuuugagggcucaaaggagauaaauaucacauccaguuggcaggaucaggaaggauaugugaaugaagaggcuugagagcugagcuuuaaaggauggauggaauuuugucaguaaaagguggcuagagggcuuucuaaauauagagaauauuauaagcaaaguuccaaccacagaaaaaugcaugcuccuuugagauacagucugcuuuggcuggagcauaauguacacaucacagaaguguccugggagauaucgcuggaaaggaccacucugcaugcauuuuuaaccauuucaguaaucuaucaucagaguuuucaacucuuaaaaguggcaugacauuaaugacucuggugguaaggucuaucugauauauauuauuuuuaaagaccaguauaguauucauauuuuacauuuucuauaaaaucaaacuuguugaaauggaauguaggaauucagaagggggucauucccucauggucauauaagauagcauaaaaguuuaagagcccaugaucuuuuuugucuugcuuuguccaguuacugcuuaaagaaagaagugaugguuuguauuuuacaaaagagggagaaugagguaauaaaaaaagaugaauaaacaaaauaaguaaaugcuuaauacucucuucaacaggugccugaauccacacauauaugugaauuuaaaggaaauuagccaaaauaaauaacgugggaaaucaauguuaaacacauuuguaugcaugugguuucucuccacauccugggggauuaacauuuuacucuugcugcagucccauuauuaaucuuacucuuaccagagucaaaugggaaguaaaucggcaaaaauguaauaagugaagcuagaaggaaauuguuuuuuucuuacaggauaaguacuuuuaguucaaccugaggacuguuuuagacaguccuaaagguuguuucgucagccuacaaaugcacagucuuagucaagcucuuuuaaacacacagaagcacggcuuauucuacuucugaacaucaaugaguacuuuucagggcaaauuaucauacauuuaauauucauaauaauucucggaaaaauugguauaaaaacauuaucugcauuuuauagaugauaaaacuaagguucaaaaaaaauuugacuuccccaugucagaguuguauuaaggcauuucaaauuccacuuucuuccaauuuaucuaacagaagucaucuuauuuccuaaauaauucacuuucugaaccucaaaaaugcaaaaaaugggggacacuucuuucacuaacagucucacucugaguguccaugcuaguuguuauauauuuaauauucuucuaugguauccuaucagagagcaaagcuaaaacuaucucuuacauucucuuggcuuuaguucucagaagucucaaaaaaguccuuauagaggcuguugaauaaauucaaggugucucuuaaaggaaaguuugguucucccuguaagaaccuuaguaugcccauucuguaaaaauaacagucuauaguugcuagaauauaaauuaaacucuucauuuuuuuaggagaaugauaacuucccacuuggauuucuagaaccaaaagcaagacuacccaaauuguuaagcaacucagaacaccuggaugacagccuguugccauaguuuuccuucaaugcucucaugcuuccauuaaaaggucccugagacaacagaagaaaugaugaggcucccacauuuucugagcugagugggaaugggggaauauggcuuaaagcagauaaguaguucucaaacuugaaucugcauacaaaucacuuugaucuuguuaaaauguagauucugacucaguacagcagaggugaggcucaaaauugaauuuuuuuuucuuuuuuuuuuuuuuuuuuuuuuuuugagacagaguuucucucuuguagcccaagcuggagugcaauggcaggaucucggcucacugcaacuucugccuccuggguucaagugauucucgugccucagccucccaaguagcuggaauuacagacaccagccaccauaaccagcuaauuuuuguauuuuuaguagagacgagguuucaccauguugaccaggcuagucucaaacuccugaccucaggcaauccgccugccucagccucccaaaaugcugggauugcaggcgugagccaccucaccuggccucaaaauugaauuucuaauuagcucccaggucaugccuauccugcgaguucaggaccacgcuggguagcagcaaggauccagagcaaacugcacccugugccuaccuggccuaugagauaaaaaugguuugugcauuuucuaaugguugggaguaaaauuaaaacaauaauaauauuucacaacauuuaaaaauuauaaggaauucaaauuuguguccauaaauaaaagcuuucuuacauuauucaaaauagccaagauauggaaucaacuuaaguguccauaaagaaaauguguuguauguauaaacaauggaauauuauucagccuuaaaaagaaggaacuccuguuaugugcaauagcaaggaugaaucuggaggacaguguguuaauuaaaauaagccaggcauaaaaaauaaaauagaaauuacugcaucaccucacuuauauauaaaugugaaaaagucaaacucauagaagcacaggauagaauggugguuaccagggacugguggaggaagcagaggaagcacuggggagaugcuggucaaaagauacaaaauuuuaguuagaaggaauaagaucaagagaucuauugcacaacauggugacgauaguuaacacugcaugugagguaaugcauagguuaauuaacuugacuuggccauucuacaauguauacauauuucauaacaucauguugcacaauauaaaucuauauaauuuauguuugucaauuaagucauaauaaaauuucaaagaaaaauuuuauuggaagaugggcauauuuauuuaucuauuaucuauguuccuuuugcagugugaauuaaguaguugcaacagggacuguauagaccacgaagccuaaaauauuuacuaucuggucuucuauuaaaaaaacccauuugcuaaccacaggucugcagcagugguucuuaaucauggcuacauagucaaaucaccuggggagauuuuaaaaauauugaugaugcagaauuucugagagugacuucggcaucauuauuuuuuuuuaaguucgacaaguaacaccugugagcagucaagucucaaaaccacugcuauaaagaaaauauucucauccugcccgugucucagcaacuauagacaaagucaccaaagucaaagaauaaaguucaggucuucgacaauucauagauuauuucugcacaaccuccacauuuuugucacugcagacugagacacaaucccuagaacaauucuuugguugcuuuuguugcuguuguuuuuaauucuagcaauucagaaaccaguacaaucucuuacuacucucuuugugucucaccacauucauuuucaagaguuaucacugcuuccuucuuccuccagauggcugaaaccagcuguguaaucacuggacugucuaacacauaugacccacacaugcucuaaaaguacaaccaucuucauucccuuccuucaggaaagaaaugggucuguagacccgugcaagguccauccucuacuuaucucuuuauuccagacuucggacucacuggggaccuaugcauuggucauacucccuccucuaucuucaacaccucccucucaauagccuccucucccauaaccuagaaaucugcuaaauucuaccaucucaaccccccaaaaaacuccaucuguagcuaccucuuaaucuucucccuuuaucauccacaauacaugaaaaaggauucccuacuugcugccucaagucccaauccaacauuuacuucuacacccaaugugucacggcuucugucaagaucauucuaucaaaucgcuucuugcaaaagucaccaguugucuccauucccuaauuuaguggacauuuuucaacccuuaucucauaagaccucuacacagcacugcacaauguuuaacauuuuucugaaauugugucuguuucucugauaccacauaccauugguucucauuauacaucugauuauuccuguucugugucuucuguggguuucccauucuucaaugaaccuagauaccccaguaauccgucuacaacccauuauucccccaugcaccaugacucagucacuguaauaauagcaccuaccacagaugauaaaaauuccucaacuguuuccaccccaaaucucugccgacaagaucagacucauauggucaauuucuguugacuaucaccauuugacuauaccaaagacaaugugccccaaaccaaacucacuauaucuucugccugacccucuuccugcauuucacugucuuaauuggugacucuacaauccacccaguuuuacaggcuuaagccuggcacuuuuuguuuaacuccucucugcuucaucacccaaagcuaagcaucacuagcuccuguaaauuuauuuuucaaacuuacaucucaaauagaucccuugcuaccacugacuuaauccaaagucuugcucaucuuucacauggaagauuaaaucuggcuucccuuccuccaguuuugucucuccuaaaaccaucuccucacccauucaagaguaauuuaccuaaaacacaaauauuacaaugucaucgauaugggugaaaccugucaguaucucucugucauacaagauaaugcccaagcuuuuuaacacagauucucaaaaauuuggaccucacuuuugcugcaucaugcaaaccucacuugauauuuguaguaacaaguaacaauaauaagaugugcuuuccgaacccucuaccuggaauucauuucuuccccccacccauuacccucuacccgccucuauagcuuuagcuaacccauauacuuuaagauucaugaauccuaggcuugcuuaccuguccaccucucuaucuccaugacagccugugcauuucuuuuucaucucuauaucuaauuuguauuaugacuauucuuuauguauuuauuuuauuauuauuauacuuuaaguucuaggguacgugugcacaacgugcagguuuguuacauauguauacaugugccauguuggugugcugcacccauuaacuugucauuuacauuagguauaucuccuaauucuaucccucccccaucuccccacuccacgacaggccccggugugugacguucuccacccuguguccaaguauucucauuguucaauucccaccuaugagugauaacaugcagucuuugguuuucuguccuugcaauaguuugcucagaaugaugguuucuagcuuuauccaugucccuacaaaggaaaugaacucauccuuuuuuaugccugcacaguauuccauggugugugugugucauauuuucuuaauccagucuaucauugauggaccuuuggguugguuccaagucuuugcuauugugaauagugccgcaacaaacacacgugugcaugugucuuuacagcagcaugacuuauaauccuucggguauaugaccaguaaugggauggcugggucaaaugguauuucuaguuugagauccuugaggaaucaccacacugucuuccauagugguugaacuaguuuacagucccaccaacaguguaaaaguguuccuauuucuccacauccucuccagcaccuguuguuuccugacuuuuuaaugaucacuauucgaacuggugugagaugguaucucacugugguuuugauuugcauuucucugaugaccagugaugcugagcauuuuuucaugugucuguuggcugcauaaaugucuucuuuugagaagugucuguucauauccuuugcccacuuuuugaugggguuguuugauuuuuucuuguaaauuuguuuaaguucuuuguagauucuggauauuagcccuuugucagacggguagauuguaaaaauuuucucccauucuguagguugccuguucacucugaugguaguuucuuuugcugugcagaagcucuuuaguuuaauuagaucccauuugucaauuuuggcuucuguugccauugcuuuugguguuuuagucaugaaguccuucccuugccuauguccugaaugguauugccuacguuuucuucuaggguuuuuaugguuuuaggucuaacauuuaagucuuuaauccaucuugaauuaauuuuuguauaagguguaaggaagggauccaguuucagcuuucuacauauggcuagccaguuuucccagcaccauuuauuaaauagggaauccuuuccccauuucuuguuucugucagguuugucaaagaacagaugguuguagaugugugguauuguuucugaggguucuguucuguuccauuggucuacaucucugucuugguaccaguaccaugcuguuuugguuacuguagccuuguaguauaguuugaagucagguagcgugaugccuccagcuuuguucuuuuggcuuaggauuaucuuggcaaugugggcucuuuuuugguuccauaugaacucuaaaguaguuuuuuccaauucugugaagaaagucauugguagcuugauggggauggcauugaaucuguaaauuaccuugggcaguaucgccauuuucaugauauugauucuuccuauccaugaggauggaaaguucuuccauuuguuugugucauuuuauuuuguugaggacugguuuguaguucuccuugaagagguccuucacaucccuuguaauuuggauuccuagguauuuuauucucuuugaagcaacugugaaugggaguucacucacgauuuggcucucuguuugucuguuaucaguguauaggaaugccugugauuuuugcacauugauuuuguauccugagacuuugcugaaguugcuuaucagcuuaaggagauuuugggcugagacgaugggguuuucuaaauauacagucaugucaucugcaaacagggacaauuugacuuccucuuuuccuaauugaauaccguuuauuucuuucucuugccugauugcccuggccagaacuuccaacaccauguugaauaggaguggugagagacggcaucccugucuugugccaguuuucaaagggaaugcuuccaguuuaugcccauucaguaugauauuggcuguggguuugucauaaauagcucauauuauuuugagauacgucccaucaauaccuacuuuauugagaguuuuuagcaugaagggcuguugaauuuugucgaaggccuuuucugcaucuauugagauaaucaugugguuuuugucuuugguucuguuuauaugauggauuacuuuuauugauuugcauauguugaaccagccuugcaucccagggaugaagcccacuugaucaugguggauaagcuuuuugaugugcugcuggauuugguuugccaguauuuuauugagcauuuuugcauugauguucaucagagauauuggucuaaaauucucuuuuuuuguugugucucugccauagccugugcauuucuauauuauccauaucagagugcaguaguuaggaguagugcauaaucacaaagaacuggauugaaauuacuuugccacuauuuauaucgacucucuuaauugggaaaaucauauaacuucucuaauuccucagucccuucauaugugaaauagaaauaauauuuaccuuauugcuuugucauugacaaugagauaaagugcuuaggauauaaacugacacaggguaagaccccaauaaguuagaauuguaguuauuauuguuuguugcugacuuugaagucagaacacaaaacaguaagguauauguucgguaacucuucuuuuugcuuguuuguuuguuuguuuguuuguuuguuuugagacaggcgugcccaggcuagaguacaguggcguagucaugacucacugcaaccucugccuccugggcucaauugauucucccaccucagccucccaaguagcugggacuacaacacaugucugccaccgugcccagcucauuuuuguauucuuguagagaugggguuucuccggauugcccaggcuggucucaaacucuugaacuuaagcaauccaccugccucggccucccaaaaugcuaggauuacagucauaagccaucccauccggccucaguaacuuuucuuuaaaugccuuacuuuggcaaagaaaucuuuguaaaacauucuuauauuuuaucuaaguuagucuuuuuagugcuuacaaacaaauacucuuucuuacaaagagaaauaaucuugauacauauuaaaacaauaacaagcauauuuugacaaugacuagccaaugaaaagcuagaagagcagcagguuuucucacaauaaaugaauaucucaaacauauuuuuuuaaguucuuaagugguaaaacaugaauauuaugaaccauggaugacucuuucugagaaaaaacaagaucccuuauaucuaaauuauuaugaauuauccaaauccaaaauaauaggagacugugcuuucauuuuacuucagagcaugaugaugugaaaauauaaaacauuaaguucacaggaacaucugcuaacauuuuaaauguuaaaauguucugcccgggcgcaguggcucaugccuguaauccuggcacuuugggaggccacggcaggcacaucacuuuaagucaggaguucaagaccagacugagcaacauggugaaaccccaucucuacuaaaaaugcaaaaaugagccaugcauauuggcacacaccuguaaucccagcuacuugggaggcugaggcaguagaaucacuugaaucugggugguggagguugcagugagccaagaucgcgccgcugcacuccagccuggacgacaaagcgagacugucuccaaaaauaaauaaauaaauaaaugcucugauuucuguugcuuucaaugacuuguauuaaaacuaaguuaaggugaggaagucaaaauuuccucauuauauuauaagccuguucauuauccuaaggaaaagaaaaugcaaccuauuacaaaagugcccaguagcuugcuucacuaaaugccuguaauuacagcauauuuuuuagcaguuuaugaaggggaucaaagaaauauguuccagguguaggcucuguacucaacagauuuagacaaagauucauuuuuucagucuuaacauugugguaauguuuauuagaucucuauuucauuuuucuacuuucaauugaaaguaaugugcagacauguaagcgacaaauucagcauaacacugacugaggcuuuaacaauuaggucagcccaagcgucucucugccccacauuuggggagaggauacuuccuuccaaacuugcauccgauuccaacucauccgcuuacaggcuguguuuccucagggaaguaacaaacucucuuccucaucugugaaaugggaauaauaguaucuaucucaggaacaguuagaggacgaugaaaugagaaagcaccaagauguaaaguacuuagcauagugccuggacccauuaacauuauucccuuacauagcacucacugagggccaggcaguguacuaagcacuuuauagacauuauuaaucccuuucgacaguaccuacauaguagguauuauuaucauccuccuuuaacagaggagaacucauuuguacaccacaauucugauuauuucacaggacaacaggaccagaaaaacaaggauuagcacuaaucacuccaaaggguucagcaagaaaaauaaacccgaaugcccugagauaaccauuccauauaacaaucuaacuucuuuccuauuaaacuagaaaguagcauccacaagagaaaucagaaaaauagugacucagguaguuuccuguguucuguuguucaguucaaaaacccaaauagaaaguaaguauagcccugaacccuguccauagauuuccugccuuugugucagucuuacaugugggccauguauccgaucugcccaaguuacagagcucuaguuccccaugguaaagaaaucagaccauacaggaagggcaagaucacucauuuuugaagggagaugaauaauaccuacguuugggugcaagguaaguuacaaagauguuaaugagcuucauaguuuuauugcuaucgaauaacccaaaagauugaaaucacauuuaguaauuugcauucccuauuuugccuuuugauaccucauccuaccuccugagaagagagccaggucuugcaugcuuccucaccacaggguagcccagcuaccacagaaguggccuaagagaauuuccuuuacuggcuauuguuuuccaaaagcuuaguacuauggacacaaaaagaagccacugcauuggugugagaguaagggaugaugguggggacaggucuggcacaagcagcaagagaaagaaaaagauugccccaagcuugaggaagggcuggucuguggcaccuacaaguaaaugcacccaaaaguuuccucuugcagagcuccagcaaagagguuggaucugcaugggaaauaaaagcaagguggccacacgaggcuccauuaagagcgccugggcccacuacuuucucacaccccugggacaacagucccaaccccaucacaguccaagggaucugccggggggauaaaaguauguguauugugggacucaacuaaggaacuuuggaaagguagaaaaggcuuuuucucaguugucacaaugaaucaaagucauggaugcuaaaaacauccugcaacguauagaacauucccacaccacaagaacuaucccaccaaaacuccaguaugccucuguugagagaaacuaauuagcuaacaaauuaggaaauuagcaaacuaauuugaacuaaaaacucaagggucuuaccugaauacuuuguucuaugcaccaucacaggaccucagccccacaacuuugugagugagggagccccauuauaacugagauucccgucaagauggugggaugagggaucaguguuggauuuaguugaauuaaaagaauuacggcucgagacauuccuugcauaacaagguuuauugagaagaugugcuuucuagauauuucagauuaacagcugagugucaggggcuuucugaaaacaugcaaagcucuuguccuagcugugcacuccuggggaagcaccagccucuucuacaguaacaguucuaagauggcuuuccagauugcaucuguguccuaguacagugaagacgaaaccaggccauccuucuguccccaagacaacaccacauauuucuuuacucuuacuucuuuguguguaaaaauggcaguaguaauuacauuuuuaaagcuuuauuuuuaagcuauuuuauuuauaaucaauaaaaucugcuuaagcaucuggauaugcauccauccccccuaacaauuguuacaugucacaacaaaauuggcaagaaaggacuuuugcaaugcuauauaaagugacacaaauuauugguuuuauaagaaacguccacacgucaccuuaaaagcuaacuaaacagcaauaugcauuuaaaaaauagaaagagacuugaagcauucucaacuuuaguacaaaaacagauuugaggaaaggaaugaaacacaucuauguaccaccuuucccuaaaaaugaaaagaccauuguaugauguaauuaaucuuuauacuuccuuucuaaaaagaaaaaaggagaaacauaguccuuuuugcauaugggagaagcagcacaaggaauucagauuucuugccuaaggacagggaucagugaagaucaugccaaaauccuacagaaagacuaggacacuaaaugccauucucuuacgagcaauuauaucuuuuuuagaagacagcauucauuggacacuuacuauauaccaggcacuauacuuaaaguacucaucucacuuaaaucuuacuacaacccugauaugaauuguaauuuuccccauuuuacagccgaagaagccaagaacagugacauuaaguugcuuauacaagaucaccuagccaauacauacugauagaauuucagccagaacugucccugacuccaaccaugaacuccaaagcccaugauccuaacccacgaauccuccuuuucucuucaccccucacaugguaugauuuuauuaauuuuagaauucauaugaaucuuucccaguggccaugauggauucuagcagugccaaauuaaaauaugaacgaauaagacuauuuucaauucccuagaauguuaugaucauugacaaucgucucgccuuuaucuuccauacuacucuaucauuaauacuaaucacauuuuauuuuaauuacuuguuuaaugugucuugccucccagacccuugaggacaagaaaaggcccuugaggacaagaaaagagccuaucuuuguuuaccacaagacucagaaccuagcacaaugacugaugcauaguaggcucucaauacgccuuuguagaaugaaugacugagggagccgggcacaguggcucaugccuguaaucuuagcacuuugggaggccaaggcacgcggaucacuugaggucaggcauucaaaaccagccuggccaacaugcugaaaccccgucucuaccaaaaauacaaaaaaaaagccaggcgugguagcaggcaccuguaaucccagcugcuugggaggcuaaggcaggagaauugcuugaaggcagagguugcagugagccaagaucaugcuacugcacuccagcccaggcaacagagcaagauacugucucaaaaaaaaaaaaauuacugacuaagggagccaggguauguguuggcaccuagcaguaagaccaccuugucaacuacuggaugauaacaaaccacagggaaccugugaucuaagaagacaaaacauaaagauauuaaaagcaacuaaaagcccacauauccgugaagccuuucaaaacucuucacaggagaacuaauagcuucacuuucuuacacgcugggcaugauuugucucacaccaggcuuucaucauguuuugagcaucauacuuacucccugauguacacauauuuaucuuuguauccccagcaccccacagagcagcuucacauucaaccuuucuuuauccuccacccaaugcacuuaccauugaacaacugccaguaguuuguucuccuuuuuauaagaaaauuaagggcuaccccuuaucuauaguauuuacccacaaucaugugucaauauauauuucaaaucuauuucccacuaucucucccucugcugcgggauaauuaaggaaucagagagaccgagggguugagaaggaauuaauuauuuaguuacaccaucccaguuggauuaacauccaaaggacugagccucgaacaaagagucaagcuaccuuucaagcauuucguggggcagcggggggagaucugugcagggggaagcauauuacagaagggagaaacaaagacaguuauuuaauuaagacaugcauuacaacuucacacauuuuagugucaucuaagagaacuaccugcugaugcccugacgaacuucuugcuuugaucacgcaguccauucuauaccaaaugccuuucauuuucacguuuaagaccagcucaauuaucauuuccuccgggaagccaccccaaacuuagucccaauggacacaaucucuuccuuaucagaauuccuacauuuuaucuauauuuuucuauugacaucuaucauguuacucucuaaauucagauuaugcuuuguauuucccaauagaugggaaguucucugaaagcaaaugccacauaucauuuaccuccucaucuuucacaucaaguagcacaguccuuucuauauaguaaguacuuuguaauuuaagaugaaaaaauaaauaacugaauaaagaguuaaguccguuuuuguucugauguuccuaugucuugaacccguccuaauagaaaugggaugaaucauaaaacauagugcuacuucaauuuuaaucacaggcuagcuaugaaucaggcaaguuacuuaaaaucgauggauucuaguuucuucaucugaaaaggaacaugaauuagagcaaaucucucaggccauuacuaauacauagauguaguguguagcauaaaauauguauauaauuucaaacagaggaaacacaaguccccauaccccuugcucaguaacucuuagucuaucuucagagcucaacucuucaucacuuucacagagaacuuucccagagggccaugacuacaucaaaucccuccacguaaugcuuuuauagcaccauaaaucuccacuuugcagggggugucauacuuacaauuucuauuuauuucugacaauuuaauuaauaucuauccaagcuucuucuuguacauucaauaaaaauaaauuaaugaauguaaucuguguuaaauaugaaaucuuacaaagcagacacaucuuuauuaguucucuauguaauauuaucacguuuccacacuaaauacuuuccaaagauaauggauaugaguacgucaucucacaacuucaaagagcuuacaaaguuuucaaaguaucuaaauugucauuucauuguauauauucaaugaauauuaucucaaauagacuuauuuauaaguaugcaauacaaacuaaguuuucucuuuuguuuuaggucaguuccuugcuauuuaacacaaauacauuugccuuaauaagcuguuccauuuuauucaucuccaacuccuuccuaaacauaagacauucuaguuagcacuauaauuaugaguuaaagguaagagcuuagaccacaaagcaaaauacuucaaucuucuuucacguccuccuuucugugcccuugcagaguauuuccuuucaaaaaaaggagauauugacuaagacuagugacccauuaccucuuccuauccaauaaaguggaguggaagugccaaauccugagacucaugugcccucaagggacuacauaauaugagcuaagcucacuucaaauuuaaaauagcuuuucccuuuuuuagucacauguauaaaugugugaaaaguaaaccuacaagcaauaaaauucuauuccugacaacauaauugucacagucacuagauuaugcaagauuuugaaaaaccuauucagucuaucagaaaagccacaugcccauaaaaacucuuaaaagaggcuacacagggacauaugaaaaugaauguacuaaagagcaauuacuauauuuuuaaauauuauagguguuuuuugaaaaauaaaaacagcgcuguuuaguaaaaauccauauaccacacucaagaaauuccuagaguuacacacacacacacacacagacacacacacgucccuugaugguaggaaucacauuuacuccagaucugugucaucagcacuggcaugguguacugaaugaagugaaauuuaucaacuccaccugaaauaauuguccagcagaaaaaacauauaugaaauaaaccgaaaaugauuaacauaaaaaaauacuaaucacuugcucauguaucccaaacuaacacuuuuccaaauggcauauaguuauuugguuucaugggguuuguagauguguguuugugauuuuuuuaaugccuaggauucugguacaaugagauaaggaggaguuaggaaaugauaugauaugaacugccaacauauuccuuaguaauguaguaaguuucauuacauccacacuaccacaacaugauugaaucuagguugucuccugagacaaggaaaaacucuuuucacuacaauuaggaaguuacugaauuuuauaguuuuuucggaaccacgagucaacagauuuaggguuuuuuuuguuguuguuacgaaaacagaaacaguaaugcucugaagacuuuuaagauuggaguuuuaaagaacauaaaauuauaaaaguuucauaauaauacuuuauccaugugaacaaaagaacaacguacugugagacaugggcaaagaaaaucuaaaaaauaccaaugucuuauaauauuccuguaaaagugagcuaaaaauacaauuuucuuauuauuaaaaauuuauuauugcuacuacucuuaucacuacugcuauuacuacuacuacuaauuuuucuauuacuuauauauuauauagccagccauauucaggggaauacuuaucuauaccauaacacuacuaugagaaucaacuugagucuuaaagaaucaaaucacuacugaggaaucuaaagagauaaaacaaaauggacccucuuauucuucucaacacauucuacugcccuccaccuacugagaauagauauuaaaaauaugacaaaugaugguauuauuucaguauuacaaacuagguauggucacagacagaaacuagccuuacuaauuauagccagaaagaaaaagcuacgcauuucauuuuuuaaaucaaaguuuucauuugauuucacagugaauaauccuguaugauuucaaaaaaagacaguaaacaggaaauagguaauuaugcaagcucuaacccccaaaaccuaacaaaauaaauacagaaaggaaaauauacaggcagcaaucaaauuaagaaaguaagcaaacuauaccacaaauuuugacaaaaugccauucagagacaagagaguaaauauuuccgacaucaacuuucaguuccuuucaugacuaucaacacgcauuauagagacggaagaaacugaauccagaaaauucugauaauucucagugaaaucccccaauucggauggaaguagaaucuaggggaugcgaugcaacccaaaagaaaagucaaagaagucuucuucaaagcagaauaagccauaaauacaguaaacagcaacucggaggaggcaagcugcacagaguucaaaagccauaugccggagugacaucagcacgaauggcaggguaaagaccuccgaaaauccucuccuccacaaaacaaugacaagauuggcaaaaauagucaauaacaacuuuuucagaacuauggaaauugaguaauggcuuguagcaauccagggagcauguguuuaaaaaacaguugaaucaugguaaaaacaguugaguuuauggcauuuuaacuugcccuauucccaucucugcauccccagcuaugcacuagccuugaaaaacaguaaguugcaaucacagugaaaaccagcagacuaccagccacuagaagacacugaacuggguuggaacuccuuggaauccccauuagcacagaauugucauuauuugaccuauggaaaauaccucauuuucaaggcuuuccuuuauuugaccugccucaggguucucccacuguuaacaaccaucucuuugugggcauuugccaauugucuaacaucucagcugccugaaacaguggauaauauuugggguaaacaauagacuaagcaaaaaaacuuaucaagggagaucugaggaaugaacauucauaaggagcuuugagaagcuaccaccauauuccuguuaaccuaugagacccaugaacacaugaaacguuugcaugcccagggcugugcacagcucaggaauaacuugagaagggccuacaauuucacuucuuacuaaccuugaggcucugugcaauaaagagguaaagacuaaggcagaagagucaauggacuggcugagcauggaaggcaagccucagcacagacagagcccuucagcaaauacuugaagacaggaaaucucugucaaauuauuaucugacuaccaagcuaauugagaagacacucaguggucacauacaacaaagaauauaaacuuuacagauuuaguucagaaaacugaccaggaaaacaacaacaaauccuaaaaaaagagccagcauauaauuuccagaauugucauuaauuuuauuuaaaauguuuaauauucagcaacaacaaaaauacaaggcaugugggaauauuaaaaacuuauaggccucaaaaaaauaagaaguagucaauagaaauuguccuugaggagugccagauguuagacuuaccagacaaagacuagacuagacugcauuaguuuuguaagguugccauaacaaacuaucacagacuaacuagguggcuuacaacaauaggaauuuauucucugguaguuuuggagaccagaaguuuaaacucaaggugugggcagcacuguguaucccucuaaaagcuauaggacagauucaguuccuugcucuuucuaccuucugguagcugccagcauuccuugcuuugaggcuucauuacuccaaucuuucugcacaaugccuucuccuuaccucugugucucaagacaucuucugccucucucugauaaggauguauguaauuacauucagggcccgccaagauaauccaggcuaacuuccaccccucaagauccuuaacuuaaucacaucuuaacauaugugauaauagucacacuuuucucauauaagccaggcuccaaugauaaggacauggacauaucucaggggccaccuuucagcucaauacaaaagcguuucaaucagcuguguaaaauauguucggagaauuaaagaaaagcauguccuaaagaacuaaagaaaguaugagaaaggccaggcauggugguucaugccuguaaucccagcacuuugggaggccaaggcaggcagaucaccugaggucaggaguuccagaacagccuggccaauguugcaaaaccccaucucugcuaaaaauagaaaaauuagccaggcaugauggcacaugccuguagucccagcuacucaggaggcugaggugggaggaucucuugaaccugggaggcagggauugcagugagcugggacagugccacugcacuccagccuaggugacagagcaagacuccaucugaaaagaaaaaaagguaugagaaaggugccucacugaacagaguaucuggaguugaaaaguacaauaacagaaauguuaaaaucaccaggacucaauagcagauuugcaguggcagaagaaucaguaacuuugaagguaggucaacugggacuauccagucugaauaguagaaagaaaaaaggaugaagaaaaacugacagauccucagagagcuguggaacguaaucaagaauacuaacaggugcacaacaggagucccaaaaaaaagaggagaagagagaaggaggagaagaggaggacaggggauugagaaguggggccuaaaagaauauuuaagguaacagccaaauguaccaucuuuuuuggaaaaaaaaaauauccuacacaucaaagaagcucaauuaacuccaaggugguuccauacuacacaaacaccuaaaccaaacaaucaaaagccaaaggcaaagagagaauccugaaagcagcaggagagaagcaauucauuacauacaacagaccaucaauaagguuaaccaaugauuucugauuagaaaccauggaggccagaagacaguagaauggcauauuauaucuaaagugcugaaacagaaaacacaaacaaaaacauauaccaagaauucuacauugacaaaacuauucuucauauauaaaggacaaauuaaaauuauaaaauaauuaauugcaagcaaaccugcgcuacaaguaacacuaaacagaaucccuaaaacugaaaugaaaggacacuauauaguaacuaaaauccacauaaauaaagaauacuuguaggauaacuacauagguaaauauaaaagacaaccaaaauguauuuccguuuguaacucuuuuguccuccaaucucauuuuaaaaauaacugcauacuugcacacaggguggggaacaucacuuucuaaagaauaauggcugaaguccgggcgugguagcucacgucuguaauuccagcacuuugggaggccgaggcagguggaucaccugaggugagaagaucgagaccagccuggccagcauggugaaaccccaucuauacuaaaaauacaaaaauuagcugggugugguggcucacgccugucaucccagcuacccaggaggcugaggcacaagaaucgcuugaauccgggaggcggagguugcagugagcagagaucaugccacugcacuccagccugggcaauagagugagacuaggucucaaaaaagaaagaaggaaggaaggaagggaagaaagaaagaaaagaaagaaaagaaaagaaaagaaagaaagaaagaaagaaagaaagaaagaaagaaagaaagaaagaaagaaagaaagaaagaaagaaagaggaaggcugaaaauuuccuuuccaaguuugguaaaagacauaaacacagauugaaaaaugugagugaacaccaaaggauaaucaccuauaugggaacuauagcucaaaugacuauggauuuccuaccaaaaaccaugaagaccauuagaaauuggcacaaaauuuuuaacacgcugggggaaaaaauauauaaacuggaguucuacaugcagugaaaauacccuucagaaaugcaaauaaaauaaugacauuuucagaugaaugaaaacuaagaauuuguagcagcagaccuguucuaaaagaauggaaguuuucauacagaaggaaaaugguaacagaaggaaacuucaauagaguaguaugcaacuguuaaaaaaaaaaagagugauuauaucuuuauauguugacacgagaagacauucaagauauauuagauaggccaggcacaguagcucacgccuguaaucccagcacuuugggaggccgaggcagguggaucaccugaggucaagaguuugaaaccagucuggccaacauggugaaaccccaucucuacuaaaaauagaaaaauuagccgggcaugguggugcacaccuguagucccagcuacucaggaggcugaggcaggagaaucgcuuaaacccggaaggcagagguugcagugaguggagaucacgugccacugcauuccagccugggugacagagcaagacuccagcucaaaaaaaaaagaaaaaaaaaagauacauuagauaaaaauugcaaauagaaaaacuauauuaauguugugaucacaacgguugaaauaauaaguaggcaacuaauuaucuacagaaagauaaauacauuaaugcuauauacauagauacauacauaaaauuugcaaaaagacauguaagaauguauucauagugauuagugaaaggaauugaaaaaggacauauuuuaccuucccuucauagcuuuuucugucauuuaaacuuuuacauccaaaauauacuaauccuauaacuuuuuaaaagaauuaaucaauguucuaauuuagcauuaugaaauuuucaugagauaucuauacauauaagguccccuguugcuauuacguaugaauuucuguuauaacacacauuagaaaagcauaugcuacauccuccaucugacacgagaaucugugguacacuuucucaugaauacccaugguauuuuucuucucagcuauauucuaaccauuccuccauucauucacaaacacagagcauccauucuggcaugguacuagacucugaauucaaacucccugcccuaugaaaugcacauucccugaggguacuauggggcacaguauuaugaggguacguuacuguaaacauaauuuauaugucuauuuauaugucuauaauuuauuuaagacaauuauaaauugagaaauacuguggugaaaauuaguacaggacuaaagaacagaauaaagguagaaggaacuucuuuuuagauaggguugucugggacaaucucucaaaugagggauaguugugcuaauagguaaagagucuaaaggauaagaaagaaucaguuccacugacaguuggggaagaacauuccaugaaggaaauaaagcaugugccaaggccaugagauggggaguaggagagaaacuccuaauuucaaaucuugauaugauaauuuuuuuauaaccuuauuucuccuccaaaucauccaaagacucaaagguccacuggacucagacaagucuucccacucaaaguuuccaaucaaagggacuugccuuaauuagauggcucacaaaauaaucuucuacauacacaaagaaacuugauugcaucuuucuaaacuugccucacccuuaaaauuguguuacugauaaaacaccauucucccacugacccucaaaaguguacuacuaacaucagccaguauucacagcaacacucaggacauuuccucacuuacccgcaacugcaccgugauuccuucucccagcucagaacacguagcuuugugacgcugucuguacuaaugguuucccacagaauuggaccuauaucauuuauggucaaaguuucaggaccucccuucugaagacugagcccacacgugacaaucuuuauuccuacucacuuguaugucggccacccaacuaacauagaguuuguggaagagggaguggaguugggggacaaagagggccagauagcauccauaaucuggucccuaacaacuuuccaccagaguccccuucaugaaaaccuaggcucaagccagauaaaauugcucucugcacucacgcccacauaugucucaccauguucuuguuugugugauucaaucagcccaggauuacauguucauacaacaucagaauacaagaaggugauauaagugacucagcugagaaaagcagagugguagacacugagaaaucaagaaaaaccuuuuuagaccuaaggcagucaaauucacacccuuuggaaaaugcagagcuaguuauaccuaacucauauucaggaugaauucaguccaugaaccguucaauuugagacaacccuaguuccauauaugucuagauuuuaccuuuccucugucuugcaagaacaauuccucccagaaaauuugugcugauacccuuuauuuggauuaauaucuugacuguguccccacuugauggaaagggaaaacauggaaaguggagcuugaacgcucagguuaaauccacuuauuuacuugugacuuaagggaauuaauauuucugaaccuuagcuuccucaucuguaaaaugaggaugacaccaccuaccaccucacagggucauuuugaagaucaaaacagaaagcacgugcaaaaagcaacauacaaauauuaacucaaacuguaauuguggauuuuuuucaucuucauuccagaaauagcuauugcucaaggcuacauuaauauuccuccuuuuucaacccuauauaugcaugugcccagcaaaguuccugaaacauguuguuaauauuuugccucauggguucauacaguuaguauugugcaucucuaaguaaggugccauguaacucaguagauucacugaaaacuucaagucuuguuucacagccaaacaaaacaacaacaacaaaaauuaaccagaauauuuuuccacuuaaccagacaugauagggguucuaguaauugacgccaaaguaaauuggggacaaaagaaaauuaauauaggcauuauguaccucuuuaugauaaugaauucaacuugcacuuuuuuacuauaaagcauuugaaacauucuuacagauuucuaucacuccuguuauugacucauuuuuauuaaaacaguuaucuugucaaaacuccugaaaguacaguccaaaauaaauuuggcacaaacauaauuagucaaucauacauaagucaccuguuuaucuuguuguuucuuaccaaaauaaacuugcaugugacuuccaguaauaucaaggacaaucaaaaauaugcauuugggaacagaaugaaguccacagacacuuagcauuguccuaauuugauuuugaggacuucuuugaacuauauuccuucuucaggaguauauacucucagauugaaaauacucacaugucaaaugaguacccucaaauuaugagggcacuauuaauuuggaauucauuuuucuaaaucuuaaaaugcuguucaaaaauaaaauuuauaaaguuuuaggauacuuuucauugaucuaaauucuauauauuaaucauagauucuaaauuuucuagaaucuauagauucuaaauuuucuagaaucuauagauucuaaauuuucuagaaucuauagauucugaauucuauauauuaauuauuauagcuaaguggaaaacccagagaauuaaauaggcauuauuucuagaaucacuuaacuucuucaaaguaaaaggagaagagaaauuuaacuuucuaacuugaacuuuaaaucacauauucuaggaauuuguaguacgauaguguuacuucuucugacuucacuagcaacaauuuucaccuaugaauuccccaaaauuguuuaguaauaauuacuacuaugauacacaauuaagccauaugauauaauuuuuacauacagcacaaaucuuaauucuuagaguuggcucuugcaaccuaauaauccucugucuguauauauuugucuuacaauuuccuuuucaugacaaaucaauauggauuugaauuauaaauuauuggaggacaaaaugcgugguuacuugcauugaaucuuuuccguuauuugagcaagaaugcaccugcuccucagucauauuuguuuuagauaaaaauuaccuuugcuuguuagaaagcauuauccuggaauauuccauucuguuagagaacauucucugugaucuuuauguuccucuuuucaaaguuucuacaaauguaugauuuacuugccugcauaauuuuagacauuuuuccacugacauaaaagauuaauccuauuaauaauuaacacaacauugggaugguguuuuucaguugaaaaauaaaucuauagccuacaggaguaucuauuucccaguaaaaucaaaggcaaaacuacagaagauauuucucugccaacuuuauguaaauaacauaaacagcucaaaagaaaaaaguguuuaggaguauccacagcacaauuuuuaaaaaucaaauuaagguauuugauguggaaauagaaaaauaaaagagagcaaaccauucaguacauuuuuacaauuaguuucauucgucgauugcaaagugcuuugcuaacauuaauuaauuaaagauguagggucuaagaucugcaguacauuuuguaauggccucaaucagucuucaaaauuccagaugacuaauaaagacacagacaccugacagaugaagucacagaggucaucuccaugugaaucuuucagcucuucaacucuuauuccauuacuggacuuggaagaauacaggaagagcgucaaaaaaauauaauccaaaaacaaaccuaaaaaaaaaaccucaaaccaguaaaaccaugucaaaaacacacagacaacccuggcucucauuugcaguauguguuucauaauccugauuuuguuuaaaaaacacacuguccuccucaaccuagacuauuuuuauacagauguguguguguguguguguguguguguucgagauguauauacauacauccaaagcaauaauuauacuuuuuguuuacuuaaaaggauuagaaagaaauuccagugaacaugauuuuuaaauuagauggaagaaaaucagaagauucucuucuuccuauaucaggaaaugaagugaaaguuuuucuguaaucuuuucgaagaucagaacaauauugauguuaauucuaauugaacagugacaauuaagacaauaaggaaacaauaccaaaagucuuuaaugacugaaaauaucuucuaaaaaugcuaaauuuaaugaaucucuugugcaaagcuaaaauuucuuuguaauauuuuuaaacaauguauaauauuuuugaaagcucccaaaucuugcucaguuagcagcaguagaaaaaccacgauguaaugaauuuguuuucucuguuauuuaaaaaugcuuuuaggaaccugaagugcacaaaaaagcauguguugccuuaaccggacuccacagcugcauuccugauaguuaguagccaauuuucuauuacacagucaaucuuuucaacucuucccucaccugacaccaccaauuaccauggguucaccagcuauaggagaaauaaaaaugacaaaucaaacaaacaaacaaaacacaaaugcaaagcuuuuuuauuauuauuuuaguuucuggcucauccugugcacuauuuaacuuuuguagucacugaaagcaaccaaucuggguacuuauacagcaaaaaacucuuuucaaguaacuaagaaaaaagagagaaagugagggaaaauuggguaagaaacagaugagaacuggucaaaauggacucuucccuucuggcauuuuuuucuuaauguucauaugaguaaaaacauuuagcaugaaagaaacacucauggucuuuggaagugggacuaucuagcucugggccauuaguuacaugagucuggccaggucguguaauaucucugagcauuaguuccuccaacuauauauccuguacaacaguacugagaguuaacuaagaugaagggcuugagacaccauagguauucaauaaaugaacacuaagccuauuguuauuaguuuaaagcaaauagcacuuauauuuucccacaaaugcaaauagcaguuacagcacuuuauaaaaauacuuuuuucuuacuaagaaguaauauguaaaaauuauagaaauauuuagaaagcccugaaaagcaaaaaaaaagaaaaaggaaauccucccaaaucuuaaaaccaagagauaccacauuuaacauuuaaaugucucucugucuccaucucucucucugucccccacucucucucucccccaucucucucucuccucucucucucucccccaucucucucucucuucucucucucucuccuuugcccuccaaauccauccuaagcaucaugaaaagaaucucugcaagugaggaucucuagguauguuuuuuccuuccauagccucaauuacauacaaagcaaccaacuucauauggggggaucagcaauuacaccuuuugagggaaaucacuccugaucauccagguucggcagaguuaagagaauacauguguagagaggagcagcuacagugcagggcccuacagaucuccccugaagacucauucucccucaaaacugauccuucccuggcucuugcaaaacuuauuuuuguugucuuccuucuuuuuugccuaucuuuucuaggcguucuuuacuaauuaagcugagaggaaagggacgcagaugugaugagacaacuuuaguagaaaguuaugcuucggucauggauugccagugagaacugacccuggcaguagaucaaaauacacauucccacuaguggguaaacuuggauauuuacauacugcccuaaaccaaggauccaacauacccagagugucucauuuuucucuaauacaaaguagcugcaauaucauguauugcaugaaccaugaguccucgaacuggaaaucucuucaguaucauaccaccauuccccacgagcacuagggccugaccauaaaccucacuaaucuugccagagcccugaaaugcugcuagaugcuagcaguuucuuuccuccuuuccaugaccuaucaaagcacucacacaaucagcaggagccuaggauuuauugcaacugaauaaacuuugcuuggacuccuaauccacaggcccacuuuauucucuguggcuuccauccaguaauucuacugccauuucccacccaugucaacuggaaucucugacauuaauccuaauccagauuggauucaaccuuuacaugccucuuaaaugguauaauugggacugaugucugcacccucccccuucuuaggggccagagcuggagcagaaucauuguuuuacucaacuuccuuccuucuugcaacagcccauuauaauauuccauaaggggccagacacaaauguauauguuuuaagcguuauacaucaagcuccugcaaucaugggugugggaagucagaagcagaauagaauauuugaucugugaaaaggaaaaaaugauagaaaaaaaugguagacauaacuaggagucaguuucuucaagaaaaacucaauuuagaagucaucuucuucccacaaaagccagagaaaucucuaauaauagucuacuucauugccaucuuccacuccacuuccaaagcagagggaagacaauuacaacaagaauuuugcuaaauguguugaaguauuaguucccaaaugccucucugccaucuagugcuaaucucacugcaugugaaucaccuggaaaacuaauuaaaaaaacacucaauccccacucaaaaguuauaauuuuuuuuuuuuuuuaagauagagucucgcucuguuacccaggcuggaguacaauggcgugaucucagcucacugcaaccuccuccuccugcguucaagcuauucuucugccucagccucccaaguagcugggauuacaggcacccgccaccaugccuagcuaauuuuuguauuuuuaguagagaugcaguuuugccauguuggccaggcuggucucgaacuccugaccucaggugauucgcccuccucagccucccaaaguacuggaauuacaggugucagccaccacacccagccaaaaguuguaguugaaugagccuaaagcccaggaacuugcauguucaaaaggccuccauauuacucuaaaaaucagccaaauuugaaaaucaguacauuauaggaaaauggacuuccuuucauuucaugagguuucaugccuaguucagaguagugguaaauuagagucaaaacuaguuucagaccuagguauacguucaaugaagaugcuuuguacuugaagucugagcuugaggcaacugcagacaaaagauuccaagucuaugcagugaucauaucagcuucuguguaaguaagaacuuucagauauuaauaaugaacaauaguccgggugugguggcucacaccuguaaucccagcacuuugggagggcaaggaggagggaucacaaggucaaaaguucgagaccagucuggccaccacagugaaaccacaucucuacuaaaaauacaaaaaauuagcuggguguggugguaugcaccuguaauccuagcuacucaggacguugaagcaggagaaucacgugaaccugggaggcagagguugcagugagccgagaucagccauuguacuccagcccaggcgacagugcaacacuccaucucaaaaauaaauaaauaaauaaucacaaaauaaaaaaguauagacuaaaauguuauaaugugagaucugacuuacgagggaaaagcaggaaguaagaggucaaggaagacuuucggagaugacaauagagacaaaaucuggaggauaaguaggcuuuuccuagugaaggggugcuggaagugcucuagggagauggaaacauggcaggagcaaaggcuuagaggcuagaagaggagugacucaucuaggaaaugaaagcaggugguuugccuggagugccaugaaggaggaggagaauggugggaggcauggauggagaggcugugaggacagauggcaagggccaggaaggccagguuaagggcugggucuucauccuugaaucaguugggugacaugacgcuugggaggcaaaaguggaagcagagagacaagaaugagagucugcaauauucuaagggagagauaacagaccacggucgggcagcagagguggaaagaagaggaaauaagaagagagauuugauagaugaggacagauguguuugccuuaguuaaauauugcauuaauuucuauuauauuucuuuuugcucuuaccuacuauuucuggcaaguggugcugguuuuccuuuuacggaaguaaaauaacauuucuuuucucagaaaaaaaaauuaaguguuuuuugaggggcacagguguuguuuaguaaguucauauacuuuuagcgaauaucgcagugccagccauuuuauuuuauuuuuuuuuucuggguaauuuauuuauuuauuuauuuuauuauuauuauacuuuaaguuuuaggguauaggugcaaaaugugcagguuaguuacauauguauacaugugccaugcugguguccugcacccauuaacucgucauuuagcauuagguauaucuccuaaugcuauuccucccccccuccccccaccccacaacaguccccggagugugauguuacccuuccuguguccauguguucucauuguucaauucccaccuaugagugagaacauacgauguuugguuuuuuguccuugcgauaguuuacugagaaugaugauuuccaauuucauccaugucccuacaaaggacaugaacucaucauuuuuuauggcugcauaguauuccaugguguauaugugccacauuuucuuaaaccagucuaucauuguuggacauuuggguugguuccaacucuuugcuacugugaauagugccgcaauaaacauacgugugcaugugucuucauagcagcaugauuuauaguccuucggguauauacccaguaaugggauggcugggucaaaugguauuucuaguucgagaucccugaggaaucgccacacugacuuccacaaugguugaacuaguuuacagucccaccaacaguguaaaaguguuccuauuucuccacauccucuccagcaccuguuguuuccugacuuuuuaaugacugccauucuaacuggugggagaugguaucucauugugguuuugauuugcauuucucugauggccagugaugaugagcauuuuuucaugugucuuuuggcugcauaaaugucuucuuuugagaagugucuguucauauccuucgcccacuuuuugaugggauuguuuguuuuuuucuuguaaauuuguuugauuuuauuguagauucuggauauuagcccuuugucagaugaguagguugagaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacauguaguccucgcccaugccuauguccugaaugguaaugccuagguuuucuucuaggguuuuuaugguuuuaggucuaauguuuaagucuuuaauccaucuugaauuaauuuuuguauaagguguaaggaagggauccaguuucagcuuucuacauauggcuagccaguuuucccagcaccauuuauuaaauagggaauccuuuccccauuucuuguuuuugucagguuugucaaagaucggauaguuguagauauguggcguuauuucugagggcucuguucuguuccacugaucuauaucucuguuuugguaccaguaccaugcuguuuugguaacuguagccucguaguaaaguuugaagucagguagcgugaugccuccagcuuuguucuuuuggcuuaggauugacuuggcgaugugagcucuuuuuugguuccauaugaauuuuaaaguaguuuuuuccaauucugugaagaaagucguugguagcuugauggggauggcauugaaucuauaaauuacauugggcaguauggccauuuucaggauauugauucugccuacucaugagcauggaauguucuuccauuuguuuguguccucuuuuauuucauugagcagugguuuguaguucuccuugaagagguccuucacaucccuuguaaguuggauuccuagguauuuuauucucuuugaagcaauugugaaugggaguucacucaugauuuggcucucuguuugucuguuauugguguauaagaaugcuugugauuuuuguacauugauuuuguauccugagacuuugcugaaguugcuuaucagcuuaaggagauuuuaggcugagacaaagggguuuucuagauauacaaucaugucaucugcaaacagggacaauuugacuuccucuuuuccuaauugaauacccuuuauuuccuucuccugccugauugcccuggccagaacuuccaacacuauguugaauaggaguggugagagagggcaucccugucuugugccaguuuucaaagggaaugcuuccaguuuuugcccauucaguacgauauuggcuguggguuugucauagauagcucuuauuauuuugagauacaucccaucaauaccuaauuuauugagaguuuuuagcaugaagaguuguuaaauuuugucaaaggccuuuucugcaucuauugagauaaucaugugguuuuugucuuugguucuguuuauaugccggauuacauuuauuaauuugcauauacugaaccagccuugcaucccagggaugaagcccacuugaucaugguggauaagcuuugugaugugcugcuggauucgguuugccaguauuuuauugagcauuuuugcaucaauguucaucaaggauauuggucuaaaauucucuuuuuugguugugucucugcccggcuuugguaucaggaugaugcuggccucauaaaaugaauuagggaggauucccucuuuuucuauugauuggaauaguuucagaaggaaugguaccaguuccuccuuguaccucugguagaauucggcugugaauccaucugguccuggacucuuuuugguugguaagcuauugauuauugccacaauuucagagccuguuauuggucuauuuuaaaggucggguuacccacaaagggaagcccaucagacuaacagcggaucuacuggcagaaacucuacaagccagaagagagugggagccaauauucaacauucuuaaagaaaagaauuuucaacccagaauuucauauccacccaaacuaagcuucauaagagaaggagaaauaaaauacuuuacagacaagcaaaugcugagagauuuugucaccaccaggccugcccuacaagagcuccugaaggaagcacuaaacauggaaaggaacaaccgguaccagccacugcaaaaucaugccaaaauguaaagaccauugagacuaggaagaaacugcaucaacuaacgagcaaaauaaccagcuaacaucauaaugacaggaucaaauucacacauaacaauauuaacuuuaaauguaaauggacuaaaugcuccaauuaaaagacacagacuggcaaauuggauaaagagucaagacccaucaguguguuguauucagaaaacccaucucacgugcagagacacacauaggcucaaaauaaaaggauguaggaagaucuaccaagcaaauggaaaacaaaaaaaggcagggguuucaauccuagucucggauaaaacagacuuuaaaccaacaaagaucaaaagagacaaagaaggccauuacauaaugguaaagggaucaauucaacaagaagagcuaacuauccuaaauauauaugcacccaauacaggagcacccagauucauaaagcaaguccugagugaccuacaaagagauuuaagacucccacacaauaauaacgggagacuuuaacaccccauugucaacauuagacagaucaacgagacagaaaguuaacaaggauacccaggaauugaacucagcucugcaccaagcggaccuaauagacaucuacagaacucuccaccccaaaucaacagaauauacacuuuuuucagcaccacaccacaccuauuccaaaauugaccacauaguuggaaguaaagcucuccucagcaaauguaaaagaacagaaauuauaacaaacugucucucagaccacagugcaaucaaacuagaacucaggauuaagaaacucacucaaaaucgcucaacuacauggaaacugaacaaccugcuccugaaugacugcuggguacauaauuaaaugaaggcagaaauaaagauguucuuugaaaccagcgagaacaaagacacaacauaccagaaucuuugggacacauucaaagcaguguguagagggaaauuuauaguacuaaaugcccacaagagaaagcaggaaagauccaaaauugacaccguaacaucacaauuaaaagaacuagaaaaccaagagcaaacacauucaaaagcuagcagaaggcaagaaauaacuaaaaucagagcacaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagaugcaauaaaaaaugauaaaggggauaucaccaccgaucccacagaaauacaaacuaccaucagagaauacuacaaacaccucuaugcaaauaaacuagaaaaucuagaagaaauggauaaauuccucgacacauacacccucccaagucuaaaccaggaagaaguugaaucucugaauagaccaauaacagccauuuuaaaaauggguuguuauuugggguuuugguauugagggauuuuuuuguuugcauuuuuccuucugauuuuuaaaauuagaucuauuucauauacuauaagacaaaauugcacuuuagaaauagaauggcuaaaagccacauucuaaucacaccauauagaucaagacuacauuuuuuuccaaaauuagaucauagagauagcuguacaaacuugugaauauacaaaaaaaccacugaguuguacauuucaaaggacugauuuuauaauauauaaauuauaucauuauaucucaauuuuuaaaauuauauuguuuccaaacuuaugcuuccacuuucaacuuuccuucucuguuggauauaaucauuauuaauacuuacagcuauauaguacugucaaagagaaaaauaacuauguauaccuauaucuuuacccaagcuuccuucucuagcaugcagacucacaccagaagcuuuaaucacagcagguugauggugcuggagacacugaaggauuacauugauugguugguuggcugaacuaccuuuuuuuuugaggggggagcggcggggauggacucucgcucugucacccaggcuggagugcagugacgccaucuuggcucacugcaacuucugccuccuggguucaagugauucuccuaccucagccuccugaguagcuaggacuagaggcaugcgccaccacacccagcuaauuuuuguauuuuuaguagagacagggauuugccauguuggucaggcuggucucgaacuccugaccucaggucaucugcccaccucggccucccaaagugcugggauuacaggcgauagccacugcgccgggcaugguugaacuucuuaaucaucugaaucaagaaggugaugcagccacaccugauguucuaaagaguuuucuuuccuugaacuccuuggcagccuacguguauuacaguccucucuggauugacauuuaaauauugugauccccucacauucuuuccuguaauuucuucucacucuaagccagugcuucucaaauuuuggcccaggccagcuuaaagcaauuaaaucagaaucucuggcgaugggucucaggcaucaggauauuucuuaagauccccaugugauuccaaugugcccucagaaaaaaaaaccaugacugcucuuugaucccucccugagaucucacucaaucacuucaauugcuaucuuuaugccagugacucccaagucuguaucuccaguuaccacugccuuuaucauucaaaaaucgaaauaccaaaacacuacaguaagccacaaaauaaaauguugcuugcuuuuuaaauuaaaacaaaacugaaaauuuuguugaaauuuaaaucacuucuuccuagaguguuugaauuuucuuucuuuuuuuucuuuuugagauggagucucgcugugucgcccaggcuggagugcaguggcacaaucucaguucacugcaagcuccgccuccugcauucacaccauucuccugccucagccucccgaguagcugggacuacaggugcccgucaccacgccuggcuaauuuuuuguauuuuuaguagagacaggaguucaccauguuagccaggauggucucgaucuccugaccucaugauccacccaccucagccucccaaagugcuaggauuaccagcgugagccaccgcgccugaccaaauuuucucucuuuuugagggcugagcugccugugcuuuguugguauccuaaagagcagauuagacugcugacugggaaacugaacucauacagaaggaucuccauuugaagcacccauagcacuagaaaaaucagucuauagguaaagucauuacucccucauuucuccagacacaaccuacuccuccucucaucuuuccuaauaacauccucccaguggcugaaguaaaacaccuaagaaucaucaucuacuccuucaacauucacacuaauaauuauugauuaagcaauaucaauuauaacuccuuaauagaucuugaaccuguuugcugucucuucauccccauagccaccauuuccuugcaccuagaguacuguaacagccccuuaacuggucuccuggcccacaaucuuugcuuguuccacacuauugucaaaauuuuauuaauauuucuaaacacaaaugucuuugaguaccuaaaacauuucagaggcucucuccugcccuuaggauaguguuugaauuucauaacaugguuuacaaagcccuuagaaaccucuccaguuauauucacugcucccucucaugcuaguccaaucccuucaucucugccucaccugccuucaacagagauuuuacuucuucuaagaaaucucaagucucccacaacgggguuaggagugccuuccacgcauggccauaucacagugcacuuacucuguuacugcauccaucaccaccuucacuuucucucuaggugcaagugaacugcuuaggggcagaggcaauugcuuguucuucacuguagacccagcgcuuggcacacuguuggugcucagcauuuguugaaaucaugaauuaauaaaucaaugaaugaauuguauuccuucuucacaaaucucaaugaaauuugcauuaacccucuucaaacaaagguagaauagaagaaaaacaguauuuuuaaaaaaaaaucuuaggcugggugcaguggcucaugccuguuaucccaacacuuugggaggccaaggcgggcgggucacuugaaaucaggaguucuagaccagccugggcaacauggcaaaacccugccucuacuaaaaauacaaaaauuagccaggugugguggcgggugccuguaaucccagcuacuugggaggcugaggcaggagaaucacuugaaccuggcaggcggagguugcagugagccgagaucgugccacugcacuccagccugggcgacagagugagacucugucucaaaaauaaaaucuugcacacacaugcacagcagacucaugggcuaugcaguggguaauaaaaggcugcaggucauuucucuaacauuuguaaguaguuaccaauaaaauuguccauaaugagcuuguauuaugcagagacaacagucaucuagucauuuuaaauuuuaaaauauuaaaguauaaaaucugucauuuuaauguaaauaauagcuaccauuuccacucuccaacacugugcuaagcaguugacacauguugucucauuuaaucuccacaaucuagcucuaaaguagaucauauuacaacuucucaggggaagaaaugaagguucagaaggguaaacaccuuaccuacaacaacacaguuaggacgugagaaaggcaguuugacaaucguucucuuuauacccuuccuuuggguggguguuucucuacucuuauaucauggggguaaacaagaguuaccaugaaacuuguacugauauugccacgucagguccagucuuacuguacuaaaugacagaacaggccaggcacaguggcucacgccuguaaucccagcauuuugggaggccaagaugggcagauuaccugaggucaggaguuugagaccagccugaccaacaugaugaaauccugucgguacuaaaaauauaaaaaucagccaggugugguggcacaugucuguaaucccagcuacucgggaggcuuagacaggagaauggcuugaacccaggaggcagagguugcagugagcugagauagcacuauugcacuccagccuaggcaacaagagcaaaacucugucucaaaaauauacauacaacucugucucaaaaauauacauacauacauacauacauacauguacauacauacauacaugacagaacauaaagcuaaugcugcuggaauaagaaaugccucugaguugauaaaacaguccauauccagggaacagccccaugccaaaagugaugacuaaaaacuugccaaauucuuuauuugcaugcaaucuaagugaguuuguaaacauaguguaaaauguaucuuuggcuaacaaucauauuucccacaguuaccuaugccugagagauauaacacaugccuggaaguauacauaacuugggggauguuguauaaauagucuagccuauuaaauaguuaaaauauccuaacauggagcucauccuccuggaaaaugcaauuggcuacuagcuucuuugguuuuaaguucuuucuuugucgaaaauucugucauuuucuaugaauaguaguguuguuguuguuguuguuguuauuguuguuguuguuuuugagauggaguuuugcucuuguugcccaggcuggagugcaguggcacaauuucggcucacuacaaccugugccucacggguucaagcgauucuccugcuucaaccuuccgaguagcugggauuacaggcaugcaccaccacaccuggcuaauuuuuuguauuuuuaguagagacaggguuucaccauguuggccaggcuaggcucgaacuccugaccucaggugauccacucaucucggccucccaaaguguuggcauuacaggcaugagccacugcgcccggcccucugaauaacuuuuuaaagcaauuuaguuauaaagagccucauagaaauagccuauagagaguuguguuugucuacuauacuccucucacaucuuaguuacgcaaaauaauaugcucuccagcuauuauuacuuaauaaccuggccauaaugauucccagcuacuaaacacuucaugcuuuucagguauaaccucucccuauuuuugaauucucucagauuaaacaauuuauuuuuaacccaucaucuuuaagcucccacauauuguguaggauagacagcauaucauucauucauuucauucauggaacagaucuuuuagguuuauuaugugccagaaguuuucuauaauugccuuauucaaaacuacuuauugggcaucuaugugcuaaggauuuaaugggaaacaaaauagccaagucuccuauucuuaugugccaagucuuaaagcaggaccuauuuuuuggugucuuugacauucuacucaucauagaucaaugauucucaacaguaggggucagcaaacaacgccauacuggccaaauucagccugcuguccauuuuuggaugacccacaagcuaagaauguucuuuacauguuuaaaugguuaaaaaaaucauuuuuaaaugguuaaaaaaaucaaaagaagauuaaaaaaaagaaaaaagauuuuaaaaagacaaaaaagaaaagaaaaaagaaaaaagauaaauuuuuaaaaaucaaaagaaaaauaucucaugauacaugaaaauuacaugcaauugaaaugucaguguucauaacugaaguuuuauugaaacacagccacauuccucuguuuacaucuauggcuacuuuugcccuacaucagcagaagugaguaguugugaccgagaccacaugucgcauucucaugcuuauugcuuugcacaucuuuuugaugcaccacaaaucacagcgacacaaucauaacucaacaaaaucgacagugucacgcaugugguagggucacauuuuuuuaaucuucccaaugcauaccaaucaugucaaaagaagaaaagagaagacaaauggacuucaucaugcuagauguuggcauacauuggaagaugaauuuuuuuaauuaaauuaggugacaaagcauuuugguuauuauguaaugacauuauagcugugcuaaagggagacaauaacugccaaauuggguacugaucaaaauauucccaacucauaggaaagcaauagucagaaaaauuauaaaauuuaaaacacacuaucuuaaaacagcagaauuucaucacaaaaauuaaaaaauaaaaauaagacugcaaccaaaguaaguuucugagugguucguuuuugagccaagcaaagaaaaccauuuaccagugaugagucauuuuaaauugugucugauuacagcagcuaaagaaauguguccagagaaaauaaauuuguuuagaaauauuaaucuuucaguaaaaacaguuguucaaagaguugaagacauuggaagcaauaucaauagucaauuugaaaauaaggcaaauuauuuugugugguuuuccucagcuuuugauaagcuaacagaugugauggauacuguucaguuguucuuucaaggagucaguacugauuuugaagaggcugaagaauuaguuucuaugaauagacugcacagaacaacuacaaacaaguauuuucaaagaaacuaagaaaacacuaauucaaaacaacuuaagcggaaucugcuaaaauguguuacaauuuagaguggcaaaaaguuauguauggagcagagggugacuuggacaaauuuacagaggaagguguucagagccuaugguuauucaucguauuauucaccagcaaguacuuuucagaaaauauguuuugcucugauaggcuuagccaguuaguccuagaaguuuucucagaaauagaaguuuaauauucugacucacuccacucacuacacagcacuuccaugccuguaauagggauaaacuuaggugugguguuugagcucaggaucaugaaugaaauuuuucugaguaagaaaaucuauccucaaccacuaucauugagcauuaaauagcuuuggaaauuggcuuuuccugcggauuugacaauauguuuaaugaauucaaucuaaaauuucaaggcaaaacagcauuugcaugcaaaacuuuuaugacgguaaagucauuucgaugacaacuaauguuguuugaaucacgaguuaugccaagcuguuuuauauacuuccugcgcugucagaagauaaaacaaaaagugagauuuccauucccacaugaaucuggagcagauauauuuucugaacucaagcuacaacaguguucuucagaccuugaugcaagugcaaaggaaauuuccauauuucaaaauccauuuaacggagcaacugaggaauuuccaccuaacuuucaauuggaagugauuaaucugcaauguaaugacauguaaaaggaaaauaucaagagaaaagucuaauaaauucuagaaaugccuuccaggcaaugaacaugcucaauuuaaaucauaugcuguggauugauauaacuacuuggcagcaccuuucugcgugaaaagacauuuucaaagaugaaauauguaaauucuuauuacagaucagcauuaagagacaaacauuugaaaucaauucuaaugauagggaacacuaauuuuacaccugaaugaagugaaauauaauccucccaaaaaaagaauuccauucuucucauuaguaaaucugucuuauaaauaauacuaaauuauuuuauauucuuuaauuuaaucacuuaaaauuuugugagauguuuuccucucuuauugcauaaauauuugcauaauauccucaguuuugccucuuggccugcaaagccuaaauucuugacuauauggcugcuuaccaaaaaagucugccaacuccugcucaaaaggguugguuguaaaagggaacaucucacagucucuaaggagcauauaugguuaauauugcccaaaagguuacaaagguuaccuacagguuacaaaacauaauaguaagaaauugucauagguuuugauugacauaaaugucugaaagaugaaugagauaugaugaaccuccuaagucaauuauaaaaagauucugacaaguuuaugacauuaggaaugauaaaccaaaacauacaaagggaguggacaccuaacccacuggggcucacagccuuugaaaacacuccaguguccuucccauggcucaagaauccaggaauuucaagugaccacuaucaguaacgaagaggagguuggcagaaucugguggccuagagauuagaguccuucccaguucaucuggucacccugcaaaucuccuggaguuuuauggaacucuauggagaaggcaggagccaaacuaaugacugagguacgauuucccaauacgagguaaaggcucagaaugaaaucugagucaauguaagaaaaaaaaaauugcauaugcauuuguggacaagagucauaauugcuacaugauagggucaaccucauaauaauguguagacugaaauuauguaaacuauuuagccaagugcuuggcaccaaaaguauuaacuauuauuauuguuauguauccagccucaucuccugcuacuacuuugcuuucacauuuccugcuuccuauacuccucauuauucccacaguugccaaucuuuggcauuucugugcauuagcacauaauauucauucucucuggaauugcauuccacucugaucuccugguuauuuuauuuuauaccccuaaacuccaucuauccucagccuucucuacuuuauucagugcucuugacagugaccgcacaaacugcaauacccagccaacuuuucauuagauuucaccucugggaagaaaaagagauagaagaauuucuuuguggcucccucucaugugggcacuguaucucaagaagcagccagguagguccuuccaugaccacagcuuuaaccagguggccucuccuccacaguucccuuacuggcuccaggaaguacauuuccuucuugucccuuuggcuguauggcgaggugacagaucccugcuuuucccaccucuccguccaucccuccuuugcccucugcccacacuguuguauguaauaccucaaucugaacuaucagcacugaauucuguauucuacugccccgcaaccaauaaauccaccucacaaauucuuauuuagccuucugcaugucuuugaagccuuauuuaacaauacucuuccccugguuaagccagaaacucccuuccaccuuacacagugugaaaagaagggagggaagaagaaaaauaauuauaaauguguucauuuauuacuuguugcggggggaggcaaaacagaauuggaaaauagccuaaacuaauacaucuaucuauuaaaaaggcuacuucccggucucuugucuguuuuucucaauguugcacuuuuucuuuaaaauucuuucucagacucucaaaccaaaugccauaaaaaugaaagcagaaaauaaugauaguuaccagaugaacugcuacaggagccugaaacaaacccaguauauccaauuuuaucagaaguaagugacaaguggaaaaaaaaguugaugaaaaaauucagacacauuuaaguuugauguugaugaaacugaugauacuugucauauuuucgguacuuaagaugguguaauauuaagacuaauugauagaaaaucucaacuugcauaucuauaugguuuuuuuaagaacccaacuccaucagcaaaaaauaacaccauaaugacccuaaaaugagauguaaagcacagaaaaugguauuaguuuugcuucaacacuaaaauuaucuuuauuaaaagacaaauuaucuucaacgugaaagguauuuacugugagaauaaauauuuaaacccaauuucggaaaacugauuuaguuguuuuuguuuguuugcauauuuuaaccccuuaaucagguacccuucaacuucaauauguacacacauuaucugaggauccuguuaaaaugugaacucugauucauuagguccaagaugggaccuaagauucuacaguaauaugaagcuccugggugagaucuaugcugcuggucuaugaguacccuuugcguauuuagacuaauccuuuuggggaaaaaaagucuguuccugcucuucuagucuuauuuuuuaaauaguucucaaaccuuagcaguaccagucacccgaaaacuuggugaaacacagauuguuguugcauccuguaucuugacuuuagugauaguagacaucugaaaacaaccccauuaaaaagugggcaaaggacacagacacuuuucaaaagaagacacguguggccaacaagcauaugaaaaagugcuaaacaucacuaaucauuagagaaauguaaaucaaaaccacaaugaguuaccaucucacaccagucagaaugccuauuauuaaaaagucaaaaaauaacagauguugacaaaguuguagagaaaagggaacacuuauacuguugaugagaaugcaaauuaguucagauaggguggaaagcaguuuggcaauuucucaaagaacacaaaacagaaauaccauuccacccagcaaucacacuauuagguguacacccaaaggaauacauacgucauucuaccauaaagacacacgcacgcguauguucaucgcauuacucacaauaacaaaaacaugggaucaaccuaaaugcccaucaaugguagacuggauaaagcauggaauauuucacagccauaaaaaagaaugaaucauguauuuauggaacugcagaccauuaucugaagcaaacuaacacagaaagagaaaaccaaacaccgccauguucuuacuuacaugugggagcuaaacacugagcacauauggauacaagaaaggcaacaacagacaccagggccuacuugagaguagagggaaggaggagggagaggauugaaaaaauaccuauuggguaccuggguggugaaauacucuguacuccaaacuccagugacacacaacuuaccuauauaacaaaccugcacauguaccacugaaucuaaaauaaaacauuaaaaaaaauagauuguagugcucaccuuggcagcacauauacuaaaaaaaauuguauagaaguaaauauacacacacaaacacacaaaugcaugcaaaacuggugaaaauggaucucuauuauuucuuccaauuacaugugaauccacaauuaucucagaacaaaaaauucuuuugaaaaaaagcagacagaucgagauguggucugauaauuuacauuucauuacaucucaaguucucacgugaugcagcaaaucuggggaucacauuuugaaaaccacugaugcaaaauaauagcuuucuaccaugggugcauaacagaagcuucuucaaaacucuuaaugcccagcaacaccaaagaacaauuaaauauuaauuucuggaggugaaacuuggacauuaacuuugcauuaaaagcuucucagguaauucuaaugugcagcuaggguugagaagcacuaaucuaaaauuuaaacucuucucuguuucuucaacaauaauccacauauaucauuugagaaagccauacaagaguagcaaauuuuccacagauuaaaaaaugaagacaaaaacauagauaaguuggcaaaguugccauuaaauacaacaguuuuuaaccaaacucuaaaugugaugucagcuagucauugaagagugcuuauaaauguuuuauugacaaaauuaagcuuuacucauucuagagauuuucuaaaaacauuauguggaacucugaucacaguuauuaccuaacccaaaaagguauuaugugaauuaaugggauaaugcuuauaaaggccuugaaaaucuuauaagaguagugaaaacaauacaaucacacuauuauaaguacauuuugcuaaauuccuaaauaaauaauccacucaaggaauuaggaaguuuguuuuauuaaaaagagaaaaaauaaaaauauaaaauaauuuaaugugaaaucauaaaaauucauccagaagagauccauuuuuagauuuuaagaugguaaauacuuuuaaagcagaaacacaauaaaagaggucaugaaagaaaaauuauuaacuuugauacuuaaacauaauauuagacacagugaaaacagaaauaaaauuaaaacacaaacugagaaagacuagucaaaacaaauaugaguugggcauaauguuaucaaccuacaaagaguucuuaagaaggcuuacacagcaauaaagaacauauacacaacucauuauauauaaauauuuaagaaauuagaaaaaacauucaaaaucauuaagaaccaacccaaaugcccaucaaugauagacaggauaaagaaaauauggcacauauacaccauggaauacuuugcagccauaaaaaaggauggguucauguccuuugcugggacauggaugaaacuggaacccaucauucuccgcaaacuaacacaagaacagaaaaacaaacaccgcauguucucacuccuaagggggaguugaacaaugaaaacacauggacacagggaggggaacaucacauacuggggccugucggggggguugcgggggagggaaagcauuaggagaaauaccuaauguagaugacggguugaugggugcagcaaaccaccacggcaccuguauaccuauguaacaaaccuacacauucugcauauguaccccagaacuuaaaguauaauuuuuuuaaaaaucuaaauauaauaggccaggcacgguggcucaugccucuaaucccaacauuuuggggggccaagguggguggaucacuuaaagucaagaguucaagaccagccugaccaacauggugaaacccugacucuacuaagaaaaaaaaagaagaaaaaaaaaaaaaauuagccagguguggcgguggucaccuguaguuccagcuacuugggaggcugaggcagaaaaaucgcuugaaccugggaggcagaggcugcagugaacugagaucgugccaccgcacuccugccugggcaacagagugagacucucuuaaaaauaaauaaauaaauaaauaaauaaauaaauaaauaaauaaauaaauaaauaagauauaguaaugaguaugauucacuuacaaaacaggaaaaguuuuaaaaaucaaauuguaauaaguacaaagaugacauaaaaaguauuaucuuuaauauuaaaauugacauauaucaauuauaugaaauuauuuuaaaaagaacaauauuagaauaaaggauauuauagcagaaaugcuacagauuuucugcuagguauauucuaaaugaaccaaaauaaaugaaaucaccagagguccacugauaacucauacagguaaaaaaucuauguugacaaaaauauaggaaaagcugggugcaguggcucacaccuguaaucccagcacuuugggaagccgaggcaggaggauuguuugagcucaaaaguucaagaccagacugaacaauguagcauuaguagagcacccucaucucuacuaaaaauauuaauaaaaaccaaucaccuggguguggugguaugccuuuaguccuggcuacucaggaggcugaaguaaaagggucacuuaagcccgagagauagagacugcugugagccaugaucgugccacugcacuacagccugggcaacagagugaaacccugccuccaaaaaaaaccauauaagaagaacuucuuagaggaaugagugaugguauaccaggugaggagcaagcggcaaaaccucuauuuuguaacugagaauaaguaguugaacacagggaucuuagagagggccccagaauuugugcacugacaacaccaaguaggaaacagaaugacaaagacuagacucaacuauccagacaaaagaccaguuuguacuaggaaauaaggacuauuauagugucaaguguaaaaaguuagucacugaaguugagcugagauugagccacugcacuccagccugggcaacagagccaagacucuguuacaaaaaaagacaaaaaggaaaguaaguuagucacugaagcaauggccaaaucaaauguaucaaaagggaaggaaaaaucaagagacauaguuccccugaugagccugcacacuccuguaaagcuuucugaaucuaaauuuguaucaaugaguauuucacauuaagauuuaagagaagcacuuugaacagcaaccaaauagugaugaguauuaaagacaagcaaagcuauuauuacuuaccauuguuugccagcaaacaucagccaauauacgugagaacucauucagugaggauauacagaaggaggguggaaaagaccuauagaaauaucccacaauauaaaagaaagagaacagaguccuccaggugcagcaaaaaaacaagaauuucaaaaccaucuauguagggaaagaagcaaauuauaaaaagugucugcuuauccacucaaaacaacucagggaaauauguucuuccuuaaauaugaaaucaaacaugagauuaugaaacaacagcacuaacugagaagucaaaagaaauuacaauagagauagacaagaauacgauggauuucaaggguaaaagaguaaaauucagcauuacagaaaaugggguaaguuauaugcaggacaaaucuaaaaacuucuuccagaaugaggaagaagaaaaggagcaaaaauaacauugaugaggcauaauaaauaugaaaggaugaaaggacagacagagaccuaaaauaaagaugccuaacucaaacuaacccaaacaaaaaaggugggggaguggagagguugugagucaaguguauuggcucacagacuugaugaguucaaagguacuccagcuccugucauggauggauccagaaaaucagcugagaucauaugccuaugcccacaccaaucaucugacccuaggaaggacuggauucuaacgggacucauucacaagaccugcuuggcauagacggucagagguguuagcccaagcugcaccauuuuguaaacccuuaccauuucacagacccuggucagagcagaaaauuccacuagagcuccggccaugagaaauauccugccggacaagugccaggucuaaccaccugacugcaagaaauuccuccuuuaucagcagcuaaccacaccgcccaccccaguuugcaacaagcccagaccucucccgccuggaccuauaauuaccccagucuguaagugggggugggcuccagcgcuagcugcugucuccccgcaacccccgugcaggacuucauucaauaaaccuguguugcuguugagccaccagcucucucuuuuacccuugccuuccccucaaaaccuuacaagggguagggucauucccaucccuugaaacacauguaccaagugauaugcuuauaaaauggaggagggaaaaguaccucccaagaaaagaaugcuaggcagacauaauuuuuacauucacucuaguaaauuacauacuaauuuauggaaugcaaguaacaacaugaguaacuagaacaacgaaauaucauaaaugaucugaacagauuuucaagagguguuuguauaugucuaucacaauauccugcagugcaauauauaugguguguaaguugauuaauaaagcuagcaaauugauucacagugggaucaacagcuauaacuaaacuauguugauuaauggaaagauggcacauaaacuagagguuggaaauaagucacuauaacacuggccucuucugaacgugcuuucucauuuuuugauuagggacagaaugagaauuuuucaaaucucuaacucuaguaucuuugugcuuaacaauuuuucuucaauucaucuaucuuaucucccauuuuacuauaagcauucaggaggacaugggccacacuuugaacauuuuguuuugacaucucucaagcuaaauaaccaguuucaugucuugcaaguucugucuuaaaaacaaacaaacaaacaaaaacacuagaagacaacucagccaaguuaucugccacuuuauaacaaggguugccuuuucuccacuugccaauaaccuguuccucauuuccuugugaggccucaccacaauggauuuuacauuccaccaacauucaguucgagauuaucuauguauucucuaagaaaaugaaggcauaaucuccagcucuccucauucuuucugagccuucagcagaagugccuuuaauguccauacuucuaccaacaauugcuucauggcaaucuuggcuuucucugucaugcaccucaaacucuuccagccucuacccaucaaccaguuccaaagccacuuccagauguuuagguauuuguuacagcaacacucugcuucucaguaccauaaucuguguuaguguacuugggcugcuguaacaaaauaccauagacugggugcuuuugaaaacagaaauuuauuucucauaguucugaagguucaaguccgagaaucgcguuccagcugauuggcaaauggugagggcauuuuuccaggcugccaucucacugucccuaaauggccuuuccucaguaaauguacaaggagaaagagagaacucucuagugucucuucuuggaagaacacuaauccuaucagauuagggcuccacccucaugacgucauuuaaccauaauuacuuccuuagaaacccaucuccaaauacaggcuacaguaugugaauuuugggggacacauauagcucguaacaacaguguguguguaugucugcaaacauauauuuauguuuauaaaguucuaaguucagccaauaagguagauguuauguuauugucauuuuaacaauugaggaccuaaggcacagaaaaguuauauaacuuucuuaagaucacacaaccagaaaacugugaaggcuagauucaaacccagauaauguggcuacagagucuguaccuauauucccuauccuguuguaauuuucucucuguuaggaaugaaaagaaaauaauaaugaauauaauagacuuuuuuuaguuauggaagaaaacuuuaugaaaaagaaaaaacuaugaaaaauuuaaauacauagauuaaauacauucauagauuaagugggcaaauuucuagaaaaacacagucaauaaaauugacuuagaaauggaaagccuguauaauuuuuaaacuugaaaauaaauagacguauaauuuaaaaucuauccauucaaaacccacuaggccuauacaguuuaacagauuaucucuaccaagcuuuuaauauacagauaauuucaaucuucuagagaauagaaaagggaugguuauucuccaucucauuuuauaaaacuaaacuaacaugaaaaccagaguuuaagucuuuggugcaccaaacucucagaaacaaccacuaaagaacucuacauguacaaaaaauuaauauaaaaaaaaacaaaaacaaacaagaacaauauaggaaaagaaagaucugagccaguuucuuuuucaaaauagauguaaaaguccuauauaaaaugauaggaaaaaaugaaucuacaaacauguaaaaacaauacauuauaacuaauagguaauccuuggaauggaaagacaauguaauauuagaaaaccuagugauauaauuuacuuucuaucaauaucaggcaaaauugaauauauacauaccuaugaugcagcaauucuacucucagauauagauuucagaucauuuaagacaaaugaauuaaaaaaacacaaccuuacaaaaauaaaaauugcaaaacaaccuaaaaaucauucaacaggugaauggcaaacaaauggugccauacugaaugaauggaauaaugugaagcauaacaaagaauguauuagaacuauacauaugaacauacauaaaagucauaaaaaugaaauucauaaaaacucaaaaaauugaaagaaauaaaagcauuuuucagacugauguuucaguauggcacuauauaagucaaguuuaaaaacauacaaaaugauaccauguauuguuuaaagguauacauauauguaauacaagaauaaaaauauuugugacauugacaacaccagauuuaggacaguguuuaucccuccguaggggaggaaagggacugagaggucaucuggauacauucuucccuccauaccuuauacacucaaacccucugacuggaaugcucaagcacucuuucccuuuucccuuuuuuccucucaaacuucuauucucccuucaagauuuagaucaaauuuuacuucuuaugcucaucugggcucccagaguucucuguagaaaccacaauuaaagcugcuaauuauuuguauaugguaauauucuguucuugauuguggcuccuuauaugaacucugggggaccccacauaaaggaauuccauuaaauuuagcaaguaccuauggagaaucgaauacuaugugccuaauccuuggcugaaugcugaguugcuaaacacuuuauacgguuccugcuuucaaaaacguuacauuuuuuuaaaaaucacaaaauuuaauauacauaaaacuacugaagaacuauacaaucaaucaaaugcuaguauguguuacauaaagaggaaagggaaauuuuucaaaaucauaaaaguagaauucaagcaaaaucucugaggaggaaaaagcccaagaagggauacagagugauguuuuuggggucuuugaagauacucuaaagcaugggucagcaaacuuuuucuguaaaugguucaugauaaauauguucagcuuugcaggucauacaaucucuguugcaacugcucaacuccguuauuuuagcacaaaagcagcuagacaauauauaaucaagugaguaugccugugguuaaauaaaacuuuauuuauggacuuuuaaauuugaauuucacgugucaaaaacuuuuauucuucauuugauuuuuuucagccauuuaaaagugagaaaacuauucguagcucaugggucacauaaaaucagcacagauccaugggcccuaguuugcccaccccugcaauaucgaaaaugaaauaaauaagcccaaggauaggaucgguaguaaaagcugauaaugaagcuacacaaugcaaggucaagaugggucuggauguuaagagucuuaaaaauaccacgauaaaauaaacauacuaauaaauaaugcuaacaaaaauauuacuaaggcaucguucuaugaacucaugugguuggaaacacauccuaagcugccaauuuaaauccauaauuucacaaguuucagcaaggaagaaauagaauaaaauggcaccauggaacccagcauguaccucaccaucuggagccaacacaguuaccuagggaauacaaaaguauguugaauauccaauacgcaaccuccugggaacaggucuaagguuugcauggaaggcagugaggaaaagcagauaagaguuucaacuaauauggugacucacgccuguaaucccagcacuuugggaggccgaggcgggcagaucacgaggucaggagaucgagaccauccuggcuaacacagugaaacccugucucuacuaaaaauacaaaaaauuagccaggcgugguggcgggugccuguagucccagcuacucaggaggcugaggcaggagaauggcgugaacccgggaggcggagcuugcaaugagccgagauugcgccacugcacuccagccugggcgacagagcgagacuccaucucaaaaaaaaauaauaauaaaauaaaaauaaagaguuucaacuaauaaaaauguucagaggaagagaagggguagaggagugagaaagaaaaaauaauuguuuucaaguuuggagaucggccaaaggauucuguucuugguggaguuuugaggaaaugccaucuauagagauaucuaggguucguuuuucuuauuuuuuccuaaaacgguccauaacugaaacaccagauauaguuucaaugggauuucuguuuccucagccuuacaaagaccugcguucaaguuccaagucugauuaauuuguucuauaaacuuggccagcacaugcuaugaggugauaugcugguaauuauuuuuaaauacauaucagaaauuauuagcauggcauuaacauuauauaaguaauuauaauaguuuugaguuaaugaguuaauaauaauuucuaauaacuauaacaauaauaaccccaggaauaaacagauaaauuaggaugacauuuuaagauaaagcuaucgguggaaggcugauagagagguguguauaagaguaugacuauggaacuuccuccagagcauagccuucagauuauuuuuuuuaaagucaugcaaaguucaccaacagucauuacuucacauagaaaccuucuuauaugccaugugucuaaaaacagaaaaauauucaagaccagguuuauuucaagcugaggaagaccaacuucuaagauauuggagacaagccagacgcaguggcccaugccuguaaucccagcacuuugggaggccaaggcaagcggaucacuugaggucaggaguucaagaccugccugaccaacauggugaaaccccaucucuacuaaaaauacaaaaauuagccaggcaugggggcaggcgccuguaaucccagcuacuugggaggcugaggcaggauaauaucuugaaccugggagacagagguugcagugagucaagaucacgccacugcacuccagccuaggcaacagagcaagacucugccucaaaaaaaaaaaaaguacacguuuagaaauuugacagaguaauuuuaggauauuggagccuucaauuaacuucuaauaugcuggaaauggaaaaugucaacauugauaacagauauuuccuuaaagacucaaaaaugaaauaccaaguauucuaugcacuuuccacagagcccccuacucuaaauuaaucaacauuuaaucauacgaacuaaacagggguguguagcuuugccuggaggaaauauuaugguugauuacucuauugaaagaucagaguucacaaacugguaauuugucucucauuugcuuuucugagcuuugauuuuuccuauauauugcucauacuuauccauaagaaagagguuucugaguaaucucucaaguccccuuucgucccuguauucuguuguucuaugaauuacagaaaguuagcuuucuacuaggucacuaaugacaauuagagagguucaaaaaucaaguugucucccuuuggcugaguuggagagaagauggaucaguaucugccauagacuuucucaggggcuuccccugccaggugagagauugauuaauuuccuccaacuaggaggaugacuucaucauggccauucugagaugcuguauucaagacuugacauguaccacugcaccacaugugcaggcacauucacauguauuuaauuugguccucagaacaucccuuuaaggacugagucaggaucugaaaccagguccuuaucauaccccauucuuuuuuuuuaauauuugcccaucaaaaccaaaagaaugcacaggcacaaugguuuugcuucaacuguacuuuuguuuucagaaccuuccagcauucugcuggccaacucagaaggaugcaucuuuaaugccucugaacuccuuuccugguuccuaaaugaaaccagguuucuaacuaauucacagcccacaauuuuacaaguuuaguguaguuucuuuuucccuaaauagguagcacuucucacaguacuggauccuccccgccacuuucuuguccauuuaugccaucuuucaaaagcuuauuccaguugauuuauaauuuuacuggccaaaagagcuuaaauccuguaccuuuagaaacuucauugugugccugcccuuucagauuaucuauaaacauguuuaauaaagaggcccagcagaaaucccaagagggaccucacuguuuacacaucucccucaacagcaggcgcauacauucuacacuuuuuuuuucucuauuaauaccuaccuguggugaaauuucccuccuaauaccaugguaacacaauuuggaauagcauugugaaacuuuuugacuccuugaaagucuaaacaaauuguuucuugcuuuuuuccuggugcuuguuuacccuuucaaauagcucaaguauauuauaaaaaacaggaugcuuuucuccauucauuauacaaaauggucaaugauccuacaauuucuggaguuuacuaauaugaaugagauucaacagucaauagauuguagggucuccucaguagguuucauuagaauguaaacaagaauucacuaauacugaagagugagugcaauaacuuauuucacauuuagauccauuuauucccuugaguuucuucagacccucauaauggaugucauaaaguuucagcaauuuacuuauauccaucaggccaaucaggcagaacauccuguucccuuaucacuauuugaucuaauacuacauaccucaccucuuugcuucaaaagacaugaugacaguggaaaguucuacauuucaacaaagaccaaagugaagaauucauugaguuuccagaucuccuuuuuuccccgugagcacccugaucaucaagcagucucauugauucuccagucgaccuucuaucuuucauguauaaaaacgcuuuuauuucugaauugcaguccuuuuugugcugugucuugaauuccuuuauagccggacuggcuccuuauuuacaccugaccugucacacuuugaggucuucccuguucucacuugaacaaucuuuugccuacuuuuucccccuacuuuugcuucuuuuacuuuaugaaauggaugcaaaagucuuuauaugagcuccuaaucuuugauaugacguauuccccugcccuucuauuaauguauuuaaagcauuuccagauuucuuacaaguuacagacuuuuaaaaauauuacuuucauuuuuuaacuuaaugcacacguugauuugaucauaguuccauucucuuaaauugaggaauaaugugauaggguuuuuuuuuuauuuuuggccuuuauuucccuuuagaagguuaagugaaauugaguugugagccuuauuacaauaaucacagauuauuuccuguaccaaucccugcacaguccuaggcccaaguccaguauaauuccauuccuuauguaauucuaacacuucuugcccuauguggcagauacuuaugcacaaucuuuuuucaguuguauagugugauuucucucauacuacuuacuacuauuuguucuaauuuuccaguguucccaauguaauuucacuauccuuaccauauugaguugguuucuggcagauaaucuuaaccuaggguccaggaaugaguucuaggaagucuaagaagcuccugauaucccaggcaaaaaucaugcauguauaucaauauguguacuuuucuaagaaaggcuuucauagauuucaucaguuccucaaaagaauuacaggcaacaagaaaguuuaagagccacugggcaaaaaagggcgguuccaagauggccaaagagcaacagcuccagucuacagcucccagcguaagugaugcagaagacgggugauuucugcauuuccaacugagguaccagguucaucucacugggacuuguuggacagugagugcaggacagugggugcagcccacccagcgugagccaaggcaaggugaagcaucaccucacccaggaagcgcaaggggucagggaauacccuuuccuagccaagcgaagcugugacagauggcaccuggaaaaucgggucacucccacccuaauacugcacuucuccaauggucuuagcaaacggcacaccaggagauuauaucccacaccuggcucagagggucccacgcccauggagccucacucauugcuagcacagcggucugagaucaaacugcaagauggcagugaggcuaggagaggggcgcccaccauugcugaggcuugaguagguaaacaaagcggccaggaagcucgaaccagguggagcccaccgcagcucaaggaggccugccugccucuguagacuccaccucugggggcagggcauagccaaacaaaaggcagagaaaccccugcagacuuaaaugucccugucugacagcuuugaagagaacagugguucucccaacacagaguuugagaacugagaacgcuaagacugccuccucaagugugccccugaucccugaguagccuaacugggagguaccccccaguaggggcagacugacaccucacacggcuggguaccccucugagacaaagcuuccagaggaacaaucaggcaguaacauuugcuguucagcaauguucacuguucuguagccuccacugcugauacccaggcaagcagggucuggaguggaccucuagcaaacuccaacagaccugcagcugaggauccugacuguuagaaggaaaacuaacaaacagaaaggacauccacaccaaaaacccauauguacaucaucaucaucaaagaccaaagguagauaaaaccacaaagauggggaaaaaacagggcagaaaaacugaaaauucuaaaacuccaagcaccccuccccuacaaaggaaugcagcuccuugccagcaauggaacaaagcugaauggagaaugacuuugacgaguugagaggagaaggcuucagacgaucaaacuucuccaagcuaaagcagaaaguucaaacccaucgcaaagaagauaaaaaccuugaaaaaagauaagacgaauggcuaacuagaauaaccaguguagagaagaccuuaaaugaccugauggagcugaaaaccauggcacgagaacuaggugaugaaugcacaagcuucagcagccgauucgauccacuggaagaaaggcuaucagugauugaagaucaaaugaaugaaaugaagugagaagagaaguuuagagaaaaaagaauauaaagagacgaacaaagccuccaagaaauaugggacuaugugaaaagaccaaaucuacgucugauugguguaccugaaagugacggggagaauggaaccaaguuggaaaacacucugcaggauauuauccaggagaauuuccccaaccuagcaaggcaggccaacauucaaauucaggaaauacagagaaugccacaaagauacuccucgagaaaagcacuccaagacacauaauugucagauucaccaaacuugaaaugaaggaaaaaauguuaagggcagccagagagaaagguuggguuacccacaaagggaagcccaucagacuaacagcggaucuauuggcagaaacucuacaagccagaagagagugggggccaauauucaacauucuuaaagaaaagaauuuucaacccagaauuucauauccacccaaacuaagcuucauaagugaaggagaaauaaaauccuuaacagacaagcaaaugcugagagauuuugucaccaccaggccuguccuacaagagcuccugaaugaagcacuaaacauggaaaggaacaaccuguaccagccacugcaaaaacaugccaaauuguaaagaccaccgaggcuaggaagaaacugcaucaacuaaugagcaaaauaaccagcuaacaucauaaugacaggaucaaauucacauauaacaauaguaaccuuaaauguaaaugggcuaaauacuccaauuaaaagacacagacuggcaaauuggauaaagagucaagacccaucagugugcuguauucaggagacccaucucacaugcagagacacacauagacucaaaacaaagggauggaggaugaucuaccaagcaaauggaaaacaaaaaaaggcagggguugcaauccuagucucugauaaaacagacuuuaaaccaacaaagaucaaaagagacaaagaaagccauuacauaauuguaaagggaucaauucaacaagaagagcuaacuauccuaaauauauaugcauccaauacaggagaacccagauucauaaaacaaguccuuacagaccuaaaaagagacuuagacucccacacaauaauaaugggagacuuuaacaccccacugucaacauuagacagaucaacgagacagaaaguucacaagcauauccaggaauugaacucagcucugcaccaagcagaaguaauagacaucuacagaacucuccaucccaaaucagcagaauauacauucuucucagcaccacauagcacuauuccaaaauugaccacauagucagaaguaaagcacuccucagcaaauguaaaagaacagaaauuauaacaaacugucucucagaccacagugcaaccaaacuagaacucaggauuaagaaacucacucaaaaucgcucaacuacauggaaacugaacaaccugcuccugaauaacuacuggguacauaauuaaaugaaggcagaaauaaagauguucuuugaaaccaaugagaacaaagacacaacauaccagaaucucugggacacauuuaaagcuguguguagagggaaauuuauagcacuaaaugcccacaagacaaagcaggaaagaucuaaaauugacacccuaacaucacaauuaaaagaacuagaggagcaagagcaaacacauucaaaagcuagcagaaggcaagaaauaacuaagaucagagcagaacugaaggagauagagacacaaaaaacccuucaaaaaaucaaugaauccaggagcugguuuuuugaaaagaucaacaaaauugacagaccgcuagcaagacuaauaaagaagaaaagagagaagaauuaaauacgugcaauaaaaaacgauaaaggggauaucaugaccgaucccacagaaauacaaacuaccaucagagaauacuauaaacaccucuacacaaauaaacuagaaaaucuagaagaaauggauaaauuccuggacacauacacccucccaagacuaaaccaggaagaaguugaaucccugaauagaccaauaacaggcucugaaauugaggcaauaauuaauagccuaucaaccaaaaaauguccaggacuagauggauucacagccgaauucuaccagagguacagggaggagcugguaccauuccuucugaaacuauuccaaacaacagaaaaagaaggaguccucccuaacucauuuuaugaggccagcaucauccugauaucaaagccuggcagagauacaacaaaaaaagagaaucuuagaccaauaucccugaggaacaucgaugcaaaaauccucaguaaaauacuggcaaaccgaauccagcagcacaucaaaaaccuuauccaccaugaucaagugggcuucaucccugggaugcaaggcugguucaacauaugcaaaucaauaaacguaauccagcauauaaacagaaccaaaaacaaaaaccacaugacuaucucaauagaugcaaaaaaggccuucgacaaaauucaacagcccuucauguuacaaacucucaauaaauuagguauugaugggauguaucucaaaauaauaagagcuauuuaugacaaacccacagccaauaucauacugaaugggcauaaacuggaagcauugccuuugaaaacucgcacaagacagggaugcccucucucaccacuccuauucaacauaguguuggaaguucuggccagggcaaucagggaggagaaagaaauaaagcauauucaauuaggaaaagaggaagucaaauugucccuguuugcagaugacaugauuguauaucuagaaaacccauugucucagcccaaaaucuccuuaagcugauaagcuacuucagcaaagucucaggauacaaaaucaaugugcaaaaauuacaagcauucuuauacaccaauaacagacaaacagagagccaaaucaugagugaacucccauucacaauugcuucaaagagaauaaaauaccuaggaauccaacuuacaagggaugugaaggaccucuucaaggagaacuacaaaccacugcucaaugaaauaaaagaggauacaaacaaauggaagaacauuccaugcucauggauaggaagaaucaauaucgugaaaauggccauacugcccaagguaauuuauagauucaaugccauccccaucaagcuaccaaugacuuucuucacagaauuggaaaaaacuaaaguucauauggaaccaaaaaagggccugcauugccaagacaauccuaagccaaaagaacaaagcuagaggcaucaugcuaccugacuucaaacuauacuacaaggcuacaguaaccaaaacagcaugguacugguaccaaaacagagauauagaccaauggaacagaacagagcccucagaaacaauaccacacaucuacaaccaucugaucuuugacaaaccugagaaaaacaagaaauggggaaaggauucccuauuuaauaaauggugcugggaaaaccggcuagccauaugcagaaagcugaaacuggaucccuuccuuacgccuuauacaaaaauuaauuccagauggauuaaggacuuaaaugucagaccuaaaaccauaaaaacccuagaagaaaaccuaggcauuaccauucaggacauaggcaugggcaaggacuacaugucuaaaacaccaaaagcaauggcaacaaaagccaaaauugacaaaugggaucuaauuaaacaaaagagcuuccgcgcagcaaaagaaacuaccaucagagugaacaggcaaccuacagaaugggagaaaauuuuugcaaucuacucaucugacaaagagcuaauauccagaaucuacaaagaacuuaaacaaauuuacaagaaaaaaacaaacaaccccuucaaaaagugagcgaaggauaugaacagacacuucucaaaagaagacauuuaugcagccaauagacacaugaaaaaaugcucagcaucacuggccaucagagaaaugcaaaucaaaaccacaaugagauaccaucucccaccaguuagaaugaugaucauuaaaaugucaggaaacaacaggugcugggagaggauguggagaaauaggaacacuuuuacacuguuggugggauuguaaacuaguucaaccauuguggaagacaguguggcaauuccucaaggaucuagaacuagaaauaccauuugacccagccaucccauuacuggguauauacccaaaggaauauaaaucaugcugcuauaaagacacaugcacacgauguucauggcggcacuauucacaauagcaaagacuuggaaccaacccaaagguccaucaaugauagacuggauuaagaaaauguggcacauauacaccaugaauacuaugcauccauaaaaaaggaugaguucauguccuuuguagggacauggaugaagcuggaaaccaucauucucagcaaacuaucgcaaggacaaaaaaccagacacugcauguucucacucauaggugggaauugaacaaugagaacacuuggacacaggaaggggacuaucacccacugaggccugucguggggugcggggaguggggagggauagcacuaggagauaugccuaauguaaaugacgaguuaaugggugcagcacaccaccauggcacauguauacauauguaacaaaccugcacauugugcacauguacccuagaacuuaaauuuaaaaaaaaagagccacuggucgaugcugucacuaaauuauauauauguguguauuuuauaaauauuuauauauauauauauauauauauauauauauauauuuuuuuuuuuuuuuuuuuuuuuuuuuuuuuuugagacagagucucgcccugucacccaggcuggagugcaguggugugaucuuggcucacuacaaccuccaccucccgggaucaagcaauucuccugccucacccucccaaguaacugggguuacagguccaugcccccacacugggcuaauuuucauauuuuuaguagagaugugguuucgccauguuggccaggcuggucucaaacuccugaccucaagugauccaccugccucagccucccaaagugcugggauuauaggugugagccaccacgcccggccacuaaauauacuauuauuauuacauacugaccauguguuuccucauucacagagaauauauuuguccagcauuauuuuauacauuuucuuuacuguuuucauuauauucaaucuguuuucaucauucuguacauaaaauguuauaauuccacuauuucauccaacccugaugcuccuaaagauuuccuaacccagcaguaguaguuuccauuaguuucuacuaauuuacuccuucuaccaagauuaugaaaggaaaauggaaucaggauacuuacuugccaccaaucauucuauccauucuuuuuuuaugcuuuuagcauuuacguaucuaauaugcauauaaauacuuggggacuauacguuucuacaaaacuguuaauuugcugucuagauggauggaugauuuugccaugcccaacacaccaccuucauccaauacaccacuaaauccucuucuccugucacuacucccuccacugccugacaccauaacccuagcaaggucugugucaaauugggucucaugcuuccucugcacuuaucaacuuucucccaguuuuuagguuaaacccuaaacugccacuuaacagauucacuacacacagagcucauuuucuggccccccacauuaaugcaacaccucaaugcaccauuauguuugcugaacaaaccucagauucuuuugcagucuacacaguaacacuauuauaaguuuuguucccugccucccagcuucuuugaacuaggacugaacuuacugauuugauuccuacaauggaaacaggaaugacaugguaggcaaaaaagaacaauccacaccccuucuaaaguuucuugagaugcauuuuaaacaaugacuagaaauauaucuuaaauuuaacuauguaaaaaaaaaaaaacaaaaaaaaaaauccaaugcagauuccaaaagucuaacaagaaagaugaguuuauuuuuaagauacauaaugcucuuaauucuuuaauauuguauucuucuucuauuugagacagcacacuacuaauacaggugaugucacaucagaaucuccaucauucuucaucaguggcauauuaucaagcgaaaccauggggcuguuuaugauggaagugcaaagauucuuacuaggauguuuucaggaugagagaucucuucagacuuccuugaaguuguuuuccaagacugcugcuaaccaaguaauguucuggugaccccaaggugucagucauagcuauucaaagucuagagguccucccugaaccaaaaauggucauuccaaaccaauaaagauaauaaagaacagacaaucuggaauuuauguggcaaacauucaauaagaauuuggcaguuugcuucuaagaguuuguuucucuuuagaaauaaagcuuaaaucagugacuaugccauuugcaguuuaaauggcccagccuguaagauggcuauacuaacaacacuaacggugcuaacaauucuacugagcuugaucaccaugagggaaauuuucauugagaaucucaguguggaacuucucucccaguuacuguucuaggauucacauguuucccugccccucuaccagacuaccaaucugcuccccacugacccacaccauugucaugaacacauuggccaggcagaggaaaaggaagacuucuccaugacccagagcuccacucugguggacaaaaccuauaggaacaaggacuccuggcaguugaugaacuggguuaucagcugggagauaaagauagcagcaggccugcggucucugagcucguguaguacuggcagucacagcuaccggcuacugaacauaugcuaugugccagacccuaugccacauauuuuaaaugcacuguccugugacuugucaccagguaguaauauaccuauuuuauacaugaagaaauuaaggaucagugagaugaagcaaugugccaaggucugucugacuccaaagcucaugcaugcuuuuaaacacuacaccuaaaugugcugcuaucucuagcaaguugagucucagcagcaacaagugaaaagaaaaaggaaaaaaaaauucagcaguaaagaggauggguguguaaaauacuaucacugaagaaguagauguuuagacugugccuaagaauaggaaugggcauuuuaggcuuguuuuccaugauuuaaaucaagcuuguccaacccgcagcccccaagccgcauguggcccaggacgcuuugaaugcccaauauaaauucaugaauuuucuuacaauauuacgagauuuuuuuugugauuuucuuguuuagcucaucagcuaucuuugguguugcuguauuuuauguguggcccaagacaauucuucuucuuucaauguggcgcagggaagucaaaaaauuaucuaaauuuuagauaauguuuuagaaaaauaaaauucauuuucacuaaaaugcuucaaaauuaauucuguuucuggucauaaggaaucacaucagaauaaaugauguuagaaaagacccuaaagcuuagaaguaauuacuauggugaccuuaauuauuugaacaaaagaaaauuauauguaagcuaaaacuguauuguuuuuacaucaauaaaaccauuuucuuggcugaaauuacccaaaccaaguauuugccacgcauuuagugauauaaaguaaauaaaugcccccccauccagaagaggaaauacacacacucacaaaacacacucaagcacacacaaacacuugcuacuuuaugacuuguuugcuaaccuuguuaacugaaacagaggaaaaaccaugccggacuuagagguaggagcguuugccagcagguaauuucuuucaagaacuaacuuuucucaagcuaggcauccggcaaaaaaaaaaaucggaucuucuaaagcauaguccuuacccucuucacccuucuuuccuaauaugcagaccuaaccaguuguuaacaggaccuuuccuaggaaccucauacaucucuaaauguauaucuucucccucaggauauuacuuuaccuguaaaugucccuauauucaccuucauggcugaaacuaacucccuacaagauuacauuugggacauuauuuccuaagcagacucaaucuucuuuauaaaacuucccuugagacaccucacacacucagaaaggucagcacuuccuccaacaaucacaucuuagaggcugaugcuaauuucaggauacagccuugcuuccuuucuguucucaauaaugucuacggagaucaaaucuguauguuuauucuguguugcugugcucagaagcccaggaugcuguucucucagugagccugucacagcaucugcaguguauucucugcugagguuauauaaugacagacuaacccaugcaacagggaagacaguaggcaggagugccaauccaaaaaaauggaaaucauucccaggaaucucucuccaggacuuugaaccauagagaaugauaguuuuaccuuaaauaaucaauguguauaucaguagcuguaaggauggggaggaaaucaucuaauaauaauaugaucauguucagggauucuugcaaauccccauugaaaaauccugucccauuaccagguuacaagagugacaucuaguggacucauauuagaaugacaacaagggucuaaggaaaacaaaucaccugugcacacaucuuguuaaaaugcagauucugguucauuagaaugaaucuauuacuucuaacuuccaggugaugccaaugcugccacuccauagacuacucagugucacuaggacccagagcauuucgcaccugcuuucacccucaggcgagaaggaggagggggcacuugagaguaaauacuuuccaggugaaaaauaggccaaaugaauuauuaauauaauucuguauaauguuccuauuucacuagcaccacucagcaugcacacguaccauuuccugucugggcagggucccugaagcaguacuccuuuuccuaaaugccagaagcaaacuuaagaaggaaacagccuauuucacagccauacuuauacaucaacaugauuuguucaagucuccaguacagauucacuucaguacuuaacaucuuacaggcuuucuaccauuguuauauuauuugccuaauauuaaacuauaauaguaauugguaccauaucagaacucaguuauuuuccccccaggcagccugcaccugaacugagaucuaucaggguacuguguuggugcuaagcacagcuacucagaauuucaacaagauuugcacuggacaccccuaggaacaaaacaggacauguaacuacaugcgaauccaacuguuuccauaaacuaguccugugugauuuauuugagcuaaagagcccugaccuccacacagagccaccaggcuagacucuuagcugcgagguaaugugcgugucccuucaaagaggagcuaugccaggccucacccaaacucuucccaccuaggccuccaccuuggguagauuugaacccauucuuugguuuuagguccacaguucuaggaacgacaacaaugauuuccagcacugaaggaaaucagucucuuuucuccaaaacacauacacauacacacacauacacacacaugcacacacauacacacacauacacacacacauacacauguacaaaacccacuuucuuguucaauaaaguccuucaguacaagaugaucgaucuaggacaaguaaugaguuuuaagcaguggaaucccuguuucaaaaaacuaccagaagguggaauuguucugguugaaauggggugugaauacuuagaaaacugucuacuugguuucuacccaggcuaucccccuccuuaggcccuggaauacuccuccucaugucccaaauauuccuucccaucccagcucuguccccacacuaccaaacuccagaaauacagguugaaaacuagaaacgaugagucucacaacagcuaaaaccauccccaacuccuauauugcucaaggacuguucucauuaaauagauggaacuguuaauagguagaguugcuucacuauaccaucacuuacuuaugaaccuaauaccauuuuagcauaugcgaccaaaggauuuauucaaaagauguacaaccugauuucugaaggaaauuugcuuuuaagucauaauuaaggaucccugugaugaguaaacaacagaauuguuuauaccucuugaauugcucuuggcaguccuaaaggggaaauuauguagaggaaaaggucacauaauuauuucucaaaaguaggauaaagauagaaaaugaaacuaaacaugcagcauuguaucaucugccuauacaguacaaugagcucaagucccccugccucaguuagaaucccaguuauaccauggacuugugacccugcacaaguuaucuaaacucucuaugccucaguuuccacaugugaaaguggagauaauagcaauaacuauuuuaagggcugugguaaauauugauuuaauauauguaagauauuuaauaacacaguaaucauugauaaauguuacaucugauaauuauuauagugauuaagauaauauuacuagaacuaaugacugaauauucaaaauggccuuugauucuuuuagauaauuuuagccaaauauguuaggcauagaaaauauaaaaacacauuaguucugcacauauauuaagaauacaagaaaagccgaaaaaaucuuaaaggaacuagggauuuacuacuuuuacuuuccuugcaccaccuucuauuuuaccucuuagcgaaacacauuuaaaacacuauaugucagagggaauucugaguuuaaaaaaucauaauagucuuugaacaguuguaagugcauuuauucuuugugcaauaguuacccuuggacaucauguuaccuuauuuauguuaacuucagaaauuuuguuuuaaaucaaagacagccaaaucuuuccuaagaaguagcccagaggguggcagcuauuaugccgcagcuggcacaucugccuuaauuuuaccugcuccuggacugcccagugaccuauauucuucagacuguggcaaccuccuggccaacugguuccaaauuuaaccaggaucuucaaacaaaagauuuugucuugcuuuaacaagaaucccaaauccguaaggaucaaggcauacacaaaggcaaauauucaaaagcuaccuggccaaaaacuuuagaacuaaaggggcuggggguucauacaauccaugccuuaauuuaccagaaaaccaacuuuugaauauucuaacucaucagugcuaauuaaucaaaaguuuguagaagccucugaaauguaaucuaaugucuuugcuaucaccuacucuuucguucccaauaaaucuccaaauauuuuuuaauggguaagcauuaucgacauucuuugcaauuuuaaggguauaaaaacaaguguuuaaaauauucuauuuccuucacuuuuuaaaaccaaaagagaaaucuccacaauuuuuugcucuuacaaaggugaguauauauuuuuuauaaagguagguucccaucuugugggcuucucagagauuacuccugaaaaucauuuuugucaugguuccuuuuguuaaguaugaaucuauacccaaucucaauuaauuaaaccauucaauaaacuagaagccuuacucccuguaacaacugagugaugcugccauacaugauucuccucaaacucuauuaauuuuaauaaugcuauauuuggacaaugagcugaaggcuacaauuuccgaaaaaguucuacaaagaguuuuuuuaaaacaaaauuaccacagcguguugcccucuuuucuucucuaaaaaaugaaaagaaauuaagcuaaaaaucccauaaaguuuaagaaagaaauucagcucuguuuauuuauuuacucugccccuaagcuucuauggguaguuuucauagagacuauuucauauuuucauagaaacuauuauucacaaaagcuauaauuauuaguucaacacaccaauaauaacaggagccaccuuuuauugagggcuuucuagagucagaugcugcacaaaacacuuaguacaaugaucucuuuuaauucuccaggccugucugaccccaaagcucaaguucucccaacuuucccugcuauauugccuuugagucccuugaaaucaagggcccaguucuuccucauuuggaggcuuucaggacuaaaacacugccuaccccacaggguacucaagaaauuauguuuuaauugguuugucaagagucauuugaaagcaauguacugaaaccaugguagggggaaaccuacacuugcccuacagcucauaauucaaagauacuucuguagcaaggccagcuauuagguuugguacccacuagaaucauaauaaacuugacauuuguuaaagagauaauggaaacagauuagaagaauucuagaaucugccaaaaacaaacaaaaaaaaaagacgcacauccaugaugcauccagcuuaguuuggauacagucagaaaagaaauuuguuuuuguuuuguuguuguuguuuguuuuguuuuguuuugagacggaguuuugcucgucgcccaggcuggagugcaauggugcaaucgcagcucacugcaaccaccaccuccugguuucaagcgauucuccugccucagccucccgaguagcugggauuaccggcacgcaccaccacgcccagcuaauuuuuguauuuuuuaguagagacgggguuuccccauguuggccaggcuggucacaaacagaaacaaguuuuaaaaccuuaaauccaugguuccuauuuauucuagaacauaacugcuuaaugucucuaggcuucccuuucaucaaacuaaaagaagaauaagcaaaaauuuuauaaauacauacauacauguauguauacauauaucucccagcuacauaguacaugucuguugguaaccaucaugauuauuguuacuguuauuacuaauacaacaauuauuuuaaacaugugauagaaucauaugccuguuuauaccuucacauuuuagugccuuagugugacuaugguaaaauaaauaaauagaaagucacacaagaagagacagauguauaucauuuauauuuugacuuuuuaaaaaaaaauccuuaacauguguuuaagaaaaaaaaagaaaaagauucccaauguuaccuaaucugccaugauuuaacagcacuuugacauuuuucuaaggaaugauagcaaaguacugcauaucuucaaacuuggaauuuacugccugucugagucucugcuucugccaaauuaaauauacaguauaauguccccaccagaaauaacauagcacagcuuccugcucuacuccuugguugaauaagcccaaauuggaacaaggaagauguuauuuuauuuaaucauguaaauaauuguuuucuucaaccucuugaguuagaagcuacuucagaagaaaaguuuagaagaaauuaccaugugaauuaucaggccauuuaaaggaaaauucccauugaaaggcucaugaaagagcauaaaaaaagaauucucacuaaugaacuacucagaaagucaacuaccccuagcuauugcauaccaccugaacuccuggggucucccauuggucugcaaagcacagaccacaucauagaauagacaguagagggcuuccauccagcaaucacccaaaauuuuuuggaagaguccuguauaguagcacauauagaaauaggauaggauuugaaaaagacauugcuugggaaucaaagaaagguuggugggcuuuuuaaggucaaaacuaugaucuggcugggcgugguggcucaugccuguaaucccagcacuuugggaggccgaggcagguggaucaccugagguugggaguucaagaccagucuggcaaacauggugaaaccccaucucuauuaaaaauacaaaaauuagccuggcauggugacguauaucuguaaucccagcuacuugggaggcugaagcacaagaauugcuugaacuugggagguggagguugaagugagcugagauugcgccacugcacuccaaccugggcaacagagcaagacucugucucaaaaaauaaauauauauauauuuauuuauuuauuuauuuauauauaugaucaucugcuuauccuaugaaguauaauacaggugauagaggacauaaaaugcagaugcaaugcccuuaggcaaaauauggaaagggacgcuuccucucuugugacaggaaggaaugcagugaucuauauauagguucaaaugcaagaguuugggagguacaguagagaaaagauaagguaguucucuuuugauugcauuaauuuuaaguggaauaagagacaaagucuuuaaggaugaggagagauggaaagaucuuagagaagagaagaugugagguagucaucucagagggggagaaaauaaauuaccuagguaaagguggcaggauuucuggguaagcccgaggggccacuugagagagauggccauggauugggagggagaucaucagcaaaguagcauauuuucuucuggccauauccaccacuugacugcaggccaggaauagaugaacuauuaagucuauccgcacugggauuuugccaguugaguauaaaggcaaagcuauagucauugauaauaacagucuaagucugcgagcaauggcucacagcuguaaucuuagcacuuugggaggugaaggugggaagaucacuugaguccaggaguucaagaccagccugggcaagaugaugagacccugucucuaaaaaaaacuuuuuaaauagcugggcaugguggugugugccuguggucccagcuauuacucgggaggcugaggugggagguuugcuugaguuugaggcugcaaugugcuaugaucacaccacuacuccagccuggacaacagagagagacucugucucuaaaaaaauaaugauaauaaugcauuuuagaucuggaaacugagugcuccuacuaacagcaucaacaucaccuugaaacagaaucugcaucuuaacaagacauccaaaugauucacaugcacuuuaaacuuugagaaacaccaagugaaugggagugggagccaagugagaacagaaaaggaucacugcaagagaggagagguuaaagaaagaagaggguggacuguugcaaggguccucuauguggauuuuacagccaccaagacugaugacaggagaaaugacugggucaaaagaagagagauuaacagagccauaugggaaaauuguccaggugauaacagauggccaaaagguuuggaguucugguuguaauugaggcaaauggguauaaggagugaugggacucauucugguaguaguuuauuuuauuuuauuuuauuuauuuuauuugagacagggucucgcucugucacucagacuagaguacaguggugcaaucacagcucacuguagccucaaccuuccaagucaggugggaggcucaagcaauccucccaccucagccuccagaguagcugggaccacaggcuugugccaucaugccuaguuucuucuucuuuuuuauuugagagacaggucucacuauguugcccaggcuggucucaaacuccugaguucaaacaauccucccgcaucaguagugcugggauuacaggcgugagccaccaugacuggcucugguagucuuuuuaaggaaagguuacagucuuauucucaagaccggccucuugggcaauuuacccugucaugagggcaacacuauagcugaaggaguugugguuuugccaggagcacaauaaacugugagcucccucaauuccugcugccaaaggaaugagcuggggggacagauggucucaucagaaacacagucuggugggcuucuauuagauccucacaucagcuugccccuugggaagggauucacuguauaucaaaacuaaaucauuaagcacuuaguauagugguagcuacccaaagaucugugggcacaaagacugugccugcacuagagagcauaaaaacucauagaagacuagagaaauucauugcucuugaaaaggagaagagagacaagggaccucugaagccagaaaggagaagggagagagagagacacaagauggggagauucuuaugcuauucagaacagugaaacucccugguaacaaucaaaggauaugguuagaaaggugaggccuccuguuguaagacuggguacauuucaucuauaaaaaaacacugcucuuaaaauguaagaacagauggugaggacauggagaaaagagaaugcuuauagccuguuggugugaauguaaauuaguacaacuucuauggagaacaguauagagauuucucaaagaacuaaaaaauagaacuaccauucaauccagcaaucccacuacuggauaccugcccaaaggaaaaaaaaucaagaucucaaaaagauacuugcauucacauguuuaucgcagcacuauucacaauaacaaaaucauggaauaaaccuaagugccugucaacaauggacuggauaaagaaaaugugguauaucuauaccauggaauacuacucagacauaaaacaagaguaaaaucauaucguuugcagcaacauggauggaauuggaggccaugaucuuaauguaaaauaacucagaaacaucaagucaggcugggcacgguggcucucgccuggaaucucagcacuuugggaggccaagguggguggaucaccugaggucaggcauucgagaccagccuggccaacauggugaaaccccgucucuacuaaaaauacaaaaauuauccaggcaugguggcacaggccuauagucccagcuacucgggaggcugagucaggacaaucacuugaacucgguaggcagagguugcagugagcugagacagcaccauuacacuccagccucggcaacagagcaagacucugucaaaauaaaacaaaguaaaacaaaaauggcugggcacgguggcucauggccauaaucccagcacuuugggaggccgaggugggcagauuacuugaggucaggagucugagaccagccuggccagcauggcaaaacccugucucuacuaaaaguacaaaaaauuagccaggcgugauggcguuugccuguaaucccagcuacucaggaggccgaggggggagaaucacuugaaccgaggaggcagagguugcagugagccgagaucgcaccauacacuccagccugggugacagagugagacuccacuucaaaaaaaaaaaaaaaagaaagaaagaaagaaaaaagaaaagaaaaagaaacagcaagucaaaugcugcauguucucacuuauaagugggagcuaaauaacauggacauagagaguggaauaauagacacuggagacucaaaaacaugggagguggaaggggagugagggaggagaaaguaccuauuggauacgacauacacuauuugggugaugacugcacuaaaagcccaggcuucaccacuacauaauauuugcauguaacaaaccugcacuuguaugcucuaaaaucuaauuuuaaaauaaguaaauaaaaacuccauuuuuuucccacuauauucaguaucaccuguccuugugaguguauuugugaauggaucuucuacgauauuggagacaguagaggucagugugggucacaaacaaaggaggacauggaaaugaagguuccuagaagguugaagaaauuugggcaagaguuuuagauagaugcaggcuaugaaauuaaaagaauuaccauguuggccauguauguaaagggcaguggccccacugacaacuauguuacauaauaaaauauauucuuuuuggagaccagcuaucugcuuucucugcacccuccucucccaucucuaaaagccuacugucuuuaaguauaauuguuuaagggcugggaaacauaucuaugcauuaaaaauauuacaggcucacgccuguaaucccagcacuuugggaggccgaggcagccagaucacuugaggucaggcauucgagaccauccuggccaacauggagaaaccccaucucuacuaaaaauacaaaaaccagccaggcguuuuuguuaugccuguaaucccagcuacucaggaggcugaggcaggagcauagcuugaaccugggagguggagguugcaguaagccaagaucacgccacugcacuccagccugggugacagagcgagacucuaucucaaaaaaaaaacaaaaaauuaacaaauauuauguaacuauuaaucccuuaggcuaagugcuucucuguggcaggguccacuagaaaugggaacaaaagaagcagugaaaucuaaaacuuuuuuuuaaaaaucugaaaccugccagacacuguggcugguaccuguagucuccgcuacucgguaucccagcuacuaggaacacuugagcccagcaggucgaggcugcaguaagcuaugaucacaccacugcacuccagccuggacaacaaagugagaaccagucucauaaauaauaaauaaauacauaaauaucugaauucucagaaaagcauccaccaacauguucaacaaguagcaaaauuaugucagcucugucuacguuugucuaacuuacuuaaucuuaaaaagcuggcagccaaagaauagggaagaaaagggcaugagaggauaaucaaucugagaaguuaagaacugcaugcuuauaaaauaacacacaaaacaagaaucacuacuuuucugaaauuuacaugacaugcauuugagguauacaaucuuucagauaggguucaacaagaauggaggagagugagcuaggcaccucaaguaacuccugugaccaucagagucuuccauuauagacagcccaaaacucagacaacucaacuuagaugcaaaguuuucuguaauuauuacagaaaacuaaauuauaauuauccuggcauucacccacaaaaauauucccccaaucuauuuuuaaaauugaaaacagaccggggucucuaagcauaucuaggacccaucuugguaugcuaguuucauuucagcuaaauuugcauuuauuccuuaaucacagugcugaacuaguucuugggaagaggaaacaaauuaauucugggcucuugaggaaauaaccugguagauuucuuauuucuuauagauaauacagcugcaaucaacuaaaaucaaauaaguauacuauccauuuuaugugaauggcacaauucaacaggaaaaguacauuucuaucauugaagaacagacaaacacagacacagauacacacacagagagaaagagaaaaaaaauccuaugucuuuuacuuuccaaaauaaaagccaagauucugaauuucuuuucaacacauagugaaauaauugagggcauacccagggugccagaacucuaggugcacaugcccagaaggaauagcugaggucuauauaaagcuuuuuaaaaugauguuccauuuuuuaaaugagcaaaaaauaaacuauaaacuuuaugcuugaacacagugaacaccuaccuaugugaugggauuuggaauuacacuagagaaucuuccaacucaggaaugcuuucuucacguacauaaaaggcugaaggccaggccaggcaugguggcucaugccuguaaucccaguacuuugggaggacgaggcagguggaucacuugaggucaggaggucgaggccagucuggccaacauggugaaacccugucucuacuaaaaauacaaaaauuagccaggcgugguggcacaugccaguagucccagcuacucaggagguggaggcagaagaaccgcuugaaccugggagguggagguugcagggagcugagaucgugccacugcacacccacauaggcaacagagcaagacucugucucuaaauaaauaaauaaauaaagacugaaagccagacuuccauuauuugagaugauuucccauagauuccaacauuguucuguuaaaauacccuugagaaagaccuccauuaucaaugacgaguauaaauuuaguugaucagacccuugaccuaggagcaaguuugauggagacccuugauagggguagaguugaugaagggaacugaaaucaccuuuucuuaucaaagguagcagaaucugaaagaauacucaacaaggaggcagggcaccacaguuggaguucaucugcccaaucuagguaucagauuucuuaucugaaaaacaaaaagacuaaaucugaugaucucuaaccaauucaacaauguaaugacgucugugaaaugaagcaggucugguuagaaguauagggucagucacaaagggcuaggaaguggagaagcaaaaugucauuaaugguggucauaaaacgaauggugcagacaaaggggaagaacuggagaaaacaccuccacaacuguaauuacaccuaaagaucaacucaauguguugaaaagcagugcuacagugaaaucacaguaaugccucagguaaagggccaugaauauaaacagagagggaagaaucccagguucauauugggucagugcuuuccucaaauuccgauuuuaaaaaauggaaaagaaacuaguuuugcccaaggaaauaaugucuuaaagcuaaaaggaugauuagcaggguugaugaauuuccuggcaaaugaaaaaugcugacuuuuuuguuuucucccaagagcacuaacauugaaaugacuccaguaaaauucacucauucauuccacagauauguauauaguaccuaacaugugcuuccauugauugugagaagauauacaaugaugaaaaagucaccucuacucuuaagaguuugcaauagaguacaggagauaugcagauacauuaauaaauacaacaacauacagugcaacuggaccaagcaacuggauuggaagaagagcuagguuuuguuuuaaauuuuauuuuugaaagaucacaguuacuucacauauucauuuacacuagccaaagucaagaauuucuaaggacaaguuaagacacuuaauaaagaacagcagcuccugagccaucugcuuuguuccaaaaaugaagaaccaucacacgcaaauuuucauuuuacuucaauccugugagaauauuauugucagaugggguagguaacauuuguuuuguaacugacaugguuaacaaaucaugcuuuauaaaauggcuacagucagugccucuuuuaggugggaaaaaaaaaaaagaaaaccaucauacgagcccaaaaggcacuuacuuucagcaaguuccuuugaucuguuuaagggucuuguuacuaaucucuuucugaugaagaaauacgcaaaacagaacuuaaagugaacaacagaaccuuguuauagccagacacagauacauuacaaaaaaaaaaaaaaaaaacagcugaaggauuuguguauaaaaagaaaucauuuuccaaaaacacaucauauaaaacugcaaauuacaacagcccaacccuagacugcuguagucuuaccugguaaggaacgauacugccaugagcuguaccccaacguuuugcuuccuuuugaccaauaagauaauuugcagcuaugugagacaaacacgccaccuaccaggaaaaaaaguaaauaaauaaaauagaacagcuaguuuaucuauacucauaaagagaacguuauauuaugaaaguaauuucacuucaucucauuguagaagaaaaaaaccuguccaucaaguuagaaaauauacaggcauuguacuuuuaucacacaaaugaagaacggcauuacacuauugcaugagacuaaguaauagucaauugagaaauauaaauacauaaacguucaaccccuaaaaagauuaucugaaagcagagguugaccaagcagauggaaccguggucuggccuuuauccucaaacccauggcaauauacaucagcaacucgugcauuuuuuuccccucugcauguaucuccuuuuauuuugcaccaagauaacacaaagagagccugugucaucacugaguagaugaaccaaagccaggaaccacauuccucuaaauuucugaugacacagaaaaguaauaauaauaaaccuccauuuuauuuaagucaguuuagccagguuuucuguuacauucugcccaaagcauucugacagaaaagaucaagauuauuugaguuuuuaaaauuaauuaguggaucauccucauuuaaagaaacauuacuguacuucucccaauuuguuccuagccccaugugcucacugucauacucgauucaauuuuugagaacugccgaucuauuaaaggggucauccaaaaccuuagagucaauuucugacuacuguaguauuucauggacagaucuugacaaaucuacaauaguucaacucaauaugacgauaauaugaagauaaugaauugauuccuggugaucugccacaaggaucuuauguuccaaugaauauuuauggcuccaccaccacagaacuauggaaaggaggugaucaaaugauuuuccauggauuccagaaaagaauaaaaagugguucaggccacaugacauaaucaugauauagcaccggcuugcuuuucccuuucuagaucgucagaugcgauuggaaaaccuacaaagccugucauuaaaacauaccccaaauugagauuggcuccuggaacaacucaaggcaugauuuuucaggccuuuucuugcccccuaccuagcacagcagcugugcuuccuacaagaaauaucaacaggacucagcuuggaugaaucaccuugcugcugcagccauucuccuuuacuuuauucuugggacuuaaacucacuuuuauguucauuuaccgcucugucaaaauuggaacugccuguggcagcugguuuggcuguacagcccagguggcaaaacuaauaaacuuugagucauccaguucuagacuuccaucuggucuugggcauuugaaccauggagcauuccagggcugccuggggccgccuagugcuaaucaccauuucacagaucacuucugugucuuucaaaauggaaaaucaaaucaacauuuuguagcaaaaaugcccuggauaggaaguccagacauggaugguugaaaccuagaugguuucuaaucucuguugaccucuaaauaguuccaugacuguggguauguaauuuaccuucuuugaucuucugauacauucucuauaaagucuugggcauuucagcuaaaccaaagguuuucaaauuuuuuuuaaaaaagcagaacccucguauucaaccaaauaauacaugaaacccuaauauauaaauauguaagcagauaauauuucaagugcucuggaugaagcagaagcaguccugcaacaccacccaggcagaaugaacacaaaacacaauuugcaaaauaguaaguaaucuucaacgugcuuacaaggcaaaugugguauacacuucgggcucuauuauuccucuuaacaaucuggcagauaaaaagacaagaggggccgggagcaguggcucacaccuguaaucccagcacuuugggaggccgaggcagguggaucaccuaaggaugggaguucgagaccagccugaccaacauggagaaacuccaucucuacuacaaauacaaaauuagccaggcaugguggcacaugccuguaaucccagcuacuugggaggcugaggcaggagaaucgcuugaacccaggaggcagagggugcagugagcugagaucgugccacugcacuccagccucggcaacgagagcgaaacucugucuuaaaaaaaaaaaaaaaaaaaaaagacacaagggaugcaauaggaguuauuucccuugacaccccuuccugaaauuggagacauuuucugacuucucaggucucuuuucagaucuagcuauguuguuauucuuuuuauuuauuuuuucauucaaauaaaucauggcgaaugucacucucuaaggggcucuguugcuacugaaggccaagaauucaaauuaguaaagguuauucugugcaaguagucaaucacaaaaggcuuguuauuucuacuucucuaauuucaaagucaauagaccaacaucaucaagggcuacaugagguggugagguggcuggaugaucacaggccaacuuauaaauccuaaauugaucuaagauaguugccagggauagggaagaacuggauuccuggcuggauaucagcuuggcugccucauuccuuacccacuaucuuauucuuucuuuucaauuuuugacuucuguguuucugaccugccccauuuagaaugaguuugaaugaagaaucagaauucaucucucaaacuguuugcaaguagaauacuauauacauuuccuccuccauacagugguaguuaaugaaaacaaaaagcauuucagaauuagcaggcucacauugggcagaaggauuaaauaaaauuuuaagccaauugccaugaaaaaacaaagugugggccaggagcaguggcucaugccuguaauccuagcacuuugggaggcugaggcagguggaucgcuugagcccaggaguucgagacccaccugggcaacauagcaaaccuugucucuacuaaaaauacaaaacaaaaaaaaaaaacagauggggggaucaccugagccuggggaggucaaggcugcaguuagcggugaucacgccacagcgcuccagccucagcaacagagucucaaaaaaaacaaaaacaaaaacaaaaacaaacaaacaaaaaaaccaaagugugauuugucaguaacaacucaaagacaaaguuggggaaaaaagaauucuauuuuuuaagaaagagagcaacauggcuaaacuuagcaacucaauguuuaaaggggguauuaccaaucugaaaguaaucuacuauuuacagggauguauuuuaaggcaggagaagggagagaaagucaauagcuaugaugugauuauguaugaaaaaaaucagagguuuccugggcaauuaaugacaaauuuugcacaaauuaaaagaaugcaggaugugacuuuuugguuaauaacuauauacuguauaugcauucuaaauacugcauuagaucauuacuuucauucccuaaacuuaggcuuauuauuucaucaaguggacgcuauauaauuuacucagaauguugccuuuuuaugguuucaucuaaacaaaaaagucaacuuugguuuaauaauaaucauucugacagcaaacuauuauuuuagauaacagaguggguccugauauucuuuguuucuaaccagaaaaccaaugggguggucaaaauggaucucaaagagcaaagccccaaaaggcuugaggaagaauaugcccaauuaucucucaaagcagucacauggugucugucaccacaugcuccacuuccaccgaaugaggaucaagcugcaauaauacaaucuuucaucuccaaaaggacaaccaagugugacagguaaaaugaaaaaaacaagacuagaaccaugguucacugcaucaaaacgggucauuuucccccacuucccuugcaugucuucuggccuacagcuaaggugaacugaacaccaaccaugcaaucacccaccugcccacauuuccaccuauucuucaaagucuauuucaacaucaucuuuuccauuaagccccaaucccagccagcaagcaagagauuauauuuccugcccccgaaugaauacaacacuuaauuuaucugauuucuacugcacuuucacagucuuccuuguacuacaauuagaauuguaagaugucaaagcuagaacgagcuaggucacuacuuccuuaaccuacccaugcauccccccagucaccuauggaauucauagaacccaccccauaccaaaugaaucagguuuuucagggauggaaacuuggaaaaaaauaauuucaccagcguaguauuaauggcacaccagaguugagaagcauagccuuacaagagucuagucaaacuccuuaauauccagauggauacaaaaaggaacacagaauaaaaauaacuuggccuggcacaguggcucacaccuguaaucccaacacuuugggaggcugaggcagguggaucaccugaggucgggaguucgagaccagccuaaccaacauggagaaacuccgucucuacuaaacauacaaaaaauuagccaggcgugguggagcaugccugcaaucccagcuacucgggaggcugaggcacgagaaucgcuugaacccgggaagcagagguugcggugagccgagaucgcgccauugcacuccagccugggcaacaagaccaacucaaaaaaaaaaaaaacuuaugugaggacauacaggugguuaauaacagaacuuuacuccaacaacauugccuuccuccaugcuacaauauuauuuauauguucuucuaucccuccuuuuaaauaaggagcuauuucaagguaagacuuauuuauuuuaaacccuuuguguguuuccauagcacuuaacacagauccugaacacuauuuuuuaacaaaugaaugaaaaugguaauuacuacuuguuuaauuauucagcaacuacugaguguugcuaauguguaaggcuuuacucuagguacuaaguauacauaaggaaauaaaaaagauauagucuugccuucuuuggaauaguaaagaaaauaacuaaacaaagaauuauaggaccugccauggggaaagaagauggaagauaaaacuggaaaacaaagaguaacaugugcgaaagcucaaaggcaggaaagggguuggcauagagaaagaacaaaacugaaagaagacaaauauaacuaaaccauggugagaaagagacugaaacgaaaugaaagagaaagguagacagaggccacagcaugccagucauuguaguaaugguaaggagccauucuuugcacaucuugcagaaugaucauuucagaacaaucacaaauuguaucgucauucuucuauuuaaaacccauagggaucccccacauuuguaauuauauucaaagaaugaacuaagaagaggcaagagagaaaggggacuguuagggauauuguaaagguccaggcauaauuugaugauagauagcucagacaagguugguagcaguagacauggaaaaaucaugaguuuaagauauauuuuaagaacagaacagacagagcaugugaaagguuguaugggcagaggaugcagacagaauggugacagagaggagaaaccaaacuuaacucccacaguccugcugaauaucuggguaaacuaugacagccuuaacagaaaaacggaaaucagggagagaaguaauugaagcgaaaagaaaauaagagcccaccucugaauguguugaauuugagaugccugugauauaaucaauuaggcaggacucagcagccuauagaaaguauuuaaaaguccuaaccuaaggggaaagagagauaagagaagaaaucggaaauaauaucaaacaagagaagauaaaguuuccaugcaaaaacaguccuuccucuaucaccaaagggaugaucaaagauguagguauaaacuacuagagccaauuuaaaugccaagaaugggugguuuuaaauaagcuaugacaucuguauauaacaauagaagauaaauaggcacuuaaaugacacaacaaaacaauauagcaucauguggaaaaauauucauaacauuuuauuugaauuuuaucugaaauaaacuuuguauuucagaacauuguucaauuuauagaaaaaccaagauaguacagagaauucccaucuacuccacguccaguaucccuguuauuaccauccuauauuaguggagugccuucuuaacaauuacagagccaauguugacacauuauuaacuaaaacccacauacucagauuuccugacuuuucacuucauauccuuuuucuauuccaagaucccaaccaggauaccacauuguauuuagucauccuggcuccguauuuagucauccuggcuccuuuucgcugugacaguuccucauacuuuccuuauuuuuuaugcacugaaagcuuugaggaaacugaucagguauuuuguagaauuuuccucgacugggauuuuugugauguuuuacucauaauuagacuggaguuaugagguuuuaaaagaaagaccauaaaagaacagcaccaauuucaacauaucauaucaaagauacacagugucaacaaucaaucuugaucaccuggcugagguaguguuuaucaguuuucucugcuguaagauuacucuuuuuuccucccccuuuccauacaguacucuuuggaagaaugucacuacauaagccuauacuuaagggguagaaaguuaugguccugcuucuggaggguggaguaucuacauaauuauuuagaauuuagcacacauuugucucccuuuauuuauuuauuuauucaaucauuuauuuaaaucagcauggucauguguuuuuuuuuuuuuuuaauacuuuuuugguuauaauucaauaccacuuuuuuguuguugaucaaauuauuccaguuuuggccauuaggaccucucuccauugguaccugugucccucucgcugugugggcuuuguuuuuagcacucccuuacuuugugacaauauaagaugcuaugggcucaucuuccuauuuccuuucccagucuuauaggaaagcauaaauagaauaggaguuuuaggguaaagagcaaauauuuauuucagugucagucagcaccuuauucauuccauacuuuuauuuaaaagcugauuuaggccaggugcaguggcucaugucuguaauuccagcacuuuuggaggccaaggcagguggaucacuugaggucaggaauucaagaccagccugaccaacaugaugaaaccccaucucuacuaaaaauacaaaaauuagcugggcaugguggugagugccuauaaucccagcuacacggaaggcugaggcaggagaaucgcuugaggcggagguugcagugagccgagauagagccauugcacuauagccugggcaacagaaugagacuccgucucaaaaacaaacaaaaaaaaaacacugauaucacacuuacuaugugccaggaauugcucuagauacuggggauacagcagggaaggagaaagacauaguccuacucucaugaagcuuacauucuaggguaagguacauucagacauauacaggaaaauaucaagaaaugauucgugcuaugaagaaaaugcaacagaaucacagagagugcucuuuuaaacuaaugggcuuaguagaggccucuuugaagauguuauauuuaacuuaagaccuggagaaggccugugaaaaucuaggagaaauuuuccuuuuguuugagacagagucuaacucuguugcccaggcugcagugcaguggcacaaucucucauugcaaccuccaccuaccaaguucaagcaauucuucugacucagccuccccaguagcugggauuacagguacacaacaccaugcccagcuaauuuuuguauuuuuaguagaggcaggguuucaccagguuggcgaggcuggucucgaacuccugaccucaagugauccaccugccugggccucccaaaugcuagaauuacaggcaugagucacugugcccagccuagaagaaaucuuucuaggcagugagaucaaccaguuagaagacuuuaauaugcuaaaaagcuuacauacagugaagaacagaaagagagccauuggaguuggaaccuaguaaguaaaagagacaguaguacaagaugaggucaggaaaguguaaaagggccauaucauauggguccuugcaggccuggguaaggaucugagauauuauucuaagugucauaggaagguguugauuucuauaauuaaaucaccuggucauuaugguguaugaacaggcaaugaaugaaagcaaauaaagucacauugcaacucccauuuuauaagaaaaaacuaaagaccaaggagauuaaguauguuaauacuuaauucgucaacuaggucucauaguugacgaauggaaaaauccugacccaaacccaggucacuguacucucuacaccaucccuaagccacuaacuccucucuguucagccuuucugcucccugccccuuucacccgaguagugaguaguuucacauuuguaucuuugguuguauccuuggcuucacauuuuauauuccaggcaagucccccuacaucaauggaauggacuagaaguccucuacuauccccuguacuuacuuagaaaacacacuguuaacuaaaucaauaaauucucacauccuucugcucaaccucacucauuuacuaacuacaaaauaucuuauggggacaaaaugcuaaaagagaaaugaaggggcuagcauucguagaaaacacaacuuucaagaagaaaaauuugaccucgccucagaaagagauuuugaguuucuggcaucucucuuuuuaaccuaauacuguuacuuuacaugucaaacuccccuugcaauuuaacuugcuucacuuucucccucacaccauaaggugaacaguuuuuucagaauaacuaggguugaggaggaaaaaagacuccagaguacauaagguauauuguccaugccauguuaaaaggagaaucaguauucuacccaucugcaccacguuuaucaguuucuaguauuuacgacugaucaaagcuaacacuuacugcacacuguucuaagcauuuuacaugaauuaucucauuuacaugaauuaccucaucauaauuuuaugggagagguacuaugaugaccccauuuuagagaugagaaaacugaagcacugaguagucugauaaucugcccaagguuauaugcuuaguaaguggacaagccagggucugaacucaccuagccugguuucuggcauucuacacuagauacagaaucagacuacucucaaacuuucugaguggcccugaaccuggaaaaguuuaguuggaacuuacuacuugguaaagaaaaaauagugauugagcauccuuuccaauuaggugaaccucuacauauaaauuugaccuuaauuauuacauaauacauaaugcaguacuuauucaaaguuuucugcuuugcugcaaauaugguuuggcuucacugcaauguaauuagaaauaaacuucaacccauaaauauuuuaccuguaaacauugaaaaccaguagaguuguuaaauaguuuuaaaaucucuacuuuuauuuacuuaccaaagaaaaaacacauaauggaauuauucucuucauagucauuuuuuaacuuaaugaaaggaacauuccucugaauuaucauuaacagcagucaaaucauacugauguuuauuuuauuuaugaacucaaaagaaaaacagauccacauuauacugagaauaauuuucccaauccauaugaaucaaaaucagacauaugaggaaacuggauaucaaaugccagagguaagaccagacagcaaagagagacagaauuucaaaagcauguugagaauaauacaucaaacauauuucuuaccaugaaccacugacccagucaaucacaugacucaaagagugguuaugaacaacuaaacaaaaugugaugaguaaguggaaauguagaaaaacaacauuuaaugacagagugugcuuauuuauuccugugauagcaagucuucuguuucaagugucuucuucaaauacuuuuuuacauuuuagauaacagauauucaaaauauuucugcuuguagaauaaaauauuacauuauucuacaauucuaguuuugaaaaguucuaaaaaugacaugaaacuuacuuguguuuauuacuuucuucaugcauuuaacagauauuuaauaaguaauuauuauaugcaaggcaaucuguuaaguguagugggagaucccaaaaucaauaaaacaguuucaucucucagaaagguuaauuuauuauuuauaauucagaauagaaaugaucaaugcuacaagagacauuuuuaaaaaaucaagaagggauaaaaaguggcauucgagcuaacauuuuuugauaaagagaauuuagucaugcaaaaacaaaggaaagggccuucccaguaggaaaauauuguggucacagucacauguuuggaaaaguauugagaauaaaaacugagacaagcuauuaaauuuaaugaccaggagaucacagaugauucuuaaaaugcagugucaacaaagcagcaaggacaaaauccagauuaacgggggcaaaggaaugaaugaaaacaaugugagagccaaagggguaucucagagcuuguguaaaaaggagaggagagauaccagaccauagcuuaagcuggugagcagaaagaauaaagguuuucuuuuugaggauguaaaaaaauaaaauaaaauaacuggccaggcacaguggcucaugccuauaaucccaucacuuugggaggccaagacaggaggacugcuugaacucacgaguucaagaucagccugggcaauauaguaagaccucuucucagcuaagaauaaaaaaaaaauuaacugggcgugguggugugcaccuguagaacuagcuacuuaggagacugagaagggaggauuguuugagccuagaauauugaggcugcagagaacuaugaucaugccacugcacuccagccuaggacacagagcaagacccugucacaaaaaaauaaaaauaaaaaaauaacuggaguucaucuacauauacaagagaaaagaauaauugaagauguggaguucuaagcaagauggagacaaugagaaaaaaaguagaagaggagggauuaugguuugaaaugucaucucucagucaacucuucccucauucacucagaugggucauuuugucuucuggaucucugucugcuagaaugcaagcuucaggaagcaaaggauuugucugauuuguuuccugcucucucuccacaacaggaacacucccaagacacacuguaggcaaucaguaacuauuaguuaaacucaaaaaugaaugaauaacacugcuuuccucuaauuugaagaauuuaaagaagaaaugcucaagagaaaaggaggaaaguuagguacaauucccacagaaagcuacaauaguagaaaagcaucuccacagaaugagaaggucaggcugaaauuugccuuguucaguggaucugcccacugaagugacaaagcccaagcccacuuguuccuuccccacauaccagauggauaaacauagaggcugaguuaggaaacaaugucagggacugaggccccguauucagggugaagaaaggaggaaagguggcuuaaggaacaaugagggaaucuucagggagcaagacccuguggggcuaaaauugagugcaugaugaugcuaaagacccacagauggguagagaaaagaaauagcaaaccuucccugaagucagaauuggcuugggguuuuaaucauaauuauaaagggaugcuggauuuugucaaaugcuuuuucugugucuauugagacaaucaugugguuuuuguuuuuaauucuguuuaugugguguacuacucagccauaaaaaggaaugaaauaaugacauuaacagcaaccuggaugauuauuauuauuauuauuauuauuauuauuauuauuauuauucuaagugaaguaacucaggaauggaaaaccaaauauccaauguucucacucauaugugggaguuaagcuaugaggaugcaaagacauaagaaugauaugcuggacuuuggggacuugcaggaaagggugggggguggugagggauaaaauauuacauguugguacaguguacacugcucaggugaugggugcaccaaaaucucagaaaucacuacuaaagaacuuauucaaauaaccaaacacaccuguucccccaaaaccuagugaaauaaaaaaauaaaaaauuuaaauaugaaaaaauuuaaauuuaaauuaaaaaaaaaagaauuggcccaggaauagggaguggggugagucuguuguaaauggggugaccaauggguuccaugagauagcacuaggcauaucaaaagcaaacaaguugaauaaaggcuacuuccuucuaacuucuacagauuucuuucauuauuucguggagcccaaggggcuguuccuuccauaggagugauucauucugggaagggcuucacauccuuugucugguuauucuaggacccucuccaauucucuauuugucacauuuuccucuaguucugauuaccauugccuuuauguccuggugcucuuuuguuacuguuucuucaacaucauucuuuuuuuuuuuuuuuuuugagauggagucucacucuguugcccaagcuagagugcaauggcacgaucucagcuuacugcaaccuccaccucccgaguucaauuagccgauuucuggcuaauuuuuuuauuuuuaguagagacgggguuuugccauguuggccaggcuggucucacacuccugaccucaagugauccacccacgucagccucccauagugcuaggauuacaggcaugagccaacaccauucaauaauguauuauccccuccaaaacggggagagagguggcacaaaacgauggaaguauggaauauaaugcauguaggcauuccuuagacuguuccccuuucucacaaggcaauaagcuaacuugcacaggucuuuguaagguauggacagugugaaagagaagaaaugggccaggugcgguggcugacgccuguaaucccaucuacucaggaggcugaggcaggaggaucccuugaaccugggaggcaaagguugcagugagucaagaucgcgccacuguacuccagccugggcaacagagcaagacuccgucucaaaaaaaaaagagaagaaauggcaaaucugagagacauuuaaaggauggaaucacaaguccugggaacagacuguagggaauaaacaagaaguuacaaagagaguuccaauguuuuuagcccagaacuuacaagaaaugugaauuuacuuuauagaaacagcuuucuuggccgggcgagguggcucacgccugcaauccuagcacuuugggaggccgaggcaggcggaucaccugaggucaggaguccaagaccagccuggucaacaugaugaaaccccaucucuacuaaaaacacaaaaauuagccaggcgagguggcaggcgccuguaaucccagcuacucgggaggcugagacaggagaaucacuugaacucgggaggcggagguugcagugagccgagacugcaccacugcacuccagccugggugacagggcaagacuccaucucaaaaaaaagaaaaagaaaaaaaauggcuuucuuggugaagaaauaugcuagaauagagugggauuguuuguuuggggaagggguauuuauuuaaaggugucgauaggauguccagguggagaugccuaugagugguugccauccagccacuggagcccugaauaaugaugagacacagucaugaauacuuagugguuaucuacacugaggcuugggguaggcaggauucuaagauggccacuaagagucccauccucuggcauauacauccuguacaaugcaacgucacucucauaauuaugucuguaaucaguuaauaaugaauucgucaaaaaagagauuaucuugagugggccuggucuaacuuuuaaaggaaggugaagcucagagagucaugcuccuguuggccuugaaacccacaaccuccaugagcucuagaaacuguauucugccaacaaucuaaaugagcuuggaaaagaccucugagguccugcugagaaauucaguccagcagauaccugaauggcagccuuuuaagaccugagcagagacuccaucuaagccauuaccagacaacagacauacagaaacuauaaaaucauaguuuguguuguuggaaggcaccuuucauauugcauuucugauaaucuguuaugcagcaacagaaaacuaacacaaggguaaagccacugaaguggauaacuagacuggauaauuggagggaaagcagaggacaagggcagaccacuggagucaaccaaggaggggacaaaaaaaacaggugggaagaauaacagguggugugaugucuaaaggccaaaggaggagaguguuagaaggaagaguguugaauguauaucaaaggcauuaucaguagcaggaugggaguguacagucuaaugcaaagcauuaagaaaauaauuaguggguaggaagcagaaaccucaaauacuaauaacauaugaaguuuggcacugaaagaggaaagaaauagaacaacaguggaaaugcacagccacaucaccaaaaauggaaucaaguaaagguuauucaugauguuacccuuuccagggcuacacagacuuuaauaaaaaauuaauaaagauucaaaagcuuucucuacaacuaaaggaaugaagcucucuuaguggaauuucaggcauuuucuuagaacuauuaaguuacagagcuaccccacauaucacaagcucaugaaccaagucccagcaugaaaucaaaauaaaugaacuuagacacucucccuacaucugaucauucugaucaaccaaaaucccagaauguaauggugaaucugacgauuacuuguaugauccacugcacagcuggcacaguccuucucuggccaugucacacugcacugcucucuugagcuucuguggaaugguucccaaaauaacaggggagacucacuagacuacacaguacaugaugaaguucuuuacugaugacucuucuuaaagugaucuaucucaugggaguuccagggaaaggugcaaagccagguguggaauaggacaagaaaugcaugauuucagugaccaaaugauccagcagguaaaauacuuguuacguguuuacgcuucaagcaaaaauucauguaaagaauacagguacauaaugccaaggauugcuauauuaauuaaacaaacucagugauuuaaaaaacaaucugaagaauagcaagugagagaaaacacauuuuauauucuccuauauuaaugcuguuuuauuugaaaguuuuaaaaaucugguaugcacauuguuuucauucagcaaauacuuauuacuucauucaggcaccgugcuaggugcugagacagaauggugaaaagagaugaauuuucuguccucauggaaaaacagucuaguguaaaagacacacacuaaacacuauaaaacccagugacuuagagggacgauaugcugagauuauaauaauaauacccagugacaugaggaguugagggauacagucugauugaaaacaggccuagaagacuuacuucaaacaugaguuugcaugacaacuguguuauuuucacaccuccuugccucuuccccaaacucauacaaaaugcuuuuguuaaauauaacugccauuuuauggccaucacuucacaggaacaggaacacugagaauaucccacugcacacacaaacaccuggauaauuguuccucuguuuacuaaugcaucucaccagagaauaaaaucaaggaaacugauuucagaaauucacuaacuuacauuacagucagaacuccucaucaacagaccacauggcacaaacuggauggcuuuuaagaucuaagcugcaagcuauagacauguuugggcuuuucagcaucaccccgaagagaccucaaagguacacuaacacaaucagccuuugaugacauacuauaucauauauccauauacucauaugucccuaauucagcacauuugcauaugaucugcauucuaacauacccacaacuauauuuuauaugugagaagacuguaauaugauaaaacccuuaaggaggcacucugcuuuguugugucaauucuuauauucauccaacaaugaucguuaucuuagccauaucuuccauucacccuuuaaccacaauuggagggcuagacaguucugaagagggcagaauuuuuuaaucuuuuuuacauccucagcagucuggcgaaaaggaauuuggacccugauucaacaggccugagacccagucucagcucagcccucauuacacucccuuguacagcaaaguccuguaucuugagucaaguuuacaaaauagcacuaaccuccucacagccuugucuguaugacuucaggguaacaucguaaaaagugcuucagaaauacucaaaaguaagaagaauuguaaaacauaauuuuaaaaauaucauccaagggaauacacacaaaacagcuuacuuaggguuuugcuauacaacaauuuuauaauuucaauaaauuagacugacauuuuccaucuuucacuaacacaaauaaugcauccaggaaaaacaaccccccuagacggcaagccagguuuagucaguuuuagacauuccaaguauacuggcuguucuaauuaaucaaagaauaauuucugaacugcuaauuuuuaccuuauaccaauauuaaacauacauuaaaacacuguugauagcaauacauuuucauguguaaaaaaauaaaaauaaaaaaauuguugauuccaaaaaauaccagugaagccauugauuagacaucugcaguuugacuauaaaauagcaaaauugauuucuaauaagauuuccaagaaguauuaucaguuuacugucagagauuauaaauuggcaacugauaagcaugauuuaguucauuaauuuuuuuuuuuggccuacauaguauuuuaaaacccaagagauuuuauauaaaaaaaucaguuuucuucaaaaauugcaaaccuggcuacacuggggcuaguggugugcugcagcuagcuuguacuugcucauugagccaauuauuaguaucucuucuaaacaugugcagugacaaucauaguagaggcuugaaauuagcuaugugggaguguuuacaccaugagaauuggcaaaugcaaccugugacaguuuguuguuguuguuuuucuuguuuuaaugagccaguuguuaaacauuuaccagcacaccacugcacugggaucacaaugucacgugguagcacaugcuggagagaguagugacucucuccucagacaggaugugggcucuuuaguccauauccaucaccauuuccuauuguuuuucgucugacucaguucacuuauuuuaauuacccgucuggcauaguuaagcauuugacuuugcaacuccugguuuacggucaaaacacacauucaaaacacacucuuagaugauaacauggggaaaaaaaucaagucacugugcuuguuugaaaguuuaaaaaauaaaaggcuuaaauugaacacuguuggacaaauugaaauaccaucuuuagaagccuuuuuguuccuuuucaaaccauuguuauucaagcacaaaagaagacuguaacauacauuucaagucacaaaguaagaagucagcaaaaaacaaauuuuuuaaaagagaagauaauuauuuaaucauauauuuuuaagaaacaaacuauaaaaccuggaacuuuuuauuucuagugaaaaagccaucauugcuucucaaaagcagguuuucuucauuugucuaaaaaccuuauacagauauuugacggaacucuugaaaaccuggacccaaaaaaaaaaaaaauuccuucacaagagaaaccucugauuaaaugaguauuucaguaagaaugucugaacaugaagccagacaugauaguggucaggaaaauucucuuucaagucaucuuaaguggauuccuacacaaaugacugcaguguauccuguucuaauauauaggucuguguuucccacgacaauaaugauugcacauaucagucucuuccccuggggcaugaacuucauaguccuacccacuaaaagaaaauuauuguucaaaaaccacuuccaagguccuaagaacaaauacagaugacaaaauugaggaaagaacaaagaccaauggaaguuccuaaaacaguucccaucaauggguuuuauauuucuugacacuguccuaacaguaaucacuuccaccauuaaaacuaugcaauaugagcaacuauaagaagucucuaucccaaugcaccacuuuaaaaaaucugucuuccuuccucuuccccucacuaaccucacuuucagccucaggccuacuuuagcauggugacugaucuuuuuuuuuuuuuuaaaucaagauacucaaaaauaacaaguauuuggaauucuauccuaguccccaaauuauaaggucaacauuacuuagccaugcauggcuuguagcuaacuucaagaaaaaaagguuaaggaaacacaaaggaggcaaggaagggagggaggaugguaagggaaggaagggaaaggaaaggaaggacaugaacauguuuugagguuacaugagacaaaaaaaaaggcuauguuuaaaaaacagaaggaggaaaacaauaucaugugucuucuuagauucuuaauauaaauuuugggcagggacaaaauucaaauaccauuguuaugaaucaucuugaaaaaaauuucgucucugaguuuugacauccuucauguauauaggacaugcuugagaauacauuagaaaguucaggaaaugauguaguuuagagucaagagcaguuuguggauagaacccaaaacaaaacaagacccaaaaaaagagaauaacaguuuuaucuguaguggguaauaugugcuggcuguacuaauucauguugagcuuuguuucaguguacugauuuucaccaauuuaaugcuaaaggucuggacgucaguuaccucaagaucucuuuuagcgaaagaggucaaugugcacuggaguacuuuuccucaaaaugaucagauuugcaucacagcucacuaccaaagaggucuuuccugaacauucauguuaucucaguucucugccuacucuacgaaucagccagaauccauaagcuucacauggauguuuacaauaagaaauacgccaucagcauguuucauuuaauuuugguugaaguauuuuaacauguacauuacccuaauugaaauuaaaaaaaaaaaguaguagcaaaguaagacucuuacuucauaauggaagacaucauaauugcaagacuaucaaaaaguaaacgcuuuagguaaaaaucaggcuuugcugcaaccaaugggcuccuagggcaggacaugcauggcuaaggaauguaguaauaaggugaacauggacagaagagggacugaaggaaagagaagaaaaaggagaaacuaagguagugguaauaauaauauagucauaaagcuaacauuuauuuggugcuuacuauguaaugggcacugccauaagaacuuaacaaaaauuaauucauuuuaauccucagcaauccuuggaggcaaacacuauuauuauucccauuuagugaaugaggaaacuaaagcauagagcauuucaugacuugcuugagggucauagcuacuuagcaguauauugaggauuuaaaucaauguaguuuggcuccagaguccaugcuccuaaccacuacucuagaggccuauauaggaugguuaccaaauagaaagaaguggguucaacaauaagcucgaaaucaauuacacacacacaaacucacacacacacgaaagagagacuaagguuuuccuaaccacuacccuagaggccuauacaggaagguuaccaaauggagagagaaguuaauucaacaauaagcuuaaaauuaauuacacacacacacacacacacacacacacacacacacacacacgagucacucacucugucucucucccuucccccucucucugagauuuugccuuauaagggaaaaaaaaauugcauugcauugaaauuaaaauauucuccuacuaauaacuacaauauaaaauguaauauguacuugacaacaaguaacacgugcuauuacaaacauuagaaaagaacacaaaaagccuucuccagaaacauggguacacaacauuuugaccaccaaagagaucccauuuguagggcagcccaagagcacacagugccauccagcgauaaaguaggugaagcacguguucauccucuucugcaagggaaucgaauauuuaacuuuagucuuuucaauaagcaauucagaauuuucacauaaaaaaaggaaacuagcauaaguaauaaccuaucuuuuauuuuccuaugacuugcacaaaauuaccuuacauuuaaauucuccacuauuucuuaauuaaguauauaaauucagacaagaccaacccaaacuacuaacuuaaggcauccaaacuauuaacagcaucucagucgcccaacaaggauauauuaucaucauauaggguacuuuugugcugccuaacaugacuuuucaauuaguguguuuugcagaguucagaaacagucacugauuaaggcugaaagcaccugcccuacacauggcaaaguaaaucaugacuaguucugccaucagcagcaccuacacuacagaaccuccaaaaagaaacggaugcagcaauuaagcauaugguagaggagagauaaggggguguaaggagaagaacugggcaggcguuaaaaaaugcaaaauuuaucuaugcaccuaaauaggcaauuauuuuuacaaaauucucauacagacaauguuuacauuaugacauaacuaaauucuaaaguuuaguuuucauccgaagccacaacauuauggccaauuauaccacuaaaagaaaauauuuauuuaugucccuggaagaaauucaagaaacauucauuagugauuuuuucuuuuauuuguuuguuuguuuauuuuuggagacagagucuuccuuuaucacccaggcuggagugcaguggcacaaucucaggucacuacaaacuccaucucccagguucaagugauucgccugccucagcuaccccaguagcuaggauuacaggcgugcgccaccaugcccagcuaauuuuuguauuuuuaguagagaugggguuucaccaugcuggucaggcuggucucgaacuccugaccucaggugauccgccugccuugaccucccaaaguguugugauuacaggcgugagccaccacaccuacccugugaguucuuuaaauguaauuuuuuuucuaaaacacuuaccaaacuuuucauaguaguuaucacuaagcaguggaaaugcaaaaaaaaaauuuacuuauuaaauuauacauuuguaucauuuuggcauuuuuuucuaauaugaauuucuuuuguuaaagaugugaaaaaguacuaugcuccauacuuuuacagucauaaugaagaaacacugaaagauaagacuuugucucuauuuucuguauaucuguuacacauuucaaucauuuguguaaaugauuugcacguacacuaauaaaacacaguuucugguuaauuuaacaaugcccuucaccacagaacuacuucagaaucuaagcuuuuugcgcagcauauuuuccaacugacagcuaagcuagcuuuuaaauuuucauuuuucaaagugccgagauuaauaaugcaucaacagggccaggcacaguggcucacaccuguaaucccagcacuuugggaggcugaggugugcggaccaccugaggucaggaggccgagaccagccugaccaacauggugaaaccccaucucuacuaaaaguacaaaaacuagccgggcgugguggugggcaccuguaaucccagcuacuugggaggcagaggcaggagaaucacuugaaccugagaagcggagguugcagugagccgagaucacaaugccacugcacuccagccuggguggcagagugaaacuccgucucaaaucaucaucaucuucaucaucauaacgcaucuaugggaagugaauaugauuuaaaagacugguauguaaacucuggaaccaauaugugaccagcggaaucuaacuugagguucaugucuauggccauuggaaugucccucucugcugcugcuuccuuucaggacaagggcuucagaugaagagcuccuaaacacuccuaaagacuaccaguuacacagguaagcugcuguuauucacuuaguccauaucuucguugccucaguuguguucauuguauccacacaguuaucaagccuuaaaguucugucuaggccagacgcgguagcucaagccuguaaucccagcacuuugggaggcugaggcaggcggaucaccugaggucaggaguaggcaagaccagccuggccagcauggugaaaccccgucucuacuaaaaauacaaaaaauaguggggcgccauagugcgugccuguaaucccagcuacuagggaggcugaggcaggugaaucgcuugaaucugggaggcggagguugcagugaaccaagauugugccacugcacuccagucugagcaacagagcgagacuccaacucaaaaaaacaaaaaaaaaagcucuuucuaaaucacuguauguucuuuuaguccccuguccugagguagccuguagagcaaagacauuaaguacagaacuaucccccagacaagccaagaaaguugcuacaauuacaacuucaguuuugauuaaaaauuauuuggggaaagucaaugccauuuaauuuuaggaguaucaaaugauaguauuaguggaaccauccaagaagccucucuacauaagagacacaccuugcagguuuacccuaaaacacacuuucuuuuuaaauuguaaccccugggucuacugcaucagaguuaucuggggugcuacuccaaaaugcagauuccugaauccugccccagacugaguggaucucaaugcuugcgugugaggcccaggaaucaguuuuucaaaaagcucacugguacuuuuauacaucauaaguucaugaauuauucugugggacagcaguuuucaaacuuugcugcccaucagaaucauccggagagauuuuuaaaaccucaguacacagaccaugcccuauaccaguuaaauuagaaucucuggggaugggaaagagacagcagaaauucugaaaacuccacaggugauuccaaugggcagccaacguugagcacugguguugugaaggaccaagguacagcuuagagaccaaguugaguccuccugagcgucaaagcacacucaacuugagacuuuuaacaguagcaacaacaacaaaaugguuaauacucacuuuuucauagugacaauaagaccuaacaagcugccauaaaaaucuuaaguaugguauaaacacagaaaaauucucauuaccaaauaugacuacauacaauuaaaaaaaaaguuuucaacacuuuuaaacaaacaaaaaugcaaaucauuaauuccagccuccauugacagaaaacuuaugcucuaaauacagcucugaaccugucuucuagaucgguuucauuaaauaauaugaugaagugaccaauaugguuuuuuucaugacguuacauaccaaucugcaacagcuuggggauaguuagaaaauacagaaguagaauguguaucagaauaaacuaaauuucagauucauugagcugauaucucaagucaagagcuucuguaguuaaaagacugaaagauggaugcaccugauuuucccucaggggcuuacaagauaagauagugcauuauuaaaccugacaaaacauaucugacuauaccgcaccagaaacuacagucacagaauuuuaaaaguaugucuuuacuuaaugaaguacaaauuucaaacucaaacugggccuacagacuuagcagaaggcaaaaggagaauguacucauuuuacuauugugaccuggcuugaguucaauagaaucaaagauauaaaagaauuacagagcugucugguggaaaggaaaucaucauuucauaaaggacucaaugacuuacaugauuucaaaucaugcuuuaagugucugccgcuuccuuuaaagaaaaccucaaaaugcaucugaauugucgucuauccuguaagugugguucaguuucaggaagaacugauugaacugaaaauaacuaucccaccaagaagacaguguuucuggaacuuuaaaaaauacagacucuagagcaaggcugaaauuucuuacaauugucucucaacaauguguuaauccccugucccuaugaaaauccaccuaaaauauaaaacugcugaaauuaaaaauaaguacaacuccaccagcaauguaaagcuugaaucagaacugauaaagaccuucauuuguacagaauguauguauauacauaugguauauaaaaccaaaacugucuguagccaccuccaccugcuaagguggugaauugguuucccguuacugcuguaacaaauugccccuaaacuuaguggcuucuaacaagacaaauuuauuauuuuauaauccuggaggucagaagucugaaaucacuccgcaugggcuaaugucaaggugucgacaaagcugguuccuucuggaggcucucaagugagaaucuguuuccuugccucuuuaagcuucuagaggcugagugcauauguuagaugugugaccucauuccucaaaucacuucaacuucuugcuaccauuaucacaucgcaaacuauaagacuccccucuaaucugugguuucacuuuccacuuucaacugcaaucuagaaauaggugagcauaguacauauuguaaugauauacugagacagaccacauucacauaacuuuuauuacuauauauauauuuuuuuauuuuauuauuauuauacuuuaaguuuuaggguacaugugcacaaugugcagguuuguuacauauguauacaugugccauguuggugugcugcacccauuaacucgccauuuaacauuagguauaucuccuaaugcuaucccuccccccuccccccaccccacaacaguccccagagugugauguuccccuuccuguguccauguguucucauuguucaauucccaccuaugagugagaacauguggugucugguuuuuuguccuugcaauaguuugcugagaaugaugguuuccaguuucauccaugucccugcaaaggacaugaacucaucauuuuuuauggcugcauaguauuccaugguguauaugugccacauuuucuuaauccagucuaucacugauggacauuuggguugguuccaagucuuugcuauugugaauagugccgcaauaaacacacgugugcaugugucuuuauagcagcaugauuuauaauccuuuggguauauacccaguaaugggauggcugagucaaaugguauuucuaguucgagaucccugaggaaucaccacacugacuuccacaaugguugaacuaguuuacagucccaccaacaguguaaaaguguuccuauuucuccauauccucuccagcacuuguuguuuccugacuuuuaaugaucgccauucuaacuggugggaggugguaucucauugugguuuugauuugcauuucucugauggccaguaaugacaagcauuuuuucauguguuuuuuggcugcguaaaugucuucuuuugagaagugucuguucauauccuucacccacuuuuugaugggauugucuguuuuuuucuuguagauuuguuugaguucauuguagauucuggauauuagcccuuugucagaugaguagguugagaaaauuuucucccauuuuguagguugccuguucacucugaugguaguuucuuuugcugugcagaagcucuuuaguuuaauuagaucccauuugucaauuuuggcuuuuguugccauugcuuuugguguuuuagacauguaguccuugcccaugccuauguccugaauaguacugccuagguuuucuucuaggguuuuuaugguuuuaggucuaacauguaagucuuuaauccaucuugaauuaauuuuuguauaagguguaaggaagggauccaguuucagcuuucuacauauggcuagccaguuuucccagcaccauuuauuaaauagagaauccuuucccaaagcuuguuuuucucagguuugucaaagaucagaugguuguagauauguggcauuauuucugagggcucuguucuguuccauugaucucuaucucuguuuugguaccaguagcaugcuguuuugguuacuguagccuuguaauauaguuugaagucagguagcaugcugccuccagcuuuguucuuuuggcuuaggauugacuuggcgaugcgggcucuuuuuugguuccauaugaacuuuaaaguaguuuuuuccaauucugugaagaaagucauugguagcuugauggggauggcauugaaucuauaaauuaccuugggcaguauggccauuuucaugauauugauucuuccuauccaugagcguggaauguucuuccauuuguuuguauccucuuuuauuucauugagcagugguuuguaguucuccuugaagaggucuuucgcaucccuuguaaguuggauuccuagguauuuuauucucuucgaagcaauugugaaugggaguucacucaugauuuggcucucuguuugucuguuauugguguauaagaaugcuugugauuuuuguacauugauuuuguauccugagacuuugcugaaguagcuuaucagcuuaaggagauuuugggcugagacaaugggguuuucuagauauacaaucaugucaucugcaaacagggacaauuugacuuccucuuuucuuaauugaauacccuuuauuuccuucuccugccuaauugcccuggccagaacuuccaacacuauguugaauaggaguggugggagagggcaucccugucuugugccaguuuucaaagggaaugcuuccaguuuuugcccauucaguaugauauuggcuguggguuugucauagauagcucuuauuauuuugagauacgucccaucaauaccuaauuuguugagagauauuauaauauauuguuacaauugcucuauuuuaccauuguucaaauuaggccauauucaaauauuuuaccauauuguucaacuccuauacaugcauaccuaggaaaaaaacacaguauuuauaggguuugguacuaaccaugguuucaagcauccacuggggaucuuaaaauguaucccccacagguaaggagagacuauuguaaugauucugauacucucgccucucucuuacaagaaccuuuuuuuuuuaguuucauuaggcccacauggauaauccaagauaaucucccaucucaagaucuuuaauuuaaucacaucuaugauguucccuuuaccauguaagguggcauauucauagguucuggggauaaggacguugacaucuuuggagacuauuuucagccuaccacaggugauaauacggaaggaggaaagagacauaguagugguuaaacauuauuuuucacuuucaacaugaguggggaaggaagaaagaaaagacugaaauuucaaagcaucagcccauucuucuguguucuaagacuauucuagccauuacaauagccacugcccacauguggcuauugagacuuugauggcaauauuccaaauuaagauguguuguaaauguacaacuacauauaaaacuugaaggacaucauauaagaaaaaaguaaaauaauuauuaauuuuauacaaauuuuacauuuugaaaggaaaauauuuuggauauauuugguugaauaaaauauauaaucaaaauuaaucucaucuguuccucuuuauuuuuuuaauggggcuaauagggaauuuuaaauuauaggugucgguaauaagcacacucaaaaaagaugaaauaaagccuucugccauaaaagcaacaagaacacuggcaaaaauucccaaaaucaaauuuuugaaaacucuggaaauuaacuaaagccuugcaauaacugaugaguuuuuauccaagaaaaaaaaacccugaauuuuaauaagaccggcaagcuuugugacaucuuaacuugcuguguuaacauccacuucuaccaggcuugagaaccaacagccucauuaguaacuaaauacuagcagccuggcaaccacaaaauucagcagaaugaguuuaaaguuuagugggggaacaacccaggcuuuguuuucuuuuuuuuuuaagcuucaaugaugaauucuaccaaacaauaaaagaaaaauuaguacuaauucuucacaaacucuuccaaaagcaaggagaggagggaauacuuuucaacucuuucuaugaggcaaauguuacucagacaccaaaaacaucauaagaaaacuacagaccguaaagaccaauaucccuuaugaauauaaaccuaagaauccucagcaacauacuagcauacugaguacagcaauacauacaaagaucauacaacuugaccaacugaaauuuuuccaaggguugaaaaauugguucaauauacaaaaaucaaugucaauuguuaaucaaucaauaaccaaauaacauauaaaugggauaagugacacaaaacaaaucaucaugucaauagucagagaaauagcauuuaccaaaauucaacacucuuucaugauaaaaacagucaguaaacuaggaacagagggaacuuccucgaccuguuaaagaguauuaaggaaagccaggcacuauggcucaugcuuguaaucccagcacuuugggaggccaagacaggaggaucacuugagcucaggaguuugagaccagcaugggcaacauacugagaccccaucucuauuaaaauucaaaaaaauuuagcugagcaugauggcauaugcguguaguccaagccacucagggggcugaggugggggauugcuugagacugggaguucaaggcugcagugagccaugaucaugccacugcauuccagccugcgugacagacagagaccuugacuuuaaaaaaaaaaaaaagaguaucaagggaaaaaacacaguuacaucauacauaauggugaaagacugaaauguuuugccuugagaucaggaacaagaaaaggaugccugcucuugccacuuccauucaacauuguacuggauuucuguccagggcaauuaggcaagaaaaagaaauacaaugcauucauauuggagaggagaaaaguaaaacuaucuuauuuuacagaugauguaaucucacacaggaaaaauccuacagaauccacuaaaauacucuuagaacuaaauaaugaguccagcaagguuguaagauuaaaaaaaaugaauauaugaucacauuaaguucuaucgcucaaugcugaucacaauaauucaacuuuagagaauauaaacagccuauguaaugcagcaccuaugccaagaucagcaaacuuauagcacccucccaguguugcaccucagcaggcaaggauaauaaucacggcacucuuuuccagaagccaugucaaccuucucaauaccacccuccagucaggguccaagugacagaaagauuaaagcugucugcagucuuguguugcuucuacuaccauuccaccaaaacaacacuaguagucaacuccggcucuacaggcuuggcccaauguccugccaagaaagucccucuuucccagccaaacaaacaaacaaaaaacagccuguuacugauuccuuacuuugaauggaccuacuaacuauaggacauaggguuauuauuugaaaugccacacccaauguuuauucuucacgugaguaugaagaaauggccagauuuaguaccaaucacaacugcuaguagaaggcuuucagucagucacaccaaacaauaaaugcaaaggccugaagcagaagaaaguuucacauguucuacaauguuuaaccacuacuaugucuacccuuuucuccuuccuuauuaccaccugugguaggcugaaaauagucuccaaagaugucaauguccuuauccccagaaccuaugaauaugccaccuuacaugguaaggggaacaucauagaugugauaacauuaaagaucuugagaugggagauuauccuggauuauccaugugggccuaaugaaacuuaaaaaaagggguucuccuaagagagaggcgagaguaucuugacuuggcuaguccuguggcgggcuccuucucauccccgcaauuuuaacuccuuaaaguaaucuuuccuacccagccuaacacaagugccccuguuaucuuuagcaaacccuguguuuccuaauguacauuuauuacuaauuacuuguuuguugucuauaucuccaacuacaauaaaaguuccaugaggcaagaaacuugcuggcuuaucuaucauucauuguauacucuggcacauaauagaugaggagcagggauggaugguuggauucuguuuguacagacgcaacuuaauuucuuacuuccuaagugaauaucaauauguaaaaggaauuagaucagaauaauacccuuggaggugaaaauauauuuagcauauggaauggaucacaauagaaaaguaaauuaaagcauuuuagaagaauuucucugacaaggguuuaaacuaaagcagcuaccuuuuaacuauuauucaucuagaaaaugaaaucaaccauaauguuagauugcuaagcucuccagguaacuaaggucugauuaucauugcugguauauaaugacucuagccgacaaaccaauuauaaacauuaaaaaaguacucaccguuauaccucauacccauucugugaagaacuaaaguaauuuuccuagaauuacaccucgccacaaugcuugaugcaggugguuucuuuaucauuuagcuacaaugauggcauaauaguugggaccaaagagacaugaucuaguuuacagacaugguccauaaauuaagauggguaaauagucaccacugauugauuagccaauacacaaggacacgauggcaacauuuuauucuaaauaaaauucuugcccccccccgaaaaaagaaaaaaacaagaauaaauaaauaaauaaauaaaauuuaaaauucccugaccugagaaaguacaaagauaaaggugaaauuaauuaacuuaguaauaaaaacaaauuguucuaacucugaaaguagacaauauauaugauuccgauaucauuaaacacagcuuuaggaauaguccauuaaauucaugauucuacuagguucuccaaggacaaaaucuaaacucaggaaauacauguuaacaucaauagaucuuuccauuucuauuucuuuuauaucuugaacuuaauuauuuuucuauuguuuaagaacauuugaaagcuccaaaguguuuugaaguaucuaauaagaaaauuaaguuacaucaccauaaaacauuucuccccauuuuauucuuuuuuccuuugggauauucucccacuaguaauuaucaauuaucacaaguugaagaccugauuuuccucauuuguaguucauaucauauaaaaauaugcaaugcccaugaauauaacuaaugacuucaguuauacagaaccagagcauguucccaauucacuuauauuucgcucaguuuuccucaagaagacaacaaaccauauuuuguauugaagucaauuugcauuuaaccuaaccaauagcauuacuucuuuggaagaaaucugauuuuuccuuuuuugguuugucuuuaacuuccuaauuauucaucuuaacaacagauccuuuuuuuucccaauguuuuaaauugaugauuuuuuauuuaauugaaaauaaaauuauaaauguugauaguacauauaauguuugaucuaugacuacacugugagaugacuaaaucaagcuaguuaacauacacaucaccucauuuuuuuuuuuuuuuuuuggaaauggaaucuugcucugucauccaggcuggagugcaguggugcaaucucagcucacugcaacugcugucucccggguucaagcaauucuccugccucagccuccagaguagcugggauuacaggugcccgccaccacaccuggcuaauuuuuguauuuuuaguagagacgggguuucacuagguuggccaggcuggucucgaucuccugaccucaagugauccaucugccucagccucccaaagcacuaggauuacaggcauaagccaccaugccuguccuucaucaccucauauacuuguguuuuaaugauaagaacauuuaagaucuaaucucuuacgaaauuuaaaguacacauuaacucuagucaccuugcuguacaauagaucuccagaacuuauucaucccaucuaacugaaacuuugccccuuugaccaucaucuuccccugcccccaccuccaacccccagccccuggcaaccaccauucuagucucugccucuaugaguucaacuuuuucagauuccacauauauacgagaccaugugauauuuuucuuucuaugccugacuuauaucacuuaguccugcagguucauaugucuuguugcaaaugacaggauuuucuucauuuuuaaggcuaaaccaaauuacauugcauauauauaacacauuucuuuaucuauucaucugauuauuuacauuuagauugauuccaaugcugcagcgaacaugaaaaugcauauauuuauucaacauacugauuuccucaccuuugauauauucucagaagugggauuguuagaucauaugguaguucuacuuuuaauucuuuugaggaacccccauacuguuuuccauaacggcuauacuaauuuacauucccacuaauaguguguaaggguuccuuuuucuccacacccucaccaacacuuguuauuaucucucuugcugauaauagcaauucuaacaaguuugagguugugguuuuaauuugcauuuucccugaugauucauaguguuggacauuuucucagauacuuguuggccacuuguaugucuuguuuuaagaaacgucuggccaggcgcgguggcucaugcauguaauccuagcauuuugggaggccaagguggguagaucaccugaggucaggaguuuaagaccagccuggucaacaugguggaaccccgucgcuaccaaaaauacaaaaauuagcugggcaugguggcccgcagcuguaauccuggcuacuuuggaggcugaggcagaagaaugucuugaaccugggaggcagagguugcagugagcugagauggcaccacugcacaccagccugggugacagagcaagacuccgucucaaaaaaaaaaaaagaaaaagaaagaaaugucuauucaggucguuugcccaaauuuuaauggggugaacuguuuggguuccuuauauauuuuggauaacaaccccuuaucagauauaugcuuugcaaauauuuucucccauucuguaaguugucucuucacucuguugauuguucccuuugcugugcagaaacuguuuaguuugaugcaaucuuguuugucuaguuuugcuuucauugccugugcuuuuugggcucauauccaaauaucuucaccaaaaaaaaaagucaagaagcuauuucccuauguuuuauucucauagucuaacaguuuagaucuuauguuucagucucuaauccauauuauuuauuuauuuacauuuagagauagggucucgcucugucacccaggcuggaguucaguggcaugcucauaauucuauguaaccucuaauuucugggcucaagcaauucuccuaccucagccucacaugguugugacaggugcucacaaccaugcccggguaauuuuuguauuuuuuuguauagacagggucucauuauaguggccaugcuggucccaaacuccuggccucaagugauacuccugcaugcugggauuacaggccacugcacuggccccuuuaauccauuuuaaguugauuuuuguauauaguguaagauaaggguccaaccucauucuucugcaucugaauauccaguugguuuuuuuguuuguuuguuuguuuguuuguuuuuguuuuuguuuuuucaguauuuuugagacagcgucuagcucugucacccaggcuagagugcacuggcgcaaccucagcucacugcaaccuccaccucccggguucaagcgauucuugugccucagccucccaaguagcugagacuacaggugcaugccaccaugcccggcuaauuuuuuuauuuuuaguagagauggaguuucacuacauuggccaggcuggucucaaacuucugaccucaaaugauucgcccaccuuagcuucccaaagugcugggauuacaugcaugagccacugcaccuggccagucaauugaucuuugacaaaggugccacaauacacaauagggaaaguacagucucuccaauaaauuguauugguaaaacuggauauucaggcugggugcgguggcucaugccuguaaucccagcacucuugaggucaggaguucgagaacagccuggccagcauggugaaacccugucucuacuaaaaauacaaaaaguagcuggguguggugguuugugccuauaaucccagcuacuugggaggcugaggcaggagagucauuugcaccugggaggcagagguugcagugagugagauuaugcugcuaaacuggacagccugggugacagauugagacccugucuccaaaaaaacaucuaaaacaaacaaacaaaaaaucaauugccuguaacuguguguauuuauuucugagcuuucuaugcugcuccuuuggucuacaugucugucuucaugccaaugccaugcuguuuugauuacaauaguuuuguauuauauuuugaaaucaagaaguauaaugccuccagcuuuguguuuuucaccugagacugcuuucgauucauuaacagaaugaaggauaaaaauuauaugauugucucagugaauacagaaaaagcauuuagcaauauucaacaucuucucaugauaaaaacuuacaauaaauuagguauagaaggaauguaccucaacacaauaaaagcuacauauuacaagcccacagcuaguaucauacccaacuuucugcuauaaccuucuauuuuucguucucccuuaaaggaagaaaaaacaaaacucccuuugaggaguucucuuaauuuccuuagucauagacugugcugccucucuacucuuucauccuauacucaugcuucaacacaaucucagcuuucagcucuacuuccuucccagauacacaacugcuuuccucacagauuuguacauucacgggcuuuucucaagguaauucuucuagagcugaucuaucaauuaugcacaguaggcacaaugcuuaagacccacaagacuuuagggguacacaaaaauguuucaauuuucauuucauuucaaaucagaaaaaaagaguguaauaauaauaaaugcagaauaaugaauuaucuucaucuuuauaccaaugcaguuauagaauguaauuuuuaauauuuuuaugaaggaaagaacccacaaaggcaaaaguucccagggcccacggaagucauaaugggccccuucuuuuaagucagccuagucccagaucucuccccacucaaaacucguccauucuagccucaucggcaagacccgcaccagaaguaacaauacggguacucaucaaaaccugauuaauacugaugguuacauaacccacuaaacuuacuaaaaucauuaaguugucauuuuuaugauauguaauauauaccucaauaaaauuguuuaaaaaaaugauacagaguugcuuaaaaaagcagaaacacagguauaucuaaggacacaaaacaaugaauuuuagauuacuugcuugagauucaaaaguuuaucagucaaaaugauaagaauuaaaauuguuucuacuugaauauguucauguaauaugaucaauguacaugugugaguaaaggauggucacaucaaaagugacaauauauucuauauaugcaaauaauuauggugcuaaaaaaacuaacucauuguaguaguaauuaagggagccugguugcaauuaaguacaguaaggacauuaaaacuuccaaaagauauuucuguaggccacaacagaagaauagagcaacagaauaagcagaaccacauccaaacccgcuuccuuguuauuuaccaauaucaucuaaagaacacuguuuagaugcugauguuaguugucuugacuggacaaauuuaaaucauauucagacaaaaaaaucaaaagaauuuuugacaaggguugaaaguuuauagccuuaaaacuauaaaaacuguggugcccacuacaaaccacauccuggcaauugucaugucucuacaaggaacuacuugaaaugguuuuguuguggcugaggcaaucauuucugaguuaauaauuagcuacuauuccaaucagguguaaauugucuuuuuuacacuagaucacuuuuaagaggaauauaacaauuucauuuuuagcaacuaacguucaauguuauaaucauucaucauucuauguaauauaaucaaaaugaguaggaaaauguguuuuuuacuacugcaugaaauuguauucauucucacgcagcugaaauuaaauucaaauguuaccuacuuaaugcaggugaacauuuauauuaaaaagaauacuuuuuuuaauuuaaaaaaaggugaaguuuccuguuacgcuuuuuugaaaaguaccuacaaauagcacuccuuauuuacauaaagcagguuuuaaucauguugugguugguuuuuagaucuagaauuuauaaguguuaucuuaaauugaaagacaaauugaagucagucaagguuuaucuauuaugaaacguuaucauaauuaugauaaaauaauuauguuauuagccaacuuuuuaaucuaacauuacuaacacugaaguauuuuuucaauaaccuaauaaaauuaauguugucaucauuaaacuuucugauuuacaaaguauuuuucacauccuucauugcauuagauccuaaaaacaacccucuacauuagcauaguaaauauuuguagauugcuuccccaacauccauuucccucuuuucuggccaaaaaauaaccaugccauucuuuggaggaaucaccugucccccagucucagccacacaguuuggguggaguuaaccccaucgcuaguaccaggaauugcuuaugccacucaguguauucuaucuuucaggccccauuuaucaguuuaggaauggucccuuaaaccagugaaaucauguucuuguuuucugggacuucuaggaaagggaacuuccuuuaucucucaugggaacuacuguaagauucugaaacuuuuuggaauaauacgguauaagaauguaagaucugguaagaucuggcuggaugcaguggcucacaccugcaauaccaacauguuggcaggccaaggcaggaagaucccuuaaggccaagaguucaagacuagccuggacaacacagucagacccccccaucucuaaaaaaaaaaaaaaauacaaaaauuagccaggcauaaggucauacgccuguaguccgaaccacuagggaagcugaggaaggaggauuguuugagcccaggaguucgagguuucagugagcuaucauugcaccacugcauuccaaccuggacaaaagcacgagaccguaucucuuuaaaaaaaaaaaaaauguaagaucugaaaccaaaacugcuaaaaccuuaguuccacauaaggaaggauggauaaaagggagggagagggaagaaggucaagagcauagaggagaaaggaaaacaggaaaguaaagaaagaugagagagaaaaaaaggagaaaagagauguccaggcuagagaagggcacaugagaagaaagggaggacagagacaaggaauaaagcagaggcaaacagagaaaaacagagcucaggaugcagcaaauccagagagugaaaaaguucuuaccaggcauugccuugcacuucagguaagcuguagaauaaauuaucugcuauugugaauaguaucgcaauaaacauaugugugcaugugucuuuauagcagcaugauuuauaguccuuuggguauauaaccaguaaugggauggcugggucaaaugguauuucuaguccuagaucccugaggaaucgccacacugacuuccacaaugguugaacuaguuuacagucccaccaacaguguaaaaguguuccuauuucuccacauccucuccagcaccuguuguuuccugacuuuuuaaugauugccauucuaauuggugugagacgguaucucacugugguuuugauuugcauuucucugauggccaaugaugagcauuuuuucaugugucuuuuggcugcauaaaugucuucuuuugagaagugucuguucauauccuuugcccgaaccaacccaaauauccaacaaugauagacuggauuaagaaaauguggcacauauacaccauggaacacuaugcagccauaaaaaaugaugaguucauguccuucguagggacauggaugaagcuggaaaucaucauucucaguaaacuaucgcaaggauaaaaaaccaaacaccgcauguucucacucauagaugggaauugaacaaugacaacacauggagacaggaaggggaacaccacacucuggggacuguuguggggugaggggaugggggagggauagcauuaggagauauaccuagugcuaaaugacgaguuaaugggugcaacacaccagcguggcacauguauacauguguagcuaaccugcacauugugcacauguacccuaaaacuuaaaguauaauaauaauaauaauaauaauaauaacaaaaagaacaaauuaucuguuaaauugccuuuugaaguucucuaaccacuacucacagcccagaagcuauucugaauggggcagcuguagcaagucuaugaagagacauauucuuugccuuaaaagaccaucaccuaauagaauuuaugaauaaagaaacagaacucuugcucagcacaguggcucuggcugggugcaguggcucacgccuauaaucccagcacuuugggaggcugaggcagguggaucacucaaggucaggaguucaagaccagccuggccaacauggcaaaaccccgucucuaccaaaaaauacaaaaaaaaaaaauuagccaggaguuuugacacacgccuguagucccaguuacucgggaggcugaggcacaagaauugcucaaccuaggagucagaaguugcagugagcugagaucgcaucacugcacuccagccugggcgacagaaaaagaaaaaaagaaagauaguuaaugagacugaaauacacuaauuuuagcaaucugaguuaacuguaguacaauaggccaaaucacugcuacuuuuuuugccaaaagcaaauaaucucaucauuagcuguuuaucgaguacuuaucauaauucuaaugauuuacuaucuuuucacaucuuccuuggcaaaccuaaggguuacgagacauucccacugguaacaguaguucucacauugaccucaaaggauuggaaaagccaaucuuugacaaaggcugggcugggaauugaggauaccaugguacacaaaaacauugugccagcagucauagaauuuagucucagggagaaacagagacaauaaaaauagacacagacacagacagacagacagacacacacacacacacacacacacaugcacaccccaaaaaugauugacuauauaccuguguguauaugcaugaguuugccgucacugugcccucacuuugaagcagcccuauggugauuccaccuuccccacccuuacucccagggaaauacacaccuucacauggugaaccacuaguuagaugcuagaagugaauuaaacucuaugauacucaucuaaauaauacaauacucuuuauacauuagaguaaagcagccuagguaaaaaucaggagacuuaaguagagucucaacuccacgaccugcuacauaauuugugaguacugguguaaauaaaaacuauagggccuccuguggauguuauuaacaaauucaagacagugacagcagaacauuuaacuaagcccagggcuacccaugacugcacagauuacacacccaugaaaccuucauggcuuccaaacuuauuggaugugcaacuuuuaugcaguugcuuacccuaccucagguuccuuacagcuuaaaauuagaggaagaaaagacuuucugcacccucccauaacuaacaucuguaguucucuauuaaggagugaaaccacucauuugaacagaguucuuuuaccuuuuuauagaaacauuaaaauucugaccacgacucgaagcuacuguuauguaaaaacccauacauaguauuucauuuucaaccauauugauguuuuuuauuucuauauaccuccuuaauuuugccuaagaggaaaaaauauccaaagcaguguuccaaguuuacuauuuucccauguaugccuuuuaaaucugaaauucccaacuggggucucuaugucuagaaaguaguuuuucccacaguaaaaugucuccuugcacaaaucagauauuuucuuuuucuaucacggaaaaauuaucuauucagaaucaacuuccacauaugguacagcaucugggucugauccagugaaaagaaggcaaaaugucauuuugacagugaguuaacccuuuuauucccccaguuuaguauuuagcacaacauaacugauaacuacggaaaccaggaauucuuuaucuggggucuauaaacagauuucugggaguuaaucaacucaagugaaaaaaaaaguguaucuuuauuuucaucaccucuaaaauuuagcauuuuauucuauuauaaauguaggugacaaaccacaagaauauuagugguaccuaugacuugaucacgaauaaauauuaugcauaucuuuguaucauauuacaauuacuacagauaccaugaaauaccacuuaugcucaacaugacuucaaaauuauaauaguguuacacccacuauuagauauugugguuuaauguguuaguaaaaauuauauauuuuuaauaaugcaaaauugauuuuuccauugaauauauuucaguauaaccagcuuccuuuguaauccuaaguaccuuauuuuauguguucaaaaacacaauugcaaggaaaaguccagacuucaccagacuaccaaagggguucguggcacauaaaaggugaagaaacaagucaaaguaaguuacagaguacaugugaagcaaccauaucucuugucuuauaagaagcaacagacacauucuaguaaaaacagccuggaaaauuuggguucaacaaugaugucuacauuacaacaaaaucuucaugguccguguauuuuaauaugaaaacaaguacaugggccauucgugguggcucaugccuguaaucccagcacuuugggaggccaaggugggcaaaucaccugaggucgggaguucgagaccagccugaccgacauggagaaaccccaucucuacuaaaaauacaaaauuagccgggcgugguggcacaugccuguaaccccagcuacucaggaggcugaggcagaagaauugcuugaacccaggagguggagguugcagugagccaagaucacgccauugcacuccagccugggcaacaagagcaaaauuccaucucaaaaaagaaaagaaacaaguacaucaaaaugaaacaguuuucaguguuguuguguugguuuuuguauuguuuuuguacaugugaccauagaauuugaucugaaaagguauaacccagacacaguuuuuauaacauuaucugaaauguuaguuggauuguuaccugggaugacaguagguuacaaucaaugaacaguccuuucccaguuuuguauuuuuguaucaauccagccauaauagcuccauaugcauacaggccaguggcaagaucagucauagcuacuccugggcgaacuggaucuccauucugauuugaagguuggguugagaaagaagaaauaauuaaacauuaaaagaaucauaugauuucucaaaucuucuaaugugaaauagaaaaaagaauugucuauuaacugugcagacacauacacacaagaaaguuaauaaaauaaauugcuauugugaauaucuguugguaauaggaaaauauuuauauuuacuauauacuucucagugcauuucucuccccaaugccuacuaaccaaacuaaaaauaaaagauuuuuuagaaaccgaucugauguuucaauguuuuaaauuccuucuugauauauuuuaucuuguuuaugcuaaaaaaauuaauugaauuuaaaugaguuaauuuguuggggagaaagaguuaaagcaguguuuuucuccuauugggugagaggcucucucacaaaaaaaaaaaaaaaaaaaaaaaaagaagguaaaaaaucuggucaaaccuccuuguaagcacaccaauagcuggcaaaaauacuaacaguguuugcuuaauaauuuaaaaaaagacuauuuacccauaaaaagcuguuagcagacugccccugaauuaggauuacuaugauaaacaaacugagaaucucaagauuuaugggacauggagcacugggcacagggcaugagcuuugcaacuaucuggguauaaaacggagauguuucacagccuguaacacucccugcuaauaacucauauauuucauuaaggaccucaucuacugcuuugggccacagaguuuugucuauugcaguaagaaaggauccgggggccucucucaaugucccagacaugucucugcuuuuucugagccuuuugauugcuuguauucuugaaauuauaaggaaagcuuaauauugauuaacaucuccacuucaugucagucugauuugacaauccaauccuuggcccauauguaaagauguuagaacaguacuugacacaaaauaaaaaucaccuaucaaaauuaucaacauuguuauuagucauugauauaucagauaguuucuacuugucacuaccuuuaauucugcuaagccuuaaaucgcacagaauaccuaaaaaaacucacauuucauacuucaucuggcugaugcagugauucaauuaccuccuuauuaagucuagcuucuguugaaucauuuucagaaguuaauuuguccuuuuuuuguagcccaucauaaaccauguuaauuguuuugcaaaaguacuguuuugcaaaauaauguuuaaagcaaguaacugagacgguauaguagcuaaacuuauuuuucccugcuuuucaauacaauuucaaggacgauauugccaugaaacuuggaaaugucuggcaguuuacuauuauuauugucaaaaguuguaauguaaugccuuaaaucaauacacuuaaaauuaaauuugucauuagaauuuaaaauuauuuaaugucuuaaaagugagagacaaguucaaaguuacauugacccuugaacaacaaaguucugaacugcauggauccacuuauacguggaauuuuuuuucaauaaaaguuacacuaaaggcugggcacgguggcucacaccuguaaucucagcacuuugggaggucaaggcgaguagaucaccugaagucaggaguucaagaccagccuggccaacauggugaaaccccgucucuacugaaaauacaaaaauuagccaggugugguggcacauauauguaaucccggcuacucaggagacugaggcaggagaacugcuugaacccgggaggcggaggcugcagugagcugagaucgugccacugcacuccagcauggguaacagagcaagacuccaucucaaaaaaaaaaaaauaauaauaauaauaauaauaauaccauaugauccagcaauuccacagcuggguagauauccaagaaagaagaaaaucaaucacgaagagauaugugcacucccaugguuacugcagcacuauugacaacagcggaaauauggaauaaacccaaguguccaucaaaggaugaauggauaaagaaaauguguucacgcacaguggcucaugccuauaaaucccaacacuuuggaggccaagcaggaggaucacuugaggccacgaguucaagaacagccugggugacagaguaagacccugucucuaccaaaaaauacaaaaauuagccgggcaugguggcacacaccccuaguaccagcuacuugggagucugaggugcaaagaucacuugagugcaggaguuccauccaggcuggaaugagcuaugaucaugccacugcacuccaaucuaggcaaaagacugagacccuguauauauauauauauauauauauauauauauauauauauauauauauauauaugucacauugcaguuguuuuugaaacauccauauauauauauauauagagagagagagagagagagagagagagcgagacagagagagaggaauauuauucagccauaaaaaauuagcugggcaaagaauaaauuccugucauuugcaacaauauggaugucacuggaggacauuauguuacaugaaagaagccaagcacagaaagacaaauaucacauauucugacucagauguggaagcuaacaaaguagaucucaugaagauagagagcagacugcugguuaccagaggcugggaaggguagggggaggagagaugaagagagguugauuaguggguacaaacauacgcuuagauggaagaaauaagaauuguuguucaguagaucaguacggugacuauagcuaacaucaaaaggcuguacauuucaaaauaguuagcagggaauaauuggaauguuccuagaacagagaaaugguaaauauuuaaggugaugauggguauaucaacagcccugaucugauuauauuaauguauggaaugaucacaugaacccugaaaacauguacaccuauuauguaucgauuuuuaaaaagcuaaaaaaaaaugaaacuucucaaccuaauaaagggcaucuauuaaaaaucauaacccagaucacacuuaaaaguaaagaacugaauguuuuccccuaaaaugaagaacaagacaagaggccaggcacgaaggcucauuccuauaaucccacacuuugggagacugaagggagggccacuuaagcucaggaguuggagcccagacugcacaacauagugagacccccgccuauauauuuuacaaaagaaaaaaaauuuaacuaauuauuuuuuaaaagaaugagacaaggauguccacucuaaccacuucaauucaacauuacacuggagguuuuagccagugcaguuaggguacaaaaagaaauaaaaugaauuuagguugcaaagaaagaaguaaaacuaucucaauuugcagaugacccagucuuauauaucaaaaguccuaaggaauccacuaaaaaacucuuagaacuaguaaucgaguuaagcaagauugcaagauaaaagccaauauacaaacaucaguuguauucuacacacuagcaauaaacaaacaaaaaaugaaauaaagaaaguaauucaauuuauaauaggauaaaaaagaauaaaauacuuagaaauaaauuuaacaaaagaaguacaaacuuauacucuuaaaauaauaaaauauuguugaaagaaauuaagacaaaaauaaaccaaaagacaucucacagucauggagcagaagacuuaauauuguuaauauggcaaugcuucccacacuccucugcauauucaaggcaauucuaccuaccaaaauccuagauaccuuuuuugcagaaauaaaaucugauccuaaaaauucauauggaaauaccauaaacaaagaauaaccaaucuagaaaaagacaaaguuagaggacucacaaauucugauuucaaaacuuacuacaaagcuacuguaauaaaggcagcaugguacugguggaaggcagacauauaaacaauaaaaauucucacauuuacauccaauuacuuuuugacaaauaugccaacacaauucaauuggaagagucuuuacaaaaaauggugaaaauaauaaaguuggauccccuccuugcaguacauacaaaaauugacucuaaauggaccaaaaaucuaaacuuaagagcuacaacuauauaacaaaagaaaauauaggaguaaaucuuuaugauauuggauuuggcaauaauuucuuugauaugacaucaaaagcacuagcaacaaaagaaaaaauaaauuggacauaauugaaauuaaaaauauguguuucaaaggacaccaucaagaaagugaaaggacaacccaaagaauaagagaaaguuuaguaaaucauguacuugauaagaaauuuguacagaauuucuuuuuuuuuuuuuuuuuuuugagaaagggucuugcuccaucacccaggcugaaauccaaugguguaaucucggcucacugcaaccuccaccuccuggguucaugcaauucucuuaucucagccucccguguagcugggaccacaggcgcacaccaccaugcccagcuaauuuuuguauuuuuguagagacagggucuccccacguugcccaggcuggucuugaacuccugggcucaagcaauccacuggccugggccucccaaagugcugggauuaaaggcaugagcgaucacacccagcccagaauuuuuaaagaacacuuacaacgcaaaaauaacaagaaaaaugaccuaauuuaaauaugggcaaaagaucucaauagacauuucuccaaagaaaauauacaaauggucauuaaacacacguaaagaugcuuaauaucauuagccaucagagaaaugcaaaugaaaaccacagugagucuacaacucaacaauaaaaagacaaauaaucccauuuuuuaaaaauggguaggucaggagcaguggcucauaccugugaucccagcacuuugggaggcugaagccggaggacuccuugagcucaggaguuugaaacaagccuaggcaaaaaagcaaguccacaucucuacgauaaauacaaaaauuagccagacauaguggugcacaccuguggucccagcuacuagggacacugaggcaaaaggauugcuugaacccaggagguggauguugcagugagcugagauuccaccacugcacucuagccuggguaacagagcaagacucugucucaaaaaauaaauaaauaaauaaauaaaauaaaaaauuaaaaaaguaaaaauugaaguuaaaugggcagagguuuuaaagacacauuucuccaaagaacuagauacaaaugaccaaugggcacaugaaaagauauucaacaucauuaguugucagagaaauguaaauuaaaaccacagugaaauacuacuucacacucacaaggaugacuaucauaaaaaaagagaaauaacaagugucaagaaggaugugaagaaauggagccuucauguacuauuggugggacugugaaaugcgguagucacugugauaaacagucuggcaguuccucaaaaaguuaaauauagaguuaccauaugacccagcaauuucacuaagggguauauacccaagaaaaugaaagcaugggcugggcacauuggcucaugccuguaaucccagcacuuugggagccugaggcgggcggaucacgaggucaggaguucgagacuagucuggccaacauggugaaaccccaucuccccuaaaaauacaaaaauuaaccgggcacgguggugcacgccuguaaucccaacuacucaggagucugaggcuugaacccgggaggcagaaguugcagugggccaagauugcaccacugcacuccaaccuaggggacagggcaagacuccaacucggaaaaaaaaaaaauuaaaaacaagaaaaugaaagcauguguccucacaaaaagcuuagacacaaauuuuuauagcagcauuauucauaauagccuaagaguagaaauaacccaaauguccaucaaaugauaacagauaacguggggacuagccauaugguaggauauuuuaggcaacaaaaaagaaacuauucuacuaauacaauacggugggauauuuuaggcaacaaaaaagaaacaaacuauucuacuaauacauggaagcacuuuaacaaauauuaugcuaagugagagaaggcagucacaaaaggcugcauauuauauaauuccauuuacgugaacuguccagaacaggcaaauccauagagacagaagguagauuagccaggggcugggcggaggcaggaauagggaaugaccacaaauagguaagagguuucuuuauggggugaugaaaauguucuaaaauugacuguuguaagguugcaaaaccugugaaguauacuaaaagccacugaauuguaugcuguaaaugggugaguuguacaguauaugaauuauauccauaaagcuguuguauuuuuaaacuccauaauucugauaauuaaaugaagcaggaaaaauaaaguuuaaaaaaaaucuuuaaagaccugcuuaaaaucauguauuuaguaaaaauucuagaaguuuucuuucauucaaggcuauuguuuuauuucaaugaaguuuuauuucagucaaggguaacaauaacuaaagaagggguaccauucacuccuuaguacaauucugagguggcuaugcucauacugugaaaaugucuuauaaauauauuccuaucauugaaaaguugucagaaugccagagaaauaaggaagcaaaaauaaauuaccauuuagugaguagaaauucccacagagaacgacacugugacuguaaagugccuaaguauucccaggugcaagaagacaaaaucagagaaggggcuguguaucuacaagguacaacccccuuccacaucuggaacuccacagagcccugcugcuauagcaguacuaaacaaugucucccuucuccuuaacucugggaugaauggggugguauugucucuaucauggguaaagggauucauuacucaaaaucuuuaguaaaaauacauugaaaaaaauggguaauucacaaaccuuguuaagcaauaugccugagaaucucaccauaauuuauuagaaguggacuuaaacucauauacagacuuuuaaacaucaaguaauauuuuauuuuauuaaauuauagcucuagaaauugauaguacaauuuuuauuuuguucauggucacucagaaacgguuuuaaauguauuuagcucuuuuaaugaauuaauguaacccuuuugucagagagauuuaugauaauuuugcuguaaaaguaacagauaugacugucaucaauaaagacaagaaagggaagagucucuaguuaacacuuaagacauacaauuauagugugaggacaaaguauuaaauaaaaauacuaaaagucuucugauuauucacuucccauauguauucauguauuucucuauuuucaccauucccaguguuauuuucuuuuuuucuuccuuuuuuuuuuuuguuuguuuguuuuuguuuuuuuuagauggagucuugcucugucucccaggcugcagugcaguggcaugaucucagcucucugcaaccuccaccuccuggcuucaagugauucuucugccucagccucccgaguagcuugggacuacaaaugcaugucaccaugcccggcuaauuuuuuuauuuuuaguagagaugggguuucaccauaucggccaaguugaucucagacuccugaccucgugaugugcccgccuuggccucccaaagugcucggauuauaggcgugagccaucaugcccagcccccaguggguuauuuucuuauacucugucaucccccauucauucauguauucaaaaauucacuaaaaguaaaagcugaccauuaguggaaaacccacucaaaucugaauaaggugcaguuuagauaaaagaauuguaucaaugauuauuaaaagaaauuaucaaugauaauuucuuaguuuugaucauagcucuacuugaaaauguuaacauuaaaggaaauggggugaagaguauaggcacucuacuacuugugcaacuuuuuugauagguauaaaacuauuucaggccaggcgcaguggcucacaucuguaaucccagcacuuugggaggccgaggcgggcagaucacccgaggucaggaguuugagaccagccugaccaacauggagaaacucccucucuacuaaaaauacaaaauuagccaggcaugguggcaagcaccuguaaucccagcuacucaggaggcugagguaggagaaucacuugaauccguugcacuccagccuuggcaacaagagcaaaacuccaccucaaaaaaaaaaaaaaaaggaaaggaaagaaaagaaaagaaaaagaaaaaaaacuauuucaaaauuaaaaaguuaaaaaguaaaaccugaaauuccuucuuuaaaaauugauaauuuugaaaugacagaaaugguuuagugguuuuucuuuauuuuuuugauuaugcaaucuagagaugaaggggaaaaaccacaccacuaccugugaagguuuuuguuuuuuguuugugugugugugugugugguuuuuuuugagacagaguuuugcucuguuguccaggcugcagugcaggggcgugaucucagcucacuguagccuccgccuccuagguucaagcgauucuccugccucauucucccaaguaucugggauuacaggcacaugccaucaugcccugcuaauuuuuguacuuuuaguagagacgggguuucaucauguuggccuggucucgaucucauggcuuaaagugaucugccugucucaacaucccaaagugcuggcauuacaggccugagucacugcaaccagccaaagguuuuuuuuuuguuuguuuccuuuacaucccgaucucuuaaaucacaaaauuaaauauuuuaaaagauuacuuacauacacaauuuaagaauuuuuaacauuuuuauucauuucucuaugcucuucccacuacauucagagcuugccaaaugaaacagggaaagaaaaaagaaagaaaugagggaaggaagaaaagaaggaggggggagagagggacagcgugaaaaaaaaucauguguuuuucuaaguuucuaaaaucuuguuuuguuaaaaagugcauugaagcuguaaaucaauuugggcauauguucaauaaagaagcaugaauuugaaaagucgccaagcauuuuucucuuguuacauuacucaaccuaauuacuucauaaaacaacaaaaguguuaaaacuuuuuuuaaguaguuggcuucauuucuaaaauaaaaaaucauucuuaaauguaugugucccuauguuguaucuuuauuucauacugagucauucguuauacaaauguaaucuacagaaauuuuuuuuguauccuggggcacacaaauuuuuuaauaaaccacuuuccgaaauauaaauuuuucuagcauuuacuaaccacacaaccuuuggagaaguucuuggccuuucuuaguuuuuuucucaguugucaaauauggguaaugauaaaaucuacuucagcauuugguaugagaauuaaguaagaaaagguguauaaaagcacuuuaugaagguaaaaggcugcacaaaugagacuuuuuauaaacaacuuggugugaugaugggacaccugucagaaugacuucgcaauagugcagggcagagagacgagaugagaaucucaaucaaggacaaguggaggccauggauucaagagauacuuagaaacuugaauucagagacuuugauuauugaucaguuggggagaguaaaaaaugaaauaaauuuggggaaacaaucaacaggaaauuaaguuucuuaauaugaagguaguauuuucauuguuaaaaccacuauucucaugacuuguagcccuaacuagcaggaaaacugucuucaguggaauugcaagcauagagaacaaagaauggaauauucagaucaaaugaggguuuccgugcacacagaacaugaguccucacagucacugcauucacacuucaugggcacagacucugcaacuauacagcaucugaaccuucuguuccaaacacacacucuacuugaaccacuaauugauacuaaaaauaugcuuacagacguucacauacaaauuuccacaaacuaacauuccccuacuugaaggaaauuccauuuaguaacucaaaacacugaacuccacuccuuccacugccucaucuauaaacaggcauaacaaagucuauuacuuauguaccucaguaacacuauggaguccuccagucuaaaucacaccauuuuagaacuugaaaggauccuguaguucgauccucuuaucaguaaagguaaacaagcaggaaaguacacgaguuguuuagagaucagugucuacuaauuacugacaaacagagcccuaauaagacagagaaaagagucuuaacacuacaaagcacuaaauuuaggcuauaaguggugaacaaucccagcaagagaaaggucuuuacauugcagaccagaacaggaagaucauuuuucuucauuacacccugaaagacuugaagcuuucacccauacaccuccagcuaaaccucaacaaaccacaaaccagaagaaaaaaaaaaugacgaauugagaccccagaagaaaggaagaaaaaagaaagacugacaggaagggggaaagaagaaagcaaaaacucucucugaucuucauugcagguggacucaccauauuagccaggcaacucaagggaaaauguaacaaagugauuugugucauucuccagaucccuuguaagugccugauuaccuaauauuauuaaugucuuuguaauacuauacuaaaauguucugcccuuccaaacaugaaaaguaugaacuuauaaaucauaauaucauauagucaaauuuuagcauccaacuuacucuacacaaggcuuacaagcaagcaaucuuuguuacagaagagaagcuaaggaagagucaauuuaaauaaauacugugagauguuaaguagcaaagucaagaugagaccccaaaucaauuuauccaaaaacugcugccuauaccacuuuucuggauucaaaugccuuccucagggcuucaugaucagguucagauuaaauauuuugcacuuaauaaacuaauaagcuguauucagaucucuuucacaucuguaacauguaugcuuccaacaucauguuuuucaaaaugcuuuaacacauguugucagauuuaacacuaaaagauaauuuuauaagugccaauauuaucacuauuuuacaauucaugagagaaauauuuaggcugggcaccguggcucaugccuguaaucccaacauuuugggaggccaaggugggcagaucacuuaaagucaggaguucaagaccagccuggccaacauggugaaacccaucucuucuaaaaauacaaaaauuagccagauaugguggcacgcaccugugaucucagcuacuggggaggcugaggcagcagaaucgucugaaaacaggaggcagaguuugcagugagcugagauggcaccacuacacuucagccugaugacagagcaagacucugucucaaaacaaagaaauauuuagacaauaaauuaacuugucaaagucacagagaguaaaugauacaacuagaacucaggaauucugauccaaaagcuucuguucuuuuugcuaccaucuuuucuccauauauuguuuuauuauacaucaauauuccucaucuuuccuuuucagacaaucacuaaagagcaaaaauuuuaaaugugugaguuaauuugucauuucuacaacugcagucaagaaaugauaggcccuaaugugguauggcuuguucuuuuuuuugagagagagucuugcucugucgcccaggcuggagugcagugguacgaucucggcucacugcaagguccaccuccaggguucacaccauucuucugccucagccucccgaguagcugggacuacaagggcccacuaccacgcucggcuaauuuuuuuuuuuuuuuuuuuuguauuuucgguagagacggggguuucaccauguuagccaggauggucucgaucuccugaccucacgauucgcccaccucggccucccaaagugcugagacuacaggcaugagccaccgcgcccagccgguauggcuuguucuuugcaacucaagugaacugcaaacaaucuaauguaccuacagagaaacaugcuuuuaccacucagagaucaggcaggaugggcacguucagggagguauggccauagaugcuuuuaccaucugaacaauguaaaccaaaacuuuuuucagaaaauaauugaaagaaucaauucauuggcagccuacauugaaaaauacacaaaaccacaaauuuccaaaaaugccuuaauacuucgaucacacuauuuucuugucuacugacugaaaaccaucucaaucauuuuuacuaagcucccacagugagauucccaaaauaucaucuagccugucuguccucaugaguuuaaauagaguaagacugggagaaaaugaaauggaagguuggggaauugugauauuuuaaggaauagacuaagaaauaauuucaaaaauuauuuuacaucuuuccaugcugcucuucaagaaaaaguuucuuaguuacaguuucugugcuacaguuuucugcacugauggaucagaggguagaaagaacaaauguaaaagucaauggcuccaacuucugaaacaaaacaacauuuauauccacgaagaucugcauauaaacaaucuugcauuuaauaggcauccucugaacucauucuguaaaaaacuuuuaaagagacauuuggucuaacucccugccuuuagguagguaaauuucuaagucaucuaggagagaugcucauaccucucuuuaaguaucuccagaggaccgagaagaguuacugaguguuuauuacacgccaggcaagcacuacaauggagaaaggagcuagcauuguuuccuccguguuugucuacacauuaucucauugaaucuuaguacauauguugggauacauguuaguauucucacuuuuacaaaugaaaaaauaaugaggcugagagguguuaacugggacuaagauuccaagccaggacugucugaaggcccaagaucuuucuacuccaucaugcuaauagaaacugugugacccggaccuauuucuuuaucuuuuggaagauucauugcccuagugucaaagagcucuucauuagguaacuaaaaccucuucucugauaugagcuaauauucucuuauucauuguucuaugaauaauaacaauaacugcucuacaucuuacccauaaaaauagauuaaaacagacaucaaaucauuuauuugccuuauccaaggcaaaaaguccagucccuauagacuuucacuggagaaagucuacuuuauaucccugaaaucauuuuggccauuuuucuucuccaauuauaacaacuuuuucaaagcauuaugacccaaaugaacacaacacucugaaaaguaacugagauagaaaaaaaaagugggggugggguuccuugcuuuaauaaaauucagaaaguaaaaauaggccaggcaugguggcucacaccuguaaucccagcacuuugggaggccaagguggguggaucaccugaggucaggaguucaagaccagccuggccaacugaaaauacaaaaauuagccaggcaugguggcgcacaccuguagucccagcuacucgggaggcugaggcaugagaaucccuugaacccagaaggcagagguugcaguaagccgagaucacuccauugcacuccagucugggcaacagagugagacaccaucucaaaacaaaacaaaacaaaacaaaacaaaagcuuuuuaaucccuaccucaaagcugaauauuuuuuccaaacauuuguaccauauuuuuuccaaauauucacaacccagaaauucccaguucaaauuaucugaguacaagguuuuaccuaauaagaaaggcucuccuuuuaagcguguagcuuaaagaacucuagaaggaaucaagugccauagcuauggcaaccauguagcagcuucugauuaucaaacugaagcugaaucuuuccuagaacaauuaaagauuccaaauucauauacagcaaauaauaagcaccaacucuauggggggucuauguuauauucuagauauacaaaaggaaugucccaaagauucucucucaauucagccacuaauauucuaaagaggaagacaaacagauauauauuagcagcauaaguaaaaacauacagaagcacagagggaaaaaauggcaaaacaaaucuaauagaguuaagaaccaugucauaaaggauggauagaaguccugcacaccuaguagugcucucaauggaagcacuauuggcauuuugcaagaaaaauucagauucaggggccugucccauacauuaaggauguuuaauccauaccccaagcacuaaugucaauaacaaaugaaauaucccacauaucauuuuaaaauuucccuagaguuuuacuaucuccagaugaaggauacuucaagcucagaacugacauagugaagagauccacuauccuauugcuucuuaauuaugaacaguagcagggaaagugaagccaggaguucaaugacuaaauaaaugagugaaaguguuuaaaauauuaaaagaucuaauaaggucaagaaauuugugauacaaaagaugcaauuagagaauaaaaccaaaaauagaaucuucacaaauaacacaaaauacaaaauguggauauaugaguggguugagcaaaugaaugucgguaaguaaagauaaccauacaacuggcaucuaaauaagacuacaaauuacagcaugguuucacauauaccucgugugaugcugcaccaucacuuuacaaccauguauuucuucuuuuauuguauauauguacuguguacaacauauuuugaaacauaugcacauuguagaauggcuccaccaagcuaauuaacaaaugcauuacuucauauacuuauauuuuauuaugauaacgcuuaaaaaaucuacugucuuagagauuuucaggaacacaauacagucgcguagccacaguuggcccugcagaacacaaauauaugcaaauugacccucaguauauauguaucccucaagcugcauuugauugaaaaaacuccacauguaagugggcccgcacagcucaaauucauguuauccaagggucaacuguacauuaaguauauuaacuauguuguacaauagaucucuugaacuuauuccuucuagcuaaauuuuuauauccuuugaccaacaucucccuaaccugcccuccuccccaggccucugguaaccaccauucuacucucuacaucuaugaguuagacauuuucggauuccauauauaagugaggucaugugguguucaucuucugugccuggcuuauuucacuuagaauaauguccuucagguucacuuauguuauaacaugugacaagaauuccuuguuuuuucuaaggcugaauaguauuccauuacguauauauaccauguuucuuuauccauuuauucauucauucauggacacugaaguugaugcugcaaugaacauaggagugcacauaucucuuccacauuacugauuucauuucgcuugaguauaugcccauuggugggguugcuggaucauauaguuguucuacuuuuaauuuuuugaagaaccuccauacugcuuuccauaauggccacauuaauuuacauagccacuaacagccaucacuuuacaacuuuacaauuaccagugaaaaaacauauuuuccaggccgggugugguggcucacgccuauaaucccagcacuuugggaggccaaggcagguggaucacgaggucaggaguucgagaccagccugaccaacauggugaaacucugucucuacuaaaaccacaauaauuagcuggagaugguugcacacuccuguaaucccagcuacucaggaggcugaggcaggauuaucgcuugaacccgggagguggagguugcagugagccaagaucgcgccauugcacuccagccugggcaacagaguaagacuccgucucaaaaagaaaaaaaauuaaaaacauauuuucccuauuuuacagauggaaaaacugaaguuagagaaucugucuaacguuacaccaaaugacagaacgaaaauucaaacccagauuuugauuccuaugacuguucaauaaagguguuaaauaggucuucaauggcugcucaaaguaaugacaggacaugaacuuaagaagaaaacuguaagagucaagguuuucagauuacauggcagaggagagaaaaggccaggauguuuguuaccuaugauggugggaaagagaguaugugcauagauuuuagaaguggaguggauguuggcauagguuauagaaccaugacuagaugucaagguagacagcaagaagccugggacaccaucccugguucaguguuugcagaaaguggagaagccaggaacaagcauccuccaauugaaaguaauuuaaaaccauuaucccaaucuauacuccugcuauauuguucaugauacuuaaauuuuauuuauuuauuuuuuuuucugagacguagucuugcccugucacccaggcuagaguacaguggcaugaucucggcucacuacaaccuccaccucccggguucaagugauucucccaccucagccucccgaguagcaggauuacaagcauccaccaucaugcccggcuaauuuuuguauuuuuguagagacgggguuuaugcauguuggccaggcuggucuugaacuccuggccucaggugauccgccagccucagccucccaaagugcugggauuacaggcauaagccaccacacccagucuuaaauuuucuuuuuaaccuacaacauugaaacaaaccauuuauauuaacauuuacuuuagucuuuccuccugguuuacuuuuuaaaaagaagcuuucucuuuuuuuuuaacauuucuuugaaauguuuucaguuuguugauguuucucugggauuucuggugcuuauaaaccaacucaguauuacagauuccagcguaccagugccauauauagauaaacuaugaugaucuuauuccucuguaacaugaaacaaaaaugaacacagcucaaaaugauauugacaauaucaagggaaucaacaucaagaaauaauuguuacauagaaugcucaaugaaaauaauguauucuaucuuaaaaaauuaaaaaauagaauacaaaaauuugccaagugugguggcacaugccuguaauucagcuacucgggaggcugagggaggagaaucgcuuaaacccaugaggcggagguugcagugaaccaagaucgcaccacugcacuccagccuggacgacagagagagacuccauauaaaaaauaaaaauaaaaauaggcugggcgcaguggcucauuccuauaaucccagcacuuuaggaggccaaggugggugaaucacuggaggucaggaguuugagaccagcccggccaagauggugaaaccccaucucuguuaaaaauacgaaaauuagcugggugugguagugggcgccuguagucccggcuacucaggaggccagagcaagagaaucacuugaaccugggagguggagguugcaaugagccgagauggcaccacugcccuucagccugggugacagagugagacucugucucagacaaaaaaguaaaaaauaaaaauaaaaaauuauguauuccaaaugugauuacauuugcaagacucuuuagaaagaugccaacaaauaacuguuucuguaacaaggacuacugaccauugagaauccucauucccaguccaaacaaagggcuugaaucuuucucuccccaaaaaaggaaauacaccagcauccucauuccucacccuauguaacuccaauguaaaauuauuuagaugagaaaauuuuuaagcauuuuccucaaauaaugucucugaucucauuuauuuauucugcuucgaccagcaacagcacuauuuauagguaaccaaaagauaccuauaaaucagcuguagcugaccuggguuggcuucauugcuaugggucuuacuauggaaucuucauuguauagagaaggccaaaaacuacuaagauuggcuaaaccaaucuucuuagccauaaggaacugaaaacaaggaacaggcugaaauuucaucuguaucuggucccagaaaggaccuuaauccacaacccaaaaaugucaggggaaaagaaauucuaaauauaaaucccauugacucuugagacaugcaaaucaucucuuccucucuauuuuucucucagaaacaacuaugcaauuauacuuuucuuaaauaaauuccaaugggaucauaaaauuuaaagaaauuuagauuucaugagaugacaauaaauuuaacccugauccaacucugucaaggagagugguggagcaagaugguggaauaaaaagcuccaccgaccaucccccaacaugcacacacaaggaguuaacaacuaucuacaccuucauaaggaccaaauaucaggugagcauucauaguaccugguauuaacucuguccauuauauuuaccaaaugaauagagaauuucaaagaucuauguacaagauggcaguagaucaagaccaagguccaaucucuccuucuuagacugugauggcgaaaauaaaauaucaaggagcaaugagauuacaaauaaaggaaaauaugcaaagcuacagaucauaaacaaacaaugcagacaguuauuuucuuuuuuuuuuuuuuuuuuuuuuuuuuugauacagagucucacucagccgcccaggcuggagugcaguggcgugaucucggcucacugcaaccgcccucucccggguucaagcaauucuaccgucucagccuccugaauagcugggauuacaggcauccaccaucaugcccggcuaauuuuuguauuuuagcagagccgagguuuccucauguuggccaggcuggucuugaacuccugaccucaggugaacagccggccccggccucccaaggugcuaggauuacaggcgugagccacugugcccagccucagccuguuauuuucaauacuuucauuaagucaggcaaaaauaaaccgucucuugccuaauccuucuaccaguguucuuuucucuugcaauuuauggacaaguucaaacugaagacauauccuuuccaggauucuuuuuuuuuuuuuuuuugagaugaaguuucacucuuguugcccaggcuggagugcaauggugagaucucagcucacugcaaccucugccucccggguucaagugguucuccugccucagccuccugaguagcugggauuacaggugacugccaccacgcauggcuaauuuucuguuuuuaguagagauggggguuucuccauguuggccaggcuggucucgaacucccgaccucagaugaugcuccccccgccccaccuuggccucccaaagugcugggauuacaggugugagccaccgcgcccagccaacauauccuuucauuacuauuguuuuucaaacuuuaaagcaaauauuuuauuuggaucacauaaaaacuaaaggaucauuaccaugaaugugcuaaauuuuugaaaaauaaauuuuuuuuauaaaaaaagguacauuuuauuuaaaaggcauuugaaugauagaggaauauaacagagguaaaaccugacauuuuaaacuacagaagauugcaugaucuuuuacaaaauaaauaaauuguuggcugggugcgguggcugacaccuguaaucccagcaccuugggaggccaaggcagguagaucacuuuaggucaggaguucaagaccaguccagccaacauggugaaaccccaccucuacuaaaaaauacaaaaauuagcuggguguggugguaccuguaaucccagcuacucaggaggcugagacaggagaauugcuugaauccaggcggcagagguugcggagagccgagaucacaccacugcacuccagccugggcgacagaacaagacuguugcaaaaaaauaaauaaguaaauaaauaaguaaauuuuuagcaagcauuagauauuucagaauaagacauaauccuuccacaaugaaauacuuucuaugaaaaaagaaacaucucaaauaggggagucccuuucccccaaaagacauuucuugaaaaaccaggauucauuguguauguguguaugugugugugaaaucuuucacuagcacucuguuuuagaaaagagguuuuagaggaauuugaagauuuugcuuuccaauauaaauuucacagacaacucuucuuucggcuuuccuuccauuuaggggucaaauauaagaaaaacaaaguagaaccaccuagugauauaacuuuuaugaaauaacgaaugaaauaucauaugagcuucaauaacaaacauccguaguguuaaugucagucacugggauugagucuauaaauccaguucuaguugaacuaacuaaacuaaacugagcagucaauucagucaaccaacaaguaaguuguguaaagguagaaaaacaugcuuguuuauuuucucuauauuuauuugcagguucccugaacuaacuaagaaucuaguuauuuuaaaacauguaggccgggugcaguggcucaugccuguaaucccagcacuuuuggaggcugaggcaggcagaucaccugaggucaggaguucaagaccagccuggccaacauggcgaaacccucugucuacugaaaauagaaaaauuagccgugcgugguggcucuguccagccaccgggaggcggagguugcagugagcacagguggagccacugcacuccagccugggcaacagagcgaggcuccgccucaaaaaaaaaaauguaaauauauuuacacauucgaucaaacaauaugugaaugccgauuauguuccaggcauuguucuagauuugggggguacaguacagccaguccgugccuucauaaagcuuacaucuuaaagguagauaaagaaaguaacuaauaagaaugaaauauaauuucacgcaugaagaugacuguuaugaagaaaacuaaaggaggauaaggagcuggagaguaacuggaaacacugugagggugguuggacaaccuaaaagggaugucaccuuucaggacugaaccuccaauuaguaguacacuaaaucaaauauuccauuuauugaccacauacucuuauuuagggauguuaauagguaccaucuucacaacaaccacuagaaauaguuauguuauccccauuucacagaugaaaaaagggagguucacaguaguuugucuaaacagcuuaucuaaauuugcauagauaauaaauggcagagccugcauucaaaugcuauguaacuccaaaccccauguucuuugcacuauauuacacaauugcugauaaaaaaucaaaauggccucauuauuuccaaaguuauauuuccacaguuauaauauucauuagcuuuaauaaguuuuagccuugcaugguggcuugcaccuguaaucccagcacuuuaggaggcugagguggggaucacuugagcccaggguuucaagaccacucugggcaacauaauaggucccugucucuauaaaaacugaaaaacauuagccaggccugguggcaugugcguauagucccagcuaguuaggaggcugaggugggaggauccuuugagcccaggaguuugaggcugcaguaagccaugacugcaccacugcacuccagccugggugacacagcaagacccuauuucaaaaaauaaaauaaguuuuaauaaaccaaauuccuauuauauaccauauuccugagagucauuagaaaauaaaaagaaugauguuauuaauauuaauucuuaaaauguaguacuuucaggaugacuaucauuucugaaauaguuguauguggaaauucuuaguaaaauuuguucuguuucauaaaauaucuuacauuguuugaaagguaccccaaacauuuaucacaauaaaaaacagaguuuuuugggccaggcacaguggcgcaugccuguaaucccagcacuuuggaaggcugaggcaggcagaucgcuugagcccaggaguuagagaccagccuugguaacauggugaaacuccuagcuaacaaaaaauuagccaggcaugauggugcaugccuauaccccagcuaccuggggggcugaggugggaggaucacuucagcucaggagcucgacgcugcagugacugugccacuguacuccaaucugggcaacagaaugagacccugucucaaaaaaucuuaagauuuuuuuaucuugaaaucuuuauaugaucuauagaaccauaauuuuaacaaauaaaauguuaaguacaucauuucauucauaaagauagaauauugaaaaucucuucaauuuucugguggugaacaaacacauuaaggcagaauucuaccaacacauuuuuuucucaaaaacaucucuauuuauuucuuuguuuuuuuuuuuauuuuuccuaggucauacaaauugguccuauuaacaaccgaagaaaggagaacaaacuuagguuauggacuugaaaggauaaagccaagcaaaagauugaagugcugccuguguggacagcaccucacugcuccuuccucaccaagacaauacugaggggaagaaaggccaguugacugaaucuaaauuaugcuaccaaaaaucucuaaggggggaaaauacaaugaaauaauaaauuaacacugggaaaagucaacaaaaauacccuuaaggaagaaagucucaggcccagaaccaagaccaaaggugcugccaggauuugccacguaccuucaugugggagugggacgcacccuuggcuggguggaggaugccuagcauagggaauuggcuggggucuugggaagagggcugaccccugaacccuauaaggacagcacucagccccgcaaggcuuggccuccugugguacguucucuucaaccucaucccacuucuaugccuuaucucagucaacugcaaauugggggaauuauuguugcaguauagaauuuacauguuauggaacuugacuagaguuagguuaugcaaaguaaguaaaaguaccugacagcacuuacuaaguaaaaguauuuacauauaaaggugaaguaaacuuugacuaaguacaaguaguuaauuagcagcaauugggaagugaagagagggaagauggaaggaacgaauguucgaaugcuaaucauugcucagaacaugaaaucaauacaugauggaacauguagguaauaguuaaagaagcaugaaaugaggcaggacaugguggcucacaccuguaaucccagcaguuugggaggccgggguggauggaucacaaggucagggguucgagaccagccuggucaagauggugaaacccccgucuccacuaaaacaaaaauuaggcgcaguggcaggggccuguaaucccagcuacucgggaggcugagacaggaaaaucgcuugaacccgggaggcagagguugcagugagcugagaucacaccacugcacuccagccugggcaaaagggugagaccccgucuuaaaaaaaaaaaaaaaaaaaaaaaaaagaagcgugaaaugacuucaacaucuuaaggguuuucauaaucuccucucaacccccacaggaucuuuuaguaaugauuacuuuuguaaagaauaaacaguagccaaacuggagcaauacccucuauuucacuucaauuaauuguucuucuguuaaauucaauuaaauuguauacuuauuugcuucaaauuagcaaaaauguuauuaucucauccuuauaaaauaauuuauguuugucauaugcuaugaauaugccaacguauaagcauaaacagaugucaacauugaugcuuaccaacuauuaacacuaggaacuucugacugaugagaugaggauaauuugugacuuucuuccccauuauuuuugacauuguuucaguuuuauaauaaauauguauuauauauaagaauaauuacuuuaaaaaaaaaaaagacaagaucuugcucuguugcccaggcuggagggcaguagcacuaucucgguucacugcaaccuccaucuccugggcucaggcaauccucccaccuuagccuccagaguagcugggacuacaggcaggcaccuccacgccccgcuaauuuuuuuguauuuuuuguagucaugggguuucgccauguugcccaggcuggucucgaacuccugagcugaagcaauccuccugccucaaccuuccaaagugccaggauuacaggcaugagccaccaugucuggcccaagaauaauuaccuuuaaaagccaauuaagccgggcgcaguggcucacaccuauaaucccagcacuuugggaggccgaggcaggcugaucaccugaggucaggaguucgagaccagccuagccaacauagugaaaucccaucucuacuaaaaauacaaaaauuauccacgcaugguggugcacgccuguagucccagcuacucaggagguugaggcaggagaaucucaugaacccaggaggcagagguugcggugagccgagaucgcgccacugcacuccagacuaggcgacaaagugagacucugucacacacacacacaaaaagucaauuaaaauaaaguauaaauaaaacuagcaguuaaguuauuccaccauuaacucugacucuaacucugaccguaaucaaaggucagauauauuuaagcagugucauguuagaaaggugcaugaauuaagaaaaacuucauuacuuaaccuagacuauuuaaccucuuuuguuagugaacuaauacuuauaaugguuaagauuaaaaucaaggaaauauguuauucuaagucauaaaauaagaaauauauuuuauauguguaagaacccauaauuucuauaauauuuauuaagcgugaaguucuuuccuaggcacugaagauguagcaauacaugacaccuuucuuguggaauacauuauauagucuuauauuauauauauuauauacuuuauuauauuauauguaauauuuguauauaauauauucuauauaauauaauuauauauauauauauauauauauauauauauauagcuuuuugguguuuuuuguuuuaagacaaggucucacucaguuguccaggcuggaaugcaguggcaagaucauggcucacugcagccucuaucuccugggcucaaguaauccucccaccucagcugccugaguagcugggacugcagguucaugccacaccaccuggcaaauuuuuuaaauuuuuacuagagacagggcuuuccuauuuuggccagacuggucucaaacuccugggcucaagcaauccuccugacuuggucacccaaagugcuaggauugcaggcauaagccaccacauccagcccagggaacauguauuuuaacccauagcaaauacaguugaauuuuuaagagagagugagagagagagagacagagagagagggagugugugugugugugcgugugugugugugugugugugcgagcgcgcgcgcgcgcuggaaagagccacaucucuacuuguuuauuugcauagauauuucuaacuuaaaacagguuuuuauucucaaacauugcugacaggaguauaaaaugguucacucuuauaaaauacaaauaccuaucaaaaauacaaaugaacuaaucuguugacaccagagccuccuucuagggauuuuuccuacagauauaauuguacauguggggccagaugugguggcucaugccugaagccaagaucucaccacugcacuccagccugggcaacagagcaagauuccaucucaaaaaaauaauaauaauaacaauaauaauugcgcauguagaaaauuacauaggugcuaggauguucccuguaguguuacaguauuaguaaaauaauggaaagagacuaaaugcccagcaagagaagguuaaauaaacuaugguacauccacagguauagacacaauaaaagcaaguguauugauauaggauaaucuccaggaaacaugauuuaaaauaaaauacaaugcaaaacauucaguuuagguaacccuaaaaguaagaaucaaaacuauaggccgggcgugguggcucaugccuguaauuccggcacuuugggaggcucagaugggcagaucaccugaggucaggaguuugagaccagccugaccaacauggagaaacccugucucugcuaaaaauacaaaauuagccaggcaugguggcgcaugccuguaaucccagcuacuugggaggcugaggcagaagaaucgcuugaacccaggaggcagagguuacagugagccgagaucacgccacugcacuccagccugggcaacaagagugaaacuccaucucaaaaaaaaaaaaaaacaaaaaaacaaaaacacaagaaucacaacuauaaaccuucuagaagaauaucuucaaaacuaaggguaagcaaagauuucuuaaagaggacauaaaacacauuaaccauaaagaaaauaaauuaacuaauuugacuuaaauaaaacuuaaaacuacuuaucaaaagauagcauuaugauaauaaaauggcaaaccacaggcugggagaaaauaucagcaauguauacaucucacaaauacuuguauuuagaauauacaaagaaauccuuuaaaucacugaggaaaagacuaacacuccaauaaaaacaaaggaaaggccggaaccuauaguucacauagauaucuaaaugucuacuaagcauagaaaacacaucuuaacucaucagggaauugcaaauucaaaucacaaucagcugcuacuacauacucaccaaaauggcuaaaauuuaaaagacuggccaggcacagugacucacaccuguaaucccaggacuucgggagguccaggcggguggaucaauugagguuaggaguucaaaaccagccuggccaacauggugaaaccccgucccuacuaaaaauacaaaaauauuagccggucaugguggugggugccugugaucccagcuacucaggaggcuaaggcaggagaauugcuugaacccaagaugcggagguugcagugagcucagaucaugccacugcacuccagcccgggcaacagagcaagacucugucucacacaaaaaaagacuugcauuaucaagaguuggugcagauaauuaaaacucucaaacacugcuacuacagucuaaucuggcaacauuccagaaaaccagcagcuuacuaaagcuaaauauacaucuacccugugacccguuaguuuuucacuuguagguauauaccaagagaaaucaauacgcaugucaaacaaaaggcauucagaagagaguucaguuuuauucacaaaaggcaaaaacuaaaaacaacucaaauguugaucaauagcaaugugaauacuuugugguauauucauaaaauguaauacaauauacacaguaaaaacacaucacugauacacacaaaauugaaugaacauuacaagccuucaauuaguccaagcaugguggcucacgucuguaaucucagcacuuugggaggcugaggugggcagauugcuggagaccaggaguucaagacaagccuggccaacauggcaaaaccucgucucuaccaaaaauacaaaaaaaauagccaggcaugguggcgugugccugcaauuccagcuacuugggaggcugaggcacgagaaucgcuugaaccuuggaggcagagguugcagugagcggagaucaugccacugcacuccagucugggcaacagagugagacuccuucucaaaaaaaaaaaaaaagcaagccuucaauuaaacaaaaaagucaggcauaaaucagaacacacuaggccgggugagguggcucacaucuguaaucccagcacuuugggaggccaaggcaagcagauuaacuugagcccaggaguucaagaucacccuggucaacauggugaaacccagucucuaccaaaaauacaaaaaucagccaggugucauggcaagcaccuguaaucgcagcuacucaggaggcugaggcacaagaaucaccugaacccuggagacggauguugcagugagccaagguugcaccacuacacucuauccuggaugacaaagcaagacuccaucucaaagaaaaaaaaaaaagaacaugcuauaugguucuacuuaaagaaguuaagcuagcauauaguaucagaagucaaaaauagugguuaucucuggaggagguaguauugcuugggaauagaaaaagaaacuuucuggagugauggaaauaugcuguaucuuaaacugaguagugucuauccaaggugucuauauuuaaaaaaauaauaauaaucgaacccagccugggcaucauggagagaccccaucucuacaaaaacuacaaaaauuagcugagcgugauggcaugugcuuguaguuccagcuauucaggaggcugacaugggaggaucgauucagcccagacugcagugagccauaaucgcaccacugcacuccagccugggcaacagagcaagacuuguaauguuuguaaugcaaagaaaugauaaaugcuugaggugauggauaccccauuuauccugaugugauuauuauauacuguaugccucuaucaaaaaaucuuacaugccccauaaauauauaucuacuaugccgggcacaguggcucacgccuguaaucccagcacuuugggaggccgaggcagguggaucacgaggucaggagaucgagaccaucuggcuaacacagugaaacccugucucuacuaaaaauacaaaaaauuagccgggcgugguggugggccccuguagucccagcuacucgggaggcugagacaggagaauggcaugaacccgggaggcagggcuugcagugagccgagaucaugccgcugcacuccagccugggugacagagcgagacuccaucucaaaaaaaaaaaaaaaaaaaaaaaaaaaaaaaaaauauauauauauauauauaugucuacuacguaccuauaaaaauuuaaaauaaaaaaaaaaguucauggccaggugcgguggcucacaccuguaauccuagcacuuugagaggccaaagcaggcggaucacuugaggucaggaguuugaaaccagccuggccaacacggugaaaccccaucucuacuaaaaauacaaaaaaaaauuagccgggcaugguggcaggugccuguaaugccagcuacuuaggaggcugaggcaggagaauugcuugaaucugggaggcgaagguugcagugagccgagaucaugccacugcacuccagccugggcaacagagcaagacucugucucaacaacaacaaaaaaaaaaguuuaaagaggaagacuauuuugcuugguuuugaauagaauaucucuggaaagauacaaaaaagaacugcuaagauggauuucaucugaggaagagaauaaggugggaugggcacagaggaaaggagauuuauauuguggaccguuagacacucaaggaaaaagacccaguuuaugucccaacauaaucauacagaggaccuuccugcucucucucucucucaaaacuguccugguuuguaugaugaauuauacgguccaccuacuuauguaucuuauggauuuaguauuaugugaauguauuaccucuucgaaaaauaaauaaaauaaaaacuaagaauaauacggugccuuuugacagcaauguaagagcaauuucuccuuguguaauuuuguguuuucuuaguuuuuaaaggaggagauaaauaucuaaggaacaaugcuuguaaacuugauuuaauccauccugcacacuugggccaaacuaaucuuacgaagcacagcuuucaucauaucacuccccuucugaaacaucuucugaacuucacuuugagcaaacaaccucccaacuucuuuacuugaccuugaagacuugccaaaguaaggccuaaagcaaccuuccccuuauguccugaaaccuuaacucucagcgccucugugacuggccuauuguuuucccuaagaccgccugauuccuuccugcuucucugcauuuguuuuccacugugugaucuccccugggaaugucuaggaaugucuuaauccauccacauucuaucuaucuuuccaggcaccaugcaucucaagucccaccgcuuccuuaaaguccuacccugaaccacauuuauacuuuauauauauuuuuuaauuuuguuuuguuuugagacagagucucgcucagucacccaggcuggagugcaguggcgcaaucugggcucacagcaaccuccaccucccagguucaagugauucucuugccucagccucccaaguaccugggauuacaggcaccugccaccacacucagcuaacuuuuguauuuuuaguagagacagggcuucaccauguuggcuaggcuggucucgaacuccuaaccugaagugacccacccaccucagccucccaaagugcuggaauuauaggcgugagccaccgcacucugccuauacaucaucaaguuacaauaaaaacuucucuccaacagauucaguguaagccauaaauagauucugaagauguuauuaaguuuuuuuaaauugugaggagcauuuauugcacuggaaacuaggacacagaguugaauucuuggcuaucccuaccauggaaguucucacagaaacaucuaacaacugccaccauaucaacuugcccucauacaucugccacucucagcugcuugcaaagaacugccuucguugucaacaucacauauauagacauacacacacacaaacacacacagacagacacacacucccaagccccaagccucuaggaucauccaacucaugaguuuuccaauguuguuaauccucaagaagaaaauuaaagaugcuuuaccuuccaaucugauguauuaucugcaacauaacauaccacuaauuuuauucaguuuucuguuauuuuuauuuucucauuuuuccaugcauauacaucuaaucuagggaaggaaaaaauuccuuacagaguaacuuauuaugguaccuaauacaacauuacacauauggucaauacgucuuuguucauuugauugcucaguauaauucuucuugauguuuaacugugccaauauuuacaguugaauuauuacucagaacacauaucacauaugucugagucauuuacuuuccagaaucucucauacuuugauuucauucccaaucucuucaaauucuguaugcauuaaaaaaagaugauagauagauaaacagaugauagagagagagagagauggaugcaggcaugguugcaugugccuuuggucccagcuacucaggaggcugaguggggaggaccaccugagccccgggauguugaggcugcugugagccaugauuacaccagccugggcaacagagugagaccuugucucaaaaaaaaaaaaaaaaaaaaaaaaaaaaauauauauauauauauauauauauauaugccacauagcacaguaccagauauucauuuacucauuuacucaacauaauuguuuacuaagggccuguucuaugcauaaaguagugaccaaaucaaggaccacggucuuuccuaugaggcuuacaucuuacugaggcccauuuuaggcagucagugaacagacagcagugaauuagagccagaaccccaaacucuuugagugcucucccacucuuucaaauggacuauuuacuacaucguaacaaauaucaagcagcaugcagaagcaaggugcaaauacaacagacaucaggaucauucugcagguaucauggggaguggaaagaguacaggcuacagaaguaaagaaaaccuggauucaaaguugggcuuuaguacuuuacauaucaaguuauguaagccucuaagcuucaguuauagaaugugucaauacgaggcucggcaugguggcucacaccuguaaucccagcacuuugggaggccgaagugggcgaaucacuugaggucaggaguucaagaccacucaacauggugaaaccccgucucuacuaaaaauacaaaaaaaauuagccaggcaugguggcacaugccuauaaucccagcuacuggggaggcuaaggcaggagaaucacuugaacccaggagguggaggcugcagugagccgagauugugccacugcacuccagccugggugacaagagugaggacucuaucugaaaaaaaaaaaagaaaagaaaaaaaaagaguuugucaaaacauaccuggaaguaccaaugugaggaucaaaauacauauguaaaaugucuaucaucugucuggcauaguguaggaauucaaaauagauucucucuuuguccguaaucaaauauaaucuaaucugacaacaccacagcauacguaaaaggcuggauuuuagauuuaguaaaggucaacaguaauuaguuuacccaaaaucacaugauaaagacgguuuuuuuuuuuuuuuuggagacagagucuuggucugucgccaggcuggaguacaguggcgugaucucagcucacugcaaccucugcauccuggguucaagcgauucuccugccucagccucccaaguagcugggacuacagaugcacaccaccacgcccagcuaauuucuguauuuuuaguagagacgggguuucagcauguuggccaggauggucucgaucucuugaccucaugaucugccugccucggccucccaaagugcuggaauuacaggcaugagccacaacgccaggccauaaagacuucuuucauaaaauuuucccuacaguauacuuuuuccuuuuuuuuuuuuuuuugagacagagucucucuuucacacccaggcuggagggcaguggugcaaucuugggccacuguaaccuccaccucccggguucaaccaauucucuugcuucagccuuccggguggcugggauuacaugcaugugccacgaugcccagcuaauuuuuguauuuuuaguagagacgggguuucaccauguuggccaggcuggucuugaacuccugaccuuaagugauccgcccgccucagccucccaacgugcugggauuacaggcgugagccaccaugcccagucccuauacuauacauuuagauaugcccaguuuugaauaaaaaugacauuauuauaacacuauaggaaaaaaaguugcacuuugaguuuuuucauuauaacacuagucuauauauuuggaauaucacucgauuucaagagagaaauauaugagauuaucacuaaaaauauauuugcauauaauaauguauuuucucaucaaacuauuaaguaagguaauaaauccacaagcaauaaguucagccacuguuccuuaccuccccaaccacauuuggccccacuuccuuauuaguucacaauaauccagugacacugcccuucuuuuggcucuucaaaacuaccagacucuccagcaucuagaugacaugcaauaccaugcauuacucucuaaugcuaaucggcuaaugcuuaacaggaucccacccuaaauauaugcccucagagaugccuucccugaccgacaacccugauaaacuugggcuccaccgcguagggugauguggagaagccuccugaugucagagaagccugaguuccaaucacucaucugacaacauggaguuaugcuacagcacagauacauggcugugcaguuacagaaaaguucauaugcaauggauauaauuggcaauagugugugugcacuggcugguuaaaaauauuagccaaggcuuucagaagugcuuucccguacaaucucugcugagaggcuuagggaauuguuaauauauugcugauaagauaagggaaaacaacucucuuaagggggacucccagcauggccugauucuucugauucuuuucuuuuuuuuuuuggagauggaguuucgcucuugucacccaggcuggagugcaauggcgccaucucagcucacugcaaucccugccucccagguucaagugauucuccugccucagccuccagaguagcugggauuacaggaaugcaacaccacaucuggcuaauuuuguauuuuuaguacagaugggguuucuccauguugaucaggcuggucucgaacucccgaacucaggugacccgcccaccuuggccucccaaagugcugggauuacaagcaugagccacugugccaagcuggccugauucuuuucaaucagcuuuuaucuuuagcugucaaaccacacuuuauggagaucuuuagaagcauaauaauggccugaggcacacuguuauuuauauauguucauagcacccuguacucuucuucgcaguucuuuuuauuugcauguaauaaauauuuucugcuaauguuuguuuucccuacuuaacagcuauaggaagauaaggacugugccuguccuguugccugcuuaaucuccagcgccuaccaccauucccaccguacaguaggaaacagaugcgguaacuacuuacuagguugauguguaacuuaauuaaggaaugaaagauguguccaugugaaagaaauacagugugagaguuaagcuuacuuaauguaauacauggaaaguauauaaagcaauguuuggcacauaccaagcacucaauaaauguuauuugcucaccuagaacaaaaaucaccugaguaggguaacacaagagauaaaagcuguuauugacugagaaauuauaagguugagcauauacugugugauuaucccuguuagaccacagugcaauguacuaaaggaacuacaguaaucccccagcucaacaguuuuucauuuaauucauuuuaccauuugaauauagaaauuuuuaaaucccagaucuuuucacauauuccuaauugaguucaacacccuuaaauaaaaccauucacaauaaagaaugucuuggccacaugagagccuauggaauugagcaaugagagaaauguccaugcucuauucucucaauggauggaaagaaaacuggugcucuugaauauuuuaagggaaggccagcaggguacagcagcucaugccuguaaucccaucacguuaggaggccaagaugucgugaguccaggaguucaagacaagccugagcaacauaaugggacaccaucucuacaaaaaauuuaaaaauuagucagguuuggugccacacaccuguaguccaagcuauguuggaggcugagguuggagaaucuauugagcccaggaggcugcagugugccacggaggcugcacuccagccuggagacccugucucaaauaaaacaaaacaggcuagaugugguggcucaugccuguaauccuagcacugggauuggaucacaaaguaaggaguucaagaccagccuggucaagacggugaaaccaugucucuacuaaaaauacaaaaauuagcuggucaugguagcuggcaccuguaaucucagcuacucgggaggcugaggcaggagaauccuuugaacuuaggaggcagaggcugcagugagcugagaucacgccacugcacucuagccugggcgacagagcaagacucugacuuaaaaaaaaaaaaaaaagcaaaggccacacacauuuuuuucuaagacuugugaaaaugaaacgaagaugaaaguacaauaacuuuguauuuccagaaauuaaaaccccaacaguugcuuugaaauuaauaaaaaguaaaucucaucaugagaaaauagaggcaaaggaaaauaauuaauuaauuaauaaguaaaauuaaauaaaaggaagacugcaaaagacuugaggucacucugucucaguuuauuccaacacuacagcaagcaauauuuccugaagaauuaacuagaagaagugauuuggagaaugaacacccacugaaacaaguuuuuuaaggccaucaaucuaguuuguuuugaaauggguguguuuuagcauuuuuauuuacuaggcuuucacaauuuuuuucacuuuguuuaacgucauucauauugcuuuccccgagagccuuuuuuuuaaucuaaccaaccacauuuuggccaucuaaauacuuguuaggaacuucccaaaccacuaucaauggagaggaauuauuauaaaaucaaauaauuauuucacugucagaaucuaaggcacaugacaaauuagauacauuuaaaccugagggaggcuuuaagcaacaaauuuucaaauacauaacuaccuauauuuuuccaaaaggaaaaauagacccucugcuauguacacauggcagaugaaggcacucuaguagaaauggacauccguggucuagucuagucaacuguuuuauuucaaagagggaauauuccuaaaucacacaaaggugccuauauuaagcuugaauaacauaauaaauguggaaaguguguucaccaucugaucuauggcuucuugcuaaaaacauugcucuuuuccauguggccaaauugauguuuagacucaauacauuuguaaugaacacuuccuguuuuacuuucauaagcauucacuuucccugguuucuuucuaaaauuauuaauuucaauggcaaaaacagcaauuacuuuugccccaaccuaacaacucauuuaauccuauggguuagugcagaguaaaauccuuuuggaauauguaagggaagaaauuaugaauauucuaaggaaggauaccuaccucaggcccugugaugugcaucagaccagaaacagccgaggcaacagcaucauaaccagcucgcugagaaauuggaccugucugaccauacccuaaaacaacaaaaauaaacauauucagcaccacacagggugugcuaaaaccacuguacaauauaguguguuagaaacauuuguauccagaaauccugcagcauuucgagacuauuagaucuauaccauuccuugaagaaggcaguaagaauucauuauagugcucgaccccggcuacucauuuuuuuuugagauggagucucguucccgucgagcaggguggaguguagugguucgaucucggcucacugcaaccuccaccucccagguucaagugauucuccuuccucagccucccgaguagcuaggauaacaggcgugcaccaucacacccagcuaauuuuuguauuuucaguaaagacaagguuucgccauguuggccaggcuggucucaaacuccugaugugaagugauccaccugccucagccucccaaaaugcuaggauuacaggcaugagccaccgcgccuggccuacccuggcuauucuuaaaaaaaaacucaggccgggugcgguggcucacgccuguaauccuagcacuuugggaggcugaggugggcggaucacuugaggucacgaguucaagacaagccuggccaacauggugaaaccccaucucuacuaaaaauacaaaaauuagccaggugugguggugcaugccuauaaucccagccacugggaaggcugaggcacaagaaucacuugaaccaggagguggagguugcauugagcugagauugcaccacugcacuccagccuggacaaugcagggagacucccuuuaaaacaaaaaaaaaggaaauaauucaaaaccaggcccacauucucacaugcaauaaucaauuagagucgaguauugccucuccccucuacauagggcauaaauccucugauuugccacaggguccaccacucuacuuccauaugccucagccggguuucaaguacuucccugacuccaacagguauuugcuacccuugcuuuguacacaguaauauacaaaguuaagcuaauauacaaaguuaagcagaacaauaucucccugaguucuauuuauguauuuucucaaguaaacaaagaaaaccuaaaugauuuuaagauuuggacauaaauaaacaauaacaucaacuaagugauuuuuaagauuacaaagagaagguagagaaggugucaaauuuuuuuuuuuuuuuuugccaucagaaagaaucaacagaacacaggaaagauuuucuucuacuccccucaguccugaugcuuauugcuacaucauaaaaguuguaucaggccaggcgugguggcucacgccuauaaucccaggacuuugggaggcgggaggaucaccugcggucaagaguucaagaccagccuggccaacacagugaaaccccgucucuacuaaaaacacaaaaauuagcuggguguggugguaggcgccuguaaucccagcuacuggggaggcugaggcaggagaacugcuugaacccgggaggcagagguuacagugagccgagauugcaccaccgcacugcagccugggcaacagagaaagacucugccucaaaaaauaauaacaaaaauaaaaauaaauaaagguuguaucagaagcuacauaaauuugucuccaaauccuucauaucaagcagagugacccaaugaagagcuuuccauacacaucagcuacuugcugauauucccugcauaugcugcuuuaggaaggccaugaaaggguugccugcaagccuuguuucuccagccaccuggaagacucucccucaaccuuuuguaaaagagcacccucauuauauauguugccacagcacuuaucacaauagaaacacaauaccauuauuuguuagauuuauuuugucuccucccuacuaaaguguauacuccagaauguuuuucuguuugguucacugcuguauccccagccucuagaacaguguucaauaacauuuauugaaggaaugaaugagugcaaaaauauuuuauauaaaaauaauuuuuuggcuggaugcgguggcucacgccuauaaucccagcacuuugagagaucaaugcaggcagaucacuugaggucaggaguuugaaaccagccuggccaacauggugaaaccccgucucuacugaaauuacaaaaauuagccaggcgugguggugcaugcccguaguccagcuacuugggaggcuaagacaggagaaucgcuugaacccaggagguggagguugcagugagccaaguucaugccacugcacuccagccugggcaauagagugagagucugucucaaaaaauaaaaauaacaaaaauuuuuuucaaaaacaaucuauaaaaaguaaauaaauaaaaccacaaaagugagugauaaucaccaauuaaucuacccagaugcauucgccaccagaaaugaucuuugucacaaauaagaguauguaaaacaaacuccacagauaaaauuaucacuuaauaugaaggaauuaaaauaauucaagauuauaauuauugaugauuaaaaaaagguguuaaaacaugucucugcuuauguuuuaucuuggaaaauuucaaauaaaaauagauagaauauauaauaaacccaucggucaacuucaauaauuauucauggucaauuuuauuuccacuaugccuaucuuucaauuagaacuguuacaugaagaaaaaauaaaaccauuaucuuuuucuuuuuuuuuucuuuuuucuuuuuuuugaaacugggucucacucugucacccagaccggagcgcaguggcaccgucggggcucaccgcaaccucgacugacuguguuccagcaauucuccccccucagccuccccaguagcugggacuacaggcacacaccacuacacccagcuaauuuuugcauuuuggguagggaugggauuucacuauguugcccaggcugguuuugaacuucugagcucaagugauccaccagccucagucucccgaagugcugagauugggcaugagcuaccacgcccggccacauaaaaccauacugaaaaacccaaacgucuugauucagguaaauuacaguuuuaucucccaauaucaauaacaaaauguauaaauucuuaacuauuacuuucucagucuuuagaagaacaaaaaugggauaugaagcaaauaaagagaaauaaacuauaagccaacauucucugugcagaaauaacgccaaguuuuagagaaugaguuccagggcagguagugugcugcuguagagggcacccuggcccgggauuccagccuucaaagcaaugguuuucaaaccacugguaguccccagcacaaaacaagucuccaggaacagaaagaagcugccaccaucggcaggaaggccugugcacugugaaccaccuguuaucucagcaggaagucaacaaaagaaauuaaguuucaguuaacucuagguucggaaaaucaggugcuucuggccaggagcccaaaucccucaaaugggacaaacccaggucccucaccaucagugcaacucuaaaaggacucuucuaaauaaaggccugcaggaaaaauucucuuuuuguucagcuuagaacaagggagagacacaaauauccuaauuacuuuaaauuacaacuucuaaguauuucuauuaaagagaaaaggaauaguugcucucauuggaagcaguaaaguauagggaaaaaggggaguuuuaggauuaaaaaaaaucuggauucaaauuauaguucugccaacuauuaaaucuuugacaauucauucaaucuuccuaagccucaaugucuucaucuguaaaauggcaauauucacauuuaucucauagauuucuuaugaggauuuaauuugauuagauaacacaagcaaaaugaauuuuauaucaagagcuaaauauacauaauuacuaaagaugcauuaaucaauguauaaauaauauauuagcuuaccuuuucuacaaaauguugagaauaacaaaaagaaaacuacccugagguaugucaaaugaugacaauagacaucuaagcauuuaaauuauguuguuuaauaaaccauaaaaauuaagauauuuuguacguggaaucuugcacuuguucauaauagcgaagaagcugacaauaauaauaauaaacguggcucucgccuguaaucccagcacuuugggaggccgggguggguggaucacuaggucaggagcucaagacaagccuguccaacaugguguaacccugucucuacuaaagauacaaaaaauuagccaggcaugguggcgcaugccuguaaucccagcuacuugggaggcugaggcaggagaauugcuugaacccgggaggcagagcuugcagugagcugagaucgugccauugcacuccagccugggcgacagggcaagacuccaucucaaaaauaauaauaauaauaauaauaaacauauauauuccauaauaggagucaaaaauuauuccacauuuucaccuuauacuuguaacuauuuaaauacugacuaccaguacuaugaauaaauuuuaugagaauaaauaaauaaaauuuuaaagcagagaaugaacaucaaaaugguauuuuacuaagauuacucuguuggugaugugcagaaugaaauuauucauuaauaauuuaaugaagagguagaaaaaauguuaagccugggauccagauaguuccuuuaaauuuuauuuuuagcuuuacaauuccaaaaacaacuaugauuaaaaucuaaauuaaagaggaaaaauguaugcauaucgauucuacuuuauauucaaguaaagagcuaagaaaaaucagggaaguuauggaaaaucagagaggaauacccaacacacauuuucuuucucuuucucccucucuuccacuugguaauucacauucauuuuaaggagcaaccucgccaucuuguggcauuuauggacacugaaagcaaaacgugaauuucuagacguugguaaaaacguacagggaggaagcuaaggggaaaagauuuauuaucucuuaauauuuucccugagugccauaugaucuggccugccuaccccauuuuucuucuuaauuaugucugacuuuguguuuucccucucucccaucagugcucaacacacugucuuguuaaugguuauacuuuuggaggucacaggucccuuugacaaacugguaagaagcuaugaacucuccucagaagaaaguaauugaauacaugcucauacucuuagaaccccacucauuaaccccuguugcccuggguuaagagucagguuaacgaccuucaguaggucaucacugcucuaggccuggagaaccucaauuaucaaaacaacucucccgacagggaucuguucaaggacagcuuugaggcuuccaagcaaccaagagacucaggaugaggcuuucacuugauaauaaaaggaaaaaagagaacaaaauaaaguaucucucaucuagacuauuccauuagccaccuguuucugcucucccuaccucauuuuugacucuugugaucacagugauugacugauugauugauugagacaggaucuuguucuauuacccaggcuggaggguaguggugugaucuuagcucacugaagccucaaacuccuggguugaagcaauccaccugccucagccucccaaguaacugugaccacaggcaugcaccaccacauccagcuaauuuuuaaaauuguuuguagagaugugguguugcuuuguuguccagacuagucuucaacuccugggcucaagcaauccucccaccucagcuucccaaaguaauaggauuacaggcauaagccaccacgcucaaccauacagugaccuuuugaaaagguaaaucaguacacuacuuuccugccuaaagcuuuuuaagggcuuuccaagucacuuaaaauaaaccuccacucuuuauccuggcuuagagggccccacauggcuugguuacuaccuacucuuuggccucagcucgucuguuuucccaaugcccuaucuugggcccugauauuguuuuuaguguucuccacagcuuauucccaagguggggccuuugcacaaccuaggauguauuucucuccaaucuucacauggcuugcuacuacauccuccucagagaagcuuucucuaccacccaaucuaacauagacuccuaggaauucucuagcauuuuaugauauuuucauucucucuaaaguacuuaucacuaguggauacuuuuauauuuuugauggauaucucucuccucuagaauguuaguacccugaggccugugaccaaggugacuguucucugcaauaucuuuagcaccuagaauuacgucuaccaguaacuuagcaaaagcauguuuaauaaaugagugaaugugaauauauaagucugggaauaaaaacaacacuuguuacaaccggcuauaggacagagauaaaccucugcucccuccagugaugucugaaauaaccuauugaggguagaggacuccuggcaacugaguuucugagguucaacuguuggcauuccccaacaguccauauuugguccucucucuucucauucucaucucucuaaugaaucucaucccuucuaaacaagauacuggaaauucccguaucuagaauaacaaugacaacauuuaucaaguuauuguguauuagacacucuguuagacuuuugucaauuauuuguuuaauucauauaacaacucuaugaauuauccccuuuuuacaacuauaacugagacauggaaagguuaacuaaccuacucaaggucacacaaauaggaaguaacagagcuuagauuugaacccaagucuggguccuuaaauaaaaagauguuuauauauauuuaugcauguauggacaucuccaccagaaaguccaagggaaugcaagcugacaaccccuaagaagaaguuaucccacuuaagucacauucauaugccaccaacccagacugcuccuucuacauucacuaauucaaacugaaggaaaccuaagggccauccuggacucuauucuuuuacuuccugccuauauccaauagaucacuaauuccuaauuauuugaccugccaaguaauucccaaauccauccagccucucauguccugcgauagccugcuuaccacuuccccugucucaguuuauucuucauguggcuacaaaagccuuucgaauuuguaauucuaaucaagacauuuccuuauugaaauucuuacgaaauugccuguaggauaaaaauaacaguuccuuagcaugacauacugaauuguuugugaccuagcccccacucacuaccuauaucuuaucucuggccaccacgugacaugcauacuuagaauagccguucuucagacaugcaaacucuuuaauuccucugggccucuauacaugccauuucacuugugauccucaucuccauuguuugucaguucaaggacagcucaaaccuagcacucuuuaagauacagaccuggucaaugauagguuacuagagacaagaaagaagcagguuucaaagaggacuaagaccuauccugguaaugaguucaaaaacaguguauauuuaaaaguaauaccauuguuauuagcuagaagguuaagauuaauauucuaagcaacuacagaaacuccaacaauagacuguuuaccucaaaggagaauaaaaugcaauaaaauguuucauaguaaguaauguaauucuucaaaauguacauacauaccuggauucuguuuauuucucuacucauuuucuaguguaggauguuucugaauuaaaaugauaggagguauaaacuccugaugcuuuuuuuuuuuuuuuuuuugagacagagucuugaucugugaccaggcuggagugcaguugcacgaucucggcucacugcagcuuccaacucccagguucaagugauucuccugccucagccucccgaguagcugggacuacaggcacgcaaccaccaagcccagcuaauuuuuguauuuuuaguagagaugagguuucaccauguuggccaggauggucuugauaucuccugaccucgugauccacuugccucagccucccaaagugcugagauuacagguguaagccaccgcaccaggacuuuuuuuuuuuugagacggggucucacucuauugcccagacuggaguucagugaagcaaucucggcucacugcaaccuccaccugcuggguugaagccauucuccugccucagucucccgaguagcugggacuauaggcgcaugccaccaugcccgguuaauguuuguauuuuuaguagagacaggguuucaccauguuggccaggcuggucuugaauuccugaccucaggugauccacccgccuuggccucccaaacugcugggauuacaggcgugagccaccgcacccagcgcauauucuuuuuuaauauuuauuuucuuauccauccacuaaaaaggccuagaaucaaagacuaacccaguaucacugagauuccuacuaucagacaguaguauguaaauaccacuucccacuaagaggaacuaacaguccuugaagaaauggcugauuccaggauggggcaggaaagguacaaaauguuccuggaauaucuuguuuuaccagaaaucaaggaagcuaucaaaaauuauuggucaugucaaaaagacgcagaagccaacccggaaaggccuuuacuggccugagaaugugagcaucaagaaggauaauaauugcaauaaauugaagcacaucaaauaugcucaauauuguggguucauaaugauauuacaaaaaaaaaauagccaucacugguaaagccuaggggaaaauucauuauuauggcaauugguaaauaaagggaaugugcaucucuccugccuauaccucaggguaaucaaauaacugaucagagaaagaguccccuuacaaaaguuucccaacuaauauaugaagaaggaaugauagaacuagaauagcacauuuuguaauuccuaauaaauucacagaucugggaaaucaucaucaaugccugccaacaucacagagaaaguaaugcccagccauuauaugccucuuaguggaacugcacaccaccuucuaugaaguauuuuuggccaaaaaaacaaaacaacaaaaacacacacacacacacacaaaccugaacaaguuauagaucaguuuauaaagaacaaaaaaaaauuaacaucacaggaauucagcaaaaucaaaaaacacaacagaauaaauuaacugguuuuuuaaacaaauuucaagaaaaaagacugagaaggaacuauaaauuuaaagucuuaagaaauauauaacucaacuacuaugauuacuuuauucggaucccaauucaaauuaccaacuaaacaaaagagagagagaauugggaaaaaucugaaaaacaacuguauauuuaaugauauuaaggaauaaugacaaaaaaggaaagaaagaaagaccaggugcaguggcucacaccuguaaucccagcaccuugggagguggaggcgggauggaucacuugaggucaggacuuccaaaacagacugaccaacauggugaaaccccaucucuacuaaaaauacaaaauuagccaggcaugguagcgcaugccuguaaucccagcuauuugggaggcugaggcaggagaaucgcuugaacccaggaggcggagauugcagugagccgagauggugccauugcacuccagccugggcaacaaaagcgaaacuccaucucaaaaauaaauaaauaaauaaauauauaaauaaauaaauaacaaauaaauaaaauaaaggaauuaugauuauuuuuacuuaugugugauaauggcauuggccuccgaaagugcugagauuacagacgugagccacagcaccuggccuggauguucauguguuaaaaaaagaguccuuuccuacuagauauaucccgaaauauuuagaaaugaaaugaugaaaucugagguuugcuuuaaaauaauugagacguauacaacuauuauauaucaauuaaaaauuuuuuuauaaaauaaaguugacauugggaagccaaggcaagaggaucucuugagcccaggaccccaucucuacaaaaaaauuuaaaaauuagccagaugugguggcacacacauguaguccuagcuacuggggaggcugaagugaggggauuucuugaacccaaggggucaaggaggcugcagugaguugugaucccaucaccaaaguaagauuggccaugaauuaucauuauugggcugggaucuuaagaucucaaggucuauuauacuggccaggugugguggcucacaucuguaauccccgcacuuugggaggccaagcggggguggaucacuugaggucaggaguuccagaccagccuggccaacauggugaaaucccaucccuacugaaaauacaaaaaaauuagccaggcgugguggcgggugccuguagucucagcuacuugggaggcugaggcaggagaaucacuugaacccaggaggugaugguugcagugagccgauacagcgccacugcacuccagccugggagacagagcaagacucugucucaaaaaaaaaaaaaaaaaaaaagaucuauuaaacuauucucucuacuuuaggugacuuuaaauuuuuccacaauaagauguuaaaaaaauuauuuaguuuuuauuuaauuauuaauaauuaacuuuuuauuuaauaaauuuuuuguuuguuuguuugagacaaaaguuuugcuuuuguugcccaggcuggagugcaauggcaggaccucagcucacugcaagcgugagccaccacgcugggccaauaaauuuuuaagugauaugcaaauuucauuuuguaugucuaaaaguacaccaaggaauuuuagagcuaaaugggucuggggcaaaaauucuuacuuuacagaugaaaaaaacugaagaccagauagguuaagugacuuggccaaagucaugaagccaagcaauaacaaaacuagaacuaaugcucauuucaguuuuccacuuuggauacccuacaccugaaaaaaaaaaaaaagaguuaguuuucuauucugaagauucuucuuagccacuuuuuacuuuuauagaguuaauucagaaacaaaaccaagagccaguucucuagcguuuuuggucuuuguguuuuuuuguuuugcagacaguacccuugugagaacuaaaugagacguggucagcaaaugguccaaaguuuuacagucuuacagcauuucacuucauuuuuucuauugaccuggugaaaaaccuucccauuacuuggaaagaaguuuugccacaaccauacugucaauuuaguaguuuguccuucugccauguguauaauaauguagauucacacaguucuaccucauuuugcuuuauuuccuuuucucuuuugcccuuaugguacagauacagcaucuccaaccuacagauaguuacuuuccuacaugcaagauuccaaaaccaaccucagcaggauuccaauaagauuuauguaaauuucaauacagcaagagaccucccaauauaccugcuagccaaucuaaauuaacauauaacccaaagacuccauaaggucaacuaauagcaguaauuuaggguuauaauaauaauagucaacauguacagaguacuucuguguucuagggacuguguuggugcuucauaugugucaucucauuuaagucucacaagaacuauacaaaguaaauguuauuguccuaguuuaauuauuauugagaaaauugagguucugaaagacuaagugccuuacccaaagauacacagcuacuuucuaugauucuauaauuacuaaacuguaaacacucauuacuaugaguaauauuuuacaaaauacuuccaugaguaucaacaauucaucgaucuuagccaggcacaguggcucacaccuguaaucccagcaauuugggaggcugaggcaggcggauuaauugaggucaggaguucaagaccagccuggccaacauggugaaaccccgugucuacuaaaaauacaaaaacuagcugagcgugguggcaugcaccuguaaucccagcuacuuggagggugaggcaggagaaucgcuuauacccggcaggcagagguugcagugagccaagaucaugccacuguacuacagccugggcgacagaguaagacuccccaccucaaaaaaaaaaaaaaaaaucauauauuauucaaagaccaaaaaucugauuaauaugguuuacuacaucaauaaccuuugaaguuggaccccucaaucucuaccacagaaaggcagcaaaacuggcugauuaauuacacagcaucuaaaacuucugaaauguaauacuaagaagcauaugucccuagucaccaaagguaaauaaauugguaaguuaagcaguauccugugaugcagcaaaagcauacugaacaaaaaaagaaaaauguuuacacugguaucugucuuuauuacagaauucccacuuuguuuuacuauauccaacuugggaacgcuaauauauaaagguauguuuugucuggcaauuguuucauaugcauacguuucauuuuccucaacuagacagcaccuucuaccccaacaggcaggcagccucugugauaccgaaaggucuuguucccucaugguaccccacugcagacacagcuggggcuucucccaugggaaugcaguguggaugccccuauagacagcuuuccuggaacaauucagaaugauugcggccccacaggaggagcacuccccaaauucaggccaacacaaaaggcagagucacaauuccucccuacuuggaacaucaacauccauacagaugaaaagagguccggucugaucugaauagcuggaacacugggacacaggaaacaguaguauagcgggaauuuaauaaacacuuuucaccugacuggugcauauuuuugccauuuacaguauuccaugcaugccuaugauguuuuucaaauaaacuaucaaaauaaauguuuucagaagauugacaggagcuaggaaucaagauacuaucuugccuacaacauacacuguuuuuuaaggaaaaaaagucuucaaaacuauuauucaaauggagucuacaauuucaaaggcucugaugaccaugucaaugcaucuugcuaaaagugaccuuaacuaaacucacaaucacauacacacacuuauacacaugcaugcacacacacacacacacacacacacacacacgcacagauuauccuaaauccuagaagacuuauucaaauaaggagggaaaaaaaacuauuauaaaccacacagacuaaaugaaaauaaaucgcaaaauuugucuucauauuaagaauuuaaauauauuuucauggaaucuaaagaaacuaugucagcaauuagaucuaugucccaaagaucaaacauuuuuuacaaaaugaaugcagcucacauucuggcagauggaucauagaaucauuaaagaaugaagagaauuaccauuguuaaauauuuuucauugucaggagcaaaaucaaauuucaaaugacaggaauauaaaacauaaucuuugaguagaaaagaaaauaaaaacucagccagacucucacauaaaaccaauucccuauagcuggauucccacacuccaaauagcagcacuacgucagccugugaaaggacauuuuaggcaaagaacacagaaauguucaguacagaucucuuuacaaaccaagacuaaacaacaucucaaaucaaauccagauaaauggauaacccaaaugaguaacaaauuaacaagaaucaccuuuuagccuuguuucaucgccaagaggaaaacacaauuaaguacagucuacaucuuuauuuaauagagauaaaugaaagaacagaauaaaaguaacucaaguaaauaagauaguaaauaaaauccaguaaccuuugaacugcccaaagugagagcaauuaaagucuuuucaaaagugcagacuucagggcaagcaaugcuuccuaaauaggcaaacauacacaguggcuccaaaucccagagcagaaaagaauaugaaaucaggagaaagagcauguaauggcauguaaaacaugugguggcccuggugaaaaugaucauuuauagaauaacuaucuaaugggugguuuaaaaaguuugcaguuauaagcacaucuaguucucagaucuugguuuuaaauacccuucgucacucaauggaaucagggcuucuuggauaaacaguugauuccacaacuggggcaagaaauaaaaacaggcugggugcaguggcuuacaccuguaaucccagcacuuugggaggccaaggcggguggaucacuugaggucaggaauucgagacccaucugaccaauauggugaaaccccaucucuauuaaaaauacaaaaauuagccaggcaugguggugggcaccuguagccccagcuacuugggaggcuaagccaggagaaucgcuugaacacaggaggcggagguugcggugagccgagaucaugccacugcacuccagccugugcaacggagaaagacuaccucaaaaagaaagaaagaaauggaaggauggguggauggauggaaggaaggaaggaaggaaggaaggaaggaaggaaggaaggaaggaaggaaggaaagaaaugaaaaauaaaauaaaauaagaugugugcuugugccaaaaauuaagaaagugcuggccaggcaugguagcuuaugccuguaaucacagcacuuagggaggcuuaggcagguggaucacaaggucaagagaucgagaccauccuggucaacacagugaaaccccaucucuacuaaaaauacaaaaauuagcugggcauggaggagccuccaccuccugaguucaagcaauucuccugccucagccucucgaguagcagggacuacaggcacacacaccacacccagcuaauuuuuguauuuuuaguaaagauagaguuucgccauguuagccaggcuggucuugaacuccugaccucagguuaucugcccaucucagccucucaaagugcugggauuacaccgcgcccagucuauuccacuaauuuugauuugagaaauaucugaguagcuaccaugugcagacaguacuuccaaaaaaaucagaagcacuuaagaaaaaccaucaguguucaauagugacagaagcaaauccauguagcaccucauuuugcaaaaccuagcuucuaaugccuccauggcuggauauaagguugagggacuggagaacacagagaagagguaugggcaguagugaaggucuuauuuaauuguauuacucuggugacccagcauugcugcucccugugauugacggggauuuaaagccuacuuauuguaacacggggcauuguaauagguucuuccaagaucucuuccacuccaucacuggggauaucucaccaccagacuuuuuuacacugaugaaucuaucuguuuuccaccuggucacuucuaagucccuccucagccccagucaccaucagcacaccaccagcuuccuucugccugcuugcgcaggcucuaaaaccagcacacaauguucuucucucucuuaccccaauccacaggaaauauuugcagaacugcaguggcaucccaaaccacagcccuccagacauucucuuagucucuaaauaucucaggcgugaaucauauauuaauccacucauccaccaaguucaggaaacaaaaaucuuacagaggucccagugaagccccuuucuuuugccaucagauuauaaauuuuauagaacuguuccuucugaaacuaugaacauucaauuaacauuuauuaauuaaaaaugauuauggggucaaaugcagugguucaggccuauaaucccagcacuuugggaggcugaggagggcagauuaccugaggucaggaguucaagaccagccuggccaacauagugaaaccccaucucuacuaaaaauacaaaaauuagccaggcgugguggcacacgccuguaaucccagcuacucgggagguugaggcacaaguaucacuugaacccgggaggcggagcuugcagugagccaaguucaugccacuguacuccagccugggcgacagagugaaacucugccaaaaaaaaaaaaaaaagaccaauaacagcuuucuaaauuaaaaaauagauaauguaaacaaaugauuuauuuuauaauuagauuuuuuuuuuuuuuugagacagggucucgcucugucacccaagcuggagugcaguggcaugaccuuggcucacugaagccuccuccucccagguucaagcgagucuugugccucacccucccaaguagcugcgauuacaggaaugcaccaccaugcccggcuaauuuuuguauuuuuaguagagacuggguuucacuauguuggccaggcuggucuugaacuccuaaccucaggugaucugccugccucggccucccaaagugcugggauuacaggcuauaauuagauuucugauaauaauaauuuaaaaguguauuuuccaaaugaauauaaaugaaaacugccuuuuguuuuucggguuguuuuugcuaagugcaugacaaauuagacgggaucuaaccauauucauauauuuuguaucuccacugaugauaaagacacugacucuaaaaagcuaaaacaaaaauuguccugugaaugcaucuucaauacagaaaauguggcuucauaccaauuaacuuaacuuccucauuguuugagcuaagcuaauaguaagauaaauuuacauucucuuucaacaauccaaacaaggaagauuaugucaaaacauuuuguguugggugagucagcccagguucagaauuuuucuguggcuacuccaaaaauaaauaauuuagaauuugcaauccuaaaauaagaaacuuaaggugaggcuggcauuauuuucuugaaaagggauauaucuauguauuuguggaauugugccaagaagagaaaauuucccacuuuuacaugagaaacuacugcauaaagaguacuuuuccuuguagcccuaaguuaaaugggguggaugaaucauuaaaagcucucagauuuugucaccuccacaugcaacuuagauuaaguggugcuuccuccauuguuacucagggacuaucacuuggcuugaaggccuaauggcuuaaaaauacuugguaacagacuuaucaaaaagucaugaaccaauaacaacuuuccuccugauauagucaaguugcaaagccagguuuauguuuuuaauucauaauaacuuuguaucagaugcauauaaauaucuggaacacucugggaauaucauuacagccagauggaauaucagggaaugcagcaaaaguaguuccuacuucugggucagcauggcagcagacagccauaccaguacgccucucaacaucucaucaaaacacuuauagagagagaugauaaacaucaaaacuggccaaaguggggaaaaacacuuuaaagggaagauaacaucacauaccauguuuaguagagaauuuccacaaaaagcaucauuggugcaaaggauuaagaagcacauucuuaaaugauaaaucaugugucuccuauucucaaaucaaaacaguacaaacugccuucaaacgaguugggaaaaaagcuuuauuucuucacauacuccuauacuaaaaaacaccagccagcaauuaggguaaacuuccuuauuuuuaccagcuucuaauuaauugacacuuguuauaagggagugaacauaagauuuagaauucuaaggaaaaaaguuggaucaaaagauuuuuuauuaacaaguugccuuuuaauuucuuaauuuuaauuuaagguauuauuuacacagguuuuuuucugcccuuuggugauaagaaguuuuuuaguuuuuuuuaauucguauuuuauuuugucuguuuaauguacauuuuaaacauccaaacagaagagucaccaccccuacccccgugauuggcauaccugguggagagaggccuauccuucaacaaucuccauucacauggccuggucacaacgucccaaagagacagugucaccuaacuuuuacaauugagaugacugaucaugacauccaauuacaacacuuucuccccccuucauuuggaaaagugggagccaggcuucuauuguuuaauaaaaauguuauuacuacaaaguaguacauguguguauuucuucuccaaagagcaaauaauaauuuugaagagcaccucuugcuuucacucccuuuauucuacuuacuaauuuguauuuaaauguguccggaauugguggguucuuggucucacugacuucaagaauuaagcugcggacccucgcggugaguguuacaguucuuaaagauggugugucuggaguuuguuccuucugauauucggacaugucuggaguuucuuccuucuggugggauccuggucucgcugacuucaggagggaagcugcagaccuuggccaugaguguuauagcucauaaagguggcgcguccagaguuguucguuccuccagguggguucauggucucgcuggcuucaggagugaagcugcagaccuucguggugaguguuacagcucauaaagguagugcggacccaaagagugaguaguagcaagacuuauugcaaggagcgaaagaauguagcuggcacaacuuggaaggggaccccaacggauuuccgccacuggcucggguggccagcuuuuauucccuuauuuggccccacccacaugcugcugauugguccauuuuacagagugcugauugguccauuuuagacagugcugacugguccauuuuuacagagugcugauuggugcguuuacaaaccuuuggcuagacacagaaugcugauuggugcguuuuuacagagugcugauuggugcauuuacaaaccuuuagcuagacacagagcgcugauugguguguuuacaauccucuagcuagacagaaaaguuauucagguccccacccaauuagcuagacacagagcacugauuggugcguuuuuacugagugcugauugguguguuuacaaaccuuuagcuagacacagagcgcugauuggugcauuuacaauccuuuagcuaaaccgaaaaguucuccaaguccucacccgacccagaagcccagcuggcuucaccgcucaacaacgucccaaagagacaaugucaccuaacuuuuauaauugagaugacugaucaugacauccaguuacaacacuuuuccccccacuucauuuggagaagugggagccaggcuucuauuguuuaaugaaaauguuacuacuacaaaguaguacaugcguguauuucuccaaugagcaaauaauaauuuugaagagcaccucuugcuuucacucccuuuauucuacuuacuuuuuuuguuuuguuuugagacaaagucuagcucugucacccaggcuggagcacuguggcacagugucagcucacggcagccucugccucccagguucaaaugauucuccugccucagccucccaaaaacugggauuacaggugcacaccaccaugcccagauaauuuuuguauuuuuaguagagacaggguuucaccauguuagccaggaugaucucaaacuccugaccucaaggauuccaccugcuuuggccucccaaagcgcuaggauuacaggugugagccaccacaccuggcccccuuuauuuuaaauuguguaaauuauccucuuggaauggaacuccccaaccauggaugaccaauucaagugacacuagugacaguuuuucaagcccaucuuuuuucaggauaaccccguggcaaguagccaaauguuucugcccacaaaugcaagauguuccaaggguaaccugguauagucauuaauucuagacugcaugucaaacaacagauagcuuucugaaacccaaauuuggguuuuccaucagucccauccacuuuucuguuucuacagccauucagagauuccgaguuaccaguacacaacagaggagaaaguagaggaggauggggagaaaggcacaacaugcugggaugcuuugauaccugaggaacagcacuguaagcagguguggagacaacgauaauucaggaaguuggccaggcgcgguggcucauuccuguaaucccagcacuuugggagaccagagccggcagauugcuugagguuuggagaucaagaccauccugggcaacaugggaaaaccccuucucuacaaaaaaauacaaaaauuagccugguguaguggcacgagccuguaguccgagccacuugggaagcugaggugggaggaucacuugagucccggaggcagaggucgcagccagucuuagauggcgccaugacacuccagccugggugacagagugagacccugucuuaaaaaaaagaagaagaagaauaauucuggaaucaauucaagacagguuggugggcaacggagaaggguaaacaucaaaugguaucuguggcccuagcuuaaucacaguaucaggcaguuaagacaacagacuagaaaccucagugcagcaaacucuugcuaaauucagauacagacuccauaaacaauuugccauucaauauaagacugaggggggggaaaugccagcauccaaaugaacagaguaaaaagaacaccacaaagaaaauacuuacacuugcccugaacauccugacugccuguaaugauuuuuauucuuucuuauauggagaggguauuaauaaauuacaacacuuuucuuuuuuuuuuuuucgagauggaauuucucacugucaccuaggcuggagugcaauggcgcacucucagcucacugcaaccucccccucccagguucaagcgauucuccugucucagcccccaaagugaguagcugggauuacaggcaugcaccaucacaccuggcuaauuuuuguauuuuuauaagaggugggguuugaccauguuggccaggcugaucuggaacuccugaccucaggugauccacccaccuuggcuuccgaaagugcugagauuacaugugugagcuacugcguccggccaacacucuucuuaagcaagcuuaagcagccuuguccuaucaugcuuucuuuuuuuuuuuuuuuuuuuuuuugagacggagucuugcucuucgcccaggccggaauguaguggcacgaucuuggcucacuacaaccuccuccucccgggcucaagggauucucccaccucagccucccaaguagcuaggauuacaggcaccugccauuaugccagcuaauuuuuguauuuuuguagagacgggguuucaccauguuggccaggcuggucuugaacuccugaccucaggugauccgccugccucagccucccaaagugcugggauuacaggcgugagcuaccacgcccagccccaucuugcuuucuuguaagcuauuugugaaucugccccaagacaaaaugaagaaaauucuuuuuaaagcaccuuuuauuucccaaaacaaguuaaaaaaaaaaaaaaaagccuuucucuguggaugagagcuguaaguaaauugcauuucauaucaauaauuucuguucuauauaagguaauaauagcucaaauauuuacuaaaaggucugggcugcaggauauauucaucuaccucuacuuaccaauagagaaacaauuucgaaaucccaaaccauucaugccauagaaguuccaaaccuuaaucucuuaauauuaauuagcuuaauggcuuaaucucuuaauuuuuuuuuuuuuugagacggagucuugcugugucgcccaggcuggagugcaguggcgcgaucucggcucacugcaagcuccgccucccggguucacaccauucuccugccucagccucccaaguagcugggacuacaggcgcccgccaccucgcccagcuaauuuuuuguauuuuuaguagcgacgggguuucaccguguuagccaggaugguuucgaucuccugaccucgugauccacccgccucagccucccaaagugcugggauuacaggcaugagccaccaugcccggccuaaucucuuaauauuaagcucuuaacauuaauuguauuugauaagaaguaaaugauacaugaaacucacuagccauuguuugcuaguauccucaaaguucugcauuacugugauuaaaauguucaagaggagagugggugguucacaccuauuaaucccaguacuuugggaggccaaggcgggugggccacuugagccuaggaguucaagaccagccuaggcaacaaggcaaaauccugucucuacaaaaaaauaaaauaaaauacaaaaauuaucugagcaugguggcacgcgccuguagucccagcuacuugggaggccgagguaggaagaucguuugagcccaggagcucaaggcugcagugagucauaaucgcuccacugcacuccauccugagcaacagaaugagacuuugucucaaacaaacaaaaaaaaaguguucaaaguauaacguggcccagaaaaagggagacaucuuuaauuuugauagacccuaacguaucugccaugcuauaaacucugggagucuuucucaguuauuucucucauucuccauagagggaaugccuaugugacugaucucauguagacauacgcauucucuccucuauacauauacacauacucuuuccucuuuauccacacuuucuuucuuuuuuuuuuuuugagacagagucucacucuguugcccaggcuggagugcaguggcguggucucggcucacugcaaccuccgccucccggguucaagugauucuccuggcucagccuccugaguagcugggacuacaggcacaugccaccacacccagauaauuuuuguauuuuuaguagagaugggguuucaccauauuguccaggcuggucucgaacuccugaccucaugacccccacccccaagccucccaaagugcucggauuacaggcaugagccaccaugcccagcccauaauuucuacuuucacugaaucucaauuuagacccacaauaccacucauaaagaacaucaccacaacuacaacucucugcucccagucccuaaguucugacacacaaagaggugcgaaucacaacccuuaguuuaguggcagaguaauccuggacaagugacauaaccucuuugugccucaguucucucacuuuaaaaugauaauugaagcuaccccauggggcugcuguaaauauuauguaauauauuauaaauauuaugucagguaauacauauaaagugaugaacagugacuaacauuuaauaaauauucagucauugcuaucauuauccaacuacaauaaggacuccuugaggacaguaauuuuuuuguuuugcucauuguugaauucucagugacagaagagucuggaaggcagggcaacgguuauaagaaaauuuuaaacucuaucaguaagaaccuccucaacuaaccucucucuuugaaugcgaacuugucagaaaaaggagagaguacauagcuuagcaguugauaauagugugguucaaaccgcugaguucauggucugacuaugccaagcacugugugacuucaguuucaaaaucuaaaaauggagauaauaauaucuaucuaccuugcaaggcuaucuugaggauuccaugagauaauuuaucaaaacaagcacugaguuguagggcugaugcaaggaggaggaaggagaaaaggaggagagagaagaaaagaaaaucuugaaaggauagaggcaugucagaaagacacaaaagucaaccugaaagagcaacccuuugccaaagcugagaaauuuuagcaacaaaacaaaaaacaauaauauuggacuacaacuugaagaauaaaacaaauauacauaagucaauacugacauaaacaaauaccugaauaaacaaacaacugggaaagaaggaacaaauguugcuuucagaacaguuacaaauaauagagauacuccacaccuccucaggaggugaagcuucauuccccuucagcagagaggaggcugaacuugaguuccaagaauaucacauggaaaaggaaggguaguaaauuuauaguggagaaaccuggcagauaccauccuaacgaagagaucaaaguuaacgucaucagugaugucauggugacaucagauagucccugacaugaugaaaagagaaggguacuucaccucuguaauagucuucccaaaagccaucaacucaguuccuaagaaaacaucagacaaacccaguuugaaggacaucuacaaaauaucugacaagucucugacaacugucaaggucaaaaaaacaaggaaagacugagaaacuguuacauguuggagaaaucgaaggagguauaaucauuaaaugcaguaccacaugcuggauuggauccugggacagaaaaggacauuaaguggaaaaguuggucaaauuugaauaauaaagauuuuaacgcgucuuucucaguaauugauaagauaauugauaagacaacauaaaaaaacauuaaaaauaugaaagacuuguauaguauaauuaauaaucuugaccuauagaaagaaaaccuucaaaaauuuuauuuaguuuuaaauuuuuucuggcuuuguugaaguauaauugacaaaaauuauuuacauuuaugauauaugauacgacguucucauauacauugugaaauaauuaccaucaucaaguuaauuaauguaccaucaccucacaguuacuauuuuuguuucuuaucaaucacugagaaagacgcauuaaaaucuucaacuauaggcugaguauaguggcucacaccuguaaucccagcacuuugggaggccaaggugggugaaucacgaggucaagagaucuagaccauccuggccaacauggugaaacccugucuguacuaaaaauacaaaaauuagcuggaugcgguggcacaaaccuguagucccagcuacucgggaagcugaggcaggagaaucgcuuuaacccaggaggcggagguugcagugagcugagaucgcgccacugcauuccagccuggcggacagagcaagacuccaucucaaacaaacaaaaaaaaaauauugaacuauaaucaucaauuuacauguuccuccuuauaguuuuaucauuuuuucucuuauauauaauguggccauacuauuuggggcauauaucuuuuuuuugguuuuugagacagggucuugcucugucacccaggcugcaguacaguggcuugaucauagcucacugcagccucaaacuccuggcacaagcaauccucuugccucagcuucccaaauaaauaagacuaaaggcaugugccacuauucccagcuaauuucuuuuuuuuuuuuagauauggggucucacuauguugcccaggcucuuuagaauugacaaacuugggagaccgagguggaaggaucacuugagcccagaggaucaaggcugcagugagccgcgaucaugccacuacacuccagccuggacaaaagagugagauccugucuuaaaaaaaaaacagaauuacucucuggcacuuuacagaaaaagucugcaggccccagaucuagaguauuugguauccauggccuaaagguggggauaacaccaaggauguagagaaaaaagguacauuauuuguucccuuuugagcuucaaaaaucuaggcccugaggauacuuaggauagaaaaugcacuaugauguaaaagccaagaaugugagucuugugcccacauucccaagaauggaaauaauucuuccaggccccugcucuagauaaguaaauuugggaacugcaaagaauccaaagaaaugcugggaaugugguggugugagagguggggcaugagaagaaaacauauuaagcuccacucaugucacucacaagcccagauuccaccugggccuugucccgcuuucucuccaccaucuucaucugagaugugucugggccacacguccaguguucugugccuuccacguuagcuuuuguugucuuagauacuacaggucucaaggugguaauaaugauggaucaaaaagcuuauauucaauaaucuccaugccucguguauguaauaaauaauucaagucuaaggccagcaagguggcucaugccuguaaucccagcaauuuggaggccaaggcagggagaucacuugaggccaggaguucaagaucagccuggccaacauagggaaacucugucucuacuaaaaaauacaaaaauuagccaggcaugauggugggcaccuguaaucccagcuacuagggaggcugaggcaggagaaucauuugaaccccagaggugaaggucacagugagccaagaucgugccauugcccuccagccugggcaacagagcaagacucagucucaaucaaucagaucaaucaaccaaccaauaaaagaguuugagaucagucugggcaauauggcgaaaccccaucucuacuaaaaauacaaaaauuagcucggcugguggcaggugccuguaauaccagcuacucgagagacaggcacaagaaucgcuugaacccaggagguggagguuacagugagccgagaucacaccacugcccuccagccugggugacagacuguuagauacgaguucuaaauuucuuuccaaagaauuaauaugucaguauguucaauucuuugccuucuacuuuuaaacuuccucguaaagcaaccuuuuuggauuaccuacaccacccugacucauucugaucaccugcuccacccuaccuuccaaucaccugcuccacccuaacucauuccaauuaucugcuaccugcuuugcccugacucccgccaaagcacucacccugucauucucuuuaaauuagccaaacggaauuaguuuagccuguguggucuaacccuagcaaauaggggaacgacacaguagcaggggccacaugcgucaggaauaagaaccccuuccccuuccuuauccaggugugcgcucaccaucguuccaucuguaagggcucacccuucuauauauaaauaacuugccuugcugagaauugaaaagaaaauuuuauauucgagugcuauuucuuauacagcaccaaaacuuuauauauaacaagacugucucaaaauauauauauauauacacauauauauauacacacacacacauauauaugcacauacagcuuaauggaaucauuguaucaauauguuggguuugaaacacaacugaggguguauagcaggcaaaaaccaagguaugguaaagaaagaaaaguaggccaggcgugguggcucacaucuguaaucccagcacuuugggaggccaaagugggcagaucacaaggucaggaguuugagaccagccuggccaauauggugaaacucugucucuacuaaaaauacaaaaaaaauagcugggcgugguggcacaugccuguaaucccagcuacucgggaggcugagguugcagugagcugagagcaugccacugcacuccagccugggugacagagcaagacucugucucaaaaaguaaauaaauaaaauuaaauuuuuuaaaaaaaagaaaaauagaaaauucaagguaugaggaugauaagagaacaugucagauucuggaugcaucuaacuaaggugaagauuugucccacacuacuauuuggcuuuccuuggagagcuguaagaaacaugauggaacuuucuagaugaacuauguaggggaaaugugccuuccuagaaaaacuugggccaaaauauuucauuucuuggauugaaauuuuaaaaauaauuauaaaaucuuuauucuuuuguuuguuuguuuuguuuugagauagagucucacucugucacccaggcuggagugcaguggcacgaucucggcucacuguaaccuccgccuccuggguucaagcaauuauccugccucagcaucccacauagcuaagauuacaggcaugcgccaccacaccuggauaauuuuuuguauuuaguagagacagguuuucaccauguuggucaggcuggucucgaacuccggaccucaggugauucagccgccuuggccucccaaagugcugggauuacaggcaugugccaccgugcccggcauguuuguuuuguuuuguuugagacguagucuugcucugcagcccaggcuggagugcaaugacgagaucugggcuccugcaaccuccaccucccgguucaagcaguucuccugccuuagccuucugagugucugggacuacaggcaagugccaccacgcucggcuaauuuuuuguauuuuuaguagagaugggauuuggccaggcugaucucuaauuccugaccuccucaggugauccuccugccucggccucccaaagugcugggauuacaggcaugagucacgccaccgcauccggcccuuuauucuuauuuugaaguaacaucagcaacucuccuagaacucuccugauuauaacuauucauucuauuagacaagucuucucuccagaaagcaccaacugaaacucccaucacucauuccucugaguauuucuuagacaauuuuaggaaugacaauuuacaauggaauaacaaaauauggugaauagcaguaagaaucugaagauguguauggaauagaauuuugaggauaaaaacaugaaauauuggucaaaauuuauuauuaagcaaauaacaaguauguauccuauacuguacuaauugcagcagauugaaaagaaaaacaaaauccuuaaaauaaagggcuuuuaacuuaaacauguaagaaucagucgggugcaguggcucacgccuguaauccuagcacuuugggagucugaggcgggcggauugccugagcucaggaguucgaggccagccugggcaacacggugaaaccccgucucuacuaaaauaaaaaaaauuauccggacauggcggugugcaccuguagucccagcuacucaggagccugaggcaggagaauugcuugaacccgggaggcggagguugcagugagccgagaucgcaccacugcacuccagccugggcaacagagcaagaaaaaaaaaaaagaaucaauuuauucuugaacaagagaauauuuuacauauucaauaccuaguugucaaauauuuauuuguauuuguagaccaugauccaagacauauuaaaacauuuucuacuacuugugacauaguaaucugaauuucuuccauggaauaccuuauaguuuagacuauucuuuccuuuuuuucucuacuuuuuaaaauuguggcaaaauauacauaacaaaaaaauuaguuuuaaccauuuuuaaguguacagugcaccggcauuaaauauauucacauaguugcauaacuaucaccaccauccaucuccagaacuucuucaucuuggaaaacugaaacccuauacccauuaaacacuaacucccgagucucuccuuccucccaaccucuagcaacuaccauuuuacuuccugucucuaugaauuuuacugcucuaggaaucucauauaaguagaaucauacaguacuugaccuuuucugacuagcuuauuucacuuaacaaaaugucuucaagguucauccuugcagcaugugucagaauuccccgccuuuuuaaggcugaauaauauuccaucauuauugcuuauuuauucaccugucaauggauacuuggguugcuuugauguuuuagcuacugugaauaaugcugcuaugaaaaugcguguacaaauaauccuucgagguccugcuuucaauucuuuugguauauaccuagaaauaaaauugcugaaucauaugcuaauucuguguauaauuuuuuuuuuuugagauggagucuugcucuggcacaaucucagcucacugcagucucugccucuggguuucaagcaauccuccugccucagccuccagagcagcugggauuacaggugcccgccaccacgccuggcuaauuuuuguauuuuugguagagacaggauuucaccauguuguccaggcugaucucaaacuucuggcaucgagugacccacccaccuuggccucccaaagugcugggauuacaggcgugaaccaccacgcccagcuuccguguuuaauuuuuuugaggaauguccauacuguuuuccauaggggcugaaccauuuuacauucccaccaacagugcacaaggguaccaauuucucuguauccucaccaauacuuguuguuucccgguuuuuugauaguauccaucuuaaugggggcgagaugguagguaucucguugugguuuuggugugcaucucccuaauggcuaaugauguggagcauuuuucaugugcuuauuggccauuuguaugucuucuuugaagcaauguguauucaaguccuuugcccauuuccuaauugguggcuugcuagacuagucuuucuuuuuucuuuuuugagccagaucuuugcucugucacccaagcuggagugcaguggcacaacauagcucacugcagucucaaccucccaggcucaagcaaucuucuaugucagccucccaaggagaugggaccacaggugcgcaccaccacacuuggcuaauuuuuuuauuuuuuauagagucagagucucacuauguugcccaggcuggucucuauccccugggcucaagcaauccuccugccucagccuccaaaagugcugggauuacagccaugagccacugugccugaccagacuagucuuucuuauaaucaaauacaaucugccuuuuguauccauggguuccacauccauggauucaaccaauccacaaauugaaaauauuaggaaaaaacuugcauccgugcugaagauguacauuuucuuuucuugucauuacuuccuaaacaauagguauaacaacuauuugcacagcauuuacuuuauauuagguauuacaaguaauuuaaagaugauuuaaagaauacaggaggaugugcauaaguuauaugcaaacacuaugccuaucauaucagagauucgaacauccacagaagguccuggaacuaaucccucauauaaacuuaacuguacguuugccaaauuucuuaaacuuugauauuuuucacuugaaaaaccuuugugcauaauauauucuuuacaaguuggauuucacugauuccacaaucugguauuccaucaaaaucccugaucuuuccagguucaaacuauuaccuacuccacauacuuuuaaccuuugugauuaaauauacugagguucaaauaaaaggcugaaaguugugguauugcacuaaugcuagcuugaagaaacaugcaaagaauggaaaaaauaauuagcgagaugaaugcuaucuaaacacuaucugacauguauguuuuuauccuuuuaaguauaaaauuuuuuucuuaucuaacauugcuucuuuaaauuuauggauuuauuucccaggccuauuaccauaaggggaaacaauucaguuuugaugacaggguuuuuggaugguggcuaaguccuggcauguuuaucuggcacgaucuauaaaacauucaauuugugaaaguuuugaaauaacuacugcugugacauuaacuaguauugucaucuuuuuccuuuuacuggucccuagucuccaagagauucuuuaaauuggaaacuauucuaaccauauaucagaaauuagagaccaaagaugaaaucaacugauucuuaguggguaaugaucuauacuaaauuuauacuguauuucuaggcccaggcgaucucuuugcuucuggaauuuuagaauauguagaaaaacagcucaaucuccuguuaaaguuuuggguuucucuuuuuuaaaucaauaguaucagaaaaauaaaaauaucugggaauugaaguagaccacauacauuuauguacaaagcugugucaugagaggguacuugcauaucccuaauuacacccagcagagcucuucuaagaugaacaauuuugucacuuuucuuuuuuuuuuuuuuuuuuuuuugagaugaaguuuugcucugucacccaggcuggagugcaauggcaugaucucagcucacugcaaucuccgccuccaggguucaagugauucucccgccucagccucccaaggaguuggcauuacaggcaugcaccaccaugcccgguuaauuuuguauuuuuaguagagaugggguuucaccauguuggccaggcuggucucaaacuccugaccucagaugaucugcccaccuuggccucccaacgugcugggauuacaggcgugagccaccgcgcccggccaauuuugucacuuuuaacagaaugggaaaucacuucauccauguuccaauccaauacauuuuccuuuuuccuuuucccuuuuuauuuuuguuuuguuguuuuguugagacagagucuugcucugucgcccaggcuggagugcaguggugcaaucucggcucacugcaaccuccaccuccuggguucaagcgauucuccugccucagccuccccgaguagcuaggaguacaggcacacgccaccacgccuggcuaauuuuuguauuuuuaguagagacgggguuucgccauguuggccaggcuggucucgaacuccugaccucagaugauccaccugccucagccucccaaagugcugggauuacaggcaugagccauugcaccgggcccuucucuuuuuauuuuuaagagacaaguucucacucugucacccagguuggagugcaguggugcaaucagagcucacugcagcaaucagagcucacugcagccucaaacuccugggcucaaaugauccucccaccuccaccuccugaguagcuggaacuacaggcuugugucaucaugccuggcuaauuuuuuuuuuuucaaauuuuuucuagagacgaggucucacuaugucacgccggcuggucucaaacuacugacccucacgcaauccucuugucuuggccucccaaagugcugguauuacaggcaugaguuaaugugccuggcuccaagauuuucuuaaucccacaguuucauaaagaauucccaggccggaugcaguggcucacgccuguaaucccagcacuuugggaggccgaggcgggcagaucacgaggccaggagaucgagaccauccuggcuaacacagugaaacccugucucuacuaaaaauagaaaaaauuagucgggcaugguggcgggcaccuguagucccagcuacucgggaggcugaggcaggagaauggcgugaacccgggagguggaggcugcagugagccaagaucgcgccacugcacuccagccugggugacagagcaagacuccguaucaaaaaaaaaaaaaaaauucccaaguaggcugggcacaguggcuggcucaugccuguaaucucaguacuucaggggaccaaggcaggaggaucacuugaggccaggaguuugagacuagucugggcaacauagugagaccacaucucuaccaaaaaaaucaaaaaauuagccaguugugguggugcaugccuaugaucccagcuacacgggaggcugaagcgggaggaucacgugagccugggaagucaaagcuguagugagcuaugaucaugccacugcacuccagccuaggugacuaagugagacuuugucucaaaaaaaaaaaauucacaaggaaaacugucauaauguuucuuauacccaguaacaauucaauaucaccuuucaauugauuuuuuauagcaggaaaauauauuuuuaaauuauauauacagaaaaaguuaaccuuuucacuuggguuuaaauaguugaaaaucuacaacauuagccaaaauauguuuaucuuauuaaauagauauucuuuuuuuucuuucuuuuuuuuuuucugagauggagucucacucugaugcccaggcuggagugcaauggugcgaucucagcucacugcaacuuccgccucccagguucaaccgauucucaugccucagucucccaaguagcugggauuacaggcgugcaccaccacacccagcuaauuuuuguauuuuuaauagagacgggguuucaccguguuagccaggcaggucucaaacuccugaccucaagcgaucuacccacuucggccucccaaagugcugggauuacaggcaugagccacugugcccggcuuaaauaaauauucuauuuccauaguuagaaacuuugaagacagcuaucucauguucacucgacuuaauguuaauccuuacuaccugaaaaacauauuucuucagcaaaauuugcuuuaaagaauguugcaaagagacuccuucucucaguuucaucugaggcuucaaacccccaaaaaauguccuagugccagaacacuagcacagauaacacuaaaagauuaugaaaccaguuuugcugccauuagcuuaucauccauuugaggauaugugagaaaaggugaaaagcuaaauaaaaccuucagcugaauuuccuuggaaagaguuguuauuguaugcuaggcaucucauucugucauaagagaggagcaagcuguuuuccccuuaacuuaagccacacaagagagacuuccaaaaaagcgucagagaccuugauacaagcuaagggaauuugggaauucugggaauuuggaauuaccuaagcaccuguggcaugugucugaaagaauaccaaaggcaagggguuauggcuacaucggcuaaaagcaacagagcuaagaguucggaauaaacuguacaccugccaauggccaaggaggagggaggauuuuuccccaugggccaaguucaccaugaggaaagcagaaggaguuuaucugaaaaggaauucuacccaugagggcugccuauaggacaaggugaucauaacagauagacucuguguauagacaaccacaaaaaacagggacugaagugggagaacuacaaucugaggucucugaggagacuacaaaacuccccauaaagagagccaccuacagaacuucaggcacacagaaggcuccacugcagguuacaacuacaccagucaagucauacccuuauugcacccuuuaacuugcuucccuucccugggagggccugauucugaaaaaaaccacaaauagcagcuaacaauaggaaaagauggauaaugaagaaacugacuaggcucuuccgaaacacauagacaugcagacacaugcaugcaugugcauacauaauacaaacacacacacaugcaacauaugugcaccuguaauacaaacacacacacauccucuucacauucccaagaaaguagccugaaguuggggaaaaggagacgucauaaacuggacaagagucugagguuuugauauuagacuggacugaacauuuuaauacuuuaaacgaaauaacugccaggcaugguggcucacgucuauaaucccaacacuuugggaggccgaugcaggaagaucacuucagcccaggaguucaaaaccagccugggcaacauggugaaaccccaucucuaccaaaaauacaaaaacuauccgggcgugguggcaugcaccuguagucccagcuucucgagaggcugaggaggaggaugauuugagccugggaagcagagguugcagugagccgagaucgcaccacugcacuacagacugggcaacagagccagacccuguuucaaaagaaaagaaaagaaauaacugaggagaaaaaaaaucuauaggacuugccugggauuucaucuaugagcaaagagaauaaguggacagugcagguuugcagaggugggcugggagagaagaaagcaucuggugguacuccaguaaguccaacucauguaacacaucuguuauauguguauggguaaaaagaaauauuuaaagauaaaagguuauacuguuggggaauaaaauaaaggcauaaagucauuuucuggaaucaguccaugucuacagacaaaauauaaucucaguccuuagcuccaagggcuguguuuugaaacccuauauuuauaugcuaaguuucucuuccccugcagagauggugucauuauuucuuuaaauaaugagcuuaauaugaaaugguaaauaugucaaaccacacuuucacuaaagaucacugucuauacaguuggacagauggccacaauauccugaaacucuggugaaaaaauauuuccugauauaagagggugcaacagagacacucauaauuuagaccaguaguuuucaauuguuuugacuaugaggguucccuuuaauaucaucuauuaaacuaucaucuccauauugauuauuuauucagucuaaaaaugauacuuaaugcagugugaacaucgccagaugaacuagacuacugucuuuagaaauuuuuaaaaaaucuugcugauuguuaucccauuuuacuccacucugccucucuuauuuuauucuuccuucucuucuuccuuucuucauucccuccuuccuuuuuccuucauucccucuuccuuccuuucuuauuuucccucucucuagucuuaaugucuuuucucaccuucaaaacaucuaugaauuugcaguauggauuugcagauccuauucuaauuauucuaucuuuuuuuaaagcuauaguuauguggugaauaugccgaaaauaagaacacacacacacagacuaacucaugccguaagaauccaacugcagcaguguuuuguuuuguauucccguugcugugauaugaauguagaaugcaguugcuaaauaauuugccucauccauuugggcucaccauucucugcuauugacucugaaacacuaugagggccuuuaauaaucuuuaaaaaauuaucuuuauagcuacucugugaaaccugagccccauuucaaucuccaaugccuauaaugaagucagucaaccaggaauugaauucuaccucuuuuuuuuuaaucugcauucuacugaaaaauccuacuucuuuuaaagauuaugauccuaccccuccacugcucagacccauccuagcaugucauggccccugcacaccucugcaguaucuuuucaagcauacugcucucaguuuuuaguguuccaaacacuucggcuuucucuuagauccuuaaaggcgucuagaucuuuccuaccacggagccuuugcacaugguauucucucugccucaaucacuucuccccuugcucauuacauggcuggcuccuugucauccuucaggucucuuaaauguuaccccccucaaaaaaaaaccuucccugacaagcccauuuacagcaugcaaccccuccucuguuaaucuccaccacaguacuauuucauucuuucauaauaguauaguuugcuaauacauguuguauuuauuauauguuuuaacuuguuuauagaaugucucugaccuaggcugucagcuccuuaaaaaugcaaggacaaugucuacauuguuugcccugagcacucaacacagccaggaauauacagaagaucaagaaauaguuguuuggggguaggaaagggaagaaaggaaggaaauaaggaggggagcuauuugggcauuucugaaucuuuuauucucacuuaaaucauaaaauacagaaugacgaauacucauguaccagccagucaguuuauuuugugaauauaauugaaauucugugguucucucuucccugucccauauccuaccuccccacuccccaggguuaaucauucucuugaauuuuguacuauucauuaccuuguaugucuucauauuuuaaacacauauauuuuguaugauuuuaacucuauguaaugcuauauaaauagagauuaaggaaaugucccugaggaauucacaaaaauaaaaaaggcacuuuucaaacccucuuccuuuaaaaaaaaaaaaaagaaacuucauuaaaugacauguacaguguucccacuacaaacucagucuagucaauaauauaaugaaauguuuauccuuccagaaagaaagaguaaugaaauuaacaagaacaggagaaauaacauuuuaaaauguaguggcgaggauuccuacugcuaaauuuuuauaauuaauaacauguucagaagauacgagggaaagaagguacaacuuaaaauuaaauuguuaggggaaauaccauuguacuucuaaaaguauagagaaauauagaguggucacuucacaaauauaaauauguccuucagagaaucuuccuacccagugguacacaggaaacacugcccuuuucacaaaaauaauuccuagugaauaauagcuguuuaaacacugcccccuaaugugcauacucagcuuccucugaaaugauaagaggaccaugcuaauaaaaauaaucagguccuuccucccuugugaucacucuagcauuuuuguccugcagaccagauuucauagacugaggcaauuucaaccacacaacugucagagugcauuaaagucaaucucccagccauucuaagauuacucucaucagcaauagggccaacaugugagugagaacaaacuauuugggcuuggacagcacugacaagagagcaauaccauugggaaauaucaggaaagucuaggaucucaaucacaacaugugcaacuuuagacugauguaaucagucuuauuaaaaaaaaaacacacacacacagacacacugauuaccaagaaaaucaaacuuuuuuuuuuuuugagguggagucucacucugucacccaggcuggaaugcaauggcaugauuucggcucacugcaaccucugccuccagguucaugcaauucuccugccucauccuuccaaguagcugggauuauagucacccaccauacccagcuaauuuuuguauuuuuaguagagacgggguuucgucauguuggucaggcuggucuugaacuccugaccucaggugauccgcccgccuuggccucucaaaguguugggauuacagucacccaccaccauacccagcuaauuuuuguauuuuuaguagagacggggguuuugucauguuggucaggcuggucucgaacuccugaccucaggugauccgcccgccucggccucucaaagugcugggauuacaggcaugagccaccacgcccagccaagaaaaucaaauuuuaaaaaaagagaugaaccuugcuuuauaugcacacaaacucacaacucaugaaugacuuuggcuuccagaagaaucuguugaaauuuagacucccugacuaauaaauuuguucaugacuuccacuauugcaaauaaaauuaacaagcgaaagaaaauggcaaaaauauauuauucucaaguagcacuguucagugucaccuaauuacaaaaucugucauuacuuauugauaugucuaaguauggaaagcauagaggcacuuacuacuaagacaagaagccugaguuuuaaacccaucugcuauuaaauagcugugugaccuuaggucuggaucuguuucauuaucaggaaauaaaggagaacggaguauauagauguuauucuaauaacugucaggaggugggaauuaggagauuauagaauaaugagagguacguuuucagacuacacauaucugccuaucacccucucauuccuccauaauaucacuaaaaagcacaugauagaaccauucuuccuugucugagaacuacugaauuauauaaucuaucuccaaugccauuucaccacacuaaaauuuuaauacagaauuugagaacuguaagaaaacuuagagacucuccaaucauuaagucaaggcccagaagaacuuuugacccuaaccaguuaguuauaaaugugaaucauuaggaagugugggcuucccaaguagacuaacauuuuuuuugacucgaugaugugauaaaauguauuauuauucucaauugucauccugcucgaaacccacacccuaugccaugugacuuuguaguuccucccucugaaacagaauguauuucaccacccauugguauuggacuuggccaugugacuugcuuugacaaauacuccauuuguuagcagaugcauugggagcacaggcuuuaaacacacuggugaaaaugggcuuguucucuugcacuccaccuuucccuaugaggggagaugcauuugguggccacugauccaaggaggauaacagacaugcagagcauaccagucccccaaugcacaacuuggagccaaaccuaaccagucuguaucaacugaaucccagccaaccacagacaugggaaacagaaauaaaugcuuauugucauauagcauuuugcauuuguuggcuaugcagcguuuuuaugguaauaugauaauucagaagauaauuuaccuauauuaagauuuuaaaccucaacauuuccauuagauuacaagauucugauggaaaaaaaucucucccucacucugucacacauauaaauauuguuuagacagaaaaaugaaaauaugauuauggaucuauaaaacagcacauuuuaaaaagugagaucuaguggccaagaaucaucuaccaaguacagaaccugucauucaguacaaaaguuaaucaucagggccgggcacaguggcucacacguguaaucccaacacuuugggaggcugauguggguggaucacuugaggucaggaguucaagaccagucuggccaacauggugaaaccccaucucuacuaaaaauacaaaaauuagccaggcaaggugguacaugcccguaaucccaucuacucggguggcugaggcaggagacucaccugaaccuaggagguggagguugcagugagcugagauugcaccaaagcacuccaaccugaggaacagagagauacacugccuccaaaaaagaaacugcuguuggcuguggaaccccuaucaugugcucugcauuacagguggaacugggaauagaauaacacaaucacauaaggcaaggaguucaagaccagccuggccaacauggcaaaaccucaucucuaugaaaaacacacaaaaaauuacccgggugugguggcuagugcacuugguguuguccugccuaaaacccucuucgccaguagcuaugugguucacuccuuuaccccaugcaggucucuacucaaaugucaccauauggguagggcauucucucaccuaccaguuugaaauaacuuauccucaccccacccccuugccaacuaccagacucaauuaccaaaaacaaaaacaaaagugcuuauuuauuuacuaucuaucacccuaaccuagcauauaaaugcucuagagagcacagauggauuuuuaucacuccuguauuccagaaucugagucuauugccuggaagaucaaaggcuugcaguaaauauuugguggaugacugaguaaaaacuuaaaauauuaugaauuuuucugaugcaaacuauuaauauaacauuuuauguuaugagucacuuuucucuaucgcaucccuaauuaagaguuaaguacuuauauagaaaacuaaguaacaccgugacuuuuucccuuuagccuaaacauacacauacaugcauauauaagagguucacuggcaagggcugaacaauuggaagacuuuaugccacucuuuuccuuccuuuggcuuagugcuucugaauauauugaagggauaccuuggguuccuauguuauuaucuuaaagccaauuaacauuucaacuguaggccaggagugauggcucaugccucuaaucccagcacuuugggagaccaagguggguggaucacuugaggucaggauuuagagaccagccucgccaacauggugaaacacugucucuacuaaaaauacaaaaaucagccaggcauggugguaggcaccuguaaccccagacacucaggaggcugaggcaggagaauccuuugaaccuaggggcagagggugcagugagccgagaucaugccacuaaacuccaggcugggcgacagagugagacucugucucaaaaaaaaaaaaaaaaaaaaaaaagaauuguuuucaacuguaaauucaccuaugcaagaguuaauaacaguauuuuguaaacauuugcaaaacaucaacauaaaacuuagcaaaacuauaggcagacaauucaaagaagaaauacaaauagccaauaaauuuaugaaaauauucauuuagguuaauguuucuuaauaauguucagcagccaaggccggacgugguggcucacgccuguaaucccagcacuuugggagacugaagagagcagaucacgaggucaggagauugagaccauccuggccaacauggugaaaccccgucucuacuaaaaauacaaaaauuagcugggcgugguggcgcgugccugguaaucccagcuacucaggaggcuaaggcagaagaaucgcuugaaccagggagucagagguugcaguaagccgagaucgcgccacuacacuccagccuggcaacagagcgagacucugucucaaaaaaaaaaaaaaaaaagaaaaaagaaaaaaguaaguucagcaaccuaaacggccuuggaaaaaggaaaacagaauaacuuccaaaaaaaaaaaaagccagcaaaagguuucuuauagcaauaagaaaacacagaaacuggaaaaccuuuuaacugacaagggugugggguugaaauaccugugauggaacaauagaugaugugaggagcaaucucgucuauaucuucauaucccaggcccauugcagacaguuugccagggacauaguuuuccacaaacacaucacaaacagcugcaagcugauggaagaggugaacaugagucagacuuccacucaacaaauccccacaugauagaauuuuaacuuuacacaauugauucucccuuuguaauagcucagaaaaaucacaggacugaugaagcaaauuagauaaacauagaaguucuagucaacuacuuaaagcauuacugucaguaaaauaauggcuauuaaaguuuuuguaaguacauguaaguacaugcagaauggauucugcauccuucaaauguaauaaauaucuagacuacauggucuguccaaauagauucucaaaagauuagguagaaaaauuagaauguaaguacacuaaaucaaugaaaaacauuuuuuaaaccuuuacaagaaaacuaaauaggccaggugugguuguucacuccucuaaucucagcacuuugggaggccaaggcagguggacugcuugagcccaggaguucaagaucaggaguucaagaccagccugggcaacauggcaaaaucccaucucuacaaaaauuagccagacacgguggugcauaccuauggucccagcugcucgggaggcucaggugggaggaucacuugagccgguaaauugaggcugcaaugagccgugauggcgccacugcacuccagccugggagacuguuagaccuugucuccaaaaacagaccuaaacacaauaucucuacuacucagcaucccuauuauuauguaauauuccucauuauaacaugcacuuaacgcacuuaagcaggauucugaaauguuuucacaccuuucagaugcauucuucccaaagaguuuuaaauguauuuaagaaccacuggaguuuuuuuucuucaggcuacuaaacuauagcccaguaaaccaggaacugucaggaacaaaauccagauugugaugcccagaccgcuguuacgggaauuagaggacaaugcagcauuguaaaccuuaauuuuacagaaauuuuacaaaaaauugggaaauuuuuuucccaaaauuucaauugugacuacauacuuuuaaaaauguuuuuaaagggccaggugcagugacucacaccuauagucccagcacuuugggaggccgaggggggcagaucauuugaggucaggaguucaagaccagccuggccaacaugguaaaacccugucucuacuaaaauuacaaaaaaaugagccaggugugguggcacaugccuguaaucccagcuacucgggaggcugagacacaagaaucacuugaaccugggagacagaggucacagugagccgagaucaugccacugcacuccagccugggugacagagugagaaccugcuucaaaaaaaaaaaaaaucuuuuuuaaauaaauuggccgggcauaguggcucacaccuguaaaucccagcacuuuggggggccuagguaggcagaucacuuaaggucaggaguucgagaccagccuggccaauauggcgaaacccugucucuacaaaaacuacaaaaauuagcuggacgugguggcacgugccuguagucucagcuacucaggaggcugaggcaggagaaucacuugaacccaggagguggaggugcagugagccaagaucgugcugcugcacuccagccuggggcaacagagugagacuccaucucaaaaaaaaaaaaaaaaaaaaaacacaguaauuggccaggccaaauagcucacaccuguaaucccaacacuuugugaggcugagucggggggauagaucacuugaggucaggaguucaagacaugccugggcaacauaccaaggcuucgucucuacaaaaaauuuaaaaauuagccaggcaugguggcacaugccuguagucccagcuacacaggagguugaagaaggaggacugcuugagcccagaagguggaggcugcagugagccaaauucucacuacugcacuccagccugggcaacagagugagacugucucaaaaaaaaaaaaaaaaacacuacuacaagcacuaaagaaaauaaacugcaggcuggccaggcacaguagcucauaccugcaaucccagcucuuugggaggcugaggcagguagauuaccugaggucaggaguucaggaccagccugaccuacacggugaaaccccgucucuacuaaaaauuacaaaaauuagccaggcaugguggugggcaccugaagucccagcuacucgggaggcugagacaggagaauugcuugaacccagaaggcagagguuggagugagccgagaucgcaccauuguacccuagccugggagacaagagcaaaacuccaccucaaaaaaaaaaaaaaaaaagaaagaaagaaaauaaacugcaugcuauauagcaaaauucuaauauuuuuguuucaucuaggcauaggauaaaugagaguucauuauucuuucaacuuuucugaauguuuuaauuuuucauaacaaaauguuauaggaaaauaaaacucaugcauugcucugcugaccauaacacaugcccauaauaaugauauuguaacugucaacuaauuaacauagaaaauugucugaaauauuggauaagacaugaucagaaguuaucaaaucauauugccacaauaauacuaaguuucauauagguuuucuaggcagaguuucaguuuuuacacaaccuguuuuugguuagccuagcugacaaaggagucauacuuuuugaagcucucauguauccagcugauugccuuguguaauacuuuggaacuguuucuauaaacuaaacucauuguauuagcaaucauagccaccaaggccuaaauggagagggguuauuuuugcuaauccuuuuuuuuuuuuuuuuuuuuuugagauggaaucucacugugucacccaggcuggagugcaauggugcaauaucggcucacugcaaccuccgccugucggguucaagcaauucuccugccucagccucccaaguagcugggacuacaggcacgcaccaacacgcccagcuaauuuuugcauuucuaguagagacaggguuucaccauguuggccaggcuggucucgaaguccuaaccucaugauccgcccaccucggcgucccaaagugcugggauuacaggcgugagccaccaugccuggcauuuuuugcuacucuuaaggccagaagagaaaucuguaccagaaauaugaaagacuagagaaaaaauaauuuuuccuuuagauaguaagauacauaacuuauuaauuguaauaacuaucuaaaagcaauuggcuggccauggugguucccaccuguaaucccagcauuuuggguggcugaggcaugcggauugcuugaggccaggaaaacaauuuagaaaaaucaaaccaaguuucaaaagaaaaacagaaacaaaccuaaguuaugcuacaggaaagauaugggaagaaagagugguaagaucaggaugauuuucaaguuuuggguucaaaauauaucuaguuaacgaaaauucuaaauuggcugcauugauccagcagaacuaaaaagaauggucccugauucugaucuuaauaauuaaagauuaucuuucaauaacugagacagagaacauaaagcagcagcagagcaauugaagcuaaguuaauguuuugguaaaaaauaaaguuugaggccaggcgcgguagcucacgccuguaaucccagcacuuugagaggccgaggcggguggaucaccugagguuaggaguuugagacuagacugaccaauauggugaaaccccaucucuacuaaaaauauaaaaauuagccgggcaugguggcacauaccuguggacucagcuacuccgcaggcugagacaggagaauugcuugaaaccaggaggcaaagguugcagugagccgagaucgcgccacugcacuccagccugggugacacggcaagacucugucucuaaauaaauaaguuugagacuugguucucuaaccaaauagcccuaaguacaguuggcccuugaacaacagggguuugaacugugcaaguccaccccuagguggauucuuuucaaccaaacguggauggaaaaugcaguauucacuggaugcaaaacccauguacccugacaggcaauuuuuuguauaagcagguuccacagggccgacugcaggacuugaguaugcacagauuuugguauauguggagguucuaguagaaccaauccccugaauacagaagaauacuauacaaccauuagauucaacuuaaaccuuaacaaggauggcaaacaagguuuaucccacaugaugaauccaacaucaggaacauaggaauaauaauagcuaauaccucaugagugcugacuauguggcaagcacucgucuacacauuuuacaaagacuaacucaauucuaacaacaacccuagagaguagguacuauugggcugggcgcgguggcucacaccuguaaaucccagcacuuuggaggccaagguaggcagaucacuugaaguaaggaguucgaaccagccuggccaacauggugaaaccccauugcuacuaaaauuacaaaaauuagccaggugugcuagugcacaccuguaaucccagcuacuccagaggcugaggcaagagaauugcuugaacccaggagguggagguugcagugagcugagaucaugccacugcccuccagccugggcaacaaagcgagacuguuucuaaaaaaagaaagaaaguagguacuauuauuaccuccaguuuacuaaugaagaaacugagacacaaagaaguuauguaaccugucugaggucauauagccaguaagcacagaaggcaggauucaaaucccaugcaaagguauccacccuuaauuuaaccacugugccuuccagcuccucuaagaaagaugcucagaucaggucuggauauauuggucaucugaguaaggguuagagaaagcuuggacuuuccagugaugugacccagauccaaaugucagcuuuuccccauacuagcuagggaaucuuggagcaucacuuaggcaccaggaaacucaauucccuuuuauguaaaugagauuucaauacuucauuuacaagguaaaaucugaggauuagaggagauaaugugagcaaagugcccaagcccaggauuugcugcagaguuggugcucagucaauaguagcuagcaccauaaugauacacaauauacaaaaaauuuaaagcacaucacacuuacaaagaaguauacaaaucaaaguaaauacuuaaaagguauuuguugcaaacguacagaucacccauaaaauugaguuuuaaaacacuuuugcucugauauuccaaacccuaauuauaaccuaggugguaggaugcuuucuauacaucauacuguaccucuuugaugauuuucaccccuuuuggauccuugauauuaacagcaauacucuaaaaauuaaaaaauauauauauauauauuauuucgaugaccaaaacacaagaagcccaauccccaccacuaugcaauauacccacauaacaaacaugcacauguauccccugaaucuaaaauaaaaaguaaaaaaaaaaaaaaguauguguauuaaaauacuaucauaaaaguuuuucuuuuuuucuuuuuuuacuuuuugagauggagucuugcucugucacccaggcuggagugcaguggugcaaucuuggcucacugcaaccucugccucccggguucaggcgauucacaugccucagccucccaaguagcugggauuacaggcacacgccaccacgcccagcuaauguuuguauuuuuaguagagacgggguaucgccauauuggccaggauggucucgaucuccugaccucgugauccgcccgccucagccacccaaagugcugggauuaaaggcaugagccaccgugcccagccaugaaaguucuucuuauugcugacaagaaagccauucauaucauagaucauccucuuaaauuuauuuuaugcaugaagaaauauuuaaaucaucuuuacugauucuauuuaccaugaggauauauuaauaugcuaacaaggaugauaggagauguuuuuaaaguauaauaccgaguguuaggcaauuauucccuaauaauaacaaauguaaggaaucaaauaauuuuucuauuucauaaaauuauuuccauuauaaauucuuaugaaauguucuaaguuacuuaguagguaagaaagaguaguaaaaagcuccauuauuucuacuuagugaaugguaaaugaauagaauuuuaauuuauuugaaauauuaguuacaucuuaauuuuuuuaaggaagaaaaaaacaagccacaaugauaucaacaguuuugcuauuauaagagaauuacacacaaaaagcaaaaaagggaugauauucuuacuuuuuuauuucgguuaacacugagauaauauguacuuucugucccaacaaaagguggcccccaaguucguguaucaucaccagcuccugaaaauaauaacaugagcuauuaaucuuugggguuuguuuuuuuuuuuuuuuuuuuuuggagauggagucuugcucuguugcccaggcuggagugcagaggaacgaucucugcucacugcaaccucuaccuccuggguucggguaauucuccugccucagccaccugaguagcugggauuacaggugugcaccaccauaccuggcuaauuuuuguauuuuuaguagagacaggauuucaccauguuggccaggcuggucucaaacuccugaccucaggugauccacccgcuucagcuucccaaagugcugggauuacaggcgugagccaccgcgcccauccauuuaaagcaguuucuaagugaccuugaaaauaaaaauaaaaauaguacuaccaacuucuagaacuauaauuucacuguaccaucaauugcuaaaacuagcugggauuacagguacccgccaacaugcccggcuaauuuuuguauuuuuaguagagacaggguuucaccauauuggucaggcucaucucaaacuccugacuucaaaugauccacccgccucagccucccaaagugcugggauuacagguaugagccaccgcacccagccaagaagcauuaguucuaacuggagauaaaccaaugacaucuccugcaucagccuccauaguaacugagauuacaggcgugcaccaccaugcccgacuaauuuuuuauuuuuaguagagacaggguuucacaauauuggccgggcuaguuccgaacuccugaccucaauccugacuucaagugacccagccgccuaggccucccaaagugaucccacugcaccaggcuaguaguuuauuuuagauauuugcacucauaucucagguggagauaaugucaggagucuaaacuggaggccuacaggcuuuccugaucuaacugggguuucagaaggcucuguguccauggcacaugacaggaaauguaugguuaaaggacauaaacuggaaaaaccugcagcuugggagacauguuuuauuugacccacacaauucuuuuuuuuuuuauuauuauacuuuaaguuuuaggguacaugugcacaacgugcagguuuguuacauauguauacauaagccauguuggugugcugcacccauuaacucaucauuuaacauuagguauaucuccuaaugcuaucccuccccacuccccacaccccacgacaggccccggugugugauauuccccuuccuguguccauguguucucauuguucaauucccaccuaugagugagaacaugcaguguuugguuuuuuguccuugugauaguuugcugagaaugaugguuuccagcuucauccaugucccuacgaaggacaugaacucaucauuuuuuauggcugcauaguauuccaugguguauaugugccacauuuucuuaauccagucuaucauuguuggacauuuggguugguuccaagucuuugcuauugugaacagugccgcaauaaacauacgugaccugcacaauucuuaaaauuuuuaacuagcugccaugauuucaaaaucuggaaaucuuuaaaaauucacacugccuuucuuagaugaccuuuugacacacucauucauucaacaaauauuuaaugagcaccaacuaugucacagacacugcucugugcagagcagacacagcagugaacaaaagaccaacagcccuggccucguguccccuaguggagacaaugcugaaauuucagcugcauccuugcucacuucccugcucacuuuccucacuuagguucccugccuggcccugcaggcacacagauacacccacugacuggcuaacucuacaaaaagaagaguauacauaaauauaauaugcucuuugguuacacaaauaaaaauaaucucaucuaauaguaaaucagaaaacuacaaccaggccagauccgguggcucaugcugguaaucccaacacuuugggaggccaagguggguggaucacuugaggccaggaguuugagaacagccuaggcaacauggugaaacccugucucuacaaacaaugaaaaaauuagccaggugugguagcacacgccuguauucccagcuacuuaggacgcugaggugguaggaucacuugagcucaggaggucaaugcugcacugagccaggagugcgccacugcacuccagccuaggggacagagcaagauccugugaaaagaaaagaaaaagaagagaagaggaggaaaggggagaagggaggggaggggaggggagaggagggaaggggaggggaggggaaggaauaaaagagaaaagaaagagaaggaaggaaggaaaagaaggagagagagagaaagaaagaaggaaagaaaggaaggaaggaaggaaggaaggaaggaagaaaaagagagaaagaaagaaagaaaacaacaaccaaauuuuauguaauugaggaacuguagaaguggauauaaaaugaaacuaguuuucuauugaaaugugaaaauaccaccaaguugcuuuuaaugaaaaucccuuuuucucauaucuguguugaauaacuaucucaaaaacccaaaacaauuaaauauauaauaugaauauuaaaauguauuaaucagaagggugaagacagggagucauaguaacuggucaaaaaaaggacaauaggccagaugugguggcucgccccuguaaucccagcacuuugggaggccgagguguguggaucaccugaggucaggaguuugagaccagccuggucaacauggugaaaccccgucucuacuaaaaauaaaaaaauuagccgggggugauggcauaugccuguaaucccaacuacucaggaagcugaggcaggagaaucauuugaaccugggagguagagguugcagugagccgagaucgugccauugcacuccagccugggcaagaagagcgaaaagucugucucaaaaaaaagaagacaauaaaucccugcuaggaacaaagcccgauaccaaguguauggcgaugagacauaauaaaggccuagacaaagaaagaucuguugugguuuaguuuccaugguggaaacuaaaaaguacaaagaggaaauaggccucacuauauagggaacaacaauuuauaaaauuaauagaaauacaaauguuacccugguggccaacagaaauagcaagagaaauuauuaauacauugaauguucuaucuaggaauggaaaaugcaagaaaaccaaugguuguagugcugcaguguugaaaucagauagcaauauggaaauuagaagcuuuaaagaaaaaaaacaaauguugagcuagaaaauaaacauucuuccgcauguauccaacaaugacuaaaagcgaugaacaucauuagcugaauaaacaaagcaucaucucugggagcaggacuugccaggcacuucuacugccuaagacugucagggauaauaaaaaguaauaaaauauaauauacuaauauacaauauuccccaugcucaucagagaaucuucugcuaacugcuuuggccucuuaagaauaucuacuuaacaagaaauugaaucuuccagaucaaacauucuacuuucuguaaagacaaaauaaaauuuaaaauuuuuuaaaaaagaaggaaacaaacaaaaagauauucuacuuuauauggcuaucacuuauggucaauuacuaaguugauguaauuauaaaucauucucuuguaagucuuagagauacauacacacuauucagcacuauaccagucucacugauuuggggauucuguuuaagacccguaggaucagaucuugaaacauaaauaauaaugcuaauuuuugaaaacuucuaaaacaagcugcauaggccaugugugguggcuuacccacaccuauaaugucagcacuuugggaggcugaggucgaaggaucguuugagcccaggaguucaagaccagccugggcaacauaggaagacccuguuuuuaccaaaaaaaaaaaaaauuuaauaaggccgggugcaguggcucacagagugagacuccaucucaaacaaaacaaaaaaaauuuagccaggcacaguugcgcacaacuaugguuccagcuaagguaggaggauugcuugagcccgggaggucaaggccgcaguaagccaugaucacacaauggcacuccagccuggaugacagagugagaccugucucaaaaaaaaauaaaauaaaacaagcuguuuauaugaugauauagcagacauuaaaaaacauggacugugcccuuuaagugcuuauuggagagaaagggcacaaaacaaugacacguuccuuuuugagauggaguguggcucuuguugcccaggcuggggugcaauggcauggucucgacucacugcaaccuccgccucccagguucaagagauucuccugccucagccuuccaaguaguugagauuacaggcaucugccaccaugccccacuaauuuuuguacuuuuaguagagaaggggguuucaccaucuuggccaggcuggucuugaacuccugggcucaaacgauccgcccaccucguccucccaaaauguugggacuacaggcgugaaccaccaugcccggccaacaaugaugcuuuucuaagcaacuuuaucaauaacagcuugaacuaaacaccaaaaugcuaagaugauaccaaacaaaagugagaaauguguacacagaauauaucuauuuggugaacaaaggaggaagaaagaacaggaaagaugucagaugaaaaacauaaaagcaaaaaacugaucuaagcuuaggcguuucccgcuucaaaaccuuuaaaauuauaaaauggggaaauguuucuuuuauugggaauagaaaaaaauggccaggaguaguagcucacaccuguaauuccaacauucugaaaggcugagacaggaguucaagaccagcccaagcaacauagcaagacccugucucuacacacacaaaaaaauuuuuauuauuauagcugggcauggugguacaugccuguagucccagcuauucaggaggcugaggcaggagaacugcucgagccuaguaguuggaggcuauggugagcuaugaucacaccacuguacuccagccuggaugacagagggaaaugcugucucuaaaaaauaaaaacaaaaaggaauagaaaagaaugacuuagguuggaguauuugagguuuuuuguuuguuuguuuguuuguuuuugagacagggucucacucugucacccaggcuggagugcaguggcacgaccucggcucacugaaaccuccaccucccaaguuuaagagauucuucugccucagccucccaaguagcuggaaccacaggugucugccaccaugccuggcucauuuuuguauuuuuaguggagacaggguuucaccuuguuggccaggcuggucucgaacugccgaauucaggugauccgccugccuuggccucccaaaguacugggauuacaggcguaagccaccacgcccagccuuagguuguuuuuugagggacugugauuccuuuuccuucucuccuucuucuguacccuauuucuucacuuuuauccuccuuucuccuggccuucccuugauuccacggugagggaggguggccaggcccauuguaaucucagucucaaugcuaaagcuaggcuggggcuaaggaaggccagaaucauggcugagggucuggauauuccuuauuaccugugugccccuaaauaaguugcuuuacuucucugugccuccauuuucuccuuuauaaacuaugaauaauagcaucagcccauaggguuguuguaaagauuaaauaagcccaggcaaagcauugagaacuuugccccggcacuguaggugucauuaucauaguuguuauacgcugcaucucagucccuuuuuuuucauuuuuuuuuuuuuuuuugaaacggagucuugcucuguugccuaggcuggagugcaguggcaugaccuuggcucacagcaaccuccaccucccggguucaagugauucuccugccucagccucccaaguagcugcaauuacagguccaugccugucuacuuuuuuuuguauuuuuaguagagaagagguuucaccauguuggccaggcuggucucgaaguccugaccucaagugaucugcccuccuuggccucccaaagugcugggauuacaggcgucaaccacugugcccagccucagcuucuaacaaaagccuucaggugcaaagaagaaacuggcuugagccuuagcacuuagcacacauaaggagugaaaaagauaucauuaguguuaguucacaggaaaacaagaaauggagaagaaaaagacaaucauuucauuuuaauucucuccuuaucccacuuauagguacacuaaacauggguauuuagagaauuauuuuaaaauauuuauuagcuuguuucuauuuuuuaaagggaguaauagcuuuaccuggucucuccacuuuuauaacuucugcuccaagaucuccuaaauucauaguagcaaaaggucccgccaggacucuacaauguuaaaaaugauaaauaaauuaauuaccaucuugaaaauguuuauauuaauuauuuuccaacaacccgucaacacagacacgcucauauaauccuaguaagaaucaaaacaguuaaaacuguaauuuggccauauguaauaggagcuuuaaaaauauauauccccuuugauccuauaauucuuuuucuuuuuuuuuuuuuuggagacggagucucgcucugucacccaggcuggagugcaguggcacuaucucagcucacugcaagcuccaccuccuggguucaugccauucaccugccucagccucccgaguagaugggacuacaggugcccaccaccacgccuggcuaauuuuuuuguauuuuuaguagagacgggguuucaccguguuagccaggauggucucgaucuccugaccucaugauccgcccgccucagccucccaaagugcugggauuacaggcgugagccaccgcgccuggccccuauaauucuuuuucuagaauuuuauccugaggaagaaaucaaaacugagggaaacauuuguguacaaggaagccuaauuuauaaucgugaaagauuagaggaugauuaaguaauuaugugacaucgauauauuaauuacuauuucacuuuuuuguugaauuuugaauaacauaggaaaauauuaaaaauauaacauuguguuuaaaauauggguaaaacuaauuucaauaugguuccaauuuuuguuuuuuaagauuauauauaaauauacauugggaaaaggcauaaauacuacacuaauugucucauagaaugaugauauuacagcaauuuuucuuuucuuauuuucuucucuaaaauuucaacauaagcauauaagucucuucuuauaauucaaaaaauuaaaaguuuuugaggaaagggaaaaacccaaucaccaaaauguagauaaaccaauacaaaccuuguuagauccagaauuuuuaccccuuccaauggcuuuauauuguucauaucuggcaaaacagagaaaacauuucaagauaauucauuaguaauuuucuuacauuuucacauacaccauuauaagcuugagacagaucacaaggacuacagugauucuuagcaagggaguccacagaccacaagacucuaguaaagaauacuggaagcucagccaggcacaguggcucacuccuguaucccagcacuuucggaggccgaggcaggcggaucaccugagaucaggaauucgagaccagccuggccaacauggugaaaccccaucuguaccaaaaauacaaaaauuagccaggcaugguggcacaugccuguaaucucaauuaucgggaggcugaggcaggagaaucacuugaacccaggaggcagagguugcagugaguugagaucaugccgcugcacuccagccugggcgacagagcaaggcucugucucgaaaaaaaaaaaaauacuggaagcucauacaguaggcauucuguccuugaaaugagccaauuuauuauuuuguaagaaauugcugucacaggccagguaugguggcucacgccuguaaucccaccacuuugggaggcggaggcggguggaucacuugaggucaggcaccugagaccagccuggccaacuugguaaaucccaucucuacuaacaauacaaaaaauagccaggcacugugggaugugcauguaauucuagcuacucgcugaggcaggaggauccuuugaacccgggaggcggaagcuguagcgagccgagaucgagccacugcacuccaccugagcgacacagcaagacaccgucucaaaaaaaaaaaaauuacuaucacaaucacagcaauagcaaauauuugaagugcgugugauuggugcauuauuuucuugacagcauacuuacauggaaaaccaaauuauaaucagaagguaaacugauaggcaaagcaucagaaaaagggaaguagcuaaaacaauguuuaaugugguaaauuguuacagcuauuuccccaaaaaucacaccuccagauauccacaaccucauacauucuccucccacguuggcacugggcuuggacaucugccuuguuuucgccaacaggauauuaggaaaguugaugccagcagaggcaggauaagugcuuacacacuggggcuugacuuuuuggaccacuuccaucuucaugugaagaagcacaagaugaaagaacacauggagagaaguucagcugagacuaucauugcagcagucccggcugaggcccauacaucuggaugaagccaucuuggaacacccaggccgagccaagccacuagcuauuugcagacacaugaauaaacccaggugaauccagcaaaagaacugcccaacuggccgggcaugguggcucacgccuguaaucccagcacuuugggaggccgaggcgggcagaucaccugaggucaggaguuccagaccagccuggccaacccugucuccacuaaaaaugcaaaauuagccagguauggugacgcacgccuguaaucccagcuacucgggaggcugaggcaggagaaucgcuugaacccaggaggcagauguugcaguaaucugagauggcgccauugcacuccagccugggcaacaaaagcaaaacugucuuaaaaaaaaaaaagaaagaaagaauugcccaaucaacccacagaacuuugagaaaaaaauaaagucuuguuuuaacgcacuaaguuuuggagugguuuguuauauggcaauagauuaauacaauggcuuacagcagagauaaccuguuauagcagugagaaugauccuuuuuuauguaaaacauaauauccuucccugcucaaaauccucuauggcuuccuacuaaacuuagaaugaaauccaacuucuuucugcagcucacaaaauccugcuuguuguggcccuugacacuuaaaaauaugauagaaggaaaaauauuauagaaaggcagaaagaucgagauaagaaaaucaccuacagagcagaacaaaaaaauaaaauaaaaguggaaaauggagaaaagguaagaaaaauaaaacaucaguccaggaaaccuaauaauaugagcuucuuuagugaacagcaaaaacagaaaagagaauauuaccaaagaaauaauucagaaaaaauugccuagaacugaaaggcauaaauuuccagauuggaaggucccucuacuggcccaguauaauggauuuuaaaaagacacagagcaagcacaccaagacaucauugugaaaaucuggaauacugacuucucugacaaaaggucuuaaacauuucuagggagaaaaaagcaggucagauauaaaguauugguuaucaggaggacauugaauuucucaacaaugcugaaagacaaaaaacuggagcaaaaaaaaaacccuuaaaauucugaggggagaaauucuuucucucuaaaauucuaaacccaauuaaagcacaagucaagugugaggguagaaaaaaauauauuuuuagucacacagguuuucaaaaacuaccucucaugcauccuuucucggaaaaauuacuuucaaagguaaucuagaaauuuagaaaauuacuuuauaagaaaaucauuccuccccaccugaauauaaggaagacucuagauccaacuuacaaauaagugacaggagcuauaggagacagaggacuauguucaaggacaccauauggaagcaggcagaaaaauccagaaugccugaaacacuguaggaaauggaaauguuuauuucuuuaaaaaauaaaaaggcaaggaaaaugcaagauguagaagaagaccccaaauuaaaugagacuuaagaaaagugucaaccaaccgcaguauaugagccucacuuagagccugauucaaacaaacuauuaaaaaucagauaaugguaggcaagguggcccaugccuguaauccccgcacuuugugaggccaaggcggaccuaucacuuaaggucaggaauucgaaaccagccuggccaauaauggugaaaccccaucucuacaaaaauacaaacauuuagcuggguguggcgaggagcaccaguugucccagcuacucaggaggcugagacaggauaaucucuugaacccaggaggcagagguugcagugagccgagauuacaccacugcacuccagccugggcaacacagggagacuccaucucaaaaauaaaauaaaauacaaaaagaauaaaauaaaacaaagcagaggggugaagugaaagcucaggaugacaacaaggaagauaccaacacaauagcugagagguuugcacuugcauugcgguaugggauaaauggaggauagauauugagaaggcaauuaaagaaacuggacaaauauuaacaaagagaaauaagaagguauacaugagcagcaauguaaucagaguaugaauaauaauuguacuauuucaaaaaauuuuuuaaacaaacguaauuuaacaguuuaauuuagcaaggaaaaaugauuugugaaaucggacaaccccuccccacccucccccaagucacagcagauuuagagggccgccagcgcugcuuguauagugggcgcagugggagagaacuuauggauagaaaaaggaaagugaugugcagggagcagaagcaagguauagaaacagcuagugccuuaucagaacacgaucugaauagcugguggcuuaagucuuugagguccagcugcugggacuggcugagagucagcaacuguuauugaagcauaccccuaaguuagguuuucaguuugcuuaccuacuaaauuagguuguggguuguagguaaaaacucaaguaugugaguauggaggcuuucuuaggccagauuuuaguuugaugaaacaauauaauaacaaccuaaauacugaauagugaucuaacaaaauguauaauuuggaaggauggaaagggcaugcauauuuguucaaaugguagugaaagaaagcuagucuuuuuuuuuuuuuuuuuuuggagacggagucucacucugucucccaggcuugcgaucuuggcucacugcaaucuccgcuucccagguucaagugauucuccugccucagccucccaaguagcugggauuacaggcaccugccaccaggcccaguuaauuuuuguauuuuuaguagagacgggguuucgccauguuggccaggcuggucucaaacuccugaccucaggugauccacccaccucgaccucucaaagugcugggauuacaggcaugaggcaccgugccuggccugaaauuuagucuuuaucucuaccgauagugccuuaaaaaaaaaacaaaauaaucaauaacauuauaaucagguuauuuagcaauuuggcagaaaaaaaaggcaaaaagaauugaaauuuguuaucucugggcaaagggaaggggcagaaaggcauaagggguuacucuucuucauaauuaacacugcagaacuucugaaguuuuaaaaccaaguauaccuaaaacuuugauuuuaaaaauuaaaagauaaauuauaaauuauacuacauuugugaacaagagugaaguaucauucuguguaucuccugcuauacagcccccugcaguguuuugauaaauauuuccacuaugaagcuuuuacugacucauuguacacauggcagcagcaccacagaggaauuacaguuaauacucagauucuguauuugggaauuugacuacucacuaaauuuuuuuuuuuuuucuuuugagauggagucuugcucugucacccaggcuggagugaucucagcucacugcaaccuccaccucccggguucaagugauucuccugccucagccucccaaguagcuaagauuacaggcaugugccaccaugucccgcuguuuuuuguacuuuuaguagagacgggguuucgccauguuggccaggcugaucuccaacgccucaucucaggugauccauccaccucagccucccacagugcuggcauuaccggcaugagccagccaccacgcccagccuacucacuaaaauuuauuuguaaccccaaaaucaauacauguggagcuuucacggucauucccagacaugcacagaugcaggaaaauuugaguaggucauugugcauguucccagcugagguugaacaaggugauacuuguuucaccucucauacuauaaacaaguguccucuugcaguauauuuaauguuacguuuuuaacauuuuugugcuuuuuguuggugaucucacuguuuauggcccagaagcauagugcugucuaguguucccaagcauaagaaggccaugaugugccuuauggagaaaauacauuguuagauaagcuucauucaggcaugaguuauagugcugcagaucaugaguucaauguuaaugaaucaauaggguguuaaugaaaucaauaaguugucuuuaaaaagaaacacaguccaggugcggugauucacaccuguaaucccagcacuuugggaggaggaggcaggcggaucacuuaaggucaggagucagagaccagccuggccagcauggcgaaacccugucucuacugaaaauacaaaaagcagcugggcauguuggugcauaccuguaaucccagcuacuaggggggcugaggcaggagaaucgcuugaacccgggaggcagaggcugcagugagccgagauugcaccacuacacuccagccugggagacagagugagacucugucucgaaaaaaaaaaaaauuuaaacgcacuacagugaaagauaccaugaacacaauuagaagauaaaugacagcccgaaaggcuaaaaaauaaagaagaaagguuuuuaaguauaaagaacucucacauaucaguaagaaagaaacacagcguaauggaaaagugggaaaagaacaugagcaaccaacucacaaauaaauaaaaaucuccaguaucauagcaaaagauguucauagcaauuccacuuaaaauaaaaaagaugaauauuaucacaauaaaauuuuuuuucucaccacauuggaaaacauuuaaaagauaacuauucaauacucgcaaaaguggggugaaauggacacuuucauacauuguggaauaucaaucaguaacaaucuuuuaggagagcaauugacacuuuccauaauauuuuaaaaucuuaauagccuuuaauuaaguuuuccuguuggcagaauugaauucacaggaacauucuauaaguaugcuaagacauagguauaaaaauguucauggcagaaauuuuguuuuuucugcuguacuuuagauguuuuauaaucaacuuuauucauuuauuuauguuuugagagacaaggucugggcuuuguugcccaggcuagggugcaguggcaggaacauacauaguucacuguaaccucgaccuucugggcucaagcaauccucucaccugagccugcuaaguagcugaggcuacaggcaugagccacugcauccagcaccuaauuaacuuuauugaagaaugacuuacauauaauaacacuauauauaauaaauuauaauauucuuagccaggugugguggcaugcuuguggcccuaccuacuugagaagcugagaucgggaaauaacaugagcccaggaguucaagguuacagagagccaugaugggccaggugugcuggcucacgccuguaauccgagcacucugggaggccgaggugagaggaucaccugaggucaggaguucaagaccagccuggccaacauggcaaaaccccgucucuauuaaaaauacaaaaauuagccaggcaugguggcgcacaccuguaaucccagcuacuugaaaggcugaggcaggagaauugcuccaacccaggaagcagagguugcagugagccaagaucaugccacugcacuccagccugggggacagagugagacuccaucucaaaaaacaaaacaaaaaaaauacagugagccaugaucacaccacugcauucuagccugagcaacagagcaagacccuguuucuaagaaaaauacacacacacacacacacacacacacacacacacaggauauacauuauauaaauaaauuauguuauacaaauaacuauauauaauacauuauauauaauuuauaugauauacuauauauuauuucuauaaauacaauaaauuguacaauuaaauaaauuuugacagauguauacaccugugaaauugagagacaggacuagcuggauuuccuaguccaacuaagaauuccuaagacuagcugggaaggugaccacacccaccuuuaaacacggggcuuuuaacucaacucacauccaaccaaucagguaguaaagagggcucacuaaaauacaauuagguuaaaagcaggagguaaagaaauagacaaaucauauaucaccugaaagcacaggguaagggacaaugggauauaaaccccaggcauuugagccgggagugggcaacccccuuuggguccccucccauuguaugggagcucuguuuucacucuauuaaaucuugcaacugcacacucuucugguccguguuuguuauggcucaagcugagcuuucgcuugcuguccaccacugcuguuugcugcugucgcagacccgccgcugacuuccaccccuccggaucuggcaggguguccgcuguguuucugauccagugaggcacccauugcugcucucaauugggcuacaggcucgccauuguuccugcauagcuaagugccuagguuuguccuaaucgagcugaacacuagucacuggguuccacgguucucuuccgugacccacggcuucuaacagagguguaacacucacugcauggcccuagguuccauuccuuggaauaugugaagccaagaaccccaggucaaagaauaaaagacuugccgccaucuugggagcagccugccaccauaucaugggagcucuaagaacaaagacccacccguaacauuugguggccucgucuggggauucuccaaagcugugaguaauauuggaccacuuucacuugcuauucucuccuauccuuccuuagaaucagaggaaauaccaggcaccuguuggccaguuaaaaacgauuagcauggcugcuggacuuaacacucaggugugaggcuuccugggaaaaggcuuucuaacaacccccaacccuucugguugggagcgauggucugccuggaaccagcuucugcuuucacaauuuuccuggggaagcugagggcugacuagagacagaaaggugucaucccaaacucccagcauuggccggucgagaucauggugcagccagaagucuuuacucaacaguugcccaugcgugcgccccuacaucuccuucugacccauacguccuggguccugaucaugacuuuuuuaaaguguagccucaaaauucuccuuaccucugaaucuauuuccucugaucccugccuccuagguacuaaugcuucagacuuucacuuccucucccaaguauuagagaagcuuguaucuccaaagggaucuaaggaagcgcuacgcuguguccuuaggcaucuaggcuaugaacccagggagucuugucccuggugccccucccaauauauagcucuugacaugggcaguuaugugggacccguuucccaccacccuugccaggaccccaaguuuguaaauggcuaggauuccucucccauuguguaagaugcucuccucccccaauuucuacccagcuucccccacugcaauacaaucuccaagccucggcuccuuggccagggccuuagaacugaugacccaguacuuuaacaacuggaacugggucuaugacaacauaauagaucaggaugaaagcgaauugaguaaauuaaagggaggcacacauuccuauaguggcaaaugggggcaacaagcuaacguccuuccaccguguucccaaaauccaucuaccaaaagagagagagggaaagagagaaaagggaaagagagagagaggaaaagagagaaagagagauacacaaguaguuaaagaaaaaacaguauauacccuauuccuuuaaaagccaggguaaauuuaaaaccuacaauugauaauugaagaucuucuccgugacucuauaacacuccaauacuaccuuguugucaguguaaacaagggcguagccugaaaacacugagaccacugacaacacauaccuagccuuccuaucaaaaauucuuaauccacuaaccugcggauggcccaaaugcauucaaucaguaauggcaacugcuuugcuuagcagcaguagaaaaguaacguuuagaggaaaccucauugugagcacaccucaccagcucagaauuauccuaauucaaaaaaagcaaaaacguagcuuacuaacucaaaagucuaaaaguauagagcuauucuguuagaaaaaggugauuuaacacuaaccacugaaaauucccuuaacccagcagauuuccuaacaggggauuuaaaucuuaauuaccauacaaagguccaaccagaccuaggaggaacuccauucaggacaagaagguagaugguuccuccagggugacugagggaaaaaacacaauggguaugcaguaauugauagggaaacacuuguaaaagcgaguuaggaaaauuggucugcucaaacaugugagcuguuuacacucaggcaagccuuacaguacuuacaaaaaaagcaaacccaucuuuuucuccuugcucuucuucucguaggaaaaaggcacauaggauaaacaggauucaucucucauauuucuuacccaaaaggacuuaaucuggggcaagaaaaaguuuaaggucgauaauuagggcacauuccuacaaaggaaagaaggacaaaggcccuagugggcaaaaacucuaucucaauccuaacccaaaagguuaccuacacccucucugaaauaaauuugcauaagaacuguugcaucuugauggggcagcuggguuguuaugaaauauucaggaacccagcccaacucuagaacucaccccugagcgcaaaggcaaugucggguaugcugguaaaggaccacuagaauccagcagccccaaccccuuucucuguggucaagagaggcaggaaaagaggugcaggacugcuacaucaguaagcguuaacuauuccgauaagcagagguccaugggugguuaugcacccuggaaaggaacucaccucugagugcaaaggcaauguugggcaagcuguuaaaggaccacuagacuccagcaacccauaccccuuucuuugugguuaagaaaggugggaaaacaggugcaggacugcuacaucggugagcguaacuaauccgauaagcagagguccaugggugguuaugcacccuggaaaggaauaagcauuaggaccauagaggacacucuaggacuaaugcucauuggaaaaugacuagaggcacuggcaucccuauguucuuuuuucagauagaaaauguucccccuaaggcaaaaaugacccuaagauguauucuggagaauucagcccagucagaguguauguacuuuucucccugucagacuugaagcaaauuaaaauagaccuagguaaauucucagauaacccugauggcuauauugauguuuuauaaggguuaggacaauccuuugaucugacauggagagauauaauguuauugcuagaucagacacuaaccccaaaugagagaagugccgccguaacugcagcccgagagucuggcgaucucugguaucucagucaggucaaugauaggaugacaacagaggaaagagaauuauuccccacaggccagcaggcaguucccacuguagacccucauugggacacagaaucagaacauggagauuggugccacagacauuugcuaacuugcaugccagaaggacuaaggaaaauuaggaagaagccuauaaauuauucaaugauguccacuauaacacaaggaaaagaagagagacugccuuucuggagagacuaagggaggcauugaggaagcauagcucucugucaccugacucuauugaaggucaacuaaucuuaaaggauaaguuuaucacucagucaguugcagacauuaggaaaaaacuucagaaguccacguuaggcccggagcaaaacuuagaaacccuauugaacuuggcaaccucaguuuuuauaauagagaucaggaggagcaggcagaaugggacaaaugggauaaaaaaaaaaaaggccaccacuuaguuguggcccucaggcaaacggacuuuggaggcuuuggaaaagcgaaaggcugggcaaaucaaaugccuaauagggcuugcuuccagugcaguccacaaggacauuuuaaaaaagauuguccgaauagaaauaagccuccccuucguccaugucuauuaugucaagggaaucacuggaaggcccacugcccuaggggacaguccugagucagaagccacuaaccagaugauccagcagcaggacugagggugcccagggcaagugccagccuaugccaucacccucacagagccccagguaugcuugaccauuaauggccaggaaguuaacugucuccuggacacuggcacauucuucucagucuuacucuccugucccggacaacuguccuccagaucugucacuauccuagggguccuaggacaggcagucacuagauacuucucccagccacuaaguugugacuggggaacuuuacucuuuucacauggcuuucuaauuaugccugaaagccccacuuuguuagggagagacauccuagcaaaagcaggggccauuuuacacuauaauuaggagaaggaaaaaggguaaauauauauacagacucuaagugugcuuaccuaguccuccaugcccacacagcaauauggagagaaagggaauuccuaacuuccgagggaacaccuaucaaauaucaggaagccauuaggagauuauuauuggcuguacagaaaccuaaagaggugguagucuuacacugcuggggucaucagaaaggaaagaaaagggaaauagaagggaaccaccaagcagauaccgaagccaaaagauccgcaaggcgggaccauccauuagaaaugcuuauagaaggaccccuagaguaugggguaauccccuccaggaaaccaagccccaguacucggcagaagaaauagaauggggaaucucaagagaaaauaguuuccuccccucaggauggcuagccgccgaagaaggaaaaauacuuuugccugcagcuaaccaauggaaauuacuuaaaacccuucaccaaaccuuucacuuaggcauugauagcacccaucagauggccaaaucauuauuuacuggaccaggccuuuuaaaaacugucaagcagauagucagggccugugaagugugcugaagaaauaauccccugcacuuugcacugcaggccauacauuucaaucccuguaucuuuaaccuccuuguuaaguuuaucucuuccagaauagaagcugugaagcuguaaaacuacaaauuguucuucaaauagagccccagaugcaguucaugacuaagaucuaccacggaccccuggaccagccugcuagcacaugcuaugauguugaugacaccgaaggcaccccuccugaggaaaucucaacugcaugaccccuacuacgccccaauucagcaggaagcaguuagaguggucauuggccaaccuccccuacagcacuuggguuuuccuguugggggguacugagagacaggacuagcuggauuuccuaguccaacuaagaauuccuaagacuagcugggaaggugaccacacccaccuuuaaacacggggcuucuaacucagcucacauccaaccaaucagguaguaaagagggcucacuaaaauacaaauuaggcuaaaagcaggagguaaagaaauaagucaaaucauauaucgccugagagcacaggggaagggacaaugauugggauauaaaccccaggcauuugagccgggagugggcaacccccuuuggguccccucccauuguaugagagcucuguuuucacucuauuaaaucuugcaacugcacacucuucugguccgugauuuuuauagcucaaacugagcuuuggcucacucuccaccacugcuguuugcugcugucgcagacccgccgcugacuuccaccccuccagaucuggcaggguguccgcuguguuucugauccagugaggcacccauugccgcucucgacugggcuaaaggcucaccauuguuccugcauugcuaagugcccagguucauccuaaucaagcugaacauuagucacuggguuccacaguucucuuccgugacccacagcuuauaauagagguauaacacucacugcauggcccuagguuccauuccuuggaauccgugaggucaagaaccccaggucagagaacaaaaggcuugccgccaucuugggagcagcccacuccaucuuaggagcagccugccaccaucuugggagcucuaagaacaaagacccaccuguaacaaaaucaccuccacaaucaagaaagagaacuuucuagcaccuaaaacuuuccaccugcccuuugcaaacuaccucuuccucaauuuccagcuucagacauccacugaucugcuuucugucacuauaauuuaauuuucauuaucuagaauuuuauauaaaugaaaaacaguauguauuuuugugucuggcuucucucuuuaagcauaaugauucugaguuucaucacauuguugcauuuuuaugaguacacucuacuguauggauauaccacauuuguuuauacauucagcuguugacggacacugaauugguuuuuaggcuacagugaaucaagaugcugugaacauuuguguacaaaucuuugugagaacaugucuucauuucucuuguguaaauacuuagcggaauggcugaguuauaugguaagugcauguauagcuuuuuaagaaacugucuaaacagauuucuaaaaugcuuauaccacacuguauaagaguuccauauguuccauaucuuugaaagauaggaauuguucuuuuuuuuuuuuuuuuugagguggagucucacucugucacccaggcuggagugcaguggcgcaaucucggcucacugcaaccuccaccuccuggguucaagcaauucuucugccucagccucccaaguagcuggaauuacaggcacccaccaccaugccugacuaauuuuuguauuuuuaguggagacaggguuucaucauguaggcuaggcugcucucaaacuccugaccucaggugaucugccugccucagccucccaaaaugcugggauuacaggugggagccaccaugcccagccauggaauuguuuauuuuuuaauguuagcuguuugaaugggcguauaaagguuucuuguugggguuuuaauuugcaucucacucaugacuaaugauguugaauaucauuucauguaaauaguuggccauuuaaugaaacaaaaacuuguaaauugaauucauuuaauaucagguaauggaauuuuauuaucugauaagacacucagaaaggacuucuagaguauauuuaagucaaaaugaaugagugaguuuuaaaucauuaaaagucagacugccuggauucgacucccugcucuacuauauaagagcucagugacauugcaugagguaacuccacuucucaaagcuucccuuuccucaucugaagcaccugucucauggaguuugcaaguuuuaaaugaaauguuguauauaaaguguuuaguauacccccagcauaaaguaaaugccacuaaaagcugcaauuguuauuuuuauuuuuuuaaagauggagucuagcucugucacccaggcuggagugcagaggcacaaucucggcucccugcaaccuccaccucccggguucaagugauucuccugccucagccuccugaguagcugggauuacaggcgugugccaccacauccagcaaauuuuuauauauuuuuuguagagaugggguuucaccauauuggccaggcuggucuuuaauuccugaucuuaagugauccaccagccucggccucccaaaguucugcggucauaggcaugagccacccaccacaccuggccugcaauuguuaugauuaucaucauuaucauauauguauuauacagucacaugaucuauuacagcaaauaacuucuuguuugaaaacaagaaaagauaaacauaugauuauucuaaggaacaggaaaaaaaucacuucuuaaugcgcuauacuuaaaaaguauaucuagagucaaauuuugcauauuucugaaagaacugaugggcugggugggaguaggggaugauuacaaggcaugaaacaguuggaaaaggcauaaauuguaauguaauuuguugaaauauauugagcagcuuguauaucucucugucuuuuuggccucuaguauggaaagcuauuaugaugauacagcuggucaaccaugcaaagaaguauaauuauaaugaagcugccaucaauucuaugcuugccaaagcugcuugguaggacuccccugguacuuggcccugggguuuagacgacacaaauaaacuugagcaacaccagagcagggauaauugacagaugcccacacaagugguucaucugugugacaggaaucauggcaucccuucccacccauacuagccaacuauugagauuaaaaaaaaauucuuaaaggccaagucacaaaacaaacugcucaaauagcaauaugaaacagaaaccugugauauacaccaaaauaauuuuuuaauuugaugauuuacagagaauuuaaccaccagaccuuaugcaugaggaggcagaaaaugggccucucuucaaagcaugcucucuuaaucugcugaagcuuuaucuauaauaguuagcaugauguuuccuuuccagcaugugucugaagucacagaagaagcucuguuccuaacaaccuaguuugauaggaaauuuuaggaguggaggguaccuggaaaauuaguauccacuggaagacauuccagggaaauaauaauuugggagucagcaggcaauaauuguuuucaauuucuagguucaugggaaauaagaaaugagguucguggaaaaggagaguaaaagaucuucauggacucaaggaggcuucaauucuguucaucauggaaauucaugaguauguauugacggauuaauuauugucucaucaucauccacuuuauuccucuuuaacacaaucacucacaaaagaaucacaucgagaugauaauuuuuaauuagauuucuuuuucugaaaucucuggaggcagaggggacaugaauuuucagcaucaaauguuuaugcauaauaaaaaacaaaauaggaauucaccuuccaauucaacuaauuaauauuaauuuucugaagccucuguuacauuaauaaaguaaauacagagacacaacaaaaacagaaaaaaaaauccucaacuuuugcaauuaauuuccauguuuucucuuuacauaaacaauucaggccgggcgcaguggcucaugccuguaaucccagcacuuugggaggccaaggcaggcagaucacaaggucagcaguuugagaccagcuuggccaauauggugaaaccucaucucuacuaaaaauacaaaaaaauuagcugggcaugguggaaggugccuguagucccugcuacuugggaggcugaggcaggagaaucgcuugaacccaggaggagaagguugcaguaagcaagccaauauugcgccacugcacuccagucugcaugacagaacgagacuccgucucaaaaaaaaaaaaaaaagucaagggucaggcaugguggcucacgccuauaaucccaggacuuuggggggccgagguggacagaucgccugaggccaggaguucgagaccauccuggccaacuagugaaaccccaucucuacuaaaauacaaaaauuaacugggugugguggugcaugccugcagucccagcuaucugggagacugaggcagaagaauugcucaaacccaggacguggagacugcagugagcugagaucaugccacugcccuucagucugggugacagagcuagacucugucuaaaaaaaaaaaaaaaauucaauucaaaaaauuaagaaaauagagcuaaagaaaauugacaaaauugaaaucacucauuuuuucgucacuuaaagguaauaauugguaguguuuuggguauaaauccuuucagagauagacaaguggguggcugcauacacagaugcaccauuuuuguucaaaaaaacuaaucugugcuagauauuauauaauaaccugcuuuuuuuuuuuuuuucugagacagagucucgcucuaucacccaggcuggagugcaguggcgcgaucucagcucacugcauccuccgccuccacaguucaaguguuucuccugccucagccucccgaguagcugggacuacaggugcgcgccaccacgcccggcuaauuuuuuguauuuguaguagagaugggguuucaccguguuagccaggauggucuugaucuccugaccuuguaaucugcccaccucgaccucccaaagugcugggauuacaggugugagcaacuaugcccagccaacacuacuuuuuuaauaaaagcuugagaaauuugcagauaguacaaaaaggccagaaaaagaacuuuugaaucaugguuaaagcaugucacaaucaaaguacaacucagugcuaaucccaaaucucacugcucuuccacauuuuccagcuucucuugcaauuauguuggagucaaaugacuucgaucuugccagugaaacacaggcaaaaauaauaaaagccauuuccaacucugaccuuuaaaaacaccccaugaaauccuccaggccucuacucuccuuagagcccacaaauuucaaauaguguagcuacacauguaagauguuuuuauuguauugagcaacugagauugggcuaauuuguacugcagcacaaccccgccaguccugcccaauaaagaugccaggcaucagaggcagcaugaguucugaaugaguuaccaccaucaacaacuaggaugucuauuucaggguagacuguuucacuguccuuuuaguggcaaucuucaaauuggaauaugugaagaauucccuaagggcugggcgaggugacucacaucuguaaucccaacauuuggaaggccaaggugggagugucacuugagcccuggaguuugagaccaaccagcacaacauagcaagaugccaucuuugccaaauaaaaauaaaaaguaaaaaagucagcugggaaugauggugcaugccuguggucccagcuacucaggaggcugacguggaaggaucacuugagcccagcaggucaaggcugcaaugagcuaugauggcaucacugcacuccagccugggcaacagaggaagacccugucuaacaaaaaaggaaaauacuugccuaagggaugcaugaaucauuucaguaaaucaauuuccagaucuucaacuuccauagguauucuuuccuacaauugaucaaccuguaaguaagccuucuuucacaauaagccuucuccuacaaggcaaaggaaagcagauuccuaacauaucccagaucuuauucucaccuugguuuacaguauaaaauuuacauaagcgaugacaacuuuaaaauaucaacuuaaaauaugcaaauaauuccuuuucaaaucauuuaggauuugaaaaucacuucacggccgggcgcgguagcucaugccuguaaucccagagcuuugggaggccgaggcgggcggaucacgaggucaggagaucgagaccauccugcccaacauggugaaaccccgucucuacuaaaaauacaaaaaauuagcugggcauaguggugggcgccuguaaucccagcuacuugggaggcugaggcaggagaauggcuugaacccgggaggcggagguugcaaugagccaagaucgcaccacugcacuccagccuggugacagagcaagagucugucucaaaaaaauaaaaaagaaaaucaccucaaauugguauguggaaggguacaaaaugguaccaauuuauagauuuuauaaaucaaccuacaguuauagaaugcacaaccaaaagucaacaagucaaaggaaaaaacuuagguguucaggcuucuuuaacgggccauccugaaguuagcuguccagaggauuagaagggauugaaccagaaacuggaggggaaaugaucacugcaaauuacuauucaauauaagaaugcucacaaacccaaaagaucccuggaauuucucaacauuggugacgugauucuccuacggagaagacugaccaaaaggaagacuuuagugcaaacaagaaaaaugcaucccauccaggggaaaacuggcaaaguagugaccauucuagguugguugaucaaacaacuucauagguacuuaaggagaauuauaauugucacagcaaaaaaaauaugcaugggguggaugaagacaguggaguguugcaguguuaagagugugaauacaaagagccucuugacacaaaaaaauauagagagagcccauuccauggaauaguuuagauauuuaacacggaggaauagaagggaaaggaagaggcagcuuggaagaaacgugggggcgauacauaugugagagauuuguuuuaugauuugauuuuguuuuuaacagcuuccagugagcaacucugaagagcaagagaaaugucuggagagaaguuuagaaauuucuaugugcuggacuaagguauccucccagagacuucucuucagguaguaaagguaaaaauuagucuuuagugcuuucagaguuuuuggagauagagaaggggaagcaaagaacuugcuuccaaagacagagguaggcuuuaaaguggccuagccauauucauguuaugaauuccuuaauacucuuaauacauauuaucaaaccguccaccaaaaaggguauauauaauauuauauauauguguguguguguauauaucaguaugcuaugaaaaucauguucucuaucaucuuccauaacccuaaacauaaucuccuggguuuguggaguuuuuguuuguuugcugcaaccuaacaguuaaaaauuugcaugucacuauuauuuuaauuuguacuuauuuaaugacuucugaaauugaacaucuuuuaaaucugcucuuuuuauaucuucucuuauaaauuauucuugauguugguccauauuucuacaugcacauuuaucuuuuucuuauagguuuauaugaauuauacauacacuaagaauauuaaucuuuuaucagucauauuuaguaaaaguaauuuuucccuaucugcucuucacuuuucaaagguguuuuaagauuucauguuuuaaaaaaaucauuucaucugggcaugguggcucacgccuguaaucccagcacuuuagaaagccaaggaggguggaucaccugaggucaggagcuugagaccagccugaccaacauggugaaacuccgucucuacuaaaaacacaaaaauuagccgggcaugguggcguaugccuguaaucccagcuacuugggaggcugaggcagaagaaucgcuugaacccgggagcaagagguugcagugagccgagaucauaccacugcacuccauccugggcgacaaagcgggucuccaucucaaaaaaaaagaaaaaaauuauuuuaugguuucugccuuuggaauuguuucaggguuucccaagaccacccauauuuucagugauuugcuaggaggauccacaggaccuaaccaucugguuguauacagagcuaagguuuacuacagcaaaaugacauaugacaggaccaacaagaggaaaagacacagguagagauggaaaaaauucaugccaugcagaggcugcuuauguucuuuugcucucauggaaggccauaucaagcaugcuucuuucuccagcaacaacaaaaaauagauauagaaacacacaaaguuucugcccagggaaacccauuagagacucagaaccuagguuuucacugaagacuauuuacauaggcacucucugcauaccauguagcacaauuccagacucccucccagaagaaagguagguguuuaccauuguugaggcacagaagccacacccaaaauguaggcaucacagcagccucagaagccaaaguuuuucucugaccuccugccuuccuaucucucagucccaugcuccucugaggauagcuauaaaaacuagaauccggccaggcacgguggcucacaccuguaauuccagcacuuugggaggccgaggugggcagauaacaaggucaggagaucgagaccauccuggccaacauggugaauccucgucucuacuaaaauaagaaaaauuagccaggcgugguggugcgugccuguagucccagcuacucaggaggcugaggcaggggaaucgcuugaacccaggaggcagagauuguagugagccgauaucauaucacugcacuccagccuggcaacacagcgagacucagucucaaaacaaacaaacaacgacaacaauuaaaaaaaacuagaaucccucuucccuaagaagggucacagaaaccagaccucuuuucgccaaugccagccacaaaaccuaaaaauacuacuccaauugucucucugccacaucuguguaaaaaccggacauaaagaaauuaucuggccaggcgugguggcucacaccuauaaucccagcacuuugggaugccaaggcaggcggaucacuugagcacaggaauuggagaccggccucagcaauaugaggaaacccugucucuauaaaaaaaauacaaaaaaauuagucaagccugguggcacaugccuguaaucccagcuacucagcaggcugagguaggaggaucacuugagccagugaggucaaggcugcaaugagcugugaucaugccacugcacuucauccuaggcaauagagccagacccugucucaagaaauacaauuuuaaaaagagaucucuauuuuuccuugcuuucuguuuuccuaaauauuucacauuuuuugcaaaauguauccaucauuuuaacaauugaaaaaauacaaauauguaaaugcuagggacauaaaaauuuuauuuacucauuuuauuuauuuauuuuacuuauuuauuuauuugagacagacucucacucuguuacccaggcuggagugaaguggcacaaucucagcucacugcaaccucugccccccggguucaagcaauucuccugucucagccucccgaguaguucggccuacaggcacaugccaccacgcccggcuaauuuuuguauuuuuaguagagauggguuucacuacauuggucaggcuggucuugaacuucugaccucaggugaucugccugccucggccucccaaagugcugggauuacaggcgugagccaccacacucagccauauuuacucauuuuuaaauaaacuuuuagucuuguaucuagaaaacaauauuccuacucuaugucucuucauauagaaauaaucugucagcaauuuuauuauuuucagugaaaaacuuuuauaagcauaacuuaaugcauuaauaccuguguuacacuugggugaggaauauuagucuacaaagaaguaaauauguauaaaacauuucucuugugcuugacuaccuugcauaauuggaaaugaaaauaucacauuuuuuuuuuuuggauacagagucuugcucugucacccaggcuggagugcagugguacgcucucggcucacugcaaccuccaccucccggguucaaucuccugccucagccuccugaguagcugggauuacagacacgcacaaccauaccuggcuaauuuuuguauuuuuaauaaagacgggauuccaccauguuggccaggcuggucuugaacucuugaccucgugaucugccugccucagccucccaaagugcuggcauuacaggcgugagcaacugugccuggccccaaaauaccacauuuuaaugaagcaguagaauuugacucucggaaacccuuuaaaacaagccacuucuaauucucccuuuaucaaugagaucauuauuuaagugacaguuaagcaaucuacuguguucagugcaggucuaacccuaucaacgagugagcuaaucacauccuacagaagcauuuacuuuuccacuauuaguagccuuuaacaugaaacagcuaacaauaagcaccucuauaaggaaaacugauauaaucugaaaaguuuuaggaauacuaagguaaagcuuaaaccugaaguauacauacaaucauuucuguacagagaaauuauuaaguauauucuccuaagaaguauuuuacauuaaaaauauuuaaguuuuuaaucucuauauugauucauucuuguaaccugaaaguaaacacaaaguuucuggagcagagaucagaguuauuauuacuuaagucaagacauacaucauuuucccauaccuaauaccccauagacaaugcaaugaaaacccauugauagguaaggguugaaccacaggagaagaaucccaaaauuuugaaucuguagguuuguacaggauaacugcccagcugccgccuucgccugagaaagugaaagaaagcaaucuaccuaugguaagcaaauucugcuugggaagaaaaggggaagaucccugggaucuuacccuuuggaacauaaauaaaugucuccaggagaagguaagauaagcguuacuggguuuacgaucuugggaaugccuccaacacucuggguuuuauaucccuuaagucaucuuuuaacuuccaaggcuugucuuuuaacccagguucuacuuuucuaugcucagaaagcccugaccaugcagaaacaugaaaauauuuaccuuuuuuuuuuuuuuuugagacagucuugcucugucacccaggcugaaguacaguggugccaucucggcucacugcaagcucugccucccgaguucaagcgauucucguaccucagccucugaguagcuggguuuacagaugugugccaacacgcccggcuaauuucuguauuuuuaguagagacggggguuucaccacguuggccaggcuggucucgaacuccugaccucaaguaaaccaccauguccagccaauauuuacuucuuaauaacacauagugaaacuaaccaacaauuucuauuuguagcacugguuaauaccugacaucuaccuaaaauaguggcuuucaaacccuuucugcagagccuugggaauuccucagaggugccaccaggagccaccaccucagagguggugaagggguaggaggguaguuaaaauaggaguacagagugagcagggcucugggacuccaauuccuccuuugaauacagcccauuugcucauauauugggcuuccaaguguaguuuuuuaagacaaggcacuaaaaaucuucuauuucuuugaggcagagucucacucugucgcccaggcuggagugcaguagcgugaucucgguucacugcaagcuccaccucccggguucacgccauucuccugccucagccuccugaguagcugcgacuacaggugcccuucaccacgccgggcuaauuuuuuguauuuuuaguagagacgggguuucacuguguuagccaggaugcucucgaucuccugaccucgugauccgccuaccuuggccuuccaaaguucugggauuauaggugugagccaccacgcccagucagcacuaaaaaucuuagguauccuagaccaggcacaguggcucacaccuguaaucccaacacuuugguaggcugaggcagguggaucacuucaggucaggaguucgagaccagccuggccaacauggugaaaccccgucccuacuaaaaacacaaaaauuagccgggcaugguggcguacaccugugaucccagauacucagaagcugaggcaggagaauggcuugaaccccggagguggagguugcagugagccaggauugugccgcugcacucuagccugggcuacagagggagacucuaucucaaaaaaaaaaaaaaaaaaaaucuuagguauccuaaguaaaaauccucagccucacagaaauagacaaggucccauuuacauuuauacuuaaauuuucuugucuuguuacccuuacuugcauuaaagcagaacuucuaaacacacaccaccacaucauuaauaaccaauuauuaacaauaauaaccaauuauuuauggggcuccccaagaggcuugggugcucaaauguuccuugaugguuuuuuugucugaugaugucuucuguauacaaugucacuugaagauagccccuagccacuggaagcauauuuccuaaaagcacugccuuauccaggaucuugucuucuaauguugggccuccuucaacagugcuacaaggaucuuuuugugggaaccauaccuauguugcucacaaaaacgagcaguguccuuuucccuuagcucagaggacagccaccauaagcucacaugcaucaucccaguucuucauuuguccuuuuuuuuuuuuucacuggaagaaaacauuucuuuuaauuugcuuugugggucccacaccucaaauaccaaugugucugcuauuuuuuuuuuuuuugagauggggucucgcccuguugcccaggcuggagugcaguggcgcaaucuuggcucacugcaaccuccgccucccagguucaagugauucuccugucucagccucccaaguagcuggaauuacaggcaugcgccacuacacccagcuaauuuuuuuauuuuuaguagagacgggguuucccauguuggcgaggcuggucuccaacuccugaccucaggugaucacccaccucggccucccaaaguuaugggauuacaggcgugagccaccacgcccugccucugcuguuuacaaauaguaaugcucuaugcuacuacuaacaguauuuuugcaaucccuuugauaaauccuaguccucuauuuuaguucugaauaacagaugcauauuaaucugaauaacagaugugcauuuuaauuuuuaaggcagaugguaaacuuuccuauaggacuugugagauuucaucuuauggggcaaacauuguucacaaaaugcaauacuucacuucuagaguuaaagaauuugagcaacugaauagcacagauacgcaggcaaugaaauguggccuaagauguaauuauguucucugccuuuccuuuaggccagaguagcuuuccgcuuggcaaaauagaaaacaggccguaaagccugaaaauaggucagguguuguggcucacaccuguaaucccaaaacuuugggaggauugcuugagcccaggaguucaagaccagccugggcaacauggugagaccccuaucucuacaaaaaacuauaauauuaaaaaaaaaguuuuaagccugaaaauaaaacguucuacacccaaaucucagagcguuuuacuaggcuuuucacuaggcaucuuuaaaagcauuuuaagcaaaauacuaauugcccaaaacacaaaacagugccaaggaaaagcucugcuuucucauaagacuuuuucaaucccauuacauuacauuacauucacaucuuuugccaacuagagugaagagcucugaacagguuuaaagagugcacacugcacuuuuuuaaauacuauuuugcucucaaagcaaguucuucaugcugacauuuccaguguugggaaguacgaguacuauuaguuagcuucaaucuuugcauuaccagagcuccuguuucuccaucuuguucugaaggaugaacaaaagcuugagguguacauuucaaaauauaaacugcagcacaaagacccccaauguucacccgaacuguauccacuuuucaccauacacaucacaugccagauaaugcuuugguaaagcauuucgcguccugaguacaucguacagcuuggccuguuguagguguacacagacgcaacucaucucccauaggcaagguggaugaagguuccaguuucucuucuuggaucccaucuuuuuuccaaauggcaaaucugccacaauaauauccacagagccaguucuuaauggcauauugcauuuaucccauugaacagcaucuaugggcaaggaugguuagccuucuuuaauuuggcucuuggucaauaaagaugugauguuguuugcugcucuauucacaaccagaggauuauuaucaccagaauauaacgugaaaacauuaaguaguccccucuauugguauugccccuguuccacacauuggaucgacuauuauaacauaagguagcagaccacagaggcugaguaucccagggguaagaguugauagguccaaaaugugcccauagguccaaaauguugauagguacaaaagagucauagguccaaaaugugugauacgucuucaguggagacucgcuuuagucaaugccaugcccacagugauuucauuaucauggauauucaaaagaaucgcaacaucaaauuggucaugucggccuuccacuuaaaauagccuuaaacaucacccccagaaucucuuccagucucauuugagggaaagcaguauuucucuccuacucuguugcacaugacucuaaacuuuacacuugaggcucaguuucuucuuuuuugcuuucaucagucucaucucugcaagaugccaaaucaucaccuacuaauguugcuaucuccuuugauggcuggaguuucacaauaaucuaagaugugugaaucuaaaacauuguagugaaugaacucuuuuuuuuaacaucucuuucaucuguuuggacuucuuguccaucaugaaccuuccuuuuacuugaauucugaauuaucuuuuugagcuuuguuuuuguuuguuuguuuguuccuuaaaaucaacauuaauuggcugggcgcaguggcucacgccuguaaucccagcaguuugggaggccgagaugggcagaucacaaggucaggaguucgagaccagccuggccaauauggugaaacccugucucuacuaaaaacacaaauacaaaaauuagccgggcacgguggugggcgcuuguagucccagcuacucaggaggcugaggcaggagaaucacuugaaccagggagguggaguuugugcagugagccaagaucgcaccacugcacuccagccuggccaacacaacaagacuccaucucaaaaaaaaaaaaacaccuuaauuuuccauaaaauuaaaguguuugaccacgggaguuuuccagccaagucuucaaaauccuuuagaauuucuuuguuuuucuaaacuaguaaucuuaaaacuccugaacaaccacaaauaaguuaucaaccgaucucggacaauaaaccuaagccaaauuuucacugaaaugacaaaauauaucuugccauggucucugcugauuguauggugaccccaauuugucucucacuucuuccacagcuguuugcucaaagcuggcuccaauaguugaaaucaccuugaugaaaacuaaaacagugagaaagucacaacagagaaagggaucugaccuaaccaacuccaucuugguucuaaccuccaggcugcccuuguuuauuccugggcauaggcugaacuaucuuuggguggaacuuaaaguugaacuuugaaacaaagccaauaaaaguccuuucccaaaacaaaucucuuacuugccuggggaccagacugccuuuguaaaacuaacaaauuauccacaagauuagaaauuaugguuuaggagucaugcacccagaggcugcaagauucugaaccuucccaguugcucuuagggauaacaucacuauuguaaaaccuaacacuggugcugaggauauuuccuagacccugcguucugaugcaccagcuggugccacccagaccaauaaucuggcucaaccuguucugugaucccacccagaaacaaaagaaagcuagaaaaacccacuuugacccccggugacuucaucucugacccauccaaucagcacucccuacccucuggcucccaaccugccaaguuauccuuagaaaaccucagucuccaaauuuuaagggaaacugauuggaguaauaaaucuccagucucuuguacagcuggcuaugcaugaauuaaacuguaucugggccacugggcaaaaugaaugcacugggcaguuacauagugacuugaggaagcuaagacucaccucugaggucacuuucugucacuugugcagaccucugguucucaugcagguuuacaacuaggagcuguuaguggcuucuugaaugucagacauguuggcagugcuuccaagaucccuaacacugucccaggcucugggauccaaggauggccaugaggagagaucuuggaaauaucuauacuauccucgugccaaugccaggcauauacaauaguguuuaacacugauucaauuucugugccuaaggagcucacagucacugugaauacaaucuucaucuaaaaaaggcagcugaagccagugaaaaggacauguccagcugccacacagaugcuuucagcuccagcauuccacuggccucaugugcucaggucacacgacuggaagccaccuccaguucuuaacuuuucuaacucuagguaauccaagauaaaacuuuguuucuuuauuuuguuuuguuuuguuuuuagagacggagucucacucugucaccuggcuggaaugcaguggcgcaaucucggcucacuacaaccuccgccucccggguucaagcgauucuccugccucagccucccaauuagcugguacuacaggugcacgccaccacgccuagcuaauuuuuuuguguguauuuuaguagagacaggguuucaccauguuggccagcaaggucucaaucuccugaucuugcaauccgcccgccucagccucccgaagugcugggauuacagucguaaaccacagugcccagccaagauaaaacuuucucccuuucucuucaucucuucucuccugaauucaucaucauauacaugguaauucccuggcuaaggccuaggaauguaacugcccaaggguuucaccuugcccacugucuagauagagccgauucaucaagacagggaaauugcaauccagaaagaguaauucacgcagagcuggcugagcggaagaccggaguuuuauuauuacucaaaucagucuccccagaauucagggagcagaguuuguuuuguuuuguuuuguuuuguuuuguuguguguaguuucgcucuuguuccccaggcuggagugcaauggcugaucucgacucaaugcaauguucccaaccuggguucaagugauucuccugccucagccucccgaguagcugggauuacaggugcccaccaccucgcccagcuauuguuuuuuguauuuuuaguagagaugugguuucacuauguuggccaggcuggucuuaaacuccuggccucaagugauccgccugccuuagccucccaaagugcugggauuacaggcgugagccaccgugcccggcccagcgagcagagguuuuaaggauaacuuggugaggacugggggagccagugagccaggagugcugauugcucagaaugaagucacagggagucagagcugucuucuugaucagucaguuccugggcgggggccacaagaucagaugagccaguuuauugaucuagguggggccagcugauccaucaagugcagggucugcaaaauaucucaagcacugaucuuaggaguaguucugggagggucagaaucuuguagccuccggccgcaugacuccuaaaccauaauuauuuuuuugaggcagggucucacucuguucccagguuggagugcaguggcgugaucuuggcucacugcaaccuccgccucucggguucaagccauucucccaccucaaccuccugaguagcugggaguacagggacacaccagcacacccugcuaauuuuuguaauuuuuuguuuguuuugagacagaauuuugcucuuguugcccaggcuggagugcgauggcgcgaucucagcucacugcaaccuccgacucccaaguucaagcaauucuccugccucagccuccugaacagcugggauuacaggcgccugccaucaugccuggcuaauuuuuuguauuuuuaguagagaugggguuucaccaugauggccaggcuggucgugaacuccugaccucaggugauccaccugccucggccucccaaagugcugagauuacaggcgugagcuaccaugcccggccgauuuuuauauuuuuaauagagacaggguuucauuauguuggccagguuggucucgaaauccuggccucaauugauccacuugccucccaaagugcugggauuacgggcaugagccaccgcgcccagcccuaaaguauaauuucuaaucuuauggcuaaugcuaguccuacaaaggaaaucuaguccccagacaagaaggagguaugcuuugggaaagggcuguuacagucuuuguuuaaacuaugaacuauaaacuaaguuucuccuaaaguuaguucagccuacacccaggaaugaacaaggacagcuuggagguuagaagcaagauggagucaguuaaguuagaucucuuucacuaucucagucauaauuuugcaaaggcgguuucaggaagacccuagcuacauguauaaaaauccaguauuuaagguuguaucucuaaaucuuuaaauguaaaauaagcuacaugcuuauuuuacuuuucaaagaauggacuguguugggacucaaaaacugagaccccaaaauauggcacauugacaugcugaacuaaaggagaaaccucaaggacucuccaagguuccccaccccuaccaucucuucuaaagaaguuuaagauuuuuaucugccaaaacuccagggucacccaccaaagaagaacaacuguuuuuuccuccccucccuggaagaccaagaauguaaucagaacugaacaggcccuuucagaagauaaagccugucucucagacucauucaaauucuaaagagaacuauuuaccaguuaaucuccauccgcauccauucauucucccuagcaauccuuuauuucccccaacagaguuccucuucucucccgguucccauaaccucuuucaucagaauccaaucccccauucuuucuguaacuucaagaugguauaggagcucauaaaccucaucauggguuugggucuucauucugguuuuuuuguuuguuuuuuguuuuguuuugagaugaaguuuugcucuuguugcccaggcuggagugcaauggcgucaucucggcucacugcaaacucugccucccagguucaagugauucuccugccucagcugccugaguagcugggauuacaggcaugugccagcaaacccggcuauuuuuguauuuuuaguagagacgagguuucuccauguuggucaggcuggucuccaacucucgaccucaggugauccgcccaccucagccucccaaggugcugggauuacaagcaugagccaccgcgcccggccagguuuuaccuuuccacaacugacaguccauucauauuucuuaggaaacauaauugccuguguuagauaggaguucuaaauuucuuuucaaagaaucaauaugucaguauguucaauucuuugccuucuacuuuuaaacuuaacuuccucauaaagcaaccuuuuucgauuaccuacuccacccugacucaucccgauuaccugauuaccuacuccacccugacucauuccgauuuccugcucucucauaaccauuuuucccgccaaaccacucacccugucagucucuuuaaauuagccaaucagaguuaguuuagccugugcggucuaacccuagccaauaggggaacaacacagcagcaggggccaugugcaucagggauaaacuccccuuccccucccuuguccaagugugugcucaccauugcuccaacuguaagggcaugcccuucuaaagaaguacauugccuugcugagaauuaaaaagaaaauuuuauauucgagugcuauuucuuuugcagcacagaaacuuuauaacaauuuggggggucuccugugauuacauuccccucuggggguggucucugguucucucucaugaggagguccgccccgcccccuuguggcggccucaggggugagaaaucaggacccacccagugggaggaauaacccgagcucucagcaacgcggagagaaacuggccagcaaccuagcuuaaagaauccucacauacuguggugacaacucugugcacagaccaaggaaggagaagccgcaggagcggguaaaguauuuccuugguggucgggacuaaggaaaaagcugcggggugguaaaguauuccuugguuaggacauaccaaggagagagaaaccgcagggacaguaaagcauuccuuagucgggacuagggaaagaaagccacaggauguggugaaguauuccuuagucgggaugcuuggagguuaaaaagaggugagaaauccccauugaaggcggggguugaaccucagaaagaggugagaaauccccaugauggggggguugaaccucaaaaagagguaagaaauccccauggggaggggguugaaccucacacaaaccuccaguaguaagaaaaauauucagaacuccccuuuccuuucuucucuagggaagaaagaguagguccacuccugcuggucccuccccuagcggaaggggaaggagaggggagaacagcagcauaagcggcuggcagaggcagggaaagaccagcagagaggaaagagagggagagagagagagagugaggagaaagagagaagaaagagagagaaagagaggcagagagaaagaggaagagacagagagacaaagagggaaucaaagagacagaaagagacaggaagucaaagagaggaagaaagaaggagagagauagaaguaguaaagagaaaacaguguacccuauuccuuuaaaagccaagguaaauuuaaaaccuauaauugaaggucuucucugugacccuauaacacuccaauaccaccuuguugucuguugggaacaggccccaaaaucuggccauaaacuggcuccaaaacuggccauaaacaaaaucucugcagcacggugacaugcucgugauggccuugaugcccacacuggaagguuuaccggaaugagggcaaggaacaccuggcccacccaggguggaaaaccgcuuaaggcguucuuaaaccacaaacaauagcaugagcgaucugugccuuaaggacauguucaugcugcagauaacuagccagagcccauaccuuuauuuccagcacaacccuuuguuucccauaaggaauacuuuuaguaaaucuuacgacugacuugcugucaauaaauauguggguaaaucucuguucaaggcucucagcgcugaaggcugugagaccccuaauuucccacuccacacucuauauuucugcgugugugucuuuacuuccucuagcgacacuggguuagggucuccaugacugaguuggucucagcaguugucacuguaaacaagggcguagccugaaagcauugaggccacugacaagcugaggccacugauuagccuuccuaaucaaaaauccuuaacccaguaaccugcggauggcccaaaugcauucaaucuguagcggcaacugcuuugcuagcagaagaaaguagaaaaauaacuuucagaggaaacauuaugagcacagcucaacaggucagaacuauacuaagucaaaaaaaaaaaaagcaaaaaagguaacuuacugacucaagaaccuuaaaguaugaggcuauucuguuagaaaaagaugauuuaacauuaaccacugaaaauucucuuaacccagcagguuuccuaacaggaucuaaaucuuaauuaccguacaaaggucugaccagaccuuggaggaacucccuucaggacaggaggauagaugauuccucccaggugauugagggaaaaagacacaauggguauucaguaagggauaaggaaacucuaacagaagcgaguuaggaaaauugccuaauaauugggcugcucaaacgugccagcuguuuguacucagccaagccuugaaguacuuacagaaucaggaaggagccaucuauaucaauucuaaguuaauauggacugaacagggucuuauuaauaccaaagaauaauugaaaucccaaauucacaagguuuucaacaaaaguaaaguuugcuaaaaguuaacaguguaacauguauuauccuaacuucuaaucuuguggccuuagacuaguccacagacaugaaggaaguucacuuuggaaaagaacgguuauuaucuuugagaaaaaaaaaaaaaaguggggaggagaauuuauguaaaaacgaauguuauauaguaaauucuuguccuaaaauaaauuaacugguuguuuaaagaaagggauguugcaacaagugagaaagcugaggcaugucaaagaauugucugugaaagucgugaaaaaaaaaguuauaaaagggaauuuaugcaagaaauguuguauaauguacaaguaauuaggccucuugauuguaaaacuauugaagaaacaguuuaugugcaagguguguaaggaaaguaaauauacuuuugguaaaaggauuauaaugaggcauaagaauguagauuuuuaccuacauuaaaagguuaaaaaaauuuuuuguuuuaaagguuuaagcaaguuuugaaacauuaauuuuaaagaaaauucuguuuguaaacauauuggcuaaaguuaaagggguaucauccagcuuuucuguaaacuggacauuaaaauaaaagcacaacagguuuuucuuaaagcacuaaccugcucuuuaacaaaaauuauacaagguuaaaaagagucuauaaaaaucuuaccuuauggucagacauuaaaaauuggauaaaugugucuacaaguuuuauuaaaauuaaguuuaucacuaauagcacacuaauauaaaggugaaauuuagcuuuucugguauaaaaaucauacaggaagcauugucaaauauaaaaugguauuuggcuuucuuuggucuaaaaacuaauaaaaauaggugcuaaaggaaauuucucaguaagaagacaccaaggacuauaaaguccacugcugauguccccacauuuaaaacaaaagaucaauuucuuagaaauuguauacuugguuuaucuuccacuuuccuuucccucaaaacuaaaagucuuuuagcacagguaccaccccuagaauuuccgguaaaccagcaacagccugaagaucauggucucaucaaaggguggaaagaaggaaaacuccagccacccugggaaggacccuaccuugugcugcuaaccaccaagacugcuguucuuacagugggaaagggaauagacucaucacaccugagucaagaaagcgccgcccccuccagagucaugggccauagucccaggggaaaacccuaccaaacuaaagcaaagaaaaauuucacucucuuucaucuauucuauuacucuuucuucuuuccucgcucuauugcugaccaucuaguuauuaacauaaccaagucaauuucucuucaaacuauugcauuugaugcuugccuuguuauacccuguggggacuugccaagucaaagacagcucucuacuucagaaaaguaccucucucccuccugacucuccugagacuagacauuagugaauugagaccacuuaauccagggagauuuugguaaagaccccagugucaaccaggagucuugccccccaguguagagcuuuuaugccguaguuuguccaacauucuguggaccacuaaagagcaaggauggacugccccaaccaguuuuuguaauuuccuaaaaccauacauucauuuuacuagagggacagccaacccccaacugggggucagcuaaaccagugcauuccaauacagguuauuaucucgaacccucaaacuucuuccccuuuucuaagccaguucccuucuuuaagccaguuuuaugguaugggggcugagguuucagggacagacccuauuggauucuuugaaauguguuuauuugaucccccagugccugcaccuuccucuaagccuucuuccaaaaccucucacaacugaacaauugccacuccuccaucuaacgacaagaccaagauagcuaucauacaaguuaaagacuuaaaacaaacuucggcaauuaagacaagauaccaagaugcaaaugccugguuggaauggaucaaauauuccgucugcacguuaaacaaaagcaauuguuaugcuugugcgcaccgcaggccagaggcccagacuguccccuuuccacuaggguggucauccagucaaccaggcaugggcugcaugguagcucuuuuccaggauucuacagccuagaguaacaaguugugccacacucucucucugcuauaucccaaaguccagcaugcugcgggucagcccccaagggccauccagccuccauuuuccaaaaucaauuuuaccucaugucuccaacgaccaagggaaaaauuuggcauuccuuggagacuuaacaggaugcagugaaguguggcacuuccaagagcugaccuaucagucugcccuuauucaucccuaagcggauguauggugggauuauggaggaccuuuacuggacacucugccaaauaauuagagcaguauuuaugcucuaguccaaucggcuaucccuuuuacucuggccuuucaucaagcagaggaaggaaaaaccagacgucauaaagcaagggaagccucuuaugggucuuucgacucucacaucuauuuaaaugcaauuggagucccacagggaauaccagaucaauuuaaaccccaaaaucaaauagcuacagaauuugagucaauauuuuggugggugacaauuaauaaaaauguagauuggauaaacuacaucuauuacaaccaacagcaauuuauuaacuauacuagagaugcuguuaaaggaauagcugaguaauuaggggcuacaagccacauggcuugggaaaauaggauagccuuagacaugauauuagcagaaagaggaggaguuuguaucaugauuaaaacacaaauguuguaccuucaucccaaacaacacugucccugauggaaguauaacaaaggcauugcaaggucugagugcuguguccaaugaguuagccaacaacucagggguaaaugacuccuuuacaggauggcuagaaaagugguucaguaaguggaaaagaauaauagccucaguucuuacuucccucgcagccauaauggguguacuuacucuugucaggugcugugucacaccaugcauccauggguuggugcagaggcucauaaaaacagcacuuacuaaaaccucccuuaacuauucucugccuuauguaaagaagcuucuucuuuuggaaaaucuguagaacaacuaagccaagacauguuaaagaaguuugaagaaaaagagccguaaggaaaugcaagaggacagaauguuagauaugaguucuaaauuucucuucaaagaaucaguuugucaguagguucaauucuuugcuuucuaguuuuaaacuuaacuuccugguaaagcaaccuuuuucaauuaucugcucuacccugacucauuccaauuaccugcuccacccugacucauuccgauuaccugcuucaccuugacucauucugauuaccugcuccaccaugacuaauuccaguuaccuauuccacccuaagucauuccgauuaccugcucauucuccacccugacucauucagauuuccugcucugccauaaccauuuuuccugccaaaccacucaccccgucacucucuuuaaauuagccaauuggaauuaguuuagccuguguggucuaaaccuagccaauaggggaaugacacagcagcggggccacgugcaucagggauaagaaccccuuccccucccuuguccaggugugugcucaccauuguuccaucuguaagggcgcauucuucuauagaaguacauugccuugcugagaauuaaaaagaaaauuuuauauuccagugcuauuucuuuuguggcaccaaaccuuuauuuauaacaugggcuacuggagucagacccugucucaaaaaaaaaaaaaaagaauucccucucccucaaucuucauauauuaccuguaaaugugauaagaagcacacuuuuuuuuuuuuuuuuugagauggagucuugcacugucugucgcccaggcuagagugcaauggcacaaucucagcucacugcagccucccacuccuggguucaagcaauucuccugccucagccucccaaguagcugggauuacaggugcccaccaccacgccugacuauuuuuuuguauuuuuacuagagacgggguuucacuauguuggccaggcuggucucgaacuccuaaccuugugauccaucugccucagccucccaaagugcugggaguacaaccaugagccaccgcgccuggcccaagaagcacacucucaugcauaaucugucaaaaauuuauaaaucagaugggcacaguggcucaugccuguaaucccagcacuuugggaggccuuugcagugagccuacauugcaccauuguacuccagcauggguaguagagcaagacugucucaaaaaaaaaaaaggaaaagaaaucacuaggauuucuguucaccaauaauguucuacccgaggacgaaaccaagaaggcagucccauuuaugauagcuacaaaaaaauaaaacaccuaggaauauauuuaaccaagaaggugaaagaaaucuacaaggaaaacuacaaaacacugaugaaagaaacuauagaugaaacaaaaaaauggaaaaacaccccaugcacguaggcugaaagaauuaaugugguuaaaaugaccauugugcccaaagcaaucugcagguucaaugcaauuucuaucaacaucauuuuuucacagaauuagaaaaaacaauucuaaaguucauauggaacuaaaaaugagcccgaauagccaaaaauaucccaaguaaaaagaacaaagcugguguuaucacauuuucugacuucaaaauauacuacaaggcuauaguagccaaaacagcauaauacucauagugucuauaaaaacagacacauagggccaggugcggugccucaugccuguaaucccagcacuuugggaggccaagacaggcggaucaugaggucaggaguucaagaccagcuuuaccaacauggugaaacuccgucucuacuaaaaauacaaaaauuagccaggugugguggcgugcgccuguaauccuagcuacucaggagucugaggcaggacaaucgcuugaacccggggggcggagguugcaaugaacugagauugcacaacugcacuccagccugggcaacagagcaagacucuaccucaauaaauaaauaaauagacacauagauccauggaacagcauacauaacccagaaauaaacccacaugcuuaaagccaacugauuuuugacaaagucgacaacauuuacuggggaaaggauacccuuuucaguaaaaggugcugggaaaauuggauugccauaugcagaagaaugaaacuggaucccuguaucucaccauauaaaaaaaucaauuuggccagacacgguggcucacaccuauaaucccagcacuuugggaggccuaggcgggcggaucaacugaggucgagaguuugaggccagccugaccaacauggagaaacccugucucuacuaaacacacaaaaaauucgcggggcaugguggcgcaugccuguaaucccagcuacuugggaggauaagguaggagaaucgcuugaacccaggaggcggaggcugcagugagccgagaucgcgccauugcacuccagccuggacaacaaaagcgaaacuccaucuuaaaaaaaaaagaaagaaaaaaauaaauucaagauggauuaaagacuugaauguaaggaugaaacucuaaaaauacugaagaaaaccuaggggaaacucuucuagacauugaucuaggcaaagaauucaugacugagaccucaaaagcacgggcaacaaaaacaaaaauaggcaaauggaacuucauuaaacuaaaaagcuucugcauagcaaaagaaaugaucaacagagugaacggauaaccugaggaauggaagaaaauaucugcaaacuacauauccaacaggggacuaauauccagaauuuguaagcaacucaaacaacucaacaacaaaaaacaaauaaucccauuaacaaaugggcuaaggacaugaguaggcauuuuucaaaagacaaacaagcauaucaaaaauguucaccaucagccgggcacaguggcucacgccuguaaucccagcacuuuggaaggcugaggugaguggaucagcugagguccggaguuugagacaagccuggccaacauggugaaacccccgucucugcuaaaaauacaaaaauuagccaggcgugguggcacacaccuguagucccagcuacuguggaggcugaugcagaacaauccuugaacccaggagguggagguugcagugagcugagaucuugccaucgaacuccagccugggugacagaacaagacuuugucacaaaauuaaauaaauuaauuaauauuaugaauccuggauuuauuuauuuauuuauuuauuuauuuauuuauuuauuuauuuauuuauuuuugagccagaguuuugcuguugucgcccaggcuggaguacaaugggcaaucucggcucacuccugaccucaggugauccacccacuucagccucccaaagugguaggauuacaggcauaagccaccacgcccagccugauuccuaaacuuaauccaauaacagauuucuucucaaacauuggcaguaugcuguaaucauuuuaaauucauaaccagaaaaugaguugaacaaaaaauucaagacucuagggaaacaaaaauaguuuguauauugcuagaauugucuauuaagagucauguuuucaugccuuuuaaucuucccugaaaauuucuguguacugccaugaguaaaauuuuuaaaaaauguucaacaucaccaaucaucagagaaauacaaauuaaaaaccacaaugagauaucaucuuacacacaacagaauggcuauuaaaaagacaaaaaaaaucacaggauguuggugaggaagcugagaaaagggaacucuucuuauacacuguuggugggaauguaaaucagugcaccuucuauggaaaacaguauggagauuucucacagaacuaaaaauagaacuaccggaagaugcagcaaucccacuacugugcaucuacccaaaggaaaagaaaucauuacaucaaaaagacaccugcacucauauguuuaucacggcacuauucauaaaagcaaagauaugaaaucaaccuaagugcccaucaauggagcacuaaauaaacaaaauauggcauauauacaaaauggaauacuauucagccauaaaaaagaaugaaauuaugucuuuugcagcaacauggauagaacugggggccauuaucuuaagugaaaucacucaggcacagaaaaacaaauauugccuguucucccuuauaaguuggugguaaauaaugcguacauauggaagcagaguguggagugaugggcaauggagacuuggaggguuggggauguagagggaaggggauggacuacaggagguugcuugcuggguacaaugugucuugugccagugauggaugcacugaaggcccugacuucaccccaauacaauauaucaauguagcaaaacugcacuuguacccccaugaauauaugccaaaacaaaaucauaacuggcuggggcacagggggcucaugccuguaaucccagcacuuugagaggcccagguggcuggauucugugagcugaggaguucaagaccagugugggcaacauggcaaaaccccaugucuucaaaaaauacaaaaauuagccaggcaugguggcacacacuucugguuucagcuacuugggaggcugagguggaaggauugcuugagcccagagaggcagagguugcagugaacugggauugcgccacugcacuccagccuggaugaaagagcaagacaugucucaauacuuaaauaaauaaaaaauauauagagagaguauacugcuauacgacagaaaaacacaacucaaacuuuuuuauuggucacuuuuaucuugcuacaaaauguacuacuagaagcuuaaaaagagcauggcuuuugaauuuuaauaaauuuuagugaacuuuaguuagauugaaguuauacagauaaauggguugauggaauaaagaucuauauacucauuaggcguccaucaguuaaacuguuuacuauuaaauuaauuuguugguugggcaugguggcucaccacaccauuuaauugcagaguuuugggaggccaaggcaggagagaggaaugcuugagguggggaguucugggaaacacagcaagacccugucucuacaaaaaauaaagaaauaaaaaaauuagccaggcaugguagcaugagccuguacucccagcuacuugggagacugacgugggaagaucacuugagcccaggaggucgaggaugcagugaucugugaucucaccaccgcacuccagccucggugacagagugagaccaccccauguccauaauaauaauaauaaaguuaauuuugguccccaccacucucacuuuucugcccccuccccugaguagacuggcugaugaucuaaaaggugaaaauuaccuaugugauguaugugaaccuuuuuuuuuuccaguggggugggggggcaugauagggucucgcucuguuacccaggcuggagugcaguggcacaauagcggaucacugcagcuucaaccuccuaggacucaagccaucccaccucagccucccaagcaacugggacuacaggcgcacgccaccaagcccggcuaauuuuuuuuguauuuuugguagaaauggggcuucacgauguugcccaggcuggucuucaacuccugggcucaagcaaucgucccaccuaggucauuuuauucaauaaauauucaaaugagcaauucccaagcauuaaguuaaacacuaaagacaauguccagaaaggugaauuuuuggccaggacagaacuacuguauuuaauaaaguggauaggcuggaguccuccgaccuuaauuguaucacuaagccuuaauggcaacgugcuaccuugauuaagucuaucacuuguaucuacagaagaaacgaaauguagugaauugaauuuccacagaauaaacaaacaaaaaaacugucugugugugucuccauucaucaaggaggauagaagcugagaagauaccacacucgucagcuugggaugucacagaacaugucaaagagacagcgaggaguagcagcuacaagagggugaauggaaaucacagguccaggcuacccguuaggcuaugauuuaaugaguccuaaagcucuuuuaagauucuguauccuacgccaggcgcgguggcucacgcaugaaaucccagcacuucgggaggcagaggcaggcggaucacuugagcccaggaauuugagaccagccuggccaacauggugaaacccgucuuuacuaaaaauacaaaaaaauuagccgggcauguggcacaugccuguaaucucggcuacucuagaaagcugaggcaagagaaucgcuugaacccgcgaggcagagguuguggugaaccaagaucgcgccacugcacuccagccugggcgacagagcgagacugucucaaaaaaaaaaaaaaaaauccugcauccugcaacuaauuucaagauucauagugggccgcgcgcauaaucauagagauuacgucuguaaucucaacacuuugggaggccgaggcgggaggauaacuugaggucaggaauucgagaccagccuggccaauauggcgaaaccccgucucuacuaaaaauacaaaaauuaguugggcgugguggcgcaugccuauaaucccagcuacucggaaggcugaagcaggaaaaucuccugaacacgggaggaggagguugcagugagccgagaucgcgccacugcaguccagccugggcgagacagcgagacuccgucucaaaaaaaagagaaaaaaagaaaaaaggaaaaaaaagauucauaguggauuaccauucccaaauucagagggaguaaagaaaguucuauaacacuguaguaaagcuaaauuucauccucuaaauaaaauucugcaacagguaacuguacaagggcaucuuuuauuguacaugaagugucaaguuauucaaagcagcgggcuaaaguccuuucugaaauguggcuuggugugcauuuucgaaguuacuuaaacuuggcggacgaaaggacaggaguaaagaggccccaaacgcgagccgcgggacgcgcaggagcgggaccccacggcgcacggagcccucggucacaacaacgcacgggacagaggcgacccugggcggccagagcggggcaggccggccgcaggcccacggaacgggguugcagggaggcgagcaaagccaccgcuaaggggucagcagagacuucagacccuaauugcucuccucagggcgcccgaggaggcaagcuggggcagggaucccuuuagccacccagaccgaaucucggaggguaccugacugcgggcggccaguccacagcccccucccgccgccccggccggagaagaggcagguucugcgcagagcugccacccucgccagcgucgccagcaucgcgugcgucucagauggcaucggucccggugcaagcggcgaacu

SEQ ID NO: 192407 - RNA, 1910 nt, Homo sapiens
ggacuagcaguucucugcggagggccgguugauacaguuccggugggagaacgcggcugcgagguuuucggcuuuggcuccugauaugcagcgacagaauuuucggcccccaacuccuccuuacccugguccggguggaggagguugggguagcggaagcagcuuccggggaaccccgggcgggggcggaccacggccgcccuccccucgagacggguacgggaguccgcaccacacgccgccguacgggccccggucuaggccguacgggagcagucacucuccgcgacacggcggcagcuucccggggggccgguucgggucuccguccccuggcggcuacccuggcuccuacuccaggucccccgcggggucccagcagcaauucggcuacuccccagggcagcagcagacccacccccagguaauaauaauagccagcguuugccgagcucuuacuuuauggcaggcacgguacuaauauucccuuuacguggauuauuuugucuaauccucucugagguacuauuguuagcccaauuuugcagaugagcgaacugaggcuuagagaaguugagugacuuccggaagauuauccgaaagaguggcagagccguacguucuguuuucgagcccucgugcuuuuaaccaauacacugccacccguacacagauuuuccuaauucuccauuuccuccuguuugccaaaggccuugccaguuuguuucaagaaauaguucuuuuucuuuuuuuuuuuuuuuuuuuuaucuuucuuucgagcuacacuggcuucugcuccaacuucccugaaaagaaaaucggugguaguggaaguuuuccauuccuuuagugagaguaaauacaaaagacagagagaguaucucuagcaugucugggauuucugugguuuacaacuugcaacuacgugguuuuccaacuugcuguauucuacaccaacccccuaccccuuuugagccuggagcuaaggaguaaagaaaauguucaugagcuagaaagguucuagaaacuuuaaaacuauaguauuguuuucuccugaaaaaagugaaaauuucgagggaaaauugaauauaauuacuugauuucaucacugcuuguauuuaauuacugcaaaguuacuacauuagacacaaaaguauuugagaugacaguggucauggaauuauaaauaaaugagaauaacgaauugcuuuaaguacuuuuuuuaaaaaauaggaacacuugauuaaaggaagcauggacuuuguaauugaacauuauuuagguucaagucacaacuuuuaagcagcaaugugauucccgcuaaccuuuagcuaaaggaagaaguaccaauuaucuuuacuaaguguuuuuuuaacugauuuuuuuucuaaaggguucuccaaggacaucuacaccauuuggaucagggcguguuagagaaaaaagaaugucuaaugaguuggaaaauuauuucaagccuucaaugcuugaagauccuugggcuggccuagaaccaguaucuguaguggauauaagccaacaauacagcaauacucaaacauucacaggcaaaaaaggaagauacuuuuguuaacauuucugaaauucaacuggaagcuucaugugucaggaacaucuuggacaaaacuuuaaguuguguugauauaaauuuacccaaagaugaugacuuugauuggauaauuaguaaggucuuuuuguuauuuuucaucguaucagguauuguugauauuagagaaaaaaguaggauaacuugcaacauuuagcucuggaaguaccuaccacauuuuagagauuuaccguuuccauauauuuaacauuccugguuacauaauggacauuugucuuuuaauguuuuuucaauguuuuaaaauaaaacauuuugucuucua

SEQ ID NO: 192408 - RNA, 146775 nt, Homo sapiens
uucaauuuuauauaaaauauuuaauuuuuaaaacacaggcuauucaugucacauaaauaucuucaacuguagguuagcugcuuauggucagcagaauuaucaagugugacuauuaagaauaacuuagauacugucacuuauaggaaagucuaaagcucuaagacucaccauauuaaaauuucagauacuugaauacuguugcuauuuugcuaauuucaaaauauuucuucauuuccugcaauguaguuuauaaguuguuaguaaucaauauucaaauaaaagcaacauauuuuuuucuuccauucauuucuuucucccaacaaaaagaguccaucaaaaaauaaaauggucaacugauaucaacuuauuuuauaguaguaaaaugguaaauuauccucuuuaaaauaauuuuacucuuaucaaacuacaggacuucccacauacuguuuugaaaugaagguucauaaguuagagggcacaggguuaacuggcuuuagaacuggagcaauauacauucuguaacaguuguuccaauuuaagauuccaauaaaaaaaaauaaguuaccagaacaguugaugaacaaaaugauuaauuggcacaacucuaacuuccagucaauuuuuccauuuagugauaauggaaacacugguuauuuaccuuugguuccuuucuagaauuaguauaauuguguguguaugugugagagugugcacacagugagacuugacaccauuacaguuuaaauaaggacuacuccauucuuugaugcucuucauuaaaaaaaaauguuaaaaugaacuaaaguuguugcucuaagucuggcagaagucauaaucaacuuuacagaaugugacaggaaggaagauaaaaguucucucucauugccuuuucuuuuugcuucaauaaauucaaucuaagcaauguuucuaguuaacaagugaauagaauugacuuucuuaaaagggcaauugcauaacuuaaaauacgguauuugccaccccucccccaugaacuuuaacacauuuaggcaaguucuguuauuaacucuugcuucuauaccaugacccuccaauuauccauggcaaauggaaacagggauaauauggcagccugaaagaaaaugguacucuaaaauucuccuggagcuauuacuuucaaccauuuaaaugacaaaacuuuguagaacuucucaaacaauauguacugauugcaguucuacucccuuucuuugcucucacuccccuaucaagagaaggugguagugaaaggcaacacagcccaaagacaggcagaaaaggagaaagugugacaagcagagggaauggaccuaacaggaacugaacaggcagccccugaaacuucagaguuucuugccuuuuuaaugcauugauucccuuuaaaagacaaauggggguaaaaguuaacuauuuuuuucagaccuuaagcuuaccuguuaaggcacuuacuuucccuccccaccccacccauaguuuucauauaaaacccacuauuucauuuaaaugcauuuugcuaggcuuugauaaucugcaaaacaaaacaaaaauaacguugaccauuuuuuuuuuuauaaaacuguugcaucaagagaaagguuguguuuuauuuucugaaaugagcacaaaguacaccuuucacaauaacacugaaagcaggugcaaagacugacagugaccuuugacuaaagguagcuuuguaaaaagaaaaauaccaaauaaaucagugcccuuucugauuguuguaaaacuggagguggggaggggcuguuuguuacauaaaaguugguccaaacuuacaaaaaaagcacaaaugugcauaguucagaagaucugcaagagggccauaaaaggcuuaugccccuaaaauuagcauccacuuaaaacugcaagaauacaaaauaaaauuguuaacuagaauuugugaagauguacaaucgaucuaguuuuuagaacagcaugaauuuaagcaaagguuuuuuuugucuuuuuuaaacuauuguaugcaagacccuucuccacauaaaaauaaagcuguuguugaauuauuauuauucaagucucuuggauugcugccuuaaauugcagcuagaaaagucuuuccagauaaaaaugaugugccugaggaaaaacagauacucaguaugguaacccucugccucugccucugccaguugaugugcuaauauguccccuguauccuugugaauauccagguccuugggcaggagaaguccaggucuguccaugcaugaggcuggggccacucggauuuuccuguaaguuaccaccauaguuauaguugugcaucuuugcuggcaaaggaugaguacucucuggccccguggaagggucacugcuguuugccaggacugcaauaggaccauggcuauauucaaaucuaugguccuugucuccacuaaacaacaugggaccagcauugagguaaaugucuccauauccagcuacugaacugggaaaugacucagaaaaggcagaaggcugagguggaccaccagaaugagaugaagcaguacuguaguuauccaaagacugaauaucugaauuuccaaugaaacuacgucguucuagugguggagcagaacugcuuccuagaccaucauugcuaacauaaggagcagaagagaaagaagaggauccaaaguuguccuuguagucugaaguggacacguaagugucuccugcuugauaaucaaucccaccuucucuuuuggggucauccuggggcugaugcugagcaagcagcuguaacagggcugccuucacuccggcaugagggucaguuaaugaagaacuggugguggguacaugcugguuuucuguccgauaaucuagaucuuccucagugacugguggugguucaggaggcucgggaggucguuggucaggaggcagaauucgaggccggucugguucuggcguuagcuccaagauccucauaucuugaugcuggaugaggucaucuuguccuaagugaaacagagcaaaaacaaggucaaaaguuaccauggaaaacuaaauauucaaaauacucaguguuuccuguagguaguucuaaagaugauuagaaguuccaucucuggcaaaauguuaaaugaaaaaagcaaaaaguuuacaaguacuaugguaacugguaaauuuuacuguauauggcuucucuuuaaaaaaaaaaaaauuuuuuuuuuuuuuuuuggugacacggucucacucugucacccagacuggagugcaguggagugaucacagcucacugcagccuugaccuccugggcucaagugauccacccaccucagccuuccaaguagcuggaaucacaggcaugugcuaccaugcccaguuaauuaaaaaaaauuguuuuagagacagggucucacuauguugcacagauagguacugaauuccuggguucaggcaaucuucccacuucagcuucucaaagugcugggauuacaggugugagccacugcacccagccguaauuggcuuuuuaaagcuaauuacggcuaggugcagaauucacguauacuucauugcuugaggaacaaaagcuacuguguacauaaauuaugccuuagucaagcauccuuucguauuuggaguuaaauauuauuucuuaaccauagguuuaccuuagaaauaucuuuaucauucacaaugaguucuaucucacauggauaauuuguuaaagaauccauuccuggaaguaaacagacugaaaaaccaaccuauugccaguuaccugagauucuucaggacaucuuuuggcaaugucacugaacuauacacauuauauauagucagcaacacugaguagacaauguaaugcagcuguguuaguggucugguaucugcacacuuacccgacaccggagugcuagguucuggagguggccugaguuguaaugacgcuucaugucccgauccauuuucccucucuucuaguagcacaucuuucugcuuugacugcugagccuuuauuaacugagucaacagaacugcaaaugcacucugcacagccgccugggcagcaucagucuccacuuuaggcuggauggucugagaagaaggcugaauuccucccaacgguuucgaagacuccuguugugguguugauggaucugucuguuuuucaccuguugccaaaauuccagcaggaagguuuauuuuauuuagcugcuguugagucucagaguuuaccuuaauguucaacacuuggacaaaaucagccauauuaacacuuguuuuagauuguaguagguuuaguagaauugccaauucacugugguuuaagugcuguccagggccuguuuuuacuaaagacaaaauuauauuaauuagaacugucauaauucacagcuccucccacucccacaccaaaauggcucuguauuaccauaugaaaauauauauuugagggagaguauuuaagaaauacuguaaaaagagaaccucaagucuaguuaaauaucauguacauuuaaaauguaccuguacauaaaaagaacugcagucaauuuugaauaaaucuuuagggguaaauacuucaaaaggaaaaucaagaccacuacuaaaaccucauguuauggauuuaaccaggaaacagcacauugugaaugggaaaugaauaaugauaaugaugacagcuaagggagugucacauaccuucuaagcauuuaauauccuuuauuccuuacaacaaccuuagaaggcagacucuauuauuagccuccuuuuacugagaagaagaaacugacaccgaaagagaccaagcaacuugcccaagggcaaauauucuguaaguggcagaggugagaucugaaucugauauucugauuccacaaucugagcucuuaacuacaccguacuuucucuaaaauaaaguuuauuaugcaaaaucuaagguuaucuuugcacuauauugaaaucaugacauuuuucagauucugauaaaaugccuguguuuuucuucaaauuaccuuuuuuuuuuuguaacuuuggguaaguuaggaaugccuacagaaauaugcuuauuauuaauauaugcauaugauaguauuaacucaucaccaguaauaaggauucaguuguuuuuccaacuuucaguuuagacuugggauaauuuacacagguccucccucacgcaagcuuaucugaaucacauauaacgacaaggcucaaaugcauauaauaccauauaugguaacuauaagacugcaaugauaagcaauucccauaaucacagaugacagauugauagaagaggaacucuaagaugaugaaaaacugguguuuaaugcuuuuauauucucuuuauauauuuugagauacuucugcaaguucuucuuaugauccgugagcaugcuuguuugcuacaaaucaaaagucauuuuuccuuauuuucauuucccuauuaccacagguagucucuccauaugaauucagggauguggucuuuaauugaggugccucuuuugcugaaggggcguuuucuuauuucagcauacuuacugaugacggagaagaaaaugacucagaggauucauccuuuuuucaaaaaaccagaauucuccuucuuuuuuuuuuuugagacagagucuugcucuguuccccaggcuggagugcaguggcaugauauguaaucucugccucccauguucaagcaauuuuccugccccagcccccacuaggagcugggauuacaggcgcgugccaccaugccuggcuaauuguuuuauuuauuuauuuuuuuugagacggagucucgcccuguggcccaggcuggaaugcaguggcacgaucucggcucacugcaagcuccgccuucuggguucacgccauucuccugccucagccucccgaguagcugggacuacaggcgccugccaccaccacgcccggcuaauuuuuuguauuuuuaguagagaugggauuucaccguguuagccaggauggucucgaucuccugaccucaugauccgcccgccucagccucccaaagugcugggauuacaggcgugagccaccaugcccggccaguuguuuuauuuuuaguagagacaugguuuugccauguuggccaggcuggucucgaacuccugaccucaggugauccauccaccucggccucccaaagugcugggauuacaggcaugagccaccaugcccagccuggaauucucacuucuuaaucacaauacugauucuucucuuuucucuugauuuuuuaagacagggucucacuuuaucauccaggccacagugccaguggcacaaucucagcucacugcagucucgaccuccuaggcucaagcaaucuuuccugcuucagccccgcaaguaacugggaauauaggccaggcuaauuuuuguauuuuuuguagagacgggguuuugccauguuaccuaggcuggucucgaaaucccgaacauaagcaaacagcccgccccggccucccagagugcugggauuacgggcaugagccaccacacccagcuauuuauagauaacucaaggucaggaguucgagaccagccuggccaacauggcaaaaccucaucucuauuaaaaauacaaaaauuagcugagcgugauggcacaugccuguaaucccaguuacucuggagucugaggcaggagaaucacuugaaccugggaggcggagauugcagugagcugagaucgugucacuguacuccagccugggugacagagacugucucaaaaaaaaauuaaaguuaaaaaaggaaaauaaaaaauaaaauuauccaccauuaaaacaggguuguaaaguaaguuagagcaaauuaacaacaaaaugagcccagaaagggcaaaucauuuuuuaccagcuaaaaugaguaaacuacuacguuugguagaguuuaagacaucaguuccaugaagaggaccagaaauaaagaccugagagucuugccaaauaugacaacuguugccugggaaaacagaucaccauccaaaauuucuguuauugccauuucacauccuuuuguuagcaggacaaauauuuuaauguauaaggggaacucacuauuucaagaaagaauacuuuugaacaacaaauaacaauugcuuuugguauucauugaaugaguacuuuaaguaugcaguugaaccaaggucaaguagaagcuuguagacuacauuggcaagcauuaaugguuaucuuccuaaagcuuucucaguuaaucuauauuuaucuucaaccaccaaaaguucagucugauccacacaucuguuuuaaucaacuaacucaucaaucaacauauacucaucucuuaagaagugcuagucuauuuuuucauguuuaauaagccaccaccuacacacacacacacacacacacacacacacacucucucucucucucucucucucucuauuuuauaucagucucuguuuucauaaaacuucaacuaaagaugguguuaaauuaaagauggguguuucuggauguuuuaggcaaaaugagggaguggagguccuuuuaaaaaguuguuaaaugauuuuaacacucuugacaacauugaagaggcagacuuugcaucaaaaagcuuacucuaugacagacugagucaaaggaagaaauuuaaguuucccuaaaauaacuagauauaagauauccuuuuuuuuuuuuuuuuugagacagucucgcucugucacccaggcuggagugcagugguucaaucuuggcucacugcaacaucugccuccuggguucaagcaauuaucgugccugagccuccugaguagcugggauuacaggugugugccaccaugcccagcuaauuuuuuuuuuguauuuuuaguagagacagaguuucaggaaguugucugggcuggucucgaacucaugggcucaaguggucugcccaucguggccucccaaagagcugggauuacagaugugagccaccaugccuggccuucccuucucauauuuuaaguuauuuugggcacaaauaucagauucacucacacacacacacacacauauuuugagauggagucucgcuccugucgcacaggcuggagugcaguggcgcaaucucggcucacugcaaccuccaccuccccaguucaagcgauucuucuuccucagcauccgaguagcugggauuacaggugugugccaccacgcccggcuaauuuuuguauuuuuaguagagacgggguuucgcgauguuggccaggcuagucucgaacuccugaucucaggugauccauccgccucagucucccaaagugcuaggauuacaggcgugagccagcaugccuggccccaaucuuuaagauucuuuaauauaaccagagaaauuauaacauuaggagugacaugaggacgcuauaaaugguaugaaagagcucucauuaugauuuuuggcuguuuucuuauaccuuucuuccuacugcuuaagcaucuauagacauugaaugcugagccucacugagaguagugucaguaaaagaccuacucacuccugcacuaagaguaaaaaggaaauacagaaauccgaggacuugccagucagguaauuugaugcuucuuuauaaguuaccuuaagauuacuuaaaauuguggugccaauagcaaugaaacuucuguacuggcacaaagaaaugucuaguucagugaauaaauguuaauuuucauuguuagccacaagaugcuuuaacauuagagcaauaugaucagaauuaacugcaaaacaaugugaagaaaaccaacccauggaagcauuacugaccaggugccacauuugagcugcccugagauuucagcugugaagauggcagcacacccugggguguguugguucugcugucauccaagcccagagacaaguccuuccugggggcuuuaauuguggaaacaucaucagucaugcccaucugcuucugucuucuucgcuuuuuacuccauaacucaugacaaucuugccauaaagggagacugaaaaaaaaaaaggaauuaaauuguaaauggcauuucuuaacaaaaaaugcuacaguuacuauauagcaacaaaguuaugcccccaccccaaauaguucuugaagacuucauagaauggcucuguaaaacucuuccaauaaaaaucauccuuauugucccacuuccuucagggcuugcuuugccuuuacagauaaucuauuuuucuuuggcuuuugaauaaucaauaaauaaucauuuaucaaaauuaugaaugaagaauauauauucauaaaaauaggcuacuaugcugggcaugccuguaaucccagcacuuugggaggccgacauagguggaucaucugaggucaggaguuugagaucagccuggccaacauggcaaaaccccguuucuacuaaaaauacaaaaauuagccaggcgugguggcgggcaccuguaaucccagcuacucaggaggcugaggcaggagaauggcaugaacccgggagguggagguugcggugagccgagauugcgccacugcacuccagccugggugacacagcgagacuccgucucaaaaaaaaaaaaaaaaaaaacaccacuauugcuguuggugcaaccuuucaaagucaguucuuaugauaguacaucauacacugaauaagacaugaaaaagaaggcagaaaaauaugccauuuccagccaggcacaguggcucacgccuauaaucccagugcuuagggaggccaagacgggaggauugcuugagcccaggaguucaagaccagccugggcaacauggcaaaacccugucuuugccaaaaauacaaaaauuaguugggcaugauguugugcacugcagucccagcuacuugggaggcugaagugggagaauagcuugagcccaggugguggugguugcagugagcugagaucauguaacugcacuccagccuaggcgacagaaccaggcccugucacacaaaaaagaaaaacaugccauuugcagaaaccagauaugggauaaaaaaguaguaaagggccaggcgcagcagcucaugccuguaauccuggcacuuugggaggcuaagguggguggaucacuugagcucaggaguucaccagcaugggcaacaugcugaaacccugucucuauaaaaaaauuagccagucaugguggcacaugucuguagucccagcuacucgggaagcugaggugggaggauggcuucagcccaggaggcagaggcugcagagagccaagaucaugccacugcacucuggccugggugacagagccagacccuaucucaaaaaaaaaaaaaaaaaaaaagaguaaggcuagaacauaacauuugugaagaacuuaacaguaaaagcuuacuuuuuacuaacuugcuugucuauccaaaugcucuagaauuaaacugaugcuacagacgaguuuucaaaauagguaauccuggcauagagcggcucaucauuuaucaacagaguugcgaauaacaacuaucaaaacugcccacaauuccuagucaauucuaucuuaaaguaacuucauacaacugauaacacuagagaauaacuuuugcuuaaagauacaaauauuugguuuauaaaugcuuucuucuuacccuaauuaaguauuuaauggaacguuacuguuguaccuauuuuaaagaugagaaacuugaggcuuagaaaggugaauaaacuugcccagaauaucuacaaauucccuuaagcaaccccaccugguaauauauaccuauaauccucaaccuggaucuguuuaccucuaggagguacccgaagacucuccaagaggguacaccuggaauuuuuuuaaaggaauuuccauauccauaugucugcuuuccuaagacugagcuuugaggauggccugcuuguuuaagcaaguucuuuuacaucuccucuuucacaauuagucauguuauaaaauaaaggcagaugcaauaauaugguugaaucuuagcaauauuaguuuaaaaagucauucccaaaauauuacaaacagcaugacgcgcuuuuauaaaauuaacaacuaaaauuuuuaaaauauaaccuuuuaugaguacauauagauggcaacaaaaaguauauacaaaagaaaacagggaugaugguuaccucagguggaggaaggcaaggggauagguugguggggguagggguaauaugauuacaguauguuauuuucagcauucuagcuuuuguuugguagguucauggcugcuuauuaacauuauuaaaaauaacuaaaguaacuaaaauaaauaaaagagagccaugcauggaccaaugaugagugacacaaggauuaugauuaaaccaagucuaugcaccugagguccaaaaacaaaacaaaggcauaccucucagccaucuuacuaugaugcauugccucagcguguaaaaaccuccuggaguaacaaacaaagggacaauuugaaauaucgauauugggaagcuuucaggcaucauaaacccgccaaagaauuuccuuucuaaguguuuguaugauaugaugugggucucagucucuguugggauaccuuaaauucagauauacuguaguacugcacagugggguaacuggagugauuccaccuuucuauccugaagcucagggaaugcauugcucuugaaggacagccccaugagagcaaagcaaaguaauccauuaaaaagggcuuuuguucccucccacaauuuaaaaguaagagauuauuuucuuuccuuuuuuuuuuuuugagauggaaucuugcucucgugcucugucacccaggcuggagugcaguggugcuaucccggcucacuccaaccuccgccucccagguucaagcaauucuccugccucagccuccccaguagcuggaauuacaggcacaugccaccaugccuggcuaauuuucguauuuuuaguagagacgggguuuccccauguugaccaggcuggucuugaacuccugaccucaggugaucugccagucuuggccucccaaagugcugggauuacaggcaugagcuaccguaccuggcccccuuaaaaguaagagauucuuuauggaugaucuuaauacucaucucuaggaaagauaaauuuuacccaagaaauagcuaaaauaguacagguuacugaugcugauacuuucagauggaucaggaaugucuuccagauaaccaaacuuuuauuugcuuucuugaagguucaaaugccagcucagucacuuacuugaugugucuuaggcaaauaacuggaccucugugccucauuuuccuugucuuuaaaaaugggauuaacaauacuaucuaccucaugggguaguacuguauguuaacaugugcaagcucuucagcagugccucuuacaaaguaggcaauguauuaauucauguuugacaucacugaucauuuaauucauaguuuacaacuauuuccaucaaaucauuauugugaaauauucauucuaauggcaacugauauuuugucuuauaaauggcuuaaugcuuuuuacuugcuguuaaagaaagcuuacaggcuggcugcuagucuaauucacuuuccagcuauauauacuuuacguuugacagggcaucuaauacaauuaauggaguuauuucuaacuuuuuuguuuguuuuugagacagaguuucacucuugucacccaggguggagugcaauggugugaucucagcucauugcaaccucugccuccuggauucaagcaauucuuguaccucagccucucaaguaguugggauuacaggcaugugucaccauacccugcuaauuuuguauuuuuaguagagaugggguuucaccauguuggccaggaugguaucaaucucuugaccucgugaucugcccaccucggccucccaaacugcugugauuacaggugugagccacugcgcccggccuaauuuuuguauuuuuacuagagacgggguuucaccauguuggccaggcuggucuugaacucccggccucaagugauagguccgccucggccucccaaagugcuggaauuauaggcaugagccacugccaccgugcccagccuauuuccgauuuuuaaauaccccauucucucauuugauuauuccuaaaaaauugaucaaaagaguuugauacaccuuccaacuuucuaaaggaauaccauguauuucuucauaguccuuaccucauaaguaaugcauaauuuuaacuacucauuauaucauauugcaaaauagugagagauauuauauuauauuguuuauaaaauguuuuuauuuaaauauuggaucaaucugauacucuuuacuugauugcuuuaguaauguaucuaacaagauacauuccauaauuuguuacagauagcuuacagaauguuccuugaauguguuuuuaacauguuuguuuuuaaugaaaaaaugcagucagguguguucugauaaaauuaagucugauuuaggugauuugcuuuacaauaaggacacaguuuaugauuagaauauaagguaggcauuucccauaaauugagugggauaaaccuauaguuccaaguuuuggcaaaauacuuaaaaaacauaauuaagaaacaauuuuaaaaauggacuggcaaaguagcacugauauuacaugcugauuuccuaaucuuuucuagguauacuggauuaaaugugcugugaaaagaaacaguaacaaguacuagaaaaugucauuucauaagcauugguaagacaacugaaaaggcaaauaauuacuagacaagaaauccuucuuuagaucaugugaucucuaauucuucaucuuuuuuuuuuuuuuuuguaaagacagggucuccuuauguuacccagguaggucucaaacuccuggccucaagcaauccuccugcguugguucccaaagugcugggauuacaggcaugagucaccaugcccagccuccaauucuuuacuauccaaaaaacugaaggagaaagaaucuuaacaccuagaaggucauuagaaucuuuuuuuuuuuuuuuuuuuggagacagagucucacucuguugcccaagcuggagcgcaguggcgcgaucucggcucacugcagccuccguuucccaagcucaagcaauucucgugccucacccucuggaguagcugggauuacaggcgugugccaccacgccuggcuaauuuuuuaguauuuuuaguagagauaggauuuuaccauguugcccagauuggucucaaacucaugggcucaagggauccaccugccuuggccucucaaagugcugggauuacaggcaugagccacugcacccggccuaaaauaacuuuuuuuuuuuuuuuuuuugaggcagagucuugcucugucacccaggcuggagugcagcggcaagaucuuggcucacugcaaucuccaccucccaggcucaagugacucuccugccucagccuucugaguagcugggauuacaggcacacgccaccaugcccagcuaauuuuuguauuuuuaguacagcuaggguuucgccaugucggccagguugaucucaaacugcuggcaucaagugauccuccugcagugcugagauuacaggcaugagccauugugcccguccuuuaaaucuuuuuuuuuuuuuuuuuuuuuuuuuuuggaaauggagucucacucugucgcccagacuggagugcaguggcgccaucuuggcucacuacaaccucugccucccagguucaagcaguucucugccucagccucccgaguagccgggauuacaggcacccgccaccacaccuggcuaauuuuugcauuuuuaguagagacaggauuucaccauccuggccaggcuggucuugaacuccuggccuugugaucuauccgccuuggccucccaaagugcugggauuacaggcgugagccacugcgcccagccuaaaaucauuuuugaugaaaggcuuuucacacauaaugucgaaggaguuccaagaacucagugauauaacuaugacaaaacuccuuacauucucaaaugcuaauuuacaagcauacuuauagaacuaaaaaauaaaauuggaauucauauggaaauaugucucauucuagaauaagcaauauuaaucaacagauaugcaaacuacuugggaaaaaaaucucagcccucucuuucauuagguuguacuuccaacaaaauuuacuaauuuuuucuuuauuuaaaauggaaauauuugggcugggcacgguggcucacaccuguaaucccagcacuuugggaggccaaggcaggcggaucaccugaggucuggaguucgagaccagccugaccaacauggagaaacccugucucuacuaaaaauacaaaauuagccgggcgugguagcgcaugccuguaaucccagguacucaggaggcugaggcaacaagaguaaaacuccaucaaucaaucaauaaauaaauaaggaaauauucauuacugauauuuacaaugacaauuuaaucaagaaaagagcuuuuagucacaggaaacgugaaauuuaauuuccauuuauauacauguauuuguuuuuuaaaauauaugauacaguaaucaauaaaauacuuucuagcauaaauacuuuacauuagaauaaaagccuacgggaguaacauaaguucaagaugaaaauggaacaacguacaacugcucaacauuuuccaaaugacuauuggugguggauaucaaaaugcuaugauaguugcuuuccacuugauauauuuacaagagugauauaauugcucuacuuaaaaaugucagcauuuacuauguugacauuuuuaaguacagugguuacaucucuuggucaaaguuaccauuaccaauaauaaugguacaaaguaacauuauguucucuugaacauaauuaucacagagcaggaucaccaucaacauuacauucuugccccccaaacucuuaaucuaauucugauaaaaagaaggcaaucaaauccaaauugugaaauauuuuaccaaagagcuagcuuggaaucuuaaaaaauguugaaugucaaaagaucucuucccuagagagugauuaaagaugaaaaggacauaacaaauaaacagaaugcugaacuuugaaaaauucuuuaucuuaaaaaaaaaagucuauaagagaaauuauugggucaacuggggaaaucugaauguggauugaccauuaaauauucucauguuaaauuucauaugcuuuauaugguaugcauguagaauaaaguccuaguucuuacagauaugauuacauauuuauaagugucaccuccacaacaugauauccaacuaguucaggaaaaaaguagacagugauaaagcaaauguguccaacuauuauuaacuguugaaucuagguaaaggauauacaugaauacucuuuguacuauucuuccuauuuuucuauagaguugaaauuuuuccaaaucagaaguuuaaaaaauguuauuugaagggguacugagcccaaguuuuaagauuacugauacacacuaagaaaaaagcaaacaugaaacaauaauucaacagugaaaaauucaggucccucaugaugucagguaauagauccuuuuuggcucccaaaucaucccauaaaggccaaccauguacagcucaauaaaagcuuacugaagcugaauaugacagccucauagaaauauaauaagcacuaucuaacugauaagcagaagaaccaggauuugaacuccagagcccaugucuguucauuuaaaauaugcuauuuuuauuacauggaaacauuuuauuauuauagauaauaggcuugcuuuuaaugaugcuccuuaucauuuuaaaaauuauuaagaaaaggcugggcgugguggcucaaaucuguaauccuagcaguuuaggaggccaagguggguggaucaccugaggucaagaguucaagaccagccuggccaacauggugaaaucccaucucuacuaaaaauacaaaaauuagccagaugugguggugcaugccuguaaucccagcuacucgggaggcugaagcaggagaaucacuugaaccugagacgcagagguuguagugagcugagaucgugccacugcaccccagccugggagacagagugagacuuugucucaagacaaaaaaauaaaauaaaaauuacuaagaaaauaccuacaagguuucuagauccugucaaggaaugcaaaugaacguuuuccuuccccccuacuccccaaaucaauccuagagaaauaacaggagccauuugaaguuacagguucaagagaagccagcuauuuugacucccaaacucuauauauuucccccaucagacaauaauuccuucuauacaggcuucugauacuaacauucuuuucauucaaugauaagaaauuuauauuguauacuaugcuauaaaguauuuucagaaccucucuuacuuauuggacuaaugugaauuugagagcuggcuguacccuuuacuagauuuguauucuugggcaaguuucuuaaccucucugagccugcuuccuccucugugaaguggugaugauaauaauacuaauaccuaccuuauaagguuauaaagauuaauguaauaaaugaaaaaugcuuagcauggcacucaaaauuauggcuauagcuguaccaguaguaguguuaaguauuuaguagaaguaguauuagaauagcaacagcaguaauauuuuuuuuuuuuugagacggagucuugcucuugucacccaggcuggagugcaaugccaugaucuuggcucacugcaaccuccgccucgcggguucaagcgauucuccugccucagccucccaaguagcugggauuacaggcgccugccaccacgucuggcuaauuuuuguaauuuuaguagagacgggguuuugccauguuggccagacuggucucaaacuccugaccucaugauccgcccaccucggccucccaaagugcugggauuauaggcgugagccaccgcgcccggcagcaguaauauuuucuuagaguugaaauauauuauuaaaucuugaggucaaucaagccuaaaauuagcuagaaggcagcuguuuuugcuagcccuauggguaaacauuaagcaagcaucuauaucccagaugugcaaauuauguguauuacugcuguuuuaucuuuccuuuauuauauuuuucucauaaccagacaugaaauaucuuauuauauauguuauuaaaacuguuuuaauauaauaaauauaauaauaauauauaauaauaauaggauaaaaagucacuuacucugguggaggcauuuuugaggguuccacaucucggaggaacucgcacugaagagccuguucagcagugcagcgcuuacuaggauccaaggcaagcauguaaucaaauaagucuagcgcagcugcaggaauacuagcaugagaggauuacaaaaguuagauguguucuuuagacacaagcuuauguuucuuuaggagcuuaaauuauuuuuaauuaaauuuuaaaacuaaaacuaagaucauuuaaaaauaauuguaaauacuuuuuuaauaugugcauaauacuuuacuucaauaaauccgaauuuuccuuugaauaaauauuucauuuuuacauaauuuuuguaaccacuuucuaaacaauaguauauauuguuacuuaucgguaauuugcuguuauuauacaaauuaagaacugaacaguauaguuuuuucuaaagcaaaaugaaaacuugagcucaaguaacuugaaagcuguuccaguaacauuuaaaugaucuuauuaaaguucuuucacguaagcaccaaaccaaacacacaaucucaaaucacugauuccauaauaaugguaaaaugguaaucugcauguagcaaacagaacucaaaauuaaaugcccuagaagaauuauagguuuaccucagaucacuagagaauagacuaacauuuauaauucacuagaauuaaaguaaaacauucaugcaauaaggauguuuacacauccccuucuuacaaaacaaauucuucucuuaacuuucgacgauauugcuucuuugguuucaugguguugaaauaugguaguuugauuacaucaggccacacugcaggacauggacucccacauauucggcuaagcaacacacaaaaggaaguacaucacuaucaacuacauaaagaauacauacaacuguuauacaaaacaucaacucauuuuuaaauacacaaaaauugaagccuuggucuauaaaaacuuuuguuauuuuauucuuucuuuuuuuugagacagagucucacucugucacccaggcuggaguacaguggcacaaucucagcucacugcaaucucugccuccuggguucaagugauucuccugccucagccuccugaguagcugggauuauaggcaugcgccaccacggcccagcuaguuuuuguauuuuuaguagagacaggauuuccccauguuggccaggcuggucuugaaccccuguucucaagugauccaccugccuaggccucccaaagugcuggaauuacaggcaugagccaccacgcccggcccucguuaaauauuuuagucauccgaauuuaauuauuuaagaaauuaauuuauuuucaguggauacuuuuaacaauccaagcauuccaauucuuagaggacuuucauuauuugcaaaaugaaaucuuaaaacaugaugacacucaaaauaugugacuuacaccuuaaaaccaacauaaaaaauuuaugcccauaaauuaaggaacuagaguugaauauaugucccucucugguuuuuugguaccugucacuccuccuucccaugaauauaaggcagucuacaauaauagcagaaacggauuucuauaugaccucaggaagguaacuguaguguaaagacuacugcuaacugccaucaauggaaggacccuaaacauaacacucuugaaacauuaaaguucuucaauuuaaguagugcugcugaucuuaagucauaaagaaauuuuaacugcuuuacucucguuuaucuguaucuugaaaauccucauuauuuuagcauuaacuaguaaauccuuguuaugguaauuuguagaagaaaugcuauaacaaauaggcaacuccagcugguaaacauuuaaaaacuaacugauuuaguaauagguagaugaaaauuugcuuaaaucuacuuauuuuuaguauaccaaauuucaaggauguuuauuauauauaaaauugucagcuggucugcauauguaaaaagaaaacguugauguaucacugauuaaaaguaaaaauauuccaaacauacguaaauacaaaugcauguauaaauguauaugaacaaguaauggcucaaguugccagacauuuuuuuagcugagcuuuagaaugauaccucagaaacacauauuuauaggagaccuuuuauguuuuuaaagccguaugucacugaaauguacuuuuuugucucaauauauuuagcauuuuuauaaacccaagcuuuaaagauacuaagaacuuauucuuuacauaguucuacucucuuuugucuuaaaguccaauuuucacaaccuccucaacccuacucccuugaaaagaaagcccaacuccuguagcaugggcucucuagaucuggucccaaucugccuuccuagucucauuucccaaugcaucucuccccacaggccacuccuucaugucuaugcuaaugcuccuucucccuaaauucuauauagcugaauuauuuucacuucucaagauucagaucaaaaguaaucuaauuaauaaaagucuucuguauucuccaaugcuacucagaauuacuccuugcaugcuacugguuugacauuucuuucauccugcucuguauuuuaguuguuuacaggucucuuuucuauuucuuguuuuuguauacuuuuccaagaaaccauguaaacacaauuaaucaaccccaggcagacuguugugcacuauaauagaaguauaaagcauacuggaauccaggaaggcaaagauacuuucaagaugcagaaauacaagaaaacuuaaguuagggaaagagugaagaauuuugguuauaauuccaaggauaaguaaaccauagacaggugggaaauggaauaagauaaauuauguuaccagaagagagaacacaggcaaaggcauggaaguagcaaaguauagacauuugggaggaacacuauguaaaucaguguagggggaauacagggcucagggaggcucagcuggaagcauaaccugggucuagauaauacugcgguagguuugucuguagacagguuuuugcuauguugcccaggcuggucuugaacgccuggcuucaagugauccucccaccucagucuccuaaaguguugggauuacaagcaugggccgcugcacccaguccacaauacaguucuaagguacuuugccuauguauaaugaagacagaauuuaaaagcaaguuuuauauuugacucuugucugacaucggucaaauuacauugcuuaggaaucugcuccucuuuuggaaacuuaagauuaauuuuauuuugaagcuacgaaauuaaaugagcuagcaucuggcccauuaauagucuuauaauaaacaacaguuucauuauacuaaaauuuuauuucaauaaaauuuuauuuuauugaaauuuuauuucaauaaaaauuucaauuauuuuaucauaugugauguugaaagauaucugaguaccgaauuuaucuaacugaaagcaggauacacaauggaauacacauaccgaugcaaggaaaguuccuagaaacuagagagguagacaugacagcaacugauaacugcauuuacaaaaucugugccugguggccagucaacuacucccaacaccauuuacuacugagaugcaucauacacuaagguauaugcuaaauccccaauuaccugagguauacuuugggaaucuaucgugauuccaucaaucuacucuggugucaauaccauauugugcuuuuaauauuccuugaaagucugauaggacaaaucuccuauccaccucuuuacuuauucuccucaaaauuuuauuacacaugaauuauaaucaauacuauaacacuccaaaagagaauccugcuaggauucaaccgccacucuaaauuuauagauuuagaaccaacuacugccuuuacaaugcuuaauauuucuaucuuagaauuaguguuucuauuucuuuccuuuauuuauuuauuuaucuauuuucagugagauuuuguguauuuccuuuacgggcuuuuuguuuuuuaaauauuuuguuuuuuuuuuuaaauagacacaggguuccacugcuaccccaggcuggaggucagugaugcaaucauagcucccugaagccucgaccucccggucucaaaugauccuccugccucagcuuaccagcugagacuacaggaauaugccacuacauccaucuaauuugagacccaagcuggccucaaacuccuagccucaagugauccuccugccucagucuaucaaaguauugggauuacaggcauaagccacugagcccagccuuaaacauguuuuuagcccauuauauuuacuuucuuuuuuuuuuuuuuuuuugagauggugucuugcucugucgcccaggcuggagugcaguggcaccaucucggcucacugcaagcuccaccucccagguucaugccauucuccugccucagccucccacguagcugggacuacaagcaccugccaccacacccggcuaauuuuuuuguauuuuuaguagagacaggguuucacuguguuagccaggauggucucgaucuccugaccuagugauccgcccaccucggccucccaaagugcugggauuaugggcgugagccaccgcaccuggcccaugcccauuauauuuucuaagcaauuaauuagaaaagcuuggccaggcaugauggcucaugccucuaaucacagcacuuuggaaggccgaugcagguggauugcuugagcaggaguuugagacuaggcucggcaagauggggaaacccugucucuacuaaaaacacaaaaauuagcugggcaugguggcgcacaccuguaaucccagcuacuugggaggcugaggcagagaaucacuugaaccugggagguggagguugcagugagcugagaucaggccacugcacuccagccuggaugacagacagcaagacuuuaucuuaaaaaaaaaaaaaaaaggaaaaaaagaaaggccaggcacgguugcucacgccuguaaucccagcacuuuaggaggcugaggugggcagaucacaaggucgcgauaucaaggccauccuggccaacauggugaaaccccgucucuacuaaaaauacaaaaauuagcugggcaugguggcgugcgccucuagucccaguuacucaggaggcugaggcaggagacucacuugaaccugggaggcagagguugcagugagccgagauugcgccacugcacuccagccuggcaacacagcgaggcucugucucaaauaaaaaaaaaaaagaaagaaagaaaaagaaaaagaaagaaaaagaaaaagaaagaaaagcuuuauuacaggaaagguuucaaauuuuauuuauuuauuuauuuuugagacaaggucucacugucacccaggcuggagugcaggggugcaaacaaggcucagugcaaccuugaccuacuggacuccagcaauccucccaucucagccucccaaagugcuagcauuacaggugucagucaucauuccuggccacaaacaaaaauuuaauaauauguagccaucugagaucguaggguuccuaccaguuuuagcaguuguuucuuugagguauuccagguauauaaaucauauaacccauguuagaauucaucuauauuuuuuucaaauguaucuuuaucacugugguauguuacauuauguggcaauuacuaaacaauguuaaaaugauaaugacaguacacaauauuggguaacuuuauuuucugauuuuaaugggagcacauucauuguuuagcccugggaagaaugaugccuuuggguuugaaaaacacauaacagaaauauacucacauauacacauacaaauucacacauauuuccuguuaaggaagcauucauuuauuccucucuacuauggauuuuaauuuuuguggcuuuuauauucuaagagugcuuuaguuuuaucaguuuugauuuuuuagaacuucuauaaccaucaucaucugcauuuucuccccaggcuacuuaaugugaauuuuaucaacagacuuccuaauacauauucaucauuauauucaaaggaagaauaccauccaagccuaauaaaaguacuauuauuucaauguaaugcuguauuuuccacuuguuaaguuagauguuguacaucaguauucguauguaagacugauauacagcaacaguuuucacaagugggguccaaggaccacugagcguccccuagacacuucaaggucuggcaggucaaagcuauuacuaagccauuauuugccuuuuuccauguguugauuugcacuaaugguacaaaaccagugguaaaacuaccagcaccuuaacaugauucaacucaguggcaacaaacuauauuaacaggauguagucuucauuaucaugcaaauuucaggguggggagaaaagccaguuucacuuaagaauguacuuguuaagugaggugcaguggcucaugccuguaacuccagcacuugggaggccaaggugggcggaucaccugaggucaugaguucgagaccaaccuggccaacauggcaaaacccugucucuacugaaaauacaaaaauuagccgggugugguggugcgcaccuguagucccagcuacucaggaggcugaggcaugagaauugcuugaacccgggaggcagagguugcagugagcugagauuauaccacugcccuccagcuugggugacagaaccagacucucucaaaaaaagaauguacuuguugaagcaguacaaauuguuaauggcauuuaauucugauauuugaguauguaucuuuuuaauauucucugcgaugaaaugggaaauacucauaagcacuucuacuguacaacaaaauaugauaguuaucuugagaagaugugcaaugauuugacuugcgaacugaggcagcugcuuuuuucauggaccacuauuuuuaccggcaaagaaaacuaacaaacuacagucauccaaacuuggguauuuuccagacauuuucucaaauaggaacaaagucagcuugucacuugaaggaaaacaacaguauuuauugucaauuauaaaauuggaacuuuccagagaaauuagaauauuagaaaacuuauauccuccaccgugagcuuaacaguuucaaaauacugaaaagcuuuucugaugagaucaguggugguacaaauuauauaacauaaaacauuacauuuggaagaucuguucagugaagcagcauuuuucaaaugaccaaugcauaauaucacaaaaucaucacagauaaaagauccauucaaaguguaagacagaacaauggauuucaauauaguacacuauaaaauauuccuucauaugguuucagauuacacauuacaaccuguaaaaaacuagcaaucaucuaauuuuugugguuucuaagaagaauaugcaccauuauccaaaaaggcuauugaaaacagcacaucacagauaugaggauccaagugucaugucuauuaaaccagacagaucugccauuccaacaacuuuuauuuuagaaacuauagacguuauagacuuuaaaacauguuaacauuauuauguuaaaaugaauucauaaauaucuuuaauuucuaauacgguaaaucucaguagauacaaaaacucccgggaucuuuaauaauuugagcauaaagaaguuaugaaaccaaaaaguuugagaagcacaacucuacagaauauuuuaugccaucaguuuaugaagguauacaugauucauuucuuucaauaugggaagcuucccucuuuuccuaucuucugguacaaccaaaaucuaauuccuuuaaaguuuaaaaaauuucaccuguguaaaccaccuaggccugaggguuuguguguacugggugagguggcagauagagaaaaggauucauuuaauucuaaucuacuuucaauuucuucacugauuauaauccuuuuuaucucauaagcaauguacauugugugauauaaaggcucuucagcugacugcuagaaggcuuaggguaaugugauccucauguuuaaaaacaauuaaauauauauauauauauauggccacacagagcuuucugccuucauucaucccauuuugucccaauguguguuuuccauucucuuccuccaucacuuuuuguuuuguuuuguuuuuugagacacagucucgcucuguugcccaggcuggagugcaguggcacgaucuuggcucacugcagccuccaccuuccagguucaagcgauucuccugccucagccuucccagcggcugggauuacaggugcuagcuaccacgcccgcuaauucuguauuuuuguagagaugggguuucaccaugguggccaggcuggucucaaacuccugacuucaaguaaaccaccggccuuagccucccaaaguacugggauuacaggcgugagucauugugcccucuaucacuuuuuuuuuuuuuuuuuuuuuugggauggagucuugcuguugcccaggcuggagugcaguggcacaaucuccgcuuacugcaaccuccaccucccagguucaagcaguucuccugccucagacucccaaguaccugggauuacaggugugugccaccacacucagcuaauuguuuuuuuauuuauuuuugagauggagugucgcucucuugcccaggcuggagugcaguggcgccaucucggcugacugcaagcucugccuccuggguucaugccauucuccugccucagccuccugaguagcugggacuacaggugcccgccgccaugcccggcuuuuuuuuuuuuuuuuuuuuuuuuuuuguaguuuugguagagacgggguuucaccguguuagcccggauggucuugaucuccugaccucaugaccucaugaccuguccgccucggccucccaaagugcuaggauuacaggcaugagccacugugcccggcuuguuuuguauuuuagcagagacgggguuucacuauguuggccaggcuggucucaaacugcugaccucagaugaucuaccugccucggccucccgaagugcugggauuauagguaugagccaccgugcccggccucccuccaucacuuuuuaaucuaugcuacuucuauuauaaaauauuuguaaucugccuaaaauacuuucuggaacaaagcaaauuauaaauaaaauaacucauucacuaugguguaaagccauuuaaagcaaauuaguguuaucacucuugaucaguuuuacauguaucuguacuauacugacacuaggucucaucauuccugagccuauaaacaaccuagcauuacuguaaauaaggugagggaagaaauauguacugaaaacuuauuuacauuuaauucucacaacccuaagcauguuaucaguccucuuuuacuuuugaagaaaaaaacuuaagagcauaugggacccuaaaccauaagcgcaggaaguagcugagcuggcauuagaacccaacccuguaagauucuaaaggccacacacuuuucgguauacuccguugccucauuauagucagauuuguuuaucagaaacuucauuuucuucaugucugaaaagaaauuaaugcuaugaaaucaaaauugaagcaucuuuuuauguuuuguuguuuuauuucuguuuuuuugagacaaggucucgcucugcugcccagacuaaagggcaguggugcaaucacaguucacuguagccucgaccucccuuggguucgggugauccuuguaccgcagccucccaauagcucaggcuauaggugugugcuaccacacccaccuaauuuuuguauuuuuuguagagacgggguuuggccacguugcccaggcuggucucaaacuccugggcucuagugauccaccugccuuggccuuccaaagugcugagauuacaggugugagccacugugcccggucaaucucuuuauaaaauuauaaguaucuuaacaaaauaaaaacaugcugaaauauauaaacuagaaaaugaaaauuucuccucccuagucuucuugaaaguccauguucagauuaacaauuugagucuuuuguuuuaccuaaaugagaucaaucucaauauagccuucuguaacuauucaugcugcuuuuccauuucuuuaucuccaaaucaacuguuuccuuuuuuuuuuuuuuuuuuuuuuuucugagacauagucucacucugucacccaggcuggagugcaguggcacaaucucgacucacugcaaccucugccucccagguucaagcuaccugaggcaggauguuccugccucagccuuccaaguagcugggauuacaggcacacaccacugcgcccagguaauuuuuguauuuuuaguagagacagggauucaccauguuggcaaggcugguccugaacucgaccucaagugauccgcccgccuuggccucccaaaguguugggacuagaggcgugagccauugugccugaccaacuauuuccuucuuaguaacaguacagcaugcuauaaaauggauaaaccaagcuuuccccccauaugguucacugagaacauauuccuaaaaaaaaaaaaccaaauaugccucagagucuuuauuacuuugccauuucuucauucagaucucugcucaaaugucacuuaaagggagauaccuuucuugacccucuguaucaucuuagcucccaucauuuuucugcagguuaacuuugugauaaaaagcuggauacuauuugcuaguaccucccuuagaauucuuggauuaauaucuuauacaauuuuucuuuuuuuuuuuuuuugagacagucucaaucgcccaggcuggagcgcggcagagcaaucucggcucacugcaaccuccgccuucuggguucaagcaauuauuguguuucagccuccugaggagcugggacuacaggcgccuaccaccacgcccgguuaguuuuuguauuuuuaguagagauaggguuucgccaugcuggccgggcuggucucaaacuccugaccucaagugauccacccgccucagccucccaaagugcugggauuacaggcaugagccaccaugcccagccuaauuuuuauauuuuuaguagauaugggggaugggggcguucaccauguuggccaggcaugguuucagacuccuggccucaagugacccucccaccucggccucccaaagugcugggauuacaggcaugagccaccguucccggccuaauaucuuauaaaauuuuucauguugucuuugucaaguaccgauaugugugucauauugauuuuguaaaagaaaagauuccagguaguuuuauuuccuauguaguuuauuuauuuauuuuuugagaccaauucucacucugucacccaggcuguaguggaguggugcgaucuuggcugacugcaaccucugccucccagguucaagcaauucucaugccucagccucccaaggagcugggauugcaggugugugcuaccaugcccggcuaauuuuuguuuuuaguauauacgggguuuugucauguugccuagucuggucuugaacuccugggcucaagugauccacccgucuuggccucccaaagugcugcgauuacaggcgugagccaccgcacccagccuguacuuuggaguaaugguuaaaaguuuagauccuaagguaacaccuagcaguguuuaaaucucaauuuugccacuugcuaguuuuaugacccuggacgaauucuucaccucucuaagguucaguuuucuuaacuauaaagagaagacauaggguuguuacgaagcuuaacugagauaauucaagugaaacucuucgaauaaugcugauauuguauaugaacuaaauagauguuaacuaucuuuaauagaagcccuaguuuccaauacaaucaggaccaagaguuggcugguuggguuuaacaaaaaaaaaauggguuagaaggaaucguuuaaaaaaaaaagguuagaaggaaucguuuaaaaaaaaagauacacagauauauaauuuaaacauuuuauuuuaacugaaaguuuauaaauguacauuuguuuucccaucuucugacaaaggccaaggcuuucucuuuaaacagaggauucacugaauggaauucuguauuagcucucuuguacaaaccacacccauaacacaucaucaaggauuuuuaguuuugauuucuuuaaauaaaucuagaaauuaaaaacacuuucaaagcaaucuaauaccacaucuuggauuuuuauaacuuuucuaacuuacacaauuacuuguccaucccuaauuagacagcaaugucuuaaaguuuuuguaaagcacuguaucuacgcuuaaacuauguaauuauaauaauaaaaagcauaaaaauugaaaacuaacaacuaccuccuguucagcauacucuucaacuggugggauaaauacauagucuuacuagaaagugacagccuacuagcuacaagcauucagcuugccauguuaucaagccaguuuuucuuuacagagggaaugaagagcaucaauuaaucuaauaagacucuucaagagaagacugaauaagaaagcuuguacugaauuauucuuauguucuggaauaguuuaaagaacauuacaaguacugguuucuaaaagauguguaauaauuuaucaaagaaaauaauggggcugguuuuuuauuuuggagacauggucucacucugucaaccaggcuggaaugcgguggugucauuagcucacugcagucucgacuuccugggcucaaguaauccucucaccucagcuucacgaguaguacggaccacaugcucacccuccaaugacuagcuaauuuguuguuguuguuuuuguuuguuuguuuuaauuuguagagacaaguucucacuauauugcucaggcuggucuaaaacuccugggcucgagugauccugccucggccucccaaaugcggagauuacaggcaugagccaccgcauucagucuuuuaauuucuuuauacucucuuuucauaugaaguuaaacuaguagacuaauuuauauugcauauaugugugaauaaacccaagaccagaucauagguuucuucauaaauuuuacauuuuauguauuauaauucauuuuuauuuccuggguuuauuuugcugcuuuugucuaguuugucuguagaaugcuuaauuaauuugcuuuccuuuucuuauuuaguaguauauuuaagguugugauuuucuccuaagcacaggguuauuagcccauggauuuuuauacuuaucacucuuuuuaaaccuagauguucuaaagcaagcuuguccaacuugcaguccaugggcugcaugcaacccaggauggcuucgaaugcagcccaacacaaauucauacuuucuuaaaauauuaugagauuuuuuuuuuggaauuuuuuuuuuagccuaucaaucagcuaucauuaguguuacuguauuuuauguguggucuaagacaacuauucuucuuccagugugguccagggaaaccaaaagacuggacaacccugucuuaaaguuugauuucucuuuaauccaggauuuuuuagcauauguaaauuuuuagauaguuaagagacuuuguuguuuccauguuuauauuaauuucuaguuuuauucuauuuuagagaauuuagccuauaguauuucaacguuuuggaguuccuuccucuauuaauauauaacuaacuuuuguaaaugcccaauuagcacugaaagguauauuucuuuuuuccaagaguaucaguucuucuuaacccuuuuuacuugucuauugcacaauuaaaaagguaugacacauuuugggaggcugagacaggaugaucgcuugaguccaagaguuggagaccagccugggcaacauagagaaagccggucuccaaaaaaaaaaaaaaaaaaaaaaaaaaaaaaaaaaucacccagcaugguggugcaugccuguggucccagcuacuuggaaggcugaggcaggaggauuguuuggcuccaggaggucaaggcugcagugagccaugacugccccaaugcacuccagccuaggcaacaaagugagauacugucucaaaaaacaggaaaaaaaaaaaaaaaaaguaacauaaaaguuuucuauguuucaggugaacuccuucccuucccuucuucuuuuucauaauguuauuaaaagugaggcaacuggcugcuuuggaguugaagcacuacuaguuucuggcuucggguacuucugacuauagccaaguuauccccagagaagaagcaggcucuaacuagggcacucaucuuucccugcuguacccuauaguaaaaaccuugccuaaccaccaaaaagggcaauaguaagauuuuuaguuugauucaauuugucuguuuaugauaugauguugagguccuucucugguuacuauuuguugcuuuauguucauuuuguucaguugguaaaguaaaauucuguaaaucuguacccccuaucaauaucuuuccuaaaaaacuucauauauauuuugaaacuuucauggaaauuuuauaaguugcacguuuacauuauuacauaugaaacugaagcccccccaccuuuuuuuuuuuuuuuuuuugagacauaauuucgcucuuguugcccaggcuggagugccguggcacaaucucggcucacagcaaccuucgccuccuggguucaaaugauucuccugccucagccucccaaguaguugggauuauaggcgugggccaccacgccgggcuaauuuuguauuuuuaguagagacaggguuucuccauguuggucaggcuggucucaaacucccaaccucaggugauccacccaccuaggccucccaaagugcugggauuacgggcgugagaaaccgugccuggccaaagcccauuuuuaaaauuaaaauuauuuuaaaauauaagacgggcuggaugagguggcucaugccuguaaucacagcacuuugggagaacgaggcggggggcagucaccugagguuggaaguucaagaccagccuggccgacauggugaaaccccgucucugcuacaaauacaaaaauuagcugggcaugguggugggcacccguaaucugagcuacucgggaggcugaggcaggagaauugcuugaacccaggaggcagaaguugcagugaguggagaucaugccacugcacuccagccuaggugacagagugagacucuaucucaaaaaaauaaaauaauaaaauaaaauaaaagauaaagagaaaagcgacuaaaauguaugaguaauugcuuaugaacuagguccuaugauaggcuccaaauaaugaaggucuacgcuaggggguauaugcauguauuuuaguguguauacacacauauauagacacauauuuuuauguguauuuacaagaguauuuuuaaacaauaccccaaaacaugaauuuuucauuucuuucauaauuaaaaaauauguaucuagcauucauucucuccuacauuuacucuuccuugccagucuuaucuuuugggccucaaguccuuugacuuaaaaaaacgcacacaugcacgcacgcauguacacauacacaugcacccacccaggggcuuugauauccuuaauuucacuggaacaaguaucaaagugccuacauuucaguuuguccuccauuuagcagucauaagcccuccagagaaccauguuguucucuuccugaaaagacaaacuugggagaguuuaaauuuccuguggaguaugacacucucccaauucccaccaauauuauaaucagcagcuuaccuuauuaauucuaguugugcaaguuccugauuugcuugaaauauagguuuuuuagugaagaguucgccaaggauacagcuaauggaaaaaauacccgucauuaccaaaugaucuauuuuaauucacuaccaaaaguuucaaguaaaauaaaccaguaaauaaggcuaucuuacccacagcuccauacaucaauggcugguguguaucguucuucucccaguagcaguucagguggacgguaccauaaaguaauuaccuuguuaguauacggccgacuaaaaaacacagaaaacagucuuuagaguuaguauuuguuggaguaagacagauucucugaggaaauauuauuuuacuaaagcaaucccuauaauccuaacuaaaaacacuuucaucugccuacuaaaaaauacagacauccaaagguaucuaauauaagaucauaaaauguaugugagggcaaccuguuuaacuaaaaauucccuuaauauaugaagauaaaaacaaaaaguaguugacugauaggcugggcacgguggcucacgccuguaaucccagcacucugggaggccgaggcuggcagaucacgaggucaggagaucgagaccauccuggcuaacacggugaaaccccaucuguacuaaaaaaaaauuaaccaggcguggugacgggugcccauagccccagcuacucaggaagcugaggcaggagaaugaugugaacccgggaggcagagcuugcagugagccaagauagcgucacugcacuccagucugggugacagagcaagacuccgucucaaaaaaaaaaaguaguuuacugguauuaacugcaauuuggucaaagcaaagcuuuaguaucaacucaauuguugagcacuguuuuuccuuuccauaaaaaccuuuaaugggauuaacugauuuaaagagcguugacugguucugaucaaaucuugcuaaauuacuaauggaugacaagauauaguucaaauaaagaccaccuaacaaaaguuuucaauugaucauauuuuuggcaauuuuucacugauucacauacccacuguagugugugaauagaaaaaagcacacaaaugcagagugucuacucaaguaucuacuugaggucuacucugcaaaguagcaauacauaucguacuuuaucaaauaauuccuuuaucaccuuccgaaaagaggacauaaauauacugcuaccucuuuauuugccacagacaagauuauuuagucaaguuauauuagggucagguuugacgaaaacagcacaaauuaucuggcaauguaaaguguucaacgcucagagaauggucacguucuagcugauugacacgcuugaagagaauccuaaguagucagaggagguucuucggcugaucuguaguuacuuacuucagggagaucacauauauauucagaucagcuauaaacaucucuuuauauccagauguuuuccaaaucacaaggacucaaaagccauagcaaauuccccagaaaggcuguauuccaagcccauuuaccuaagcuuggcuugguccuggaccagucuuguuaaggaaauggagcauucaauuuagaaagcaauucccucuugccaccuauagauuugcaguuccaggcaguguaagaucugccugaccugcucugcccccauccagccaaauuucuccaaauaacuuaagcacuagcauuauaaaacuaucaauuugggcauuauagcauuaccacagauaggacuauaguuaacagugcuccaaagcuagcaaaaacauuugacuuugguaaaaacugugaaaagaggacagaauaagaugaauauuuuuaauaguaaauuaagauuagguuuuucuaacauuauuaauguacuuuucucagugauuuuugcuuguuuacuggaaucacuuaucuucacauaaugagcaagucuuucaaauuuuagcuacucuaguuaaacugaacuuaguaauucuuuaaaauuaugcucaccucuuuaugcuuuagcccccccgcccuuuuuuuuuuuugcgcuggagucucacucuugucgcccaggcuggaguacaguggcgcaaucucagcucacugcaaccuccgccucccggguucaagcgauuguccugccucagccuccugaguagcugggauuacaggcacccgccaccacuccuggcuaauuuuuguacuuuuaguagagacaggguuuugccauguuggccaggcuggucucaaauuccugaccucaggugaucugcgcaccucggccucccaaagugcugggauuauaggcgugagccacugugcccagcugccuuauccccuuuuaauaaaauccuuucccuauuuuucucauucaagugcuauacuuccuuuacaacacaguaaaagaugcauauucauaaagucuaaucucuauuaauaauauauuuaucuucacauucuuaaauuuacaucauacuuaccugucuuaacucccuauuuuguauuuucccagaaaguuaaaaaaccucguaacauucuuuauuaugaaccccacacacaaagcccaaacaaugcugggcacaggucaggcaccuuaauguauauugcccucuaacuuuagaugacacaugauuuacuggguggaagaacaaaauuuguaaaaauuaugacaacuaguuucucaaacacaucaaggaucuaugaguauaucaaaccuauacaaugguguuauaaaagugcaacuggauaacuaggcucaaggaaauguuuaaauuuauauaaaucuaucuacaaauaguuaauuuuuauuuuacuuuaaaaaauauuuuuagugucuuguauuuuuuaaaaaaucuuaaaaauuaaaaguauguugaaucguagagaaacuaaacaaauucaggugacuaaaaaggaauaaguaaaagauuauuuuauauauuguauaucaaauucuaagcaauauguagcaucaucuaaugcaauauuuagcagucaccuuagcaaacuagaauauacuuuuuauuaauugcuauaauguuuuauuaauucagacgugaaaauaguaaauuuucaaaaauaaacacaaaaccacaugaaauauauuucuaacuguacagaaaaauauuuaacguguacuaauuaauggccuuuccaaaugcuuaguuucuguuagacaagaaauaagaacuaggcaaaauacugagacaaaacauucaacuguaaaauuuaaucuaggaaguugaauuuuaaaacacugauguaauuucaaaaauauggaaauguuuugauuuaugaagcaaacaaacauucagacugauacauacuuuuuauaaaacaaaaaguaccacacucuaaaaauuauuuuuacauucaaggaagugucaacggaguagagaucaaagacuaucuguucauugauagauuccaauacuuugccucugaacaaucccaagaaggcugggugcaguggcucaugccuguaaucccagcacuuugggaggccgagguggguggaucacgaggucaggcauucaagaccagccuggccaagaugguaaaacuccaucucuaccgaaaauacaaaaauuagccaggcgugguggcaugcaucuguaaucccagcuaauugggaggcugaggcagagaauugcuuaaacccuggaggcagagguugcagugagcugacaucgugccacugcacuccagcccgggugacagagcgagacucugucucaaaaaacaaaacaaaacaaaacaaaaaacaaaaagcaaucccaggaauuccagagauggagggcagggaagaugagauacgguuauggccuucccuaccuuaaggccugauaagcugcaccguauccacaacaaaccaagcagugugauaaggagugugccccuuggcuggcacguuuuccaccuccuacuggucuagauauauauagaaaaacagaacaaaauccuagauccuugaaguauuuggggguucuagauaaucucaguuaaaauuuauaaagcaggguugcugccuuuguuaaagaccauucuaagugaaaaaaaucauauaaaaugaaauaccuaaaccagcucuaaaauguuucauuuuuccaacaacauaugauaaagucuguacuucuuucuuccugcuugaaggcaacccccccauguacuucuuuuauacuauaauucauacuguuuugagacaaagagagucuucaguaaacuaaauucaucauauacacaaaaugccaugucaucuuuaagacauucacaauccauugcagaaaaaucuaucaaaccuacaaaagaaaucugggaucuauuuucuaacaccuacccagcuuuuaaugucaaaaauccaagugucauucuugauucaucuuucccucaaauuuccaaacaacuucugccaauucuacauccaaaauagauccccaauccaaauaccuaguccaagccauuauucuuuucacugguaugaccacaacaauaucuuaacugguuuccuggcuuccaucucuaauugcacccccccgcccgcccugcccguuuuuguuuuuauuauuuuauuuauuuuuuuugagacagagucucgcucuguugcccugaauggaauucaguggugcaaucuuggcucacugcaaccucugccuccuggauucaagcaauucuccugccucuggaguagcuuggauuacaggcaugcaccaccaugcccagcuacccuuaacuucuuuucaguuuuuuuauuaagcauaaaaccagguaucaacugcuugcuuaaaacugcccagugauuucccacugcaaucaaauaaaauuuaaacuuuacuucaguugauaagacuguacagcaaggaucuuaccuccuauuacacugggcaaccuuugaccuuaaaccucccaagucuguucucaggccguacugaguuccuucuccuuuguacuuggaauguucuuggcccaggucuucauuaaguuuucccuuucucaucacucuggucuuagcuccaauuuacuuccuaaaagaggccuaucuuaacuccccuaacgaaaauuacccaauuauccacuaccaccccuacuuugacacuauagucguuauuuuauuugcuuuguagcacucagcuauuuuaaauuccucacccuacauaugcauugccuaacuuauuaauacuuucauauaacauaacuacauaacaauaaacacaaucuuuucucucauguucuuucccccuauuugaacuccuguuuuucuccuuuugauaucuuccaagaaaaauaacuuuuaaauuccucuaucaucacagugcuauagagaaacaaaaccaauuuuuucccaacugaugcugucaucuaagaucagcugucuuacuugcccauucuuauuacacaagcaaauuuagaaguccuauaaguaccuacauuauuaccuuuugcuaaaaaaugcaucucuguucuucuuuacugucucagcaaacagccucaccauucguggcagauacucauagcugcccucuaaaaaucuguuacuccucccuucuauggcagcuguccagcucugcuacauuucccauccucacugcaguuagguguggccacaugaccaagugcucuccaguggaacauaagcacgugugauaagugccauuucuaggccuggcucauuacucuccucccuccucuuuucucaccucuggcaccagcauuggaaggcauguguagaagaugacagaucuuccagucuucuucucugaauagcuguauugaagcagucaccauuugacuuggugguaugguuaaauaaucuuaauugugcacagggguaagcaacaacugcucaaaauuuuuuuuuucuuuugagacaguuuugcucuugucaccuaggcuggagugcaguggcgugaucucggcucacugcaaccuccaccuccuggguucaagcgauucuccugccucagccucccaaguagcugggauuacaggcaucugccaccacacacagcuaauuuuuguaguuuuaguagagaugcgguuucaccauauuggccaggcuggucuugaacuccugaccucaggugauccaucugccuuggccucccaaagugcugggauuacaggcgugagccaccacgcccagccaccacucaagauuauuaagugagaaauacauauauaaacuucucauucuuuaagccacuaacuuuugugguucucuuuguuacaaaaguuuagacuauccuaaccaacaaaucauucauccaguugcuuaagcagaaaccuuacaguaggggguggaggcagggauguaucucacaacacauucaaccaucaaggucuaacaagucuacauccuuaugauauaauuaaucugucuuuccacuaccugugcccauuccuugguucuagcuauagucauccuauuuagauuuacugcaacagcuuucuuaagugauuguucuugcuuccagacguauaaggccaaaccacuuuccaaagugcagucaaagugauagcgugaaaugaaacaugaauauguuauggcuauaguacacauugcuuccaucuagagaauaccuacacaaggccuauaaaauccauuaucauuugguuuuuguuccaaucacacuaaaccuucaguucccugaggcgggugagcaaauguucauuuuccagagaaaggggauaaagccagggagagaacagagcuggcaagaaaacuuuaaagaaguuagugguacuuuaauuguauuuuaaauauuuuuaauaaacuauuuuuuaaaaagcuuuuaaaagguaacaaugacaaaagacaaaugaaaaugaccguuacuaaggacaaggaaaaacaccugauuuacucaaaaauuuugcauaauagguaccaugccucacuuucuaccucucuaaugaaaaagaagcaaauauugagaaagugugcagacagaaguauuuaaucauaaaagcaaguuccaacguagguggagucagaagagaauaaggacaauuucagguaucacccaauucaguaauauaguauacuaucaaacaaaaauccacguuacgauuaggaugcuaauauuaaaucccguuaaccguuuacaaauguaaagacaaaaguaaaagagacugaaacuauguuuugguuccaggaaauuuaaagcccaggaaaauuaaagcacguuguaauaugaaaauacauuauccaaagacagacaaauaaaagaaaauccauccgggcgugguggcucaugccuguaaucccagcacuuugagaggcagaggccuaaggauugcuugagcccaggaguucggaaccagccuggccaacauggugaaaccccaccucuacuaaaaauacaaaacaaauuagccagguaucacggugcaugccuguaaucccagcugcugagaaggcugaggcaugagaauugcuugaacccaggaggcagagguugcagugaaccuagaugacaccacugcaccccagccugguugacagagcaagaaagacucugucucaaaaaaaaaaaaaaaaaaaauccagaauccucaaaaaugaauuucaaacuugcgcuauuagauuuggcuaccaacugucaacaucguagagaugaucuuguuuagaucacacaaagaagaagcaaacugaugugacacuacauauacgaugcuuuuuucuuucauggauuaaaaaacaaauuacauucuuguggugugucuauacccaguauuugcacaaaaagcaaauuaacucacaaugaaaaagaaacaggacugaaaaacauauagucgacuucuuagauguuaucaaauaaauguguacauacaaaaaagaaaaaucuaaaaaugaaaugaaccacuccacuuuacauaauuagaucaauuccaagcaauaaacucaauaacccaggaaaacacacacacacacacacacacacacacacacacacacacaguccuucugccauuaaauuggaaaacaaaauuuaguaacuucaauaaguuguuauuggauggcaagaaacuaaacuuuguaaagacccaaaaauaauggucucaacguuaacuauugugcauuucaauuucuacuuuuuuuaaaauagagaucucacuauguugcccaggcuggacucgaacuucuaggcucaaguaaucuccacaucuuggccuuccaaagugcuaggauuacaggcaagagacaccaaggccaguccuucugcuaaauacuuucauuuguaaaucucauuaauauuuuuuaaaagaaggcagacacuauuucuuugucugccaggaaaguaacacauuagaaaacaaaaucaaacaauucuuuuguuuuuccuuaaaccuuaagugauuaaccaaguauuaaaauuuaaagucaggccaggugccguggcugaccccuguaaucccagcacuuuggaaggccaagguggguggaucaccugaggucaggaguucaagaccagccuggacaacacagugaaaucccaucucuacuaaaauuacaaaaauucgcugggugugguggcaggugccuguaaucccagcuacuugggagacugaggcaggagaaucgcuugaacucaggagacagagguuggguugagccgagacugcgccauugcacuccagcuugggagacaagagcgaaacuccaucucaaaaaaaaaaaagucaucagacuuuaauauaacuuucaugggaaaaauuacagguaauuuuaaauauuuguugcuaucaaaauauuuuuuguuuauagauuucucauuagauauuucaagagcuuucaaacugcuuaaaauauaauuaaauccaauaugacaaagggagauucaaaaguagaaauaucacauaacuuccuaaucugcuggaagauuaaaccuacagcauaacucauuugucaaaaauauauuuggaggaugcaaagacaaaaagcaaaauucagcagacccuuuacuaaaaaagaacucuaaaaauugccaucagccuaaugguaccucuaaagcagacuugagaggccccuagaguucucuaccuggaagauacuucuagguaaucaaggcugaauucagagucuuaccagagaagcacucccauauaaugaaaauaaucuuucugucaaaagauccugagcucuacuacuuauugguugugugaucuugcaaaugcacuuaaauuuucuaaacuucuguaacuuuaaaauguacauaagaaugauaccuacaucauccaucucaacuuucuuuuaaaauaauucuugugaaaggaaacuauguauaauaaagugauguacacaaacguuaguuaaguuuguucuuuccuuuucccuucuuuuucuuaaaaaaaaaaaagaaaaauggugguaauauaaauuauaaucauguacuauaaauaauacauagaaugaauaauauacucuaaacacauaaaagaagaugugcccaaugaugccugugggauucaggacagauuucaaaggcgguagggccugaauugcacacugaaagaaaaaaaaaauuugucaaacucaggugagaaguauaauuacauacaaaagaaacagcuuauguagauucacaaaggcauucaagagcacagcaaguuuagggaacuacaaauaguucaacauugcuauuaucaggggggcuggaauggcagaagagaagaccauaagggagaaagaccagaggacagaaaaaccaauacaauucuauuuacaauggccuauaugaggugacuggaaaccuuuaacuaaaacgggaaauaaaggaaaaggaguagacauuuuucuggggaaugaaauagauagguuuuguaacaagguuuaauuuaggguacccaaaucaccuggguagagauuuccaauaaacaaaaggucuggagaccagaagaaagaucaaggauuggaauucaguuuuguaaguauucagcaguaaugucucggaugauauacccccaacagaaggaggggggaauucuuuccacuuuauaugcucaaaaaugaagacuacuccauuagaguugaagggagaacaauuuaaucuugaucuuacaguuaaaagucaaugaucuaaaugagaucuccuuuccugaagcuuguuuaaucauauuauuuauugucauucaucuguuauuaguaauuuuuuuauuaccaugguuccaaucuugucuagugauucucagaagauccuuuucauuaccuagaauccccaaagcucccugcacucaucugcaucaggaggauccuccagaugaagaucaccuucucccagaucagcaucaaccaagcacuuaucaugaaugcagucaauguuuuagggaacauaaaacacaaaagaauaaaauaugguaauacuaucuuccucucucauuaauaccuucaacuuuaggaaaauuuaguuuugcuuucaauaacaauguucugaaaagccacuagauggcgauacugccuucaaaaaggugugugcguuuugggagggugguauuagugagcuaaugcucuaaggcccuuuucauuuuucccuucucucuccuuacuggaucaucauauggaaauguaguaugcuuucugguuauuguuuaaaaaacuuucauuuugaucauaguaauauuauuaaagauacguuuuucagggcugggcacaguggcucacaccuguaauccuagcacuuugggaggcagagguggguagaucacuugaggucaggaguucgaggccagccuggccaacauggugaaaccccgucucuacuaaaaacacaaaaauuagcugggcgugguggcaggugccuguaaucccaucuacucaggaggcugaggcaggagaaucgcuuaaaccuaggaggcggagguugcagugagccgagaucacaccagugcacugcagcuugagugacagagugagacuccgucucauaaauauaaauaaacaaauaaagugucacauuauaguuucuucucuagaaaaugaggcuaguuucaauuaauauggaaaacuuuuuuucauacaggacggucacauaaagagagaaagauacuccauccuuuugaaaaccacuggagcaaugacuugguaaaauaaaaacuaagaagagggaaacauuguagcugucagaaaaacuauacuuaaaaaaccauauacuaaaagaugaacaguuaaugaagaaauggggcaaaaaucucuauucucaaguuuuaaaauucccaaugcagaaugggacaaaguauaaaucccaauguucaaaaugagaaaaugacugaaauuuaagaaaucauuuuccccucuaauuuuaauccagugguucucuuucuuucuucaauaggcacaugaagagcagauccacauuggucacagacccccaaguacuagcuguaacuccacccagcuuuccucaaauucaaaaaaggaacauccaaaaucuaaugagagcugugguugaugcuauuacaguuguaagcugaaaacugcucuauuuacaaacaaaaaaccuuacacaaaauucuugaacaauucaguuauucgaucuauauuaacuacuuagaaaauaaaaacacuucaaagugacuuuauacuugcaugaguauuacaguaaggcccuaccuggcucucuguuuauaaugaagcagaaauaugaaugaaaaaucauuuguuacauauuuaucucaaaaaauaucuagaaaauuugagacaauacaauaaaucuguuaaagguagauuucuuuuaaaaucacaguuauuaagguucacuagagcaacauauguauuuuaaagguauuccauuauauuaauacuaccucuccaggagauucugaagaaaucagaauuauucucuuaaaaaaaaaaaagagaaguuuuaaaggaguauauaaaccccauaaugauaggauauuugcucuuaaaacaaaaugacagacugaauuuuccucuuauacauuuaacugagcagaaaaauucaguauacauuaccugaagaugcaaaguuaugggacuuuaaaacucugguucucuaaacucaaaauuucuacaucaauccagcagggcaacagggaccauggcccagugaacacaccacaccccggcacuccaauggaacccaaauuauauuuuaaaaugaaaaucaaugggaaaauuaagccucauaauauaaaauuuggcuuuauaaucagcuuuucugaaacauaucuauuccaaaugugcacaaauaucugcauaacaagaaucuauuagauuaaaaugguaauuagcuguuuuccauuccauaggaaaggauuuacauaauuaacaacagacacaaacuuauauuaagcaaaaucuaacuacagugaaaucucaaccagcuuagcagauagaauucuuaauuaaccagaacuugcccaaaauaauagccacauuaauuuagucauauauaugcuucucagcugggcaugguggcucaugccuauaaucccagcacuuugggaggccaaggcaggcagaucacuuguggucacgaguucgagaccagccuggccaacauggcgaaauccugucucuacuaaaaaauacaaaaauuagcugggcaugguggugcacaucugcagucccagcuacucggaaggcugaagcuggagaaucgcuagaacccgggaggcggagguugcagugagcugagaucacgccacugcacuccagccuaggcgacagagugagacugucucaaauaaaauaaaauacauaugcuucuuaaacagcagaagaaaaaaauauacuucaaguuaaguuuuggauuaaguacaguucagaccaauuuuuccuuucaacuucuaccaagaggcacuauuauauaugacagaaagaauaaaaaauugcgaauugaaaacuuaacuauacacccuuggcucugcuaacauuuuuugaucuuuaaagucacucaacccuucacaauagccaggauagggaaucaacguuaagcguccacuaagagauggacggauaaagaaaauguggccuguaaucccagcuaucgguaggcugaggcaggagaaucacuuggaccccggagguggaggcuguagugagcugagauugcaccacugcacuccagccugggcgacagagugagacucugucucaaaaaaaaacaaaacaaaacaaaaaaaggaaaauguggcauauacgcacaaugaaauacuauucaagucuuuaaaaaacaaggaaauccugucauuuaugacaacauggaugaacgugaagcgcauuguguuaaguggaauaaggcaggcacauaaagacaaauaacucaucauuucacuuauacgugaaaucuaaaaaaccucaacucauagagguagagaguagagcugguaguuaccagauacggggcauagggaguauggggggaagaugcuggccuaaggauauaaaaguucaguuagacaaaaguaaauucaagagauuuauuguacaacuuggcagcuacacuuaauaacaauguauucuugaaaauuguugagaguagauuuuuaaguguuggcacacacaaaaaaaaugugggguaaugcauaguaauuagcucaauguagccauuucacaauguauacauauuucaaaauuaaaaaaggaaacuaacucagcccuuucugggucucaauucgcucaaaugcaaaaugagggacauagcuuuugagcuuuaaaacaguuuuaaacuucaaaaaaaaaaaaacacucauacaacccuuuccuaaaauaaaauguuaauuuuaaguguaguaguuaaaacaaauaaaaaccaaguaacucuggugaaaguugguacagaggacuggagguccaaucacaaaaccccauccacagaacacuuucuuuccuuucucucucucugucucucuuuccuuccuuccuccuucccucucuccucccuuccuuuuuuuuuuuuuuuuuuuuuuuuuuuggagacagucuugcuggaguacaguggugugaucucggcucacugcaaccuccgccucccagguuuaagugauucuugugccucagccucccaaguagcugggauuauaggcgugcaccaccaagcccagcuauuuuuaguagagaugggguuucaccauguuggccaggcuggucuccaagugcugacccucaagugauccgccugccucugccucccaaagugcugggauuuguacaagcaugagccacugcgccuggcccacugcacacuuucugagggguuucauggaacuugaauagauccaaaacauaucacuuauaaaccucuacucuagaacacuauauaaggaaaauacuuuccagaauuaugucacaggcgcugcaagauuuaacaaaauaagacuuuuuacucugaaaaauucaaacgagaguuuuuguuuauugcuuuaaccaaaaaaagcaaagauuaaaugaaaguaaacaucuauuccuaagacugcaaucaacugauguuucauuauauuaaauuauggugauauuaaagaaaugacaaaauugucauaaaauaauuuuaaaauucuuuaacuauauuauuucagauauauauauacacauauggaaauaaagacaaaaaaggaaugggguaaauggacuaaagauuuauuaagccaaauuaauuccguauuuuauuuacauaaaaccuacuauugcacaaaaauauuuuauuuugaaaucccauauuaguuuuaauaagacaaaucauauuucacuaccaccaggcacaaagaaagccaaguuggguauauaauccaacuuuagccagaaaaguucuacauuuuugugucuuauacagugaacauccucccaacaguugguuuaaauaaaggguucuagggaguuaaaaaaacaaagaacuguagauauaacaauaaaaucugucuaaaauaauaaugaaaccaaaguuuauaaguuuaaaaaugcaauuuaaaagguuuucauuaagaauauuuaauaucugaauacguauuagaaauuuaaguucacuucaguuacacuuaaagauguucauuuaaaaaaaucauuuuuaccuguugaagaucaauuuuuaaauugagauaauguauaaaauauuguaauuacaauaaucaacccaauaugguauaaaauuucaauguuuuauguacuaaccaugaaaaguaaacuucucuuuuaaaaaauaaaacuaucaauaagguauucuuaguauagcuucuaauacuaaacucuaguaucuacaauauucauuugaagguaugcuuaccuuucuucugagcuauacaaucgagcaaguccaaagucugcaaguuuuaucugcccucugguggaaauaagacaaaaugaacaaaagguauuaauuuacucuuaauugacaauacacauuuauauucuaugccuagaacugauuaaaaaaaaaaaaccuauguaaacuuuaacucugcucacacugcaauaucaucaagguaauacagggaaaggcaaguaguggauaaauucacaaaacaagaaaguaaacuauccuuggauagucuuaaaauuauuauaguaauaugauuauuauaauuacuguauuauaauauuagaauaguauuuuauuacuauucaguuccuauuuagaaaagcauacuucaaugaaaauaaaaugagauccuuuuuauuacuuagcaguaagacaaauuucuuguucaagguaacagugcucaagaacgaagugacaucacuuuuaauuuguuuaauucuccaguuuuagaggggcuaggugcauagaacacugucuauuaauuaaaaugagaaccagccaugccuuauuuaaauuaacaaacaguaccaauuacaagagaauuaucaggguucaaauauaagauguuacaaaucuaagcuuauuuacauaaguuuuaaauaugugaauguguauguguguguacacacuuccaagaaguucacuuuacaacugugacugcuuuuuuaaaauuuucuaaaaucuauucuuaaccuaaagcugaaguuacauugcuuaucagaugauccauucacauuacuuggaauaauagcaaacagaaaagucaacuaaguauuauuuuauaugcauuacagacuauuauuagauuuuuuuuuuuuuuuuuuuuuuugagaccgagucuugcuugcuuugucacccaggcuggagugcaguggcacuaucucagcucacugacuccacucaacuccacuucugggauucaagcgauucucguuccucaggcuuucuagcagcugggauuacgggugugugccaccacaccggguuuauuuuuguauuuuuaguagagacaggguuucaccauguuggccaggcuggucuugaacuccuggccucaagugauccaucugccucauccucccaaaguguugggauuacaggcugagcugccccacccggccacuaacagcuauguaacacaacuuuugagguaucccaaguuauaauauuguugauuauuuuuauuuuuauuuuugagccagagucucgcugugucaccuaggcuggaguacaguggcaugaucucagcucacugcaaccuccaccuccuagauucaagcaauucucaugccucagccuccuguguagcuggcaucacaggcaugcuccaccacgcuaggcuaacuuuucuauuuuuuugguagagacaggguuucaucaacguuggccaggcuggucaugaacuccuggucucaagugauccgcccgucucuacuucucaaggugcugggauuacaggcgugagccacuguggcuggccugauuauuuuuacauaguuuguauaaaguaaacuaaauuuuaaaucuuuuuuaacauaaucaaggugcaacaucauguaacaccguaucuuuauuuuaaaaauuuuagauucggggguauauguguuuguuggugacauggguauuacaaguguaauaguagggguuaggcuucugggguacccaucacccaaacguuggacacuguaccuaauagguaacuuucaacgcucaccacccccgacauuccccgccgcuacgguuuccagucuauucucuccauguacauguccaugguaaaacucauuuuaaauauauauaaaguucauacccauaccuauuauuuagaaggauauuggaacauuuaauaucucuaugcaaaaaguucuucuuaugacaauaauccagacccuccaugagcugucucauaaaugacuuuaugugauuuucauuaaaaugaaccaagccugauuccaguagucccaucagaucaugguccauauauucaaacaccagauaaaaugcaccuaagaaugagaauaauuaauacauuagaaacuuauuccuacaaccuuuccauaaauucacaauuuuuaacaauaaaaggcugguagaggaagaauuaauccuugaaaagaaguguuacuuuguuacuuuaauaacauucaucuuucucucuggacuuaauaauauuaauaaauaaaucccaaggaaaacaucuaaucuauuuucuucuccccgcaaaaaaacaguuaugauuuuaaaaaaaaaaaaaaucacccugcuguucuccauauuguauaguuucuaggugugauuaauguuuuagacgucaaauugucucuuagaagcugaauaaagucaauauaguuuaucaaaaaauuaaaaguugguaaaagaacugcuuuuaauuaaaaaaaaaaaaaaaaagaguacaggccaagaaagauguuaggcgacuucuaaaugccucaauaaacauguaauuuaauucuguuuauacagcuccagaguaccuaaaagcaagaauuugaggaaaaacaauauaauuugaaauuacaacuuuauuuuauaaaaaacagcuuaguccugcuaccaaaaccuaaaauagcacauagcacacacacacaaacuauacaaacguacuuacgagagauuuagaaauccuaaaagaaacuuacacacaaacugaaugagaaauauaauucauuacauuugugaaaagcagaaaaacuaacacgaagacaaaaaaagcaucugaacuugguucagauaaguuccuaauuuuuaaaacagagcaaagaacucucgguaaacuugcaacagaaggagucuuucuuaaaaguuuauuaugguaccucccugaaaccaacaaccaaugucauauuuaauaggaaaggcuagauauuauguaugagauuaaaaacaaaaauugccaguggcucaugccuguaaucccagggcuuugggaggccaaggugggcggaucaugaggucaggagaucaagaccauccugguugacacagugaaaccccgucucuaauaaauauacaaaaaauuagccuggcauggugguggaugccuguaguuccagcuacucgggaggcugaggcaggagaauggcaugaacccgggaggcagagcuugcagugagccgagaucacgcuacugcacucuagccugggugacagagcgagacuccgucucaaaaaaagaaaaaucaauacucaaaaagcaaaagacagccgggcgcuguggcucaugccuauaaucccagcacuuugggaggcugaggcagguggaucaucugaggucaggaacaugaaaccagccugggcaacaugucgaaacccugucucuacaaaaacuacaaaaauuagccuggcguggugguguguuaucuuaaucccagcuacucgggggacugaaguaggaggauggcuugagcccaggaggcagagguugcaguaagcugagauugagccacuguacuccagccugggcaacagagccagacuuugucucaaagaagaaaaaaaaaaaagcaaaagacuucauauaugaagaaacaauucacuagaaaauaaaauuuaaaugacuucacaauagaaaaaaauuacuacuaaugaccaggacuaaacuuuaacaagaauuauacaaaacugagccaggcgugguggcucacaccuauaaucccagcacuuugagaggccaaagugggcggaucaccugaggucaggaguuagagaccagccuggccaacauagugaaaccccaucucuacuaaaaauacaaaaacuagccaggcaugguggcgugcaccuguaaucccagcugcuccagaggcugaggcagaagaaucacuugaaccagggagguggagguugcagugagccgagguggugccacugcacuccagccugugcaacagagcaagauuccaucucaaaaaaaaaaaaaaaauuauacaaaauucauuaauaaacaccaaauuguaaaacucuguauuuuucuuuucuuuuuuuuuuuugagacagggucucacucacucugucacccagacuggaguacaguggcaccaucacaacucacuauaucccugaccucugagcucaagugaucuuccuaccucagccuuccaaguauaguuggggucaugggcucccaccaccacaucuggcuaauuuuucuguuuguuuuauuucugguagagauggggucucucuauguuacccagguuagucuugaauuccccgacucaagagauccucccaccuuggcucccaaaguggcagauuacagguuugagguaccacgcacauauaaaacucuguauuuuaaagcaauuucaauaaaaggaccaaugguuuuucucuuuugucaccaggagcgaggagacuuaacuugacaaaauaauucuaaaauuauccuugaagaaaacaaaccagaguacuagccaaaacauuucugaaaauaaacacuugcccuacuagaaauuaaucugaccugugucauaccauagggacugacagaacaguggaaauaauacacaccagaaaacaaaucccaguuauauaucuaauaauuauaaaaauagccaauuuaagucagugaagaaagaauagauaaaauaguguuuugacaaauguauaaucccacaaggagguggacaguuacaucaaagaaaaaugcaauaaaaagccaacagauuucaauucauuaaaugaaaauguagaaguacugccuaaggaaacaauauggaagagagauaaaaggcaaaugauggcugcgcaugguagcucacgccaguaauccaagcacuuugggagaucggggcgagaggacugcuugaggccagggguuugagacuagccuggggcgacauggagagauccugucucuacagaaauuuaaaaauuagccaggugugguagugcacaccuguaauucuagcuacuuggggggcugaggcaggaggacuacuugagccccagaguuuggagacuguggcugcagggccacugcauuccagccugggugacagaaggagacagacccagucucaaaaaaaaaaaaaggagggcuggagcacgguggcucacaccuguaaucccaacacuuucggaggccgagguggguggaucgcuugaggccguaaguuuugagacuagccuggacaacaugguaaaaccccgucucugcuaaaauacaaaaaaaacagcuggauguggggcacaugccuguaaucccagcuacuugggaggcugaggugggaggaucaccuaagccugggaggucaagguugcaguuagcugugauugcgccacugcacuccagcccgggugauagagugaacccugucaaaaaaaaaaaaaaaaaaaaaagaaagaaaagaaaaggacaaacuggagaaguaucuauaacauauacuagauuaauauccuuaauauaaaaugagaucuuacaaaucaauacaaaaacggcugggugugguggcucacgacuguuaucccagcacuuugggaggccgaggugggcggaucacuucagcucaggaguucgagaccagccuggccaacauggugaaaccccgucucuacuaaaaauacaaaaaaauuagcugggcuuggugguacaagccuguaaucccagcuacucgggaggcugacgaggagaaucacuugaacccgagaggcggagguugcagugagccgagaucgcgccagccugggagacagaccaagaucucaaacaacuacaacaacaaaaaaagaaucaauacaaaaaaauaccaaucccacaacagaaaauaagaaaucaaaugaacugucaauaugcaaaagaaugccuauguccaaaaaacacacgaaaaauauuuaaucucauuacuaaacaaaauauacaaaucaaagcaacuguauaacacuuuuaaauugcauacucuuucacguggcaagacugcaaagauuuagcuguaagcaugaucacuaaagcaauguaauaauaaaacacuuaaaaacaaaacaauaugucaaaaaaguucuucugguauaucuuaugccacuccauguaacuuugaaaaauguuguagagauguaauuauugauguggaaauguacugagcaugcugaguaaaaggaagucaguuaucaaauauacacauaccgcuaucucugcuguuauuuaacauuauauugguggcauuauguaacacagaaagauaaaagacagcauuaagaguugcaugguccaauacaguagcuacuagccacuagccacauguggcuaaugagcucuugaaauguggcuaguuaaaaaaugcuacgaguucugguaugacuuugagaauuauuaaaaguauauagaaaaaaauuaaaaauaaaaaugcuaugagugcaaaacacauacugaauuuugaagacaguacaaaauaaaagaauauaaaauaucucaauaauuuguggucuugauuacauacugaaauaaucuauuagauacauuggguuaaauguauuauuuguuuaguugguuuuuuugagacagagucucacucuguugcccaggcuggagugcaguggcacgaucuuggcucacugcaaccuccgccuccuggguucaagugauucucaugccucagccucccaagcagcugggauuacuggugugcaccaccacuccuggcuaauuuuuguauuuuuaguagagaugggguuucacaauguuggccaggcuggucuugaacuccuaaccucaggugauccacccaccucagccccucaaagagcugggauuacaggcacgagccacugugccuggguuaaauacguuauuaauuucaaccuuucuuuuuuuaaaaugaaguuaccagaugauuuuaaauuaaaaugcaauggcucacauucuauuuccauuaaacagcacuuaauucgagauuuaagaauugacauaggaaagcuaaaacuaucuuuaaaugcagauaacaaguuuuuggccuccggagagccauaaacacucaaugacaacaaaaaaauuauuacaguuaaacagguuaaaaaaguagaauauuacauauaauagucacuaacaucaaccaccaguuaaaauauaaaauggaagaccccauuaguaauagcuaaucaauuaauuaaauuuaaaaagcucacauaagaaaugugagaaauccuuuaaacuauaaacacucuuacaagacagaaaaguacacaugagcaaauggauagcagggcuaaacaugauaaagauguuaauuaucccuauguuaguuuauaaauuagacacagcccaauuuuucacaauacuuauugguuguuuuucuguaauguauauccacguagaaaaauaauuaagaauagcaaaguaacaccugaaagagaaaggggguauguguacacacuaucagauauuaaaccaguauacauuuccaucguuaaaaagugugauacugguaaauaaacaugaaauaaaacagaaaauucagaaauauauccacauacauauggaccuuuacuauaugauaaagauggcauaucaauucaguguggaaaagauggacuuuuuaauuggugguauugggauaacugaauagccagaaaaagauaaaacuugucugucucucacacuauacaccagcauaaaaagcaaaugaaucuacaaaauuacaaaaaauuagccaggugugguggugggugccuguaaucccagcuacuggggaggcagaggcaggagaaucgcuugaaucugggagacagagguugcagugagcugagauugugccauugcaauccauccuggaugaacaacaugagcaaaacucaaucucaaaaaaaaaaaaaaagcaaaugaaucaguuaucuaaauuuuuuuaaagaacuauaaaaguacuuuuaaaaaaacacagaauuccuuaauaaccuaagaguagaaaaaaaguuccaacuaggaaucaagaaauaauuuauaccaagaaauaauaaauaugacaaauacgacuauguaaaaauaaaaauccucugcauggcuaaaaauaccacaagcaaaauuaaaagaauauagcaaccuggaaaaaaauuagcugcaacuuacacugcagagugauuauuaguaucaacuacaguccaggcacgguggcucacgccuguaaucccaguacuuugggaggcugaggcagguggaucacuugaggucaggaguucgagaccagccuggccaacauggugaaacucucucucuacuaaaaauacaaaaauuagccgggcauggugguucaugccuauaaucccagcuauucaggaggcugaggcaugagaaucacuugaaugcaggaaguggagguugcagugagcugagauccugccacugcauucccgccugggcgacacucugucgcaaaaaaaaaaaaaaaaaaaaaaauuagccgggcauggucgugggcaccuguaauccuggcuacuugggaggcugaagcaggagaaucacuuaagccaggaggcggagguugcagugagucacaaucgugccacugcacuccugcacuccagccugggcaacaaagcaagacacucucucucucucuaucuguauauauaaauaaaauaaaaacucucuaaauuagggggaaaaaagaucaacgaccuuacagaaagugagaaaaagagacaauuagcucauccgaaaaaagagcaaagugccccuaagugaaugcaaaguuaaaaacucuaaauuagggggagaaaagaucaacgaccuuacaaaaaagugagaaagagagacaauuagcucauccgaaaaaagagcgaagcgccccuaagugaaugcaaaguagcuuaaucuugcucacaauaaaaauuuguggccaggcacaguggcucacgccuauaaucccagcacuuugggacgcugaggugggcagaucaccugaggucgggcgaucgagaccagacuaacuaacacgaagaaaccccguuucugcuaaaaauauaaaauuagccaggcaugguggugcaugacuguaaucccaacuacuugggaggcugagacaagagaaucgcuugaacccaggaggcagaggcugcgguaagccaagaucaugccauugcacuccagccugggcaacaagagcgaaacuccgucucaaaauaaauauaaauuaauuaauuucccaaacuaaaacuugaccaagauacuaaauugacaaaaaucuaaaaguagaacuccagagucuacugacaaagcuguaagaaacacuuucauacauugguaguagaaauaacacaaaaaaaagcccucugaagagaaauuuggcaauaucuagcuaaaucacauucaguauuucccuuugacuuaacaaucccaauucuaggaacuuguaccaaaaauucacuggccaaaauacaaaaugauguaugcauagggcuauucaaugcagcauuauuuacacaaugaaaauaucuaucauuaggaaacuagcugaauaaacuauagcauacccacacagugcagugccucuaagcaaugcgugauuuuugucuacuaacaaaaugauuuuugucuacuaacauggaguaaacuucagcauauaugguuaaaugaaaagaaaaagguacagcagagcacuuacaacauugcuaccuuuuuuuauauauaaaaaaaggaaugugaauauguacaaaagaaacauuggaggaugaaacaaacauuuaaaauaguuacccauggguaagggagagaacaagaaaaagaagaauggaagugacacuauucugaauguaccuguuuuauaguuuagaguuugaaaccaaguaaauguuuuauauaauuaaaauacauuauuaaaucaaaaagggaaaaaaagcaaucccuaaaaaacuggaaacauauccacauuuagguggauuuauguuuaucaaauugguugcauaaacugucuacaauagaguauacugacuauauacagcugggggguauauuuuaaggacaaaaagaaucacuaagaaaucuuaaacugcauucaguagucuuuuuaguaauuaauaucagcauuguuacuuugaaauuauuacauguauaugguagaacaaagcaagcuauguuaauauuuuaggaaccagggcuuuuaguuuacaagaaagauaaggucaaagauguauaaauccuguacucugaaauugaaacugaaaucaucuacaguagcaagccuccaaaaugguccuaaaugauccucacuaucuggcauccaugccacgccacagugauucaaggacggucugugugaccaacagaauauuggagagugaaugaugugacuuccaagucuaggucauaaagacaaugcagcgucuaccuuacuuuuuuagaucauucaaccugggagaagccagccaccaaggcugucaggauauuuaagcaacuuuguggaaggcccauguaaagaauaagugagaccucccaucaagagaacaacuugcuagccaugugaggggagccaucuuggaaguggauucucuaaccccagucaagccuucuaacgacaacccuagcuaacaucucacugcaaucuuaugagagaccccaaaccaaaacugccaagccaagauucucccaaauuccugcccacagaaacuucaagauauaguagcuucuaccauaaucuuuuaaguacaacugccaaagaauugaauuuguaucuaaauaaacuucuggauuuaauuacuauuuagaggaaaaaagagggauagaagaacaagcuaacuaacacccaaaggaagcauuuggccaaauugaaaaugcagucuacucuccaauaaauaaauggaauaaaauguuuaaaaggcaagaagagcuacuauaaauuaugagacuuaaaauauuaauuaauaugaauaacaugccaucuuguuuguauccagguucaaacaaagcagcuauaaaaaacauuuuugagacaacuggguaaacgugaauguauaucauuagaugacauaaaauuauggcugauuuuguuaacuauaaggucucuuuucuuuuuaaauguaacuacaauuucauuaucuauugucucuccauaaucaaagacuaacuuuuauaauacaaugagccugagauucacuuaaaaauaauccaggaguuuuuuguuuuuuuuuuuaaguugacagggauaaguaaauuuagcaaaauguguuaacuauaaaagugaaagauggggacacugggguucauuauacuauuuccucuacuuuuauuuuuauauuuuaauguaauuuaauuuaauuuuuuuugagacggagucucgcgcugucacccagacuggaguacagugcacgaucucaacucacugcagccuccaccucccagguucaggcaauucuccugccucagccuccagaguagcugggauuacagguaccugccaccacaccuggcuaauuguuguacuuuugguagagacaggguuucgccauguuggccaggcuggucucaaacuccugaccucaucuacuuuuagauguuugaauauuuuaguaauaaugagucucuuaaaaauguaaauaaaauuuuagaaggcuuugaaauuauuaaauugaauuaagagauaaauuucauguuccuauauuuuaaaacugguuuucacuuuuuaucaagguuuuauauguguguguguguguguguguguguaauuuauuuauuuauuuugagacagggucucacucuguugcccaggcuggagugcagugguacaaucuugccaccacuuccuaggcucaagugcuccuccuccugccucagccaccccagcagcugggacuaaaggugugugccaccacacuuugcuaauuucuguaauuuuuuauagagacgaggucuuacuauaucacccaggcuggucucaaacuccugggggcucaagcuauccuccugccuuagccucccaaagugcuggauuacggguggaagccaagguuauauauuuauguaguuuaaagcagcgauucccaaccuucuuggcaucagggaccaguuucauggaagacaauuuuuccauggacuggggauggggggauggggggacggguggguggagggaugguuuugggaugauucaaguacauuacauuucuuguacacuuuauuucuauuguuauuacacuguaacauauaaugaaauaguuauacaacucaccauaauguacaaucagugggggcccugagcugguuuuccugcaacuagauggucccaucuggggaugaugggagacagugacagaucaucagacauuagauucucauaaggaguacacaaccuagaucccuugcaugugcaguucacaauaggguuugugcuccuaugagaaucuaaugcugucacugaucugacagcaggaagagcucaggcaguuaugggagcuauggggagccacugcaaauacagaugaagcuucacucgcucaccuuccacucaccuccuacugugcggcccaguuccuaaccagccacagaccaguaccuguccauggccugggggcugggaaacccugguuuaaggcgauguuuuucaaacugugggucaugcaaucaauugaguaggucaugaccugcauuuuuaaaaacauuuuuauauugcuucauauuuuuccgauauuguauuuaaaaauuaauaaaaucauauguaauguaguuguggaacuauaacaugccacauaaaauuucauuaugguaggaaagcugauauauauacauauccuuagaaaaauauuaguaucaaaacucuaagaguuuaucugugugaacagauaagugauuuuuacuuucucuuaugcugcaauuuucuaaauuuuucuagaaguauaauuuuaagaaauauuaucaauugugccuaacagaugaauaaggggaacagcaaauaacccaacugaaaguaaaugucaauguccacaaauaaagaauccagagaggaaauuauaauguuaauaaacauauguaagaugcuccauaccucaccaguuuucaagaaaguacuaaucaaagcaaugaugagauaccauucucuucuaccagacugacaacauccaguaauagccaaagaaaggaaacucauacacugcuauguuugggcaaaguaaucagacaauauguauuauuaaaaacacaaauauccuuugacuuagcuaucccacuuuuaagaguaaauguaaagaaauaacagcacuaguaugcaaauauacauguacaggaauauuuuuagcaguacuauuuauaauguaaaaaagcugagaaaacuugaauguccaucaauaaacaaagguugaauaaaucuaguauauccauauuguaguauauuaugcagcuagagauauguuauaaucuuuaauaagaaaaguaaaauauagaaaaaaaauuagcccugcagaugaccgguuucuggucuggaauuuaaggaguuaaaaacugccauuccauacucaaaacaaaagaaaagcaaaggugaaaagcaacaacucuucguaaagccauugcagaaauuggagucacagggcaaaccacugcccccaaaauuagagagagaggcaggcagguucaggauacagagaaccacaacuuacaacugcagaaagcuccuugggaaccauuaccaagguaggaaagccuaaaccaagcuggagguucagugugaacaaguuuuaauuaaaaacuacagcaggacccugucugagaggccuccacauuuugucaguuuuuaacaaccagaagcccugccagauuaucauagcgaagaucagaaaaaaauauguaguuaugaugaaauaugcccagagcauucuguccuuaacaaggccugacuucaagagaaauuaauuaucagagacuaaccuaccaggguuccaccagagccuuaccaaucuagaagggaaauauucaacuccagagcauucuagccuuagacuuaggguaaugaaauacccaauaccagcauccucuagcacuccugucucacugcagggaaaaaccaaaacuuagaaguacuuguagagacuacagaccagggacacagguucacuaaaagacugagaacaaaucuuuaggcuauagaacacuucccucccucuacgccuuaccacuauacaaauauggcuccuguauacuaaguggagaauacaacuaaacaaauugcacaccucagaccuuauuuaagaagaaauuccaaagaaaccaaaagacaacagggaagacaaaaacaugaacacuagaggaaauuuuggccucugauacuuacagguacagcaaacagugaacauagccuaaccccuagccagauaaacacaaaaccuuacacuaaaggccuauuuaccucaguuccuucuacaccacguacuaucucugacuuucaaugaaaaauuuuaaagcacgcuaaaacacaguuugaagaaacaagcaucagagucagacucagauauagcagaaauacuggcauuaucagacuacuaauuuuuuuaaagcucuaauuaauauuccuagagcucuaauggaaaaaaggugggcaaaaugcaaaagcagagaaauggaaacucuaagaaagaaucaaaggacaauguucaggccaggcaugguggcucaugccuguaaucccagcacuuugggaagcugaggugggcagaucaccugaggucaagaguucgagaucagccaggccaacauggugagaccccaucucuacuaaaaauacagaaauuagccaaacaugguggcucacacauauaaucccaaguacucuauaugaggaaaacaauaaaacucuaaugaaagaaaucaaaagaaugaagagaaaugccaugcacauagacagacuccacacugucaagacgucaguucuuucccaacuugcuguaugcauuuaaagcaaucccaaucaaaaucccagcaaguuauuguguggauuaucaacaaauugauucuaacguuuauauagauaguaaaagauucagaguagcaagaaaacauuuuaugagagcaaaguuagagggcugacacuauccaacuuuaagacugaccauaaagcuacaguaauuaauacaguaugguaucagugggaaaaaaaaaacauaacuagacuaauaaaacacaauacaaaagcucagaaaugcauccauuaaaaaaacagucaacugaucuuugauaauggaguuaaagcacuucaauggagaaaggauagucuuuucagcaacugcugcuuaaacaaggggacaccaacaagugaacaaaaugaaauuuagacacaaaccuuauaccuuucacaaaaauuaacucaaaauggaucaaagacuugaguguaaacugcaaaacuaaauuucuagaacacagaagaaaaucuaggugaucuugaguuuggcaaugacguuuuauacaagacaccaaaaucacaauaugugaaaagaagaaacuaauauguuggauagcguuaaaauuuaaaacuucugcucuuuggcagggugcaguggcucaugccuauaaucccagcacuuugggagaacaaggcauacggauugcuugaacccaggaguucgaaaccagucugggcaacguggcaaaacccugucucuccaaaaaauauuuuuaaaaccauacaaaaauuagccaggugcaguggcaugcgccuuuggucccagcuacucaggaggcugaggugggaagacggcuugagccuguggggaagaggcugcagugaaccaaagucacaccacugcacuccaggccugggugacagagcaggaccugaaacaaaacaaaacaaccgaagaacaacuucugcucuucaaaagacacugcuaagaaaacgaaaagacaagucagacugggagauugguauccacuaggcaugguggcucacgucuauaauccuagcacuuugggaggccgaggcaggaggauagcuugaaggcaggaguuggagacuacccugggcaacauaacaagaccccauuucucccaauaauaauaauaauaauaauaauaauaauaauaauaacaauaauaauaauaaauuagccgagcuugguggugagugccugcagucccggcuacucaggaggcugaggcgggaggaucacuugagacugggaguuugaggcuacaguaagccaugauugugccaccacacuccagcguggaugacagagcgagauccugucuccaaaauaaaagaaaaaagaaaacaaacagcccaauuaaaaagaaggcaaaacauuugaacagacaucucaccaaagaugauauaccaauggcaaauaagcaagugaaaaaaugcuuaauaucauauuucuuuucuuuuuuucgagacagagucucacucuguugcccaggauggagugcaguggcaugaucucggcucacugcagccucugcccccuagguugaagcaaaucuccugccucagccucccaaguagcggggucugcaggcacgugccaccacgucaaguuauuuuuuguauuuuuaguagugaccagguuucaccauguuggccgggcuggucuugaacuccugaccucaagugauccgcccaccuuggccucccaaagugcugggauuacaggcaugagccaccacacccggccuuaacaucauauuucaucagagaacggcaaauuaaaacaacaauaagauaccacuacauaucuauuagaauugaaaaauccaaaacacugacaacaccaaaugcugguaaaaaugugaaacaacacaaacuuucauuuauugcuuaugcagacacuacggaagacaguuuggcaguuucuuaaaagguaaacauucucuuaccauauauaauccaucaaucccugguguuuacccaaaggagcugaaauuaacacaaaaaccugcauacaaauauuuauucauaacugucaagacuuggaaguacccaaaauauccuucagugggugaaugguucaacgaacugugguacacccauacaauggaauauuuugagugaaaaaauaacugaguuauaaagccacagaaagacaaggaggaacuuuaggugcauacuguuaaguaaaagaagccaaucugaauagucuacguauuguaugauuccaacuacaugacauucugaaaaggcaaaacuauggauaaaguuuaaaaaaaaaaaucagugacagcaugcaguaacucacaccuguaaucccagcacuuugggaggccaaggcagacagaucacuugaggucagaaguugcauaccagccuggccaacacagcaaaacccugucuguauuaaaaauacaaauuagccaggcaugguggugcgcaccuguaaucccagcugcucaggaggcugagguugcagugagcugaaauggcacaacugcacuccagccugggugucagaccaagacucuuaucucaaaaaaaaaaaaaaaaaaaaaaaaaaaucagugguugccagaguugcagggguggggaaggaugaacacuggacuuuuaaagcagaaaaacuauuguuuauuuuugugucacucucagauucucugucuuugcaugccagacugacugaaugacuuucucucucucucucucucuauauauauauauacacacacacauauacacacacacacacauauauauauauauaauuuucucuucuaauuucaauggugagguacuucuguucucuagaaaagauauaguguauaguggcuauaacuacuacuacugaaauacucuccccacaugguuaguacuuaaaagagaugcuacuagugcuuuugagaccgcuaaacauggguuagaaagaaucagagcaaaagggguaggggaugcaaugaaagacagccagauagaaucaagaaaugacccugaguguccuuauccacuacuucagacaguaagaaucuaaucuaggccaggcgcagugacucaugccugcaaucccaguacuuugggaggccaaggcaggcguaucacaacgucaggaguucgagaccagccuggccagcauagugaaacuccgucucuacuaaaacuacaaaaaauuagcagggcacgguggugcaagccuguagucccagcuacgcgggaggcugaggcaggagaaucgcuugaacccgggaggcagagguuguggugagccaagaucacagcacuguacuccagccugggcaacagagcgagacgcugucucaaaaaaaagaaaaaaaaaaagaaucuuuucucucucucucucucucucucagccucccgagaaacugaaacuacaggcgcgcgccaucacgcccagcuaauuuuuguauuuuuaguagagacgggguuucaccauguuggccaggaugaucucaaucucuugaccuugugauccgcccaccucagccucccaaagugcugggauuacgggggugagccacugcacccggacuaaauuuuuuuuuuuuccacacagucuugcugucaccuaggcuggugugcaguggcacgaucucggcucacugcaacuucugccucccgguucaagugauucuccugccucagccucccaaguagcuggggcuacaggcguccaucaccacgaucgaaugauuuuuguauuuuuugguagagaugggguuucgccauguuggccaggcuggucuugaacuccugaccucaagugauccacuugccucggccucccaaagugcugggauuacaggugugagccaccacgcccagccuuuuucuuaauuuuuuaaaauucuaggcuacaugguucaucugaguuuucucaaauuguugcaaaucuccaaaaaaaaaaauuuuccaauauauuuauuuuaaaaaucugcauauaagugaacccaugcagcucaaacccaugauguucaagggucaaccauauaucuaauauauuuuuccauuucuguuuuccuuuuuuuguaauauaguaucaaugauauauacuaagcuguuaacacuggauuuggcaaaaaguggcaaaagaaaaugggaaauuaauuuucucuuuauguauauuugcauuauuauauauauuuauauauauuugcauuacuguggucauaguaaacucauuuauacuucuuacagaggaacuuuauuuugaaaagaaaaauauuaaggaauuuauaguuaaaaagucccuaaaagacaagagauuuaaaauucaauaaaaguuggaaacaauaaguucuaaacucacaggcaaagcaaauaagacucagugagaccaccaucaggggaauaaauaauuguguuauuugcauuucugauccuuuucauugaguagauaguuaaguaucugcccaccaacaggucuguaaaaacccugguaaaaagucaacucaggcugggcgugguggcucacaccuguaaucccagcacuuugggaggccaaggcgggcagaucaugaggucaagagauuaagaccauccuggccaacauggugaaaccucgucucuacuaaaaauacaaaaaauuagccaagcaugguggcaggugccugucgucccagcuacucaggaggcugaggcagcagaaugacgugaaccugggaggcggagcuuguagugagccuagaucaggccacugcacuccagccuggcgacagagugagacuccaucucaaaaaaaaaaaaaaaaaaagucaauucaagcaucugagauccugggaaucacaaaggaucugacuucuaccuggugaaaacccccacucugaucaacaagagaacgaccuucagcugcuggggcauucuaacaccauacugaaccucccuaauccauacuuauuuacuuggaaugucacucuugcaagugacagaaaacccaauguacacuaauuuaaaaaaaaaaaaaaacaagguuaauuucucaaucuucugagcuucuacuguaauuauggaaaaaacagagcuaucaaaauccuauggcaagggccuacguuccuucucuccauuucucagugcuugcucuauucucagaaccuauccugucucaagaugauuacccucacacucacacugcacagguaagaggaccucacucuguauaggaaaucucagcguuaagucucaaccucguaagagaacuguaaggcuccaacugcccaaucugagucauguacccguagaaacagagcaggcuucacagcuacacagacugagaacagaaaaaaggugaauccucaaaaaaaaaaaaaaaaaaaaaaagcccaaggguguuauagaaaguaagguaaaccagugguggguggccccaaaacaugucaaauaccauaucucucccaaaguagggcaaauaccaagcuguuuagaacuaaguuguccauucggaaggcuuuagucuuaacauguggcuauugcacaguugaaaugugguuagacccagcugagauaaaauaugcugugaguguacaauacaaaguggauugugaagauuuaguaccaaaaaaucuaaaguagcuaaauaauuuuuauaucugggguuaaauaaaaguuuuuuuguuuguuuguguguuugugugagacagagucucacucugucaucuaggcuggagugcaguggcacaaucucagcuuacuguaaccuucgccugcugggcucgagacucuccugccucagccuccugaguaacugggauuacaggcacacgccaccacguccagcaaauguucuguauuuuuaguagagacgggguuucaccaugguggccaggcuggucucgaacuccugaccuccagcgauccacccgccucgggcucccaaaaugcugggauuacaagcaugagccacugcacucagccuaauaaaagauaauauuaaaauaauuucgcuugucuuuuuaguuuaaaugggguuuuuagaacauuuaaaauuuacauacacgguuagcauuauuuaucagaaaggugcgaaucaucucccuaaccagcuaauagcuugaagagaaaccagcuaagucuauauauaacuugaaauuguuuguuguucaaaaaagcuaaugaaauaucuugaagcaaacaguuccagacuacaacuuuaacuacaccacaguauuuuauuauucggauuauuucccaauuuucuccuaguauuuucauuuuaaaaugaaggcuggaaaggaaaugaaugacaaucaccgcaaaggucuaugaaaucugcuuaaucuaccaucugccuuuccaacagcauguuuuggcuauuucaaggaaaaaccagaacaaaaacugcuuuaaguaccuuguagacaaagugaauaaauuuuaugguuauuuaugagguuauuuaaggaaagaguaagaaaaacauauucagauuauuuuuaaaugguagauuguuauuuauuuauuucugaggcagggucucauucuguuguccaggcuggagugcagugcugcaaucgcagcucacuaaagccuugaccuccugggcucaagcaagggauccuccuaccucagccccccaaguagcugggacuacaggcaugugccaccaugcucagcuaauguauuuuauuguuuuagagauagggucuagcuauguuguccaggcaggucucaaacuccugagcucaagagauccuccugccuuggccucccaaagugcugggauuacaggcaugugccacugcaucuggccuaaaugguauacuuacacagaauuuauuucucuuuuaauuucaacggugagguacuuuuguucucuagaaaagauauaguggccauaaccaauucuacugaaauacucuccccacauguuuaguacuuaaaagagaugccacuagugcuuuugagacugcuaaccauggguuagaaagaaucagagcaaaaggggucaggggugcaaggaaagacagccagauagaaccaagaacuaacccugaguguccuuauccacuacuucacacaguuagaaucuaaaccuuggcuuacuuuggcaacaaaaaaaauugcuucacauagaaaaauaccuguuagcagaacugguauuaaaacuaagagagaauaaagcauuugauuuucuuaauuuucuucucuaaguguucauauaaggcaagaagggggaaacaauaccaauaaaacaauaaauucaauggcacauugguuuagaugaaaccaaaguuuucacuuauuacuaauuccaaaauaaaauuucacacaugaccaaaacauuauggaaagcaagguagcacuauuuauaaaaauguguuuuaaaauucuucaauaagauuauuccuaauggaagaaaaucccaucucaagaaaaaggcuguaaaugcccaaucaacuuuuaauuaccaauucuagaaauuaucugaauuaauauagauccuaccuguuaagacuaguaaguuggcaaagguugaaaguagauacaaggaauagcaauggugaaaguggaucaaaaaacuacaaguuuacauuuacaaauauaauuuaaauaauuuuuaaauuauaauuuuauauaaacucuaccaauuauuuuggaauuuuuucuuugugagacuauucaacaaaacaacagaaguuuauugauuacaaguacaaagacaaguaagacuuguucacaucaggaggcuggaaauuuauuaauaccacugcagauaaauauguaaguaaaguaacuguaguauuauaaugcuuugauaggcuuaaaaaugcagugguaucccaaaagauaaaaccugauucagcuaucagaagagauacuuaagcugagauuuaaagcaggacuaagagcaagcaggcugauagggaucaggagcaugaguuugagauaccuuugugaaauaugaacauugagauaccuagugaauagcuguagcuaucugaagcuaagaucugggaauguuuucauaagguaauggcacagagauaugaugauuaaaaaaccacagagcuacagcugggugcgguggcucacacuuguaaucccagcacuuugggaggccaaggcgggcgaaucacuugaggucaggaguuagagaccagccuggcuaacauggugaaaccccaucuuuacuaaaaauacaaaaauuagccaggcgugcuggcgcacacguguaaucccagcuacucaggagguagacgcaggggaaucgcucgaacccgggaggcggaggcugcagugagcagagaucaugccacugcacuccagccuggacaaaagagcaagacucugucucaggaaaaaaaaaaaaaaaaaaaaaaaaaaaaaaaaacacagagcuacagauaucuuggaagaagaccaccaccaaguagacaccacuaagaaagacuaugaagcaacagccagagagagagaaagccaaccugaauagaacucuuucagaaaagguagaauuuuuaagagcaagucaacauaauaaacgcuggccaagucaacuaagaaaaccugagaaauuguuauuacuuuuagcaagaaauuacuacuguccuuaucuuuauaaaguggcgagaaaauucagaccaaugggugaaugacaaagcgaggcaguacaacuggcaucuacugauuacucuuucacaaagucugacaacaaaaagaaguaguguacagaguaaugauccauaaagcagacucaaauuagagaaggguuuuuuuguuuuaauacaggaaauauguggguaggguuagcgcugaagguaaggagugaguggagagggaagcaguugaaaauacagaagagguaacacacacacgucaaaguaccuaggaacuugagggaaucugcuucaaguaggaaagagaaauauuacuuccucugagauaaaugaguaaaacggguacagagugagguaaauacauggaaaguuaaaagcugagagugaguucuuggcugguguuacuuucccugcagaaaaugaagcaauaucuucuauuuaagagaaaagaaauagaaguugaacaagaaucuuugcuuugcagaauggaagacagagcugacuaaggacaaauaaaaggauacuuugguagcccugaaauccuaucuuuguugaccauaaaucugagaagaaaauaaccuagauggcuguaaugauucuucuccagcaguuuuaguauuaagagaucaauccagggccgggcgugguggcucacgccuguaaucucagcacuuugggaggccgaggcgggcggaucacgagaccauccuggcuaacauggugaaaccccgucucuauuaaaaauacaaaaaauuagccaggcgugguggcgggcgccugcagucccagccacucugaaggcugaggcaggagaauggcgugaacccaggaggcggagcuugcagugagccgagaucaugccacugcacuccagcccgggugacagagcgagacucagucucaaaaaaaaaaaaagagaucaauccaagguugaaggcuagggcaggugugacaccagaagacaaaauaucagagguauaaacuucccgaucaaagucucagaaaaucaccuauuucaaccacgaauaccuuaugaaaauguauaaucagaaguuugcagggcacgguggcucaugccuauaaucgcaacacuuugggaggacaaggugggcaaaucacuugaggccaggaguucaucuccucuaccagaaacacaaaaauuagcugggcaugauggcauacaccuguagucccaguuacucaggagacugagacaugagaaucucuugaaccugggaggcagagguugugguaagccgagauagcgucacugcacugcagccuggucaacagaguaagacucugucucaaaaaaaaaaaaaaaaaguuaaguauaaguuguacuagaacucugcuuucucaaauucaacaacagaaauaacuaaggaagauaauuucagaaacaagauuuaacaguucugacuguaaaacuaagggcugcaacaauugcauugaucuuuacuugagaaaacaaguaaaagaaucagacuauuugcaaaguuuucaggacauucauaugaaauucaaaaccauuucugccuaacugcaaaaaaaaaaaaaagaagacgaaaagaaaaaaaacuuucuuccuauggaucuaccuuuaaucuguaauugcuagaaaacaauucuaguuuuaacaggaguaagcaaauuaaccuaacauuagagucccaagucauacaguaucgauggagguagaucaggacauuccucuacucugcuuugacccugguucaauugggacagagaggaaaaaaaaaaaaaaagauacuuccucuauuccccuaaccccaccccagccccaauccucagccauuaugacacaacauagggucuaccuugucuauuccaaacaccuagaacaauguuugguauauaauuggugcucaacaaauauuuguuacaauauuucuuuuaaaaguauucagggaucuuauuucaacauuucuauuuaccccaaagccaugaccuguagaagacauaugaaaaaacuaugccugaagguagaagguguaguaugaguauuggaagagaaggaaccuauacuauuccauuucucguuaguaucagugguaggaaaccuaaaaauugauacaugcacauuacaagaaguuuguggcugaugggggcaguagcaaugaaaagaaaaacuagaucaaucccugaaauggcaaaagagaaagaucuggucacugugcugacaugaaaccaaauauauaucucaaacccagagguguuuacaccaaaaagaggcccuaagaaaacucugguccucaaaccuucgaaugcugaaaacuuaagaccuccuggcucuuuuccauuccaaauuucaggccuuaaggccacuagugauagugagcugccuaaguaaauacucgcccucaacgugaaaggugguaggaauauaaagaguaaaaauccauuuaaugacacuacaacugggagugggaacaggugugcaucuugccucaaaaucugaguuccaaacacauuuucccauaaauauaccuugauaaauaaugagauucucuacauccuguuaaaaucaaaccaacagaaauaacuaucugcuugaaaagaaaaauuuuaguugcuauuuuucacauauuuagugcaugacaaaaauucuaacuuuuccuauaccccuguaccucauuuccuucucuauccuucauagauuuguuaugaugauuaacugaauauuucuaauuagcuuaaagcagugucuagcccacaguaagcauuauacauauauauuuuaauuaaauaaaacacuacuuuuuuagauuuguuaaguuucuaacuaguuuucaaaaaaaaguauguugguucuacuuuuuuagugauauuuucaaaaauuuuuuggaguuuuauguguaagaaaauuaucaaguuaaaacagacaaauuauuauuuccuuuuuuuuugagacagucucuaucacccaggcuggagugcgguggcaggaucucagcucaccgcaaccuacaccucuuggauucaagcgauucuccugccucagccucccaaguagcuggaacuacaggcaugcaacacgaagccggcuaauuuuuguauuuuuaguagagaugggguuucaccauguuggucaggcuggucucaaacuccugaccucaagugauccacccgccucagccucccaaagugcugggauuacaggcgugagccaccgcgcccagucaaaauuacuauuucuaagaaagcguaugaacugaucuuugggaauuucagacuuaaaacuuuauguguguguguguguguguguguguguguauauauauauauauauauacguuuguuugcucugagauggaaucucgcucugucaccaggcuggagugcaguggcgcaaucucagcucacugcaaccucugccuccugcguucaagugauucuccugccucagccucccaaguagcugggacuacaggcacccacuaccacgcccugcuaauuuuuguauuuuugguagagaugguguuucaccauguuggccaggauggucuccaucucuugaccuugugauccacccaccuuggccucccaaagugcugggauuaugggcgugagccaccgugcccaccccuacuuuuuaauauauuuaaagcaaucuauuccuuaaaagcuaccuugcuuuuuaaaaauuuuaccuacaaagcauuucaccuauagcuauaauauuaccauuaaaagcauauuuauguuuaagcaacuuuuauuuagcuuaauuaugaauauuccauugaacugccaucauuuaauguagugucuguuauaagaguuggaaauguugcaagaaguauguguaaccucaauaacauucuaagacaaaugcaaucacuguuaacauuuuaggaguagcaugccaguuuagccuuucuuaggcaacgaaauacauugggggaacagcaggagggaaaggaagagcuucaaaacugaagaguaaaggaguaugaaaguagcaauaaaggaauccugguugguaaaguggcugcugcauuaguaacaugaggcgauaaaacaauuugggccgggugcagcggcucacaccuguaaucccagagcuuugccgggaggaggugggaggauuguuugagccuaggaguuggagaccaguuugggcaacacagagaaaccccaucucuacugaaaauacaaaaaguagcugggcaugguggcaugcaccuguagucccagcuacuugggaagcugaagcaggagaaucccuugagcccaggagcugaagguugcagugagccaagauugugacacugcacuccagccuaggugacagagcaagacccggucucaaaaaaaauaaaauaaaguugaaaguuuauuauuuauauuaaaucuagaacauauuguaaaauuccaauucacuuucagaaaacacauuuaaagccagagacaaauaacaaaaaaacuucaugaaagugcaaaaaucauucaguuccuguuauccaaauucuugagcgugagaaugaagcaucaugcauuauggcauacacugaguuucugauaacaucuuuaugccacuaaaucaaccaacccuaaacccugcccuuaucucugggucucuucucauguaagcuaacagauucccauacgguuuaaaagucucucaguuagguauuuugucauucugccaaaaucaacuuguuacaguuugaagguuaauuucaugugccaacuuggcuaggcuauagugcccaguugcuuggucaaaaccagccuacauguugcuaugaagguauuucuuacauacgauuaacguuuaaaucagaagacuuuggggagaaaagaugaacccucacaaugugggugggcuucauccaagcaguugaggccuugaaagaaaagaaugagguccaccaaaaaggaaaaaauucugauuccagauuaccuucagacucaagacugcuggccaccccuacaaauuucagacuugccagccccuacaauugugugaccuaauuccuuaauauaaaucucucuacacauauguaaauauacauccuguugguucuuucuuaaaggaauaaacugaauuuuagcuuaaguuuguuacauuuuaacagaaaauuuucuuuuacagcuucgauguguuaagugacaauaauaagcugcacauauuuagagggaaugacuuaaauaguuuucacauagguauguacccauuaagacuguggcuacuauuaagacaguaaauauauccaccacccucaaaaguuuucuuguguuccuggaauaaauuuuaacaaaacuuuggaugaaacuuuaccuaguccuuuguaaacaguaugaauaaccuuccuuauaauuuaacuuuuacacaauguauauaaccacauagcauucucuaguaauaauauaccauaguucuguucaacaauucucuauuguugagauauuuauguugaugcuaacguuuuguuauuauaaacaauacaaugaagaacauucuuguagcuauaucuaguccugauuacuuuaaaauuuuuuuucaauuuuaauagcuuuagggguacaagugguuuuugguuacauggaugaauuguauagcggugaaguaugaaauuuuagugccccugucacccgaguaguguacacuguacccugccucccacucucccccuuucugagucuccagcauccuuuauaccacuuugaauguauuugcauacccacagcuuagcucccacuuauaagugagaacauaacaguauuugguuuuccauuccugaguuacuucacuuagaauaauggccuccaguuccauccaaguugcagcaaaagacacucucauucuuuuuuauggcugaguaguauuccaugguguauacaaaccacauuuucuuuauccacuccucagcugaugggcacuuagguugguuccauaucuuugcaauugugaauugugcugcaauaaacacacacaugcacgugucuuucugauauaaugacuuguuuucucuuggguaugacuacuucccuuauguuuccaaaaauacaauugcagaauuaaagaacacauuauauuuuaagaaauaaugauuauuauaauaguaacauaaaauguuuaucuaguauuuagcacacaccagguucuauacuacaucccuaauuacucucuaacaauuuuuacucuccagcauuacauuaauaugcuugucaaugaucccacacccugaccaauuuuuuaaaaagcauucuuccucccacacuaacaucaauguaauuccagccaaauuuccaucaguauguuuucagaccucauauccaucuaaaaugcacaaaaauaaaaucuuuuuuuuuaaaggggaaagagaaggcgaucuuuauccaccagaaacuaaaauaugcuauaggguggugauaauuaaagcgauauaauaugguggcaggacauacaaaaacaucagugaaacaggaauccucagaacaugugggaauuuaaaaaaaaaaaagaacgugggaauuucauacaggcuaaagauggcagaacacuguaagauaaaaauaaaagauuaagauaccugaauacuuuuucaaacuauaauagaauuuuuuuuaauauaaaaaaauuccuauuauucugccaaggauucagccuuccuaagcaugagagaaaccacccuuccaaaauuaaaaaaaagccaccaaacagacagaugugaccauauuuaaagauuuaaaauaacaaagaaaaacaaagggcaagcaauauaaaugggaaaauuaucugacauaugaaacacauaaaacauuaauaucuguauuuuaguaucucucuaaaucaguagaaaaugucaaaggaacaggcaaauucacagaagaaauggcaaaaauuauggaaaaaaagguuugacuucacaaauagggaaaaagguauuacuuucucuuaucagaugggcaaaaccauaaaaucaauaauauacugugcuucaguaaaguaccuauucccacaaaauuuuauuagaauguaaaaaaauugaauaaacuuccuuauaaguuaauuuagcuauaacuauuaauauacaaaagaauuguaucaucuaacuagcaauuccaguuuuaugaauguauccuaugaaagucccaaacaaauacacauagauuuacacuuaacgauguuugguaaagcacuguuggaagacgcuaaaaaccaauaaccgaaauauucaucuauaugggcaagccuaauaaaauacaaaauauauccaaauuauagaauuacagaauacuaucucuguuuuuuaaguggcuauaucauggcauauaaaaauaucuauuuugcagaauauugcauauuaaugccucaauuuugaaaaaauucaugaauagaauaaugcacaugcuuguuuugcacaaaaaauuuguggaaacugaaaaaacgugacucuggugucucuucaucacuggccaugguauucuuaucugcuacauaugcauauucccauucuauccauuuaugcuuuuuauuuccauauuuccauuguuuuaacuaaaccaaauauaauuuuauaauucuaaaaaaacaaacgagaaaaauuuuuuaaaacacuaccacuuuugagagauaaaaaguuuguaucguuuaaauuacauuucuuuuauuauagugaggcuggauauuuuuucuuuuuucuuacauuuaccagaaauuauuuucuucuuuuugccccaccuuauguacuuuuauaguaaaucuuuaaugagguauaaagaagaacuaugccuccuuguuuaaaaguuaugccacaguucauauuucucaacaucagaugauguauuucuauaaauacauaacaccugguacucccaaacuuuaacaucugacuuucaacaaaauucuaaacacaaaccaaaacaaguaagaaaccuggaaguuuuauaugguaacuguaugauggaucaacuacuauauaaagucucuccuaucacauggcauaguaacagugacaucuaguacauauagguagacucuaaugguaaucaugaagaauggugaaaauacuucacauauugucucacuuaggucucacaacaacccaaaaaguauaaugaucuucuuguaacacucaagcucagagacaauaaauaauuugcccacguugacauaacuacuguguggcaaaaguaaaacaaucccccagccucauuguccucuacuuuucacaaugaagaaacagcaguuaaucauuagcuuccuccaagagguaccaaaaacugcacagcaacguaacaaguaucuuuuagcuuaaugugcucuaaauggcacucugccacuuccacccuucacugcuggcauuucucccagugcagaauuuaacugcagaauucuaucuguucuuguuggcuauaguuaucucaaucucaacaguaucugcuccuuaacuuccucuucuacccuccauuucuaaccuguaccaaggcaucugcucuuugcauuucccuuauuaucugcucuugaguuucacuugucagucuuccuuucacugccaguuuggguuugaucgcaaccaaugacucguuuuuuucuuucugguggguuaaccaauuacucacagcuagucagaugugacugaaacucuucacaauuagagacugcuucuaagcuuucagaaaaaaauuuuuuuuuuaaacuucuggaucaacuccauuccugaggucugaucuccacauaauaaaauuucacuagaggacuaaaacuaaaauuuuuauuucuuccaaaauuccauccuaccugccuaauaauuauuguauuaauaaucuaauucugcccucaaaaucaaucuacuaccaagcuaaacuuuacugaugugugcuuacuaugugccauauucuaugugaaguccuucacaugcacuauaucacuaaauaauuacaacaaaccugugaguuagucauuauuaccccauuuugcagaugaagaaaacagaguauaggauucuaauucaugcucuuaacccauuauacauauuaccaucacuauuaccuuauaccaccuguuccaagagcacauauuucuagugcucuacugcacuguucaggaaauagugacaugggaaauguacuccccacccuacuuuccauuccuauccaacucccuucccuacuugcccacaguuucccuuuccauuaaacuccuaacagucccuuugccaugugucaucuccugaugugcaucuaacacauucuguucuacguucuuuaaauuucaaaacgugguacuaacucuacauuuccuugaaacccagagaagaaagucauuccaaauuaagauuugagcuuuuuuccuuuaagacauuauuugguguaucuuaacuaaaacacauuccucuaucaucuucuacuaauuauuugauuauucugaaacagacuacaaucuauuuuauacauauuuuucuucucaauucaacucaccccucaaaaaaauuuauugaucacuaacauaagaaaaacacugagagccagaaaaccagaugccugaacagcuuucaauguuacucaaaagaugaacauuauuacuauguaaaacauacaauuauaaucaauuaagaaaaacacuaauacccuaguuaaaaaagagcaaaggaccuaaacaugaaaauguaugguuaaagaaauauaaaugggcuggacacaguggcacacgccuguaaucccagcauuuugggaggccaaggcagguggaucacuugagcccaggaguucgagacuggccucggcaacauguugaaaccacaucucuacaaaaaauuacaaaaaugagccaggugugcuggaaugugccugucaucccagcuccucgggaggcugagguagguggaucacuugagcacaugaggucaaggcugcagugagcugagaugauugugccacuguacuccagccugggugacagggcaaggccaucucaaaaaaaaaaaaaaaaaaagagagagaaauacacauggccucuaaguauaagaaacuauucaagcuccacagaaauuaaaaaauguguauuaaaaagacaagacaggcugggggcaguggcucacaccuguaaucccagcacuuugggaggcugaggcgggcagaucacgaggucaggaguucgagaccagccugaccaacauggugaaaccccguuuccauuaaaaauacaaaaauuagcugggcguggcagcacuugccuguagucucagcuacucaggaggcugaggcagaaaaaucgcuugaacccgggagucggagacugcagugagccaagaccgcaccacugcacuccagccugggcaauagagugaaaugcuugucucaaaaaaaaaaaaaaaaaaaaaaaaaaagacaagacagcauuuuuugccuaucaaaugcccaaagauaaaauuacuauaaaugcugguugaaauguacaauaagcacuguauuauuuuuugaaaaaaguagaaguuuuuugauauuuugguuccuuggcauaguauucaaacgucuagcaccuuuacagucucaucuuuuauaacagagacaccccucacccgucuaucccucucaauuuggacucuauuuucauuaaacacagaauucauaggagcuaguuaucguuuuuuuccuuaaauaacagcuuuauugagauauaauucacauaucauacauucaaccacuuaaaguguucaauugguuugaguguacuuggaguucugcaaccaucaucacuacaaugaauuuuagaacauuuucaugacccuagaaagaaaccucacacgcauuagcagucauucuccauuuccaauccccuccccaugucucuggcaaucaccaaucuauauucugauaauauuuggcaccuauucuagauauuucauauaaauggaaucauauaauacauagucuguugugacuagcuuucuuucacuuagcacguuuucuugguuuacccaaauaguagcauguauuacuucaucucguuuaauuuuuuuaaauuguggcgaaauacacacaacauaaucuuaaccauuuuaaaauguacaguucaguggcauuagcauauucauacuguugugcaaccaugacuaccaccccucuccacaacucuuuuaaucuugcaaaacugaaacucauuaaacaguaacuccccauuccucucucucuuaagccccuaguaaccaucauucuacuuucugucccuaugaauuugacuacuguagguaccucacauaaguagaaucacacauauauuaucuuugugacuggcuuauuucacuuggcauguccugaagauauaucuauguuguaagcauguguaaaaauuuccuucauuuucaaggcuuaacaguacuuaauuguagguacacaccacauuuugcuuaucaauucuuccauccaaggacacuuggguugcuuccaccuugcggcuacugugaauaaugcugcuaugaacaugagcuuaacaaaucucuuggaaaugcuguuucccuuuuuuuuuuuuuuuuugacacagagucucacuuggucgcccaggcuggagugcaguggugcaaucuugguucacugcaaccuccgccucccggguucaaguaauuauccugccucagccucccaaguagcugggauuacaggcgcccaccacugcgcccagcugauuuuuguauuuuuaguagagacgggguugcaccauuuuggccaggcuagucuugaacugaccucaggugauccgcccaccucagccucccaaagugcugggguuacaggcgugagccacugcacccggccuucagauuuuuuauuaucuuuuaaauguuuuauuugacaacaucucacucugucacccaggcugaagugcaauggagugaucauagcucacugcagcuucaaacuccugggcucaagcaauccucccaccucagccuccugaguagcugggacuacaggcaugugccaccucaccugguuaaauuuuuuaauuuucugaggagauguggucuugcuauguugcccaggcuggucuugaacuccuggccucagguuauccucccaccuuggccuccucccaaagugcugggauuauagcuaugagccaccacaccuaaugacaauucuuuuggagauccaguaguagaauuucuagaauucuauuuuugauuuuugggggaaaggccauacuguuuuccaaagcaacugcaccauuguacucucucuguagcaaagaguaaggguuccaacuucuccacauccuggacaacacuuauuuccuaggguuuuuuuuguuguuguuggugguguuuuguuuuuuauaauagccaucuuaauggauauaaagugguaacucacugugguuuugauuugcacuucccuaauaacuaaguuguugaacaucuuuucaugugcuuauuggccaucugcauaucuucuuuggagaaauauauguucagaucccuugcccacuuuuuaaucacguugucuuuuuucauuauuuaguucuaagaguuauuuauacauuuaagauacaaguuccuuauaagauauacaauauacaaauaucuuccccguucuaaguguugucuucucaugcugaugauaguauccaccuaaaggacaaaaguaauuuugaugaaguucaauuuaucuauuuuuuuucuuuuguugccccugcuuuuggugucauaucuaauaagcaucugcccaauccaagaucauaaagucuuacuccuaccuuuucuucuaauagguuuaugguuuuagugcuuacauuuaagucacugauccauuuuaaguuaauuauuguaugagguaugaagggguccaacuuaauucuucuguguguggauauccaguuaucccagcaccaguugcugaaaagcuauucuuucccucugaaucauccugccaccuugucgaaaaucaguugagcuuauaaaauguguggaauuaauuucuagacucucaauucuauuauugaucuauacguuuaucauaaugccaguaccacacaaucuugagcacucuagcuuuguaggaagauuuugauuuauguaaauuuauaaaaauagagacagggucucacuauguggcccaggauggucucaagcuccuggacucaacugauccuccugccucggccuccaagggguugggauuaugggcaugagcaaacgugcccagccuguaggaagauuuaaaauugaaaauugugaggguuccaacuuuguucuucuaagauucuuuugguuauucuagcuccuuugaauuugcauaugaaucucagaaucagcuugucagauucugaagucagcugagauuugauaggaauuguguugaauauguagaucacuuugagaaguacugccaucuuaauaauacugaauuuucuaaucgaugaacauggaaugccuuuucauugucuucaauuucuuucaauuauguuuucuaguauucaagauacaugucuugcacuucuuuuaucaauuuauuucuagauguuuuauucucuuuaaggccuuuuuaaauuguuuucuuaauucuacuuuguucauuacuuguauacagaacaaucaauuucugcaucuuuuaugcugccacuuugcugaacuuacuuauuaguucuaacaguuuuuuagugcagggguccccaauccuaguacuggccuguggccuguuaggaaccaggccgcacagcagaugaguggcaggugagcgaaguuccaacuguuuuuuguuuuguuuugagauggagucucccucugucacccaggcuggaguacagacgcaugauuucagcucacuacaaccucugucucccaguuucaagugaaaucugccuaugcaucccaaguagcugggauuacaggugcaugccaccaugcccagcuaauuuuuguauuuuuaguagagacgggguuuccccauguuguucaggcuggucuggaauuccugaccucaagugaucugccugccuuggccucccaaggugcugggauuacaggugugagccaccacgccugguccuccaucuguauuuacagucacuccccacugcucgcauuacugccugagcuccgccuucugucagaucagcagcagcaucagauucucauaggagcacaaacucuaguaugaacugugcaugugagggaucuagguugcacacuacuuacaagaaucugaugccugaugaucugucacugucucccauugcccugagaugggaccaucuaguugcaggaaaacaagcucagggcucccagugauucaacauuauggugaguuguuaauuauuuuauuauauuacgauaauaauaaaaauaaaguacacgauaaaucuaacgugcuugaaucaccccaaaaccauccccaccucccccacagucuguggaaaaauggcaugaaaccagucccuggugucaaaaagguuggcguccacuguuuugguggauuccacaggauuuucucaugcauaaauauacacacacacaaacuaaagacaguuuuacuucuuccuuucccauuuggacacuuuuuauuucaguuucuugacuaauugcccuggcaagaaccucuaguacaaugcugaauacaggugguagaagcagauaucccuguuuuucauaagauguccuuuaucagguugaggcaguucccuucuacuucuagguugcugaguguacccuggauuugggaguauaaauuggcaccuuuuuucuggaaaacaacuugguaauauaugucaagaaguuucagaauuuaaaaacuucggucuaucaauucaauuccuauugaucuauuuaaggaaauaaucaaauguuaaaaaaagaaauguuuaccccuaaggacauucagaauggaaggaaaucugguucuaguaucuaugacccacugacugcuaggauugaugcaacagcugcucauuauguaagacuuuuguccucaauucuucauuccuaaccaaaccaguaauucagaauugauuaggacuuuucuuagcacaugaagccucugcuuuaacuaaaggcauaugaauaguggcagguaccugcuagaauauccaagcauaaaacuucaauagaaggaacuauaaugaaaugccuaaaggaacuuaaauaugcaaaauggaggaauaaaauauaguucaggcuacauuucacccaagugacauuaugccauuacaaaagcauuuuauuaaauaagacaauaaaagaagcagaaccuuccauuugguaaucaauaaucauacagaugugagaaaagagacacuagaggaaaauauagacaaaugaugauagugacauuaucugggucaucuuauuuucucuuuuacacuuuguuuuucaaauauaugacaaauauuuauuuuaucaucaaguaaagaaaaccuacacauuaacauucuucuuucuccucuucugccccacccccaaaaagguacuaacucuacacaguaacaguacuaugccaacaaaggggcagaauccuaaaacuaugaaugccugaccuuauaccuuaauuguaaauuugauauaaaauuccagauaaaaauaaaauguagaacgcagacuauuuuguaaguuuuaucuuuuacauaacauaaugaauaacaugauaaaguaacuuaugagugacuuucaacccugccuuaacaugcugcuggaagccgcacuguuacaggaacauguuauuuucaauuaaaaaaacccugcaaguucauuucucuuuuuaggaggggaaaaaaagauacauaguuuacaguugcuaagaacagacuccuuagcaaagcucccugacuuauuggguagguuccacagugaguuacuguuuaaguuuuuucacuucuuuugaaacucaacaccuucaacugaaauuccaacaauuacagauuaacuaacaauaaagaaaaaucucuaggcagaaacagguuugucauucauguauuagucugauucaguucuggcaguguuugcugauucuucugguuccagaaacuagguugagucagggaccagauguuuguuuguuuaauauccccaguauuuagauggacauuauucaaugcuaagaugaugaaaauguucuguaacuucauuguccaaaauguagccaguagcuacacguagcuacagagcacuuggaacaugaauagugcaguuaaagaacuaaacuuuugauuuuauguaauacuaauuaacuuaaauagcuacauguggcuaguggcuacugcacuggccagcccagaucuaucuagaaacuagcacaauaaacauuuguggaaagaaagaaugaacaaaucaauguugcuuucuucucaaaccucaggagauaucagcaguucuaaacugcgggaauauaaauucagaccuagaaaaacacaagguaaauaauuuggaagcuagguauucuuuaggagauaugccgaucuuucauugucuuguaaaaacaagucaugacacuaauaauuagaaugcccuccacuauaccuauccaaacugcacccaccuuuaacauuccaccuauuccacagaacauuccuaccucuccauuucauucauucacuuacucaaaauuuaaugauaaucaacugugugcugcacacaaugaacacaaagaauaaaauugagucccugcucucagaaauacaguaagaauaagauaugaaaacaugacaaguuauaugaaaauacaaguuauggcugggcgcggugguucaugccuguaauccuugcacuuugggaggccgagguggguggaucacuugaggucaagaguucaaaaccaggcuggccaacauggugaaaccccgucucuacuaaaaauagaaaaaaauuagcugggugugguggcggacaucuguaaucccagcuauucaggggcugagacaggagaaucacuugaacccgggaggcagaggucgcagugagccaagaucauaccacugcacuccagccugggugacagagcgagacuccgucucaaaacaaaaacaaaccaaagcaaaaauacaaguuauaugaaaguacuauuacagaauuacguaugacaugcaauucaaguauacaggagcaccuaacacuguuugggaaucagagaguacacagggagugacaugugaggacuucuuccccggaccaaacagugacauguugccacaagcauuugcuauagaauacugucuucuugauuuuuaggaaaauuccacacuagagugcucaaauucccucauuauaaaaacacuaauauuccaaguauuauagcuaaauuaauuacgggauaguaauuauaauacugauguuuggguguccaggauaccauguuaaguuuaaguaccaaaacacuguuaaguaggaagauuuuaugugaaauuuacaguuaagguauaaggucacagauucauaguuuuaggauucuaccccucuguguaguacuguuacuaugcagaguuaguaccuuuuugaggguagggcagaagaggaaaaagaagaauguuaauguguaggucuuaccagcagagacugguacauuucaguuuaggaauuuuuuuaaucugaauacugaaauauuuacaucuugaaauaaagaucaaugacucgaguuuuuacuucauacagcauaaaaaucuucucuagcaagauaauuugagacacagucucacucugucgcccaggcuggagugcaguggcgcaaucucggcucacugcaaccucugccucccggguucaagcgauucuccugccucagccuccauaguagcugggauuacaggcguguguccccacacccagcuggccucuuggccaggcuggucuggaacuccugaccucuggugauccgcccgccucagccaaccaaagugcugggauuacagguguuagccaccacacucagccuacccagagaauuauaaacagcacuaaaauguuuaauauuuaauuaaauauuauuuuacucauucagaaaguauuuuucuacaacuuuguaauccucagugaaaggaagaaaguaacaaagaaaagcuuauguugcaaaauaauucuuuuauuuucagcaaaugcaucuccauccauaaucuguugcaguauaaacacccaacaguucaaagacuuuuugaacagucaaauaugaacauaaauacugaaacuaauguaaguaacugcaucccacucuccuuccauacaugaagaaacugaguaccuagaggaacacgaaaggcucucucugaucccaaaaccccaccuugcuaacaauaaaagauuaaaaaucagacaaaaagguucaaaguuccccucaaagugauuaaaagagaugaaacuauaugcagaugaaagcguuaggaggaaauuucagaaucaguuuauccccuguccauucacccaauuaguuuagaaaaaguuucuucaggccaagugugaugacucacgccagucccagcacuuugggaggccaaggcaggaggaucaauugagccaggaguuugacgccggccuuggggaacaugacaagccucaucucuacaaaucacuuuuuaaaaaauuagccaggcacgcugucaugcguguguggucccagcuacuugggaggcugaggcaggaggacugccugaggucaaggcugcaguaagcccugauugcaugccaccgcacgcuagcuugggugacagaaugagacccugucucaaagaaaaaacaaaacaaaaaacaagaaaaaucuucuucagcaucugcaaguuucuacacaaaaauauacccaugacuuggugauaccacuuaacccucuguuucuuaagaauaauuccuuuuuuaagacgcaauaaaauuucacuuuuggcagggcacaggggcucacgccuguaaucuaagcacuuugggcggccaaggcaggcagaucacuugaggucaggaguuccagaccagccuggccaacauagcgaaacccugucucuacuaaaaacauaaaaauuaaaaauuagauggguguagugacacacaccuguaaugcuggcuacuuggaaggcugaggcacgagaauagcuugaaucugagaggcagagauugcaaugagcugagaccaugccacugcacuccagccugggcaacagagcaagacuugggucucaaaaaaaaaaaaaaaauucacuuuaaauaauuaauugaaauuaauaaccuucgugauuaacuuuuucucauuuuuaaguaaagcuaaguuuuaaaaaaauauauuuaugauguuuuccuuuuuuuuuuuuuugagacaagagucucgcucugucacuuaggcuggagugcaauggugcaaucucggcucacugcaaccuccaccucccagguucaaacaauucuccugcuucagccuccugaguagcugggacuauaggcaugcaccaccaugccuggcuaauuuuuguauuuuuaguugagauggguuucaccauguuggccaggcuggucucaaacaacucuugaccucagucgggugauccaccuaccucggccuucccuaagugcugggauuacagguuuaagccacuaugccaggcauuuaugauguuucucuuacacaacuaauagcuuaguuaguuauaacagugcaaauguuuauauuuuuaaaaguuaauauuuuuacuugauuuuuguauuguuucuaauuugcauauuuacauuguuuaacuuuugcuuuuuaauguuuauauguucuaauacacucauuuuagauuagcccauaacauuuaaccaguguuauugaacugucuuuaugcucuaacuagacaaucaaauuuaguuuaauaccacacagcauggcaaucacaauuaguguaaugucauacagcuagcaugcucaggauuagacuucaaaucuaguucccuuuucggaaaaucauguugcuucaucauaguucccaucaaaauuauuagauucauuuaagaaauaauuauguuuuaaauuuuauaaccucucacauucucuaaugcauuuaaguaauucuagguaccuacauguaacuucucacauaguagaacacauucuuauuuaucaugaugcauagaauuacaaacaggauuaugguaggaagaaagaugaugaagggugcaaauaacacaaaaaucuaugauuucugaaaugcagcgcuaggcacugaggagaaacaaaacuaaaaacaaagcaaaauacaaaggcucugggaauuuauaaccugauaaagaaaauaaauuaugaccauaauuauaauaccaggaagacuauuaauauauucacaaguaguacuguuuaaguauuaaaguauaaauaggauuauuaaaaaaaauagagcucauauauucauucaacaauuagucauucagcacauucuaugguccagccacugagcuagguaggaggcacaacagugaagaaaacagguaugguucccagcuaucuguacagaaacaaguaacaaaccauuauaauuauucccacuuauuaggaaacauuaaauugucugugucuauacguaguagaaagugggaagacugaucagguaaggccucacuaaugaauaaagcaacauucaggcugagaccucaggcgugagaaauuagccuuucaaauugugcaugcgugcaugugugaaugaguguguggguaugugugugucugucaagcuuggugggcaaucaaaauggcauagaugggauuggagaaguaggcagggaggugaucucacagaucaaaaaagcaggacgucccugguaugcuggaggaaaaucaaauacacugauuuggcuagagccugagguuaaugcaaaacaaacagcauuugcacaaacuuucauguuuaaaagucuuaauucuaacuaugaaagacaauguuucccuuuuauggaugaagggauaacagacucaaaagggcuaaaagucuugcuaauaaggccacaccacuaauacacuaagucucaagacccagacauucuaauuuaagucacaccaguaccccaucaaccacacaauaaguaguaaugaaaaauaaaguuaaaaagacaaaccaggguaaaagucaggcugagaaaugaaagcuuuacuagggacaaaaacuaacagaagugacaucaauuaaaaugaugauucugaacuccauauuguacuuucaaacaguuccuuuaugcaaaauaacuaccauguaguuuaucaaucauuuugaauugugucccucaacagaguaagagagagagagagagagaguguguguguguguguguguguguguguguguguguguguguguguguguguguagcuggggaagacaggagucuaaguaccauguucaaucagaacauaccuacuuuaaucuuuuucuuuucguuuuuagagauaaggucuugcucugucaccgagguuggagugcagggugcaaucacagcucacugaagccucuaucuccugcacucaagagauccuccugccucagccuccugaguaaauggaaccaaaggcauguaccaccaagcagggccaauuuucugguuguuuuuuuuuuuuuuuuuguagagaugggcucucguuauguuaccuaggcuggucuugagcuccugggcucaagugauccucacacccuggacucccaaaguguuuggcuuauagaugugagacacugugucugcuuuauguuagauuuaguuugagaaaaaguuuugcuguuugcaaaccucagaauacagucaguaaacuuugguucuaaaaucucauaaagauuuaaauguaagauuuauauaaagauccuauauuuacaucuaaaauauaagauuuaagauuuuaugaagauuuaaaucuaaaaucuuacgaagauguaaaacauaccaacaguagagcacugcuuucacccaucauaugcccuauaauaacuacuuuaauaagcaggcuaauuuuuugucagcuucucugcuaaauaauaacuauacauauauacauaccccacuauagauuauuaaaggcaauuucaaguaugauuuuugccuccacacuuucagaaauaauacauaugccuacuguaaaguuuccuuauauguuaaggcauuuguaacauaaaaauguaggguaaaaauacuacuacuaugaacugguuuuucaacuacuaaaaaaugaauacuaaaaacuauacacugaugcccaauaaaacauauauuacuagugaauacuuuauguguaauauuggcaaauacccuuuacgaaguuuacucaaaaaccacuaaaguaaaucaauucauuauucaacucuaccaaacuuaaaaauauaguuucacgauuagagcaauaguuuguaauuacucaaauagucacaucuauaaaaaaaauuuccaaguuagcaacaucaaucaugaauacaaaaaauucguuauuuaaauaugcacacauaccuuuguccuucuugaaauccaaagcaucuucuuuaucagucacuauuuccuucauauugauaauacucugauggguaagcugccggagaauuuuaauuucucgaauugcuguaauuggaaagccuuccuuuucauuauccagacguacuuuuuuuaaggcuaccauuucuccuauuaaggaauuuaauaaaaucagguuaccaguuaacaaaagcagaugacauuuuucuuaacuuuaaauguauuuuaauucaauucuguucuuauuucucaaaaauagaaccacaaaguauguuucaguuuccaauauaccaaauaauauuuauaguucaaaaaauuaagucugucauuaaacaaauuauggaauauuuacauaaaccagggaauacuauacaaccauuagaaagaaugagguaaguccaaauauacuaugcuccccauuuauauauuuagugaaaaaacuaagaugcuuuuacauucacuugggaaaaaauaaaaagaaaacagaaagaugcuaggccaggcgugguaguucacaccuguaaucccagcacuuugggaggcugaggagggcagaucacgaggucaggaguucgagaucagccuggccaacauagugaaaccccaacucuacuaaaaauacaaaaaauuagcugggcgccuguaaccucagcuaccuggguguuugaggcaggagaaucacuugaacccgggagguggagguugcagugagccaagaucacgacacgccacugcacucugcacuccagcccuggcaacagugcaagacuccgucucaaaaaaaaaaaaaaaagaugcugaagacuggguauaucacacugucauuuuuauuuuuuuuaaguaaacgagggaaagacaaauauagccaauaugcuuauguaugcauaaaaauuucucugaacagagaagaaaaacucuaucagugaaaaaaauacgcucagacauauuacuugaccaaaccuggccaguuaccuagcaguaaaacuggaauucaaaauccaguuacuugucucaaaaauauauguucuuccccacuacacuaaauugccacauaauuuaaguaugagucagcuuuguaucagaaaugauccaaauagaaaaugaaauauacacacauacacgaagccuauuacaagaaaaaauucacuauaauaaagguuuguucauuccacuuccuuggagaaaaaaaauguucuuacaaauuuucuaaaagaaggaagcauauucuuuuaaucauuaaacuuauucuauuaauuuuuauggaaugccuucuauauuguguaugaguccguuuuacuuaacaguuuuaaaaguugucauuuaaucuuuuugauaacacaucauuauaaacaccaauuauuacucuaugcaguaauugcccucaguaguuucuaaccguaaggucaucucccauauacuauauggccucuaauagcugugcuauuuuaaucuauuuguuucuuucuuugagacagagucucguucuguggcccugacuggagugcagugguccaaucucggcucacugcaaccuccaccuccaagguucaagcaauucuccugccucagccucccaaguagcugggauuauaggugcccaccaccacaccuggcuaauuuuuguguuuuuauuuuauuauuuucugagauggagucucgcucugucgcucaggcuggagugcaguggugugaucucagcucacuacaaccuccacucccuggguucaagccucaagccucccgaguagcuggguuuacaggcaugugccacuaugcccggcuaacuuuugugucuuugguagagacaggguuucuucauguuggccaggcuggucucgaacuccuggccuuaggugaucugccugucucagccucccaaagugcuaggauuauaggcaugagcaaucacgcccggccuauugguuuauuucaauaagcaguuaugaguaaagaaagauaaaauacuagcucuaugcauuauuaaguaaaauacauagcuucugacacagcuacuuuuugcucuccugugaagccuuuuaaaacuuucucugaauuccugauuauguucugaaagauuaagcugcuaaaacuggccuccaaggauaguuacugcaggaaaaaaaacugaaggcuaaaugaaaguguuguguaaggcuuaugacaaaaaaaauuuacuacuaaaauuaauucaggucaagauaccuuucccucugauuaauaacaguauaagaauuauucaccauaaaagaggaaagaaaaacuaaauccuaccauacaguauaucacaaauacuaaaggaacacuuuuuaaaauauacacauauacagacccacuuacauguacucauaucuuacaaaaugcauauauagaauaaaaaaacaagaugaaacaaaagcacaauaaaauugaauuuaauuuuuuggaaaauuucugaagccaaacaucagaagagaaacacaaacuaaguacauuccguaggcccaaagauccccagaacuuggcauucuuaccagugucuuuaucccuggcuuuguaaacuuguccguaaguaccuucuccaauaauuccgaugauaucaaauuuauccacgcagcguuuuccccagucaauaucuuuuucuuugguuucaccauagcgaggcccacauauucuaucaaauauaguucuaaaguuuuuauauacaaucaagcaaauugaauaaacugucuaauaacucaauaucuacucgccacccaauuguauauucuuuauuuuucccuacccuugcaguauuuaucaucaucuaucccaaacaaguaacacugauuugguauuguaaguuaucguaaaaacugagguaucauuucuacauacugacucuucuucuguagacaaguauuuaaacugagaaaaaaaguaguagagcuuguaugaaggcuuuucagaaauaaaauauaauuuuucagugagaagaugaaaccaacacuaguagagucaaaauucucuaaccaaucuccagaaaguuuuauuuugcauccauuaacaauaauauauauaaucuacuuuuacgaaacaagaguuugauaaagaaugugaacaaaaaucuaacuauaaaacuuauugacaaauuuagacuuaugacuggaugaaaucaucugaaaaacaucaaaaaaaaaagauuuuucagucuaagagaguacaaaagauauuaauauaaccaacucucaggaagccacguuuaagcagauacaaauggacagguaggacaaaaaucuuacauucuucaaaaagauacauaauuuuguaguauuuuaauauuauaguaaaucacagaaauucaaguaaaagaauaaaacuacagugcucaagaagagaguauuuuuuagcuauuuuauuuuaucuuauuuuuuugaaacagggucuugccuugucgcccaggcuggaguacaguggcacacgaucacagcucauuacagccuugaccucuuuggcucuggugauccuccugccuuagccuccugaguagcuggaaccacaggcaugcaccaccacacccggcuuuuuuuuuuuuuuuuuuuuuuuuuuuuugguagagauggggucucccuguguugcucaggcugguaucaaacuccuggacucaagugauucucccaccugggccucccaaagugcugggauuacaggcaugagccacugugcccggccaguuuagaaaaugaccucaaauucacacacuaggcacuaccucaacugcaauucuaaaaucagaucuaacuuaaagucuucacugucccuugguuaagaaguuaaaaaaaaaaaaaaaaaggcaccaguguuccccgccuuuaacugauuaacagguuuuaagggaaagaggucucuuuaggcacuuacuugaagcuaauuuaggauacaaauuucaaaacuucuucuacuccaucucuugcaaagugaagaauauauuuguuuaugggagaaaauggagcuaaaagcaaaggaaacagcagcuugcccauuacuaauuuuauuuggucucacuaaaugcugacuucuacucugcccaauuucaguguuuguguuauuucaaucucuuaauaacagaaaguaucuuuaacauauacaauaccccaggaaauuaauacauuacaaauuacgagagaaaauuaaauuugguuuuauuagucauugugaauaggaaugcaagcaauuaugauuuuuuucaaaacucuaauagaauucauauauuuaaguugaaagaauaaguacauuuuuuauuuuaaaccuuaauuuaguguuuuaugaacuucugaugacccagaaucacugcuggucaauuuaagagcagguagaaagcaagcacauacuuaggccuccuuuuacuauguaacuguguugcuguuuucuuuuccucuggacucuuugaaagaucaucuccuccugguagcucagggggcagcgguaaaucagcaagaagacaucggaguuucuuuucuacuucuuuuuuaacugcuuuuacugaaauauuuccucguaagcugaaagugaaagaagucagacaaauaaaacaaaaauuuuguugacuaauaaaaauaugcuuaugacuuacauuuaaguagcaauagucaugaauauucaacaguauuucacauuauaagacuauuguccaaguuucuuuccagcuaaaguaauacacuauacucaacuguauaaugcaaaauuuggaguaaaaaugauauagaauuagguaaaaacuaaggaaaucuguauaaaguaggaacuuuaaugauaacuuuguaucaauauugauuaauuguuaacgaauguaccauacugauguaagauauuaacaguaaagaaacuggguacgggguauucagggucccuguaguaucuucauaauuuuucuauaaauguaagacuguuauaaaaauaaaguuuauuuuuuaaaacgauacagaauuaacuauaaaacuguacauuaaaauugaaaaucaacuaaacaugcuuugcauaaaaacucaguuuugcaaagcauuuuucuuuuuuuuuuucuuuuuuuuuuuuuuugagauggaaucucacugucacccaagcuggagugcaguggcaagauccuggcucacugcaaccuccaccuccuggguucaagcgauuaucuugucucaagccucccaaauagcugggauuacaggugcccgccaccacaaccagcuaauuuuuguauuuuuaauagagacgggguuucaccauguuggccaggcuggucuugaacucccaaccucaagugauccacccgccuuggccucacaacgcucagcugcaaagcauuuaguuugauucugguagagacacaaaacauuuuaccguaagaaauaaaagaaagcacaugauaauauuuaucuugcccauuuaaauaaccacaagcaacagcuaauucagcuuugacccuuuucaggguuaauuaauuuuucuaaauuggacaauuauucuucuaauuuuuuuaagauuccagcuuucuagaauuacagcugaaauuuaaacuccauuagcuuuguacuuuuuaugaaugcauaaagagcucugaguuuuaaaguauaucuuaacuuggcaauuuauuuuaaauuucccugauaugacaaagucugucaucuaauauaaugugacauguugaaagagaaucucauaaugauaauaaaauuuggacuucacauacuuucauagcaguugagucccauaaugaaaaaauuuauugcaacuacacugcugugaucagaaauuacugaagauauuaucaauguaaauaauguaauuguaauuauccuccuauucguguugaauaauacuguaaaacaaaugaauccuuuaauaccacuugauaaaaacaacuuaauaauaccaucugauaaaaacgacuuaauuaucauaguaaauuuauguccuguguuacucacuggaagguucuuuaacagagaaaaaacaugcuuuaaaacaaauugguuuguaguuuuguuuuguuucuuuaagacagucuugcuuugucacccaggcuggagugcaguggcaugauccagacggagugcaaccuccaucucccgaguucaagcgauucuccugccucagccuccugaguagcugggacuacaggugcgugccaccaugcccggcuaauuuuuuuguauuucuaguagagaugggguuucaccauguuggccaggcuggucuuguacucccgaccucagaugauccaccugccucggccucccagagagcugggauuacaggcgugagccaccaugccaggccugcaguuuuauuuuuaaaguaauauauuacacagcccacuucucaauuugccucucccuccauucagcaaauauugguugugagcuuccaugugcuagguauuuguaaggcacuggaaauuuaacaacaaacacauuaagcuauaguuucuuucaaaaagagcuuacagucuggaagacagguaggaaguaggauaaaguguuacacaaacagauuccuagaguaaugaaguagcuaaaggguggcuaaaucaggucugaaauacaguaaaggcuucuuucuagaaaagguaucaccugaaugccaacugaaaauaggccuauuuagaauaacuuauuuaggaaacuauagucucuaacuuguaaugaggcuuuagucaagaguucuuauuugaagauucaaaucaacauuuuuuagagcaaaaaacuaaagucuuaauuucacuuauaauuuaaaacuuaaaagacuaucuauauuaaauguccaguguauuaucgaauauuacuuuccaagaacaauguuacauaauuuaaaacauuuuuauugaauauuugcaauaauaaaauagaaaaugagcuuuuuaaaaacacuucuauacaccccagcaacaaaaauaaaaugccuuaaaaagaaauacacaccagcaacagaaaaaaauaaaacauuugacugaagaaauaaaauuagaucugaacgaaugaaaagaaaccauguuuuaauaugggaaacuaauauuauaaagcugucuccaaauuaugacuguauuagauuuaauagaguuccaaaaaaaauucaaggaagaguuguuuuuuuuuuuaaauacaacuugacaaccugauuauaaaauuugucuaagaauaacggcaaaagaacugccaagaaguuucucaaaaagaaaaauuaaguggcauuugcccugucaaccuauucagagauccagaacuaaaagccaaacgguggcugaagucaaaggauauauauuacucagucuauccaauguuuuauaaagaacuaugaauuguaauuuuaaauccaaagauuuacauaauauucagguucuaggcuuccucuuuuaaaaaagcaaaaguucuaagacaagcuuaaauucuuguagagcaacauugauguugaggcucaacagcagagccauuuacgcaucacuaauuuacuccauccccuucauuuuuauauuacugucugccccuaaaauagaaauuugaguuugggagccaauauagaauguaucuaaagacacuacaacaguuaagauacugacaaauacaauauguuaaaagaaaagaaaguagagaaacagauauauguaagaauuuuuauauauggaaauuagugagaugaauuauacaauaaacgguaccaguaacaacacuggguuggggggagugaagaaucagaacacuucuuuacacaauaaccaaaaccaaacuucuaucagaucugacuuaaccuuuuuaaauuuuauaaaccuagaaguuuuaaaggaaagagaauaauagauuugacuagauaaaaauggaaaacauucauauaaccaaaagcaaaacaaaugucaaaaauaagcaacagacucugagaagcaaaggucaacaucccuaacauaucuacuaaacaucaauucgaaaaagggaaacaacuuuaaggaaaauccagcacagaauacaagcaagcaauucaccagaaaaauaauaaacaaccaauaaacauucaagaaaauaccauaccuuauuaucagaaaaaugcaaaauuaauuacauauuuuaaagacugucaaaauugacacuauccaaaacuguuaaggcaauuucauacaucugggugcauaaauuguuacacagccuuacuaagacauaaugugacaguuuguaucaaauuuuuaauguguauacuuugacauguaacuauccuauaaaaauuaccuaaauauacacaaaauauuaauauauaaggagaguuuaauagcgaauaauuauaaaccuaaguauccauuaaucaacagaagaacacgauacauccauuccuguaauaagaauauugggcccaucuauaccaacauggaaagaucucuaacauauuaaaugaaaaagcaagucaagaaacauuauccaugguaugauucuaauuuuaaaaauaauaauaaaacaacuacauucugugaaaacacacagauuaccaucuaucucaugauuuugugggaaaacagacuguaauuuugagaaugaagcaaaauucaaagugaaccuaacauauaccuuuaacuagaaagcaaggaaacacaaaaaaacaaacgaggucaugucaaaagaauaaaggagucagcuuauaggagcuuccacuggccaaauuucggacaaugugaggguaaaaaagaguaguggcuauuacuauuuguaacacagaaaauaaauaaaaauccaugagaguagaaugauuaaaugggauauggggaaacacguauuuacaaaacaaggccagcuaauguuaaaaggaauggcagaauuagaaaauaaccauuuuuaauuugugcagcagcaauggaaaaaaaaaucaccaugugcagucccuacuacaguaacugaauuagacaaauaccauuaacgguugcuaaaccauuaggugauagguuguugggaaaaaggauauucaaucacugccaaaaauauuacccuacagcucacuucuaauugcaaagaggaaaaugcacccucauauauggagagaccuuaacguugcucaucaccuuaaccaagugaucacaucacuacuaguagaguaaaacaaucugauauuuugguccuccuguaacaacagcauaaaguacauaaaaucaccucuuaaauauucuggcuaaaaaacuguguauucuuuauauaaacaaagcacaaguaauuuccagauuaugggaaauaaagggguuagagaagaacaaguuaaacgauaccaagaagaaauaaucagauaaauccaaaggugagacauucuguaagauuacuggccuagacucuucaaaaagucauagggcugggggcaggggguagggggggaguacugauuauugauuauauauaguggaugauauuauuauuuauuucuguuagauuaacuacuguugauuuccuuguuaucacaaugauacugugaucaagcaggagacugaccuuauucuugggagaugacuuaaguauuuacaguauaguaaaaagaaaaguauacacagcugggagcgguggcucaugccuguaaucccaacauuuugggaggccgaggcaggaggaucacaaggucagggguuugagaccagccuggccaacacggugaaaccccaucucaacuaaaaauacaaaauuuagcugggcaugcuggugugcgccuguaaccccagcuacuccggaagcugaggcaggggaacugcuugaacccaggaggcggagguugcagcgagccuagauggcgccacugcauuccagccugggcaacagggcaagacuucaucucggggagaaguguauacacacacacacacacacacacacacacacacacacacccucauuaguucucuuaaacaacuagagauggagcgugugugcuugugugugugugugcguguguguguguguguguguguguguguguguguauaauuuuuuccuuuuuuugagacagggucucacucugucacccaggcaggagugcaguggugcaaucacagcucacugcauccucgaccucuugggcucaggugaugcucccaccucagccucccaaguagcugggacuacaggccugcaccaccacagcaggcuaauuuuuguauuuuuugaagagaugggguuucaccauguugccgaggcuccucucaaacuccuggauucagccaucugcccaccuuggcuucccaaagugcuuauuacacuuugggauuacaacugugagccaccacaccugcugagauggagcauauaaaacaaaauguuaacacuucguuaaucuagauggauaacuuccauccaguaguuccaguaguuacacagaugcuaauuguauuauuauuucaauuuuucuaagugcuugaauauuuuaaaaauaaagaauuuaugagggaaggggagaauuuacuuggacauauaauaaaacagcaaaagcaaguggaguacagguuugcaaaaucaagaggccauccaaaacacacacacacacacacacacacacacacacacacacacuuuugcuaauguauuuguggauacaacagugaaagucaaccaggaauauagauacaggcaugcucaaagaaagcaaagaucaaaagcuuuccuuaagauacagcaaugagauuaugcagaccauuacucacucuucuuuaaagugaucuuuacauuuacagugaguaacaaguaaauaaagauaccucccauauucggguuuccuaaaguauguuguaacagaaaagauuguuucuuuaccucaagagaaauaguuuauaaaccacuuucaacuaauagcuguucagcaaaaaacaaaaaguauacaaugguuacuaaaaagaaacuuguaaacaaaauuaccaagagcauuacuuucagauacaugaaaaaaauggccuggggguggucccccuucauuauaaaaggggauggaaaaccaaccaauaguuccucuuuuacaaaaaccaauccuuuucaaaugaagcacuaggucuauucguuacacaccggaucuacauguuacacauauaaugguuuauauauuauacaauguaaaucauauuuuguaauuuuuacuuuuuuucaauaaucuaaagcaguuuuaaauaucuguaguauuuccagcagugcugauuuauacuaugacuaauuacaauaacugagaugcauaacacuuuacagcuugcaaaauucaguccaucaacuaauuuaaucuuuacaacuaaucugugagguuaaacuguaaauauuuucacccaugaauagaacuauggacuggggcacagaaagauuaacucaugagaguaguaagagguacaacuggcacuaaaaacuaagcuuucuacuacagcccacuaacaaauguuauuguacuucuaacaguauuauaaauaguaaauauaaaauaagucuccugugccauccauucccuucagcgcccauuuauuuccaaaaguaaucacuucuaaccauuucuuuuuacaauacauuuuuauuuaaucaccuaaaaacuuuuauaaaaaguaaaacaauaucaagucucuuccucauauguaguuaguacauacauuuagguaaauuauagacaucaaaauaaggaaaguuccauuggugaugaguuaaucuuuggccacacagacauguaguagaagugcucaugaaucuuuagaaacuuccguauccauuaaacauacaaacacauucaaagaaagaagagacaacaaaaagggggaaaaggagaggagacagaaaaggugaaucaaaaaaaaaaaguaaugaacaagaauuaaaugugccaccaacuaauuaaagacagaugcauaaggaauauccucauuaagcacucacauguauacguaagaguucuugaaaauaaccuaguaaaaauuuacuccuaaagcauacaugaagaauaaaguagguugggcgcaguggcucacgccuguaaucccaacacuuugggaggccaaggcaaguggaucgugaggucaggagaucgagaccauccuggcuaacauggugaagccccccgucucuacuaaaaauacaaaaaauuagccgggcuugguggcgggcgccuguagucccaccuacucgggaggcugaggcagaagaacggcaugaacccaggaggcagagcuugcagugagccgagagagcgccacugcacuccagccucggcaaaagagcaagacuccgucucaaaaaaaaaaaaaaaaggauaaaguagagaaacaccagucucaaugaaacauggauucucaguaacugguuacucucuaaugaaguaauucaauuccacacucaagccucacaauuacaaaucacuacuguuaugaaccuucagcguucccugagaacagucaaaccugcaaauacaacaauuauaguaguauaauuaaauaacacccgauuaaauuggauggggucucccaacaacauuuugauuauuuuuaaaaaggcaccucaaagggcaugaaacucaagaauuauuauuucacuuuuguuuguguuaaauuauaaaauuuucauaaugccaaaguaagcacuuguccacauggcauuuuuauccaucugacuucaaaaucuauuaaaaaaaaaaaaaucagcuaggaaaacuacucauauaguugcuuuuuaauggggagugggaggggguggaagcucuaauuucuucauaaaaauaaaaacagcuaggugguguaacaggcagauaaaccacacaagucuaauuuuucuacacuaggauacaaaaaagaaacauucuuagcuguauuuuuacugccucuuaagaauauguuucucaauaaaaaauaagccauacccucacuguucauaauagaaauuuuuaaacaucuuaaaggaaagcauaaucacauuaugaauuuucucuuuuuuuuuuuuuuuuuuuuuuuuuggugagacacggucuuacugugucacccaggcuggagugcaguggcgcaaucucggcucacugcaaccuccaccucccagguucaagugacucuccugccucagccucccuaguagcugggauuacaggcaccugccacugcgcccagcuaaguuuuuuguauuuuuaguagagacgggguuucaccauguuggccaggcuggucuugaacuccugaccucaggugauccacccgccucggccucccaaagugcugggauuacaggcuugagccaccaggccuggccacauuaugaguuuucuauaauauaaugugauuaaucccaacugcaagacaggcuaaaaaaauuuuuuuuuaauuaaaagaguuaagaaaagacuaaacuaaaaagugauaacaaaaucacugacagugauaaauuuacaaggccacugaagaaacuuagaaauaaaugagacaaaugcuugugagauguauauuaacuagggccaacuuauucauaaaauauucugucucugauuacaucaucaaggaaaacuaaaccaaagagaauacuggcauuucuaauacccaaaaucauauugaaauauucauuguaucccaagacaauggcaauuuuucccugaaugucuuaguauaaacuuuaauuuugccaucuuguaugcaaugugcuucauuuuaagaugcauauaaucaagaaaauucauucacuuguagucuuuuucacuaaaguuguuucgaggggguuaggggaggucaacucauuucucacuucagacuuacauuuuuucuuugaacaguuauugacaaauacuuuuugcacuuaccuaucagcuucuuuaucuucaggcagcaugggaggcaaagguaacggugguaauguagaggugacuaaagcuacauguugcuccuucuccuuggcuccuaugcuugguguaagugguuugguuuucucuuuaagagauacugauuccuccuuuguagcagcagauuuacucuccuuuccaacuaugacugcuuucuugguggcuuuaucuacaaucaaauuauuuuccaccuucguuaccugaagagguggcuuuguuuuugcuuugucauuuuuuaaaguuccaccacuugagggagaaggugcauguucaauuuuaauuuucuucacauccuucacaugguuuguuugugaugcacuggcacuaguuuccguguuccccuugguagguguagaaguguuugaagcuuuugcagccuuggcagcagccucagcagccuuaguugcuucugcagcuuucgcugcuucugcggcucuugcugccucugcugcucgugcuuuuuuauucuuguucaauucagcugccaggcuacucuucagaguuagugugcuaggagaaauacuagaaugacgacuucuggaucuagacaaucugugccugcuacgagaucuugaaugccuagaugaauacgggcuucugcuucgggauuuuccagaccgucuggugagaaauaauuaagauuuaaucaguaauugagaaagguucaguuuggaauuuacaaagacagugcuaauucaaguuuaugaaauaaaauagaaauuuacuuaauuucaaaguuacauuuuugaaguuuugaaaaauaaaaauuucuuuaaaguagaguauuauuuggugaucauaguuuucuucaaaauggauugcccugaucucgcucuggucuacaaauguaaaaauuaggacgaaaaaugugacaaggcaucacugcugucucagaaaaaagaaguaggcaauaaggcuacaucaaugguaguaguagcagcaggguaaagucugacaaaucuuuuaccaggagacaguugccacaucucaaaaguaccuuccucaacuguaaguucagaaguaagcagugcucugucuauggcaagagugaaaaagacaagacuuacuacugggcaauaaguagagucucuuagaguucguuucagaaagauaguuuuaagaaaauuuacagccaggcgugaugucucacgccuguaaucacagcacuuugggaggccaaggcgggcggaucacgaggucaggaguucgagaccagccuggccaacauagugaaugaaaccccgucucuacuaaaacuauaaaaauuagcccggcaugguggcacacgccuguagucccagccacucaggaggcuagggcaggagaauuacuugaaccugggaggcggagggcuccauucaaaaaaauuaaaaaauuacauucacacacaguaacuaaaauagacauaagcauaaucacuuuacucacguaaacacacauauacaagauaauagcuuaugagcuacauaauuucacacagaaaaugcaacaaaguaaaaacuauccaaucacucuuaaucugaggcucugauacuuuucaaaaugaaugagaguaaaaaaguuaauauacauaucauuuaagucuucaaaguacuugacaacuauuauuuuaccauaauauuaaacauuuacuaguuaaguauuauuacucaauuucuuagaaaggaaaagcacagagaggcaaaguaaaaauaauucccacaaagaacuaugccacaaauaguaguauagucugaacuaggacuuagguuuucaggcuucuggcucuauaaaacaaugacaaacuaaaucuuggaaacuacuugauaauaaugaggccauucacuucucaaaaauuauuggaaaacauauauuuaaaaguauaguggcaagcaaaguucccacaaauuuaacacaguaccaagugaaaggaagcugagguuuucaaauccaugcauuaccaagacuuuuaaaauauacucacaagacaaagacauuaugauaguacuuucacauuaucucauuuaaugcccucaucaacccaguaaaguaugcauaguuaacagauaagaaauuggguaaaauauuacguuaccugaagucaacaccugaacucauuaguaguuguguugcuuauuaucuuacuacaacugcccuaucucccaauaccuuucugcccuacucugugcccaaugaugcugaccccaacagauaugccuucugaguuccagggcuguucugccacugacagaaggaggcagagaaaggcuggauuauuucuuccuagcucccucccuccucauggccacauuuucuggaagaagcugcaucccuccaccgccaugguugcugugaggcacccucuucacagcucucaagagacuccaauaacacuguauuuuuccuggcccuuugggcuucucugcugcuaguaaaaacaugccuuauggguucccuuaauccacggcaccucuguagucccugcauuaaagucucuuauaagaucugaguuggauucuauuuuuaucuacaacucaggucugaaacucagcauuuuuuuuaacucuaaaguaggcagguuaacacauuaacacacugccaaggagcuagcuggcgagaauguggagaaaagggaacccuuguacacuguagaugggaauguaaauuaguauaaccacugugaagaacaguuuggagguuccucaaaaagcuaaaacuagagcuaucuuauaauucggcaaucccacuccuagguacauaccccaaagaaaggaaaucaauaauacuaaagagauaccugcacucccauguuuauugcagcacuauucacauuagccaagauuuggaaguaaccuaaguguccaucaacagaugaauggauaaagaaaaugugguacauauaaacaaucuaguacuauucagccauaaaaagaaaaugagaucccgucacuugcaacagcauggauggaacuagaggucaucauguuacguaaaauaagugaggcacagaaaggcaaacuuugcauguucucacuuauuugugggagcuaaaaauuaaaacaauucaacucauggagauagagaguagaaggacgguuaccagaggcuggagggguagugacaugguggagggucgggggaggguuaaugggcacaaaaaauacaaagaaugaaggugaccuacuauuugcuagcacaauaggcugacuauagucacauuuuuuuucuuuuuuuuuuuguuuuuagucagagucucgcuccagcccuggcuggagugcaguggugcaaucucggcucauugcagccuuugccuaccggguucaagcgauuauccugccuccuggguucaagcgauucuccugccucagccuccugauagcugauacuacaggcaugccugcaccaugccuggcuaguauuuguauuuuuaguagagacaggguuucaccauguuagccaggcuggucucgaacuccugaccucaggugaucugccugccucggccucccaaagugcugggauuacaggugugaaccaccacacccagccaacagucaaaaauaauuuaaguguacauuuacaaaaaaccauaagaggauaguuggauugucuguaacacaaaggauaaaugcuuguaacacaaaggauaaaaggaugccccauuuacccugacaugacuaauaugcaugcaugccuguaucaaaauaucucauguaacccauaaauauauacaucuacuaugcacccacaaaauuuuuuuaaauuuuuauuucgugaauuuuuuuaauucaaaaaaaauaauaaauaggcagauaauuuuuuuuuuuuuuuugaaacagggucucacugucacccaggcuggagugcagagauacuacccacagcucacugcagccucgacuucuugggcuaaagcaauccuccaccucagcuuccugaguagcugggacaacaggugugcgccaccaugcccagcuaacuuuguagagacagggucucacucugcugcccaagcuggucuugaacuccugggcuccagggauccuccugccuuggcaucgcaaagugcugggauuacaggcaugagccaccgugccuggacacugaaaauuuccguucuuaguugacauuaauacaguguggagggaaguguuuagaaacauucuaauucuaggacaaaaacaaaaugaugauuagguuuaggauaaacucaaacacaaauucaacaucuaccccccucuuucaaaaacaaguaugugcuuugggucaacuaagguucaguauugaggaagcauuucauaaaaacccacacuuuaauaucaauaagcuuauaauuauacauagaaaugagaagaaauguuuggcuaaauaugaagugauuguaagcugguugugaaauaacuugguuaacuuuaauauaggaaccaaaagugucauaacaugaaauacucagccacauuuuuaauuuccucucccuucagauuuuguuggagcuccaaacaagucugauauacgucauguuucuauccccugaucagauacugaugaguagcagaaagguaagcagcagaagaaagcaguguaggaaaucaacuuuuccuacacuggcaagauucuggucaucaauuucauucagacacauaaacuauauuuaauugaaauuuacaaucagugaaucuuaucuaagaaaagagauacaaagauaauagguaaaaucccaacacaauucauucuucugaacuauuaaucucuuuuagacagaaucugaauaacagagauaaagacucagaaaacuuuuguucuauauaaagauauuuuggggccgggcgcaguugcucacgccuguaaucccagcacuuugggaggcugaggugggcggaucacgaggucaggagaucaagaucauccuggcuaacauggugaaaccccaucucuacugaaaaaacaagcaauggggaaaggauucccuauuuaauaaauggugcugggaaaacuggcuagccauauguagaaagcugaaacuggaucccuuccuuaaaccuuauauaaaaauuaauucaagauggauuaaagacuuaaacguuauaccuaaaaccauaaaaacccuagaagaaaaccuaggcauuaccauucaggacauaggcaugggcaaggacuucaugucuaauaaaacaccaaaagcaauggcaacaaaagccaaaauugacaaaugggaucuaauuaaacuaaagagcuucugcacagcaaaagaaacaaccaucagagugaacaggcaaccuacaacaugggagaaaauuuucacaaccuacucaucugacaaagggcuaauacccagaaucuacaaugaacucaaacaaauuuacaagaaaaaaacaaacaaccccaucaaaaagugggcagaggauaugaacagacaauucucaaaagaagacauuuaugcagccagaagacacaugaaaaaaugcucaucaucacuggccaucagagaaaugcaaaucaaaaccacaaugagauaccaucucacaccaguuagaauggcaaucauugaaaagucaggaaacaacaggugcuggagaggauguggagaaauaggaacacuuuuacacuguuggugugacuguaaacuaguucaaccauuguggaagucaguguggcgauuccucagggaucuagaacuagaaauaccauuugacccagccaucccauuacuggguauauacccaaaggacuauaaaucaugcugcuauaaagacacaugcacauguauguuuacugcggcacuauucacaauagcaaagacuuggaaccaacccaaauguccaacaaugauagacuggauuaagaaaauguggcacauauacaccauggaaugcuaugcagccauaaaaaaugaugaguucauguccuuuguagggacauggaugaaacuggaaaucaucauucucaguaaacuaucacaaggacaaaaaaccaaacaccgcauguucucacucauaagugggaauugaacaaugagaacacauggacacaggaaggggaacaucacacucuggggacuguugugggguagggggaggggggagggauagcauuaggagauauaccuaaugcuaaaugacgaguuaauggguacagcacaccagcauggcacauguauacauauguaacuaaccugcacauugugcacauguccccuaaaacuuaaaguauaauaauaauaauuaaaaaaaaagaaaaaaagaagaaaaaagaaaaaauacacaauagugaaaaaaaaaaaaauuagccgggcguaguggcgggcgccuguggucccagcuauuugggaggcugaggcaggagaauggcaugaacccgggaggcagagcuugcagugagccgagauugugccgcugcacuccagccugggugacagagcgagacuccgucucaaaaaaaaaaaaaaaaagauauuuuggaagcuacuuuuuauaguauuugaucacuauaucaacugaauucuucuacauacaacuuccguuccucuccaacucuuuuauuucucuacaaaaguuccuuccuuaaacuauuuauuucgucuuaguaaguuuccauucucucagauauugugauuugcuaauaaauuccaaaaauauauuuacuguuuauaacaaacaugguuugggaaccuaaaacuaaacaaauuucaguuuaggccauuuuuacuaaugauuaacauuucagccauaaaaaguuaugagaauaagagagaagugcaucuuuaaaacuauauaaugaauuauggcaugauaauguuuuacuaaaagaacugaaauggagguagguagcagguccaaccuccuuguuuaauagauaauuuuuuuuuuuuuuaagacagggucucucacuuuuucgcacaggcuggagugcaguggcgcaaacaaggcucacugcagccuugaccucuggggucaagugaucgucccaccuccaccccccaaaaguagcggggacuacaggcgcgcaccaccacacucgacuaauuuuuguauguuuugcagggauagggguuucgccauauuguccaggcugaucucaaacuccuggacucaagugaucuguccacuuuggccuaggguuacaggcaugagccacugcacccagccaagauuuuucuuucuaaaaauguuuuccuaauauuccgacacuguuguagaaauuaaugaauacauauuaccuguuucuugcuugugauguuuuuaagaggcuacaggaccucuuuaagaagagaacuuucuauguuucuaacagguuuucccaaauacacacaacacaaaguaguaccagaauaaaaacccaguauccugaaacccaacugguuagugcucguuguuagacuauuuaguguuccuuggagagcaauguauauuguucacuugacuauuaucucacaguuucuccaggagucuaggucuucugaaaauuauuucuaauuagcaaauacuguguccuaaaaauuuuacuguaauacugauaauauccaguccuccacuguugaaaauaacacagagcagcaucacucaauggaacuuucuggaugacagaaauguucuauacauaugaugcccaauacaguagcugcuauccacaacaucuuugaggccaauguuuccacucugcuuauuucucaugcuaauagcagcuguguccauuucaaaaacuuauuaacccccccaaaaagguaugaauaugacucccaaacugaaaaucacuauauaaagugaugauccuguguauuuugucauguaacguuauuauaacagcucuauuaacuauauguaacagcacugugguagccucuuaaauucaucuccuuguuucaaauuuucuuccacucuaaucuauauuacuagacgcaaaauacuauucucaccaguuccugaaauuaugacuugcaaagcaaauauacccuccuguaacaucuacuccuuaccauucucuauuuuuaauuucacuacucuccacucauuuacccaggcuagaaaucuaguuucccaguucccauaccacaaccucuuaauugucucauuuuacugauucuaacucuauacuauucccuuauauccauacccucugaaugugucugaucguuguuguaacagaaaacuccacaaagucagcaguuuagaacaacacaaauuuauuuucuugcaguucugcaugucagaaguccaaaaucagucucagugaacuaaaaucaacaugucaccagagcuuuguuccuucuggagucucuugggaaaauguucccuugccuuuuccagcuuccacaggcugucuacauuccuuggcucaaaaccuuacaucaccugggccucuacuuucaucaugacauuuucucucuccuauuccugucaucacgugaguucucugacuagacccuacagccucucuuuuauaaaaauccuugugauuacacaggacccauccagauaacccagaauaaccccgccauaucaacauacuuaauuuaaucauaucuacgaaguuccucuuaaaauguaagguguaacagucagagauugaaaagauuagggcauggcaccuggagggggugugguguugggugaguauuauucggccuaccacauccuccucuuccauucucgaggacacuguucuacuuuagaccucauuaccacuucccuagaguaccauaucaucuuaaaaaaauaagcaaucucuuggccacgugugguggcucagaccuguaaucacagcacuuugggaagccgagaugggcagaucaccugagggcagaaguucgagaccaaccugaccaacauggagaaacccugucucuacuaaaaauacaaaaucagacgggugugguggcgcaugccuguaaucccagccacuugggaggcugaggcaggagaaucgcuugaaccugggaggcggagguugcggugaaccgagaucaugccauugcacuccagccugggcaacaagagcgaaaacucugucucaaaaaaaaaaaaaaaagaaaaaaaagaaagaaaaaaaucuacguuacuagucuuuuuuacuuuauuacuagucugugucugcuccauuucuacagacaccauaaccaaacuaauccucacuguucagcgauuauuacaugucccaaauucacucauuuuccuccucuuaguagcuauuccaaacuuucacaacuuucaucaagcucacacaaucccauuccuagucuucucauagcauagcuuuacuuauuguuucacagaaaaaaacaaagacuaccaggcaugucucuugccugcaaauuuaaucuguauuuccugugccuucauccaccguacacuccaccucaauuaagaaaggagguguuccucuuucuaucuaaggcuaacuccccuauaaugcaucaaucucauacucucuagagccuuacuucuuagaguguaguccauagacaggcagcaucagcaccaauugugagcuugucagaaaugcugugucucagacuccagcccagaccuacugaaccacaaucugcauuuuaacaagauauccauuaaagucugagaugcacuaugcuaggcuacucuaugacaauagcuggcuuacucuauuaauugugauguuaaccuuugcuguucauuuguuaauuccccugaaggaauaaauuacucaaaucucuaagauauuuaaaaacagacaagaaaacaaaacaaagagaaaaugaugacauacugauauuaucuuuaucuguccuuccaguuacggccaaaaucucuuuuguccuuucaauccucaaaucacuacaaucuggcuuauacauacauccauucugcaacuggucaccucugaagcaaccaaugaccuaccuuucaaaaaaagaaaaagaaaaaaacgucacugucugugauaauguuggcuacaaccuuaaaagucucucucugcugcaauuauuuggagcacuuccuagcuauuucuacuaccuuucaucuucaugauuuucuuacuucuauggcuguuuccgcaccuugagguuuuucuuccuuccuauauucauucucccacaaguuuaauuuaugcuauguguggcuuaaaugauuaccuaaauguugucaauucgucccccaucacccccgcaaaucauccucucuacuuccaacucugacauguaucuucaacacaauacagcuaaaacuauuaagcuuccucuucaaauccacccuccuucuccuuaaauacacccuauucugaggcaguggcacccucuaaaacagcagaaaccuggaaauuauucuacauuccacaugaucucuuuuaucucuucucacagaucuauuugguuuccaagcuccaccaauucuacaucucaagcaucucuccauuuuuccaugcucuuuauccccauagcuacuauuccacauuagguacuacaucaucacacacugggcccagugcaagucucccuaccagguucccaccucgagucuccacccuuuccaauuaacucugcacuugaauaaucuuucaguuaccccaaagccuucggcccugcuugacuugcauauaaaguccuuguccagccaucacaaaauauaggaagugucaggccuagaauguuucucucauauuccucucuucaccuccuuuauguaggaaacaaaaggauacuucguaucucagcacaguguuuaccaccuuuauaaagcccucucuuauuacgccagucagcuagagcugguacuuguccuacgaucccaucacaauucuguuuauaucucagaauaaaaauaaucagauaaucuaucuuccccaacuaaacugagauauucuauccucaagccuugacuucuaucauaaaccuagcagugguagaugcucaauaaauauuuacacaauuaaagacacugcugauaguauuccuauugaaaagaauucacagcagccuaguaucaagguacugcauaauuugucugguccuaaccuaccuuugcuuaucaaguacuaaauuugcccaauacuuccaugccuuuauauucccacauacuggccuagugagaauaucaucuugcccuccaucuucuauucaaggcuuauccaucucucaaggacuagcauaaaggacuucauaaagccuuaugaagaaagaagccaaauccaaacaagcagcacggucuccauucuaugaacucccauagcauuuuaucugcacccuucuuaugauaacucuuaacuucacauuuuagauaucaaccacauugucuaucagacugcacccucuuugaggagcagaaaccgagucuaauucauuguuguaucacuccacagccccuagcauaauucaguguuuuauucacugaauaaaacaaauaccguacagcaguccccucguccucaauuucacuuuccaugguuucucuuaugcaagguacgguauaauaagauauguugagagagacccuacauucacauaacuuuuauuuuaggguauuguuauaauuguucuauuuuauuauuguuguuaaucucuuacugugccuaauuuauaaauuaaacuuuaucacagguauguauguauagaaaaaaacauaguauauuuagaguggaguacuauuuuggugguuucagacaaccgcugggaguauuagaauauaugccccauggaaaacuggggacaugacuguauaccacacuaacccucacagguucacauuuauaagcauuuuucauuugauuugcuccucaugugcaaccaagguauagagaaagcagaugggggaacuaagaagaggcagagucaauauucaaacccaagucuuucacuucaaagccaagcacuauuuauugcuaccacacuaucucuuucuccuccauuuguuucugugugugugugugugugugugugugugugugugugagagagagagagagagagagagagagagagagagacggaaucucgcucuguugcccaggcuggagugcaauggcaugaucucggcucacugcaaccuccgccucccggguucaagugauucuccugccuuagccucccaaguagcugggauuacggcacccaccacuacacccagcuaaauuuuguauuuuuaguagagacgggguuucaccauguuaggcuggucucaaacuccugaccucaggugauccgcccaucucggccucccaaagugcugggaguacaggugugauccuguuuaauucuuaucuauuuugcaugggucaagcuaaagucucaucucuaucacuucccuauuugcugaucacacaguacuuguuacagguuggcuuguauuuuaugucuuugucuuuuaaaaacauaaauuggauuaugccauguccuugcuuaaaacucuguagugguuuccaacugcauuuaaaauaaaaauaaaacucuguguugugacucacaaggccuaaaccgccuuccaucuuuauuauacccuucuuuauuuaccagacuccagccaugcuggucuccuuucugcuuuugcagaaggucaagcuucuucuugacuuggugccuaagcaugcaucauuuucuuuuccugggaugcuuagaucaucacauggcgggcucucucucaucauuucaacauuaaugcauacauuauucauuauaaaacacuguucaaauguuucuguacacaugguauaugagaaaccaauguggcaaucauuacacacauacuacaaaauaggagauuuccuuuuuucauggccccuagaauaguaaugaauacuuauauuaauauaugcucacauauaggggucaaacaagguauuugagggguuuuuuuuguuuugcuuugagacagggucucacucuguugcccaggcuggagugcaguggugcaaucuuggcucacugcagccucaaccucccaggcucaaagcgauucuccugccucagccccucaaguagaugggacaagugcacaccaccaggcccggcaaauuuuuguauuuucuguagagacaaguuuuugccauguuucccaggcuaaucucaaacucuuggguucaagugacccuccugccucggccucccaaagugcugggauaacaggugugagccaccaugcccaacccagaauuuuuuuuacaccagagcuuaagacuuugagagaaacaaagucuuuuuuuuuuccugacuucugcaaugacuuggaaucaaagucauuauuuuuauuaaaaaauaaaacuagccauuuaugacgaaucugcagcuaacuacuuugcgaauaaagacuaaaugaggaacaagacaagaaagucccuucucauuccucuguucaacauuguauuugagguucuagccauuguaauuagucaaggauaagaaauaaaaggaauuccggcugggcacuguggcucacgccuguaaucccaguacuuugggaggucaagguggguggaucaccugaggucaggaguuugagaccagccugaccaacauggcaaaacccuguuucuacuaaaaauacaaaaauuagccagccaugguggcacucaccuguaaucccagcuacauaggaggcugaggcaggagaaucacuugaacccaggaggcagaguugcagugagccaagaccgugccacugcacuccagccugggugacacagcgagacuucaucucaaaaaacaaaaaaaaaaaaaaaaaaagaaaaaaagaaaacaaucccauugcaauagccuuuaaaaggaugaaauaccuaaaaguuuaaaaagugcaaggcuuauacccugaaaacuacaaaacacacuaaaaaauauuaaggaaaaucuaaauaaaaggaaagacaucccguguucacguauuagaugacuuaaauuguuaaaagguaauacucccuggccaggcgcgcuggcucaugccuaugaucccaacaccuugggaggccaaggcaggaggagcgcuugagccuaggaguucaagaccacccugagcaacauagugaaacccugucucaaaaagaaaaaaaaaaaauuaacaagauaauacuccccaaauuaaucuaaaaagucaauguauugcaguucuguagugaugaaacaaaaaauuuuuaaaaucaauguacucccuaucaaaauccuagcugcuuuuuugaacuaacuggcaagcugauucuaaaauucauuugaaaaugccaagaacccaaacagucaaaacaaucuuaaaaaagaccuaaguuggaagauucacacuuccugauuucaaaaauuacugcaaaaucagaguaagcaagacugugugguacuggcauacggacggauacauaaaucaauggaacagaauucagaguacauaaauaaauccuaacauuugugaucaguugauuuucaacaagggugcuaagacaauucaauggaaaaggaauacucuuuucaacaaauggugcugggacaacuguauauccacacacaaaagaaugaagcuagaccucuuccuuucaccauacaaaaaacuaacugaaaauggaucaaaguaggagcuauaacuauaaaauuuuuagaagaaaaugcagaaaaucuuugugaacacagauuaggcaaagccuucuuagauuugagaccaaaaaacacaagcaauaaauaauaaauuggacuccaucaaaauaaaauacuuuugugcuuuaaaagacaccaucaacaaagugauagaaugaaagaaauuauuuguaaaucauguaucugauaaaggacuuacaucuagaauagacaguauaaaaaacucuuaagauccuauaauaagacgacagcccaauuuaaaaaugggcaaagaaggccaggcauggugucucaugcccauaaucccagcauuuggggaggccaaggugggaggauugcuugagcuugaguuugagaccagacugggcagcacggcaaaaccucaucuauacaaaaauacgaaaaaauuagccaggugugguggcguguaccuguggucccagcugcucaggaggcuaagauagggaaauuguuugaguccuagagauggaggcugcagugagccaaaauugugccacugcacuuuagccugggcaacagagugagacccugucucaaaaaaaagaggggguaguggggguggacaagagauucauguagacauuucucaaaaaaagauuuuggccauuucucaaauggucaaaaacacaugaaaagaugcucaacuuuauuugucauuagagaaaugcaaaucuaaaccaaaaugugaucccacugcaaauaccaagauggcuacaaucaaaaagacaacucuuguugaggaugugaagaaacuggaacccucauauguugcugauaugaauauaaaaaugaugcagcuacuuuaaaaaacagcuugacagcucuuuaaaaucuuaaacauagaauuaucauaugacccagcaauucuacuccuagauauaugcucaagagaaaaacaaaugcucaugcaaaaacuuguacacaaauguucauagcagcauuaaaaaaauagccaaaaaguuaacccaaagguccaugacuaaugauaaaauguggcauaaccauacaaugggauauuuggccaauaaaaggaauauugauccauauacuacaacacagauaaaccuugaaaacauuaugcuuuagugaaagaauccagccauaaaagaucauacauuauaugauuccacugaaaugaaauauccagcauagguaaaucuacaaagacagaaagaaaucaccaaccguugguugccaaaacuguggaaugugggaauggggagugacugcuaaauagccauggaguuucucucuggagugacugaaauauucucaaauuagugguuacacaaagcuaugaagagacuaaagacuaauaaauuauaguuuaaaacaguaacuguacaguaugugaaauacauuucaauaaacauguuauuuuuaaaacuagaaaagauaacauaaaacugaaauguuuuguguuuauucuaaaaauacacuuccuuuaugguucuuaugccauauuaaaaguaacgacaacaacaacaaaaagacacguggcugacuuuuugcagauuugcucaagcaaacauguucuaguccacugagcauaaauucuguguuugucuucauguuucccugaaccaugccuugauauguauuuuugaagacagaaaaugaaaagcaggugagaagaguagaagggagcucaguacuugacaugcacaaaagcacauacuuugauuagucucucuguagccaucaagaauuuguucaaaguguauuaccagaccuuauuaauaucaacagaauuuuucuaaccguguggggcuggaccuuuuuuuguuuuuuuuguuuuucauuuuuugucuuuuugagauggagucuugcucuguugcccaggcaguggugcaaucucagcucauugcaagcuccaccucccagguucaagugauucuucugccucagccucccaaguagcugggacuauaggcgcccgccaccacguccggcuaauuuuuguauuuuuaguaaagacagaguuucaccauauuggccaggcuggucucgaacuccugaccucgugaucugccugccuuggccucccaaagugcugcgagccaccacacccagccuggaccucuuuuuuuuuuuaauccaaagcaauuuaugcugaaggaauaguuugcuagaaaauacaaaguguuuuuuuuguuuuuuguuuuguuuuuuugagaccgagucuuacucuguugcccaggcuggaguguaguggcaagaucuuggcucauggcaaccuccgccuccugggcucaagugauucuccuacuucagccuuccgaguagcugggauuacaggugcacaucaccacacccagcuaguuuuuguacccuuagcagagaugggguuuugucauguuggccaggcuagucuugaacuccuggccucaguugaucugcugcccuagccucccaaacugcugggauuacaggcaugagccaccacacccagcccuagaaaauaaaauuauaaaacaagacaggcaauuuaaucucacuugcuagguaccuacuaucaaaugcuguacuaggugcuuaagaaccacaaauauuuaaaaagucacaggacuugaaauccaaugguugaagcaaaaccaaaauauuacagaaauuuaucagcuagaaaugcaacaagucaaaauauuaaggaaaaaauuucaguuuaggauuccacacccaguaaaacaaucuuucaaaauggagacuuuaucagacauagaaaaagcagaccuacauaauaaaaaauguucaaagccauuccuccagccagaggaaaaugauacuacauggaaaguuggaucuguaaaaaggaaaagcauuugaaaagguaaacauuugaguaaauauaagugccucuucucauuuuaaauuuuaugucuguauuuaacacacauacaccaugcaaacagacauaaaacagaugacaacaggccaggcgcaguggcucaugccuguaaucccagcacuuugggaggcugaaguggguggaucacuugaggucaggaguucaagaccagccuggccaacagggugaaaucccagcucuacuaaaaauacaaaaauuagcugggcgugguggcacaugccuguaaucccagcuacuggggaggcugaggcaagagaauugcuugaaccugggaggcggagguugcagugagccaagaucaugccauugcacuccagucuagacgaagaaguaagacuccgucucaaaaaaaaaaaagaugacaacaguacaaaagacaagaugaaaauguaaguaugcuaucauaauguuaacauuauacauaaaaguagacugagaaacaugcacauuauaagccuaaggagaaaauaucuguuacuguggguuaggcaaaaauuuuuuuggacauaaaaugcauaaaucuggccgaacacaguggcuggcucacgccuguaaucccagcacuuugggaggcagaagcagguugaggucaggaguuugagaccagccuggccaacauggugaaacccugucucuacuaaaaauacaaaauuuagcugggcgugauggcacaugccuauaaucccagccacucaggaggcugagacacgagaaucgcuugaacccaggaggcggagguugcagugagcugagaacaugccugggcgacagagugagacacgcugucucaaaaaaaaaaaaaaaaagcauaaaucacacaaaugcuaaacugguuuuucauuaaaauuuaaaacguuugcucuuggaaauuacuguuagggaaagugagccacagacugaggaaaaaacguuugcaaaacauuuauuuguaucuagcauauacacagaauucuuacaacuuuaguaagacaacaacccaauucaugaagaaugaacauuuugagacacuuagcaaaaaauaggaagggcaaauaaacauauggaaguauacucaacauuacuuaucauuagggaauugcaaauaaaaccacaaugagauaccaauacacauccacuagaauggcuaaaaucaaagacugacaaaaaaaaaaauaagucuuauugaggaggugaggcaucuggaaucccauacucuacugacuggaaugcaaauggcaaagacauuuugaaaaacaccaugggacuguaggaagucaagcauucgcuucccauacaacaacacagcaaacccucuccuaacuuauucaagagaaacaaaaacaaaagaccuguacucaaauguucaguagcuuugcucauaacagccaaaaacuggaaauaacucaaaugccuaccaacuggguaaacuggauguaauaaguacucacaaagugaucucaguucuaaagguauuuuuaaaaaucacuucugaacgagauuaaugaagacuucauagauaaaaauaacaccugaggcuaggugccguagcucauaacuguaaucccagcacuuugggaggcugaggcagguggaucaccugaggugaggaguucgagaccagcuggccaacauggugaaacccugucucuacuaaaaauacaaaaacaacuagccaggcgugguggugugugccuguaaucccaacuacuugggaggcugagacaggggaaucgcuugaaccugggagguagagguugcaguuagcugagaucacaccacugcacuccagccacagagcgaggcuccaucucaaaacaaacaaacaaacaaacaaacaaaaaaacccaccugaacuaagguugaaagaaugagcaagccagacuggcaaacugaaggaaggauacaaacuaagauauaagaaaauaguaaacaguccaguuuguauugugaucaggauauacgguaagaaguaagaguaguuugguucagucuguguugggggucuuaaaugccccauucaagacucugauucaguggaauacucaaacccucaaaagaucccaaauggccaaagcaauccugagcaaaaagaacaaggcuggagguaucccacuaccugacuucaaaguuuauuccaaagcuauguuaauccaaagaguaugguacuggcauacaaacagagacauuaacugaaggaacacaauagagaacccagaaauaaacccauuuauagucaacugauuuuuggcaaaguagccaagagcauacaguaagaaaaggacagccucuucaauaaauggugaugggagugaggcacaguggugcaugucuguagucccagcuacugcagaggcuaggcgggaggacugcuugaaccuaggaguuccaagaccagccuuggcaacacagcaagacccugugucuuaaaaauaaacaggggugggaaaacuggauauccacauggagaauaaugaaaauagacucucaucucacaccuuauacaguagaaaggagaagaaaagcuccaugacauuaguuugggcaaagguuucgugguuauaaacccaaaaguacagggaacaaaaacaaaaauaaacaaagggauggaaucaaauuaaaaagccucugcaaagcaaaggaaacaaugaaguaaagugacaaccuguggauaaggagaaaauaccuacaaaccacauaucugauaacacauuaauauucaaaauauauuagcaacucaaaucaacagaaagaaaauaacccaauuucaaaaacgggcaaaggaccuaaauagacauuccucaaaagagggaauacaguuggauuuggugauuagugcuugaaucccagcuacuugggaggcugaagugggugaggugggaagacuccuugagcccaggaguuugagaccagccugggcaacauagcaagaucccaucucaauuuuuuuuuuuaaaaaggacauacaaauggccaacagauacaugaaaaaaugcucaucaucaucaauaaucaccaaggaaaugcaaacuaaaaccacuaugagauaccaccucccaccuguuagaauggcuagcaucaaaaaaaugaaagauaacaaguguuggcaaguguauacagaaaaggagacccuugugcacugcugguaugaauguaaauuacuauagccaucauggauaaugguauggagguuccucaaaaaaguaaaaacaagauuaccacaugaucccacuucuggguauauacccaaaggaacugaaaucaguaugcuuaggagaugucuccacucccauguucauugcagcauuauucacaauagcucagauauggaagcaaccuagguguccauuguuagaugaacggauuuuuuuuuuuuuaaugugguucagguuuguuuuuuguuuuauuuuguuuuugagacagggucucacucuguugcccaggcuggagugcagaggcguggcgcgaucucagcuuacuguagccuuuaccuccagggcucaugcaauucucccaguucugccucacaaguaucuggaacuacagguacaugccaccaugcugggcugauuuuucuguauuuguagagaagagauuucaccacguugccagggcuagucucaaacuccugagcucaagcgaucugcccaccucaggcucccaaaguacugggauuacaggcgugugccacugcacucggcuuagcuuuaaaaagaaguaaauugugguucucccagcacgcagcuggagaucugagaacagacagccggccuccucaagugggucccugaaccccgaguagccuaacugggaggcacccccgaguaggggcagacugacaccucacacggccagguacuccucugacacaaaacuuacagaggaacgaucaggcagcaacauuuacuguucaacaauauccgcuggucugcagccuccgcugcugauacccaggcaaacagggucuggaguggaccuccagcaaacuccaacggaccugcagcugaggguccugacuguuagaaggaaagcuaacaagcagaaaggacauccacaccaaaaccccaucuguacaucaccaucaucaaagaccaaagguagauaaaaccacaaagauggggaaaaacagagcggaaaaacugaaaaaucuaaaaaucagagcgccucuccuccuccaaaggaacgcagcuccucaccagcaacggaacaaagcuggacagagaaugacuucgacgaguucagagaagaaggcuucauucagacaaucaaacuacuccgagcuaaaggaggaaauucgaacccauggcaaagaaguuaaaaaccuugaaaaaaaauuagaugaauggcuaacuagaauaaccaacgcacagaaguccuuaaaggaccugauggagcugaaaaucaaggcacaagaacuacgugaugaaugcacaagccucaguagcugauucgaucaacuggaagaaaggguaucagugauggaagaugaaaugaagcaagaagagaaguuuagaaaaaaaagaauaaaaagaaacgaacaaagccuccaagaaauauggaaccaugugaaaacaccaaaucuacaucugauugguguaccugaaagugacagggagaauggaaccaaguuggaaaacacucugcaggauauuauccaggagaacuucccuaaucuagcaagguaggccaacauucagauucaggaaaugcagagaacgccacaaagaugcuccucgagaagagcuacuccaagacacguaauugucagauucaccaaaguugaaaugaaggaaaaaauguuaagggcagccagagagaaaggucggguuacccacaaagggaagcccaucagacuaacagcugaucucucagcagauacucuacaagccagaagagagugggggccaauauucaacauucuuaaagaaaagaauuuucaacccagaauuucauauccagccaaacuaagcuucauaagugaaggagaaauaaaauccuuaacagacaagcaaaugcugagagauuuugucaccaccaggccugcccuacaagagcuccugaaggaagcacuaaacauggaaaggaacaaccgguaagagccacugcaaaaacauaccaaauuguaaagaccauugaggcuaggaagaaacugcaucaacuaaugagcaaaauaaccagcuaacaucauaaugacaggaucaaauucacacacaacaauaauaaccuuaaauguaaaugggcuaaaugcuccaauuaaaagacacagaugggcaaauuggauaaagagucaagacccaucagcaugcuguauucaggaaacccaucucacgugcagagacacacauaggcucaaaauaaagagauggaggaagaucuaccaagcaaauggaaaacaaaaaaaggcaguggucgcaauccuagucucagauaaaacagacuuuaagccaacaaagaucaaaagaaacaaagaaggccauuacauaaugguaaagggaucaauucaacaagagcuaacuauccuaaauauauaugcacccaauacaggagcacccagauuuauaaagcaaguccuuagagaccuacaaagagagacucccacacaaaaauaaugggagacuuuaacaccccacugucaacauuagacagaucaacgagacagaaaguuaacaaggauauccaggaauugaacucagcucugcaccaagcuaaccuaauagacaucuacagaacucuccaccccaaaucaacagaauauacauucuuuucagcaccacaccacaccuauuccaaaauugaccacauacuuggaaguaaagcacuccucagcaaauguaaaagaacagaaauuauaacaaacugucucucagaccacagugcaaucaaacuagaacucaggauuaagaaacucacuccaaaccgcucaacuacauggaaacugaacaaccugcugcugaaugacuacuggauacauaacgaaaugaaggcagaaauaaagauguucuuugaaaccaacgagaacaaagacacaacauaccagaaucucugggacacauucaaagcaguguguagagggaaauuuauaagcacuaaagcccacaagagaaagcaggaaagaucuaaaauugacacccuaacauuacaacugaacuagagaagcaagagcaaacacauucaaaagcuagcagaaggcaagaaauaacuaagaucagagcagaacugaaggaaauagagacacaaaaaucccuucaaaaaaaaaaaaaucaaugaauccaggagcugguuuuuuuaaaagaucaacaaaauugacagaccgcuagcaagacuaauaaagaaaaaagagagaagaaucaaauagaugcaauaaaaaaugauaaaggggauaucaccacugaucccacagaaauacaaacuaccaucagggaauacuauaaacaccucuacgcaaauaaaguagaaaaucucuagaagaaaugaauaaauuccuggacacauacacccucccaagacuaaaccaggaagaagcugaauaucugaauagaccaauaacaggcucugaaauugaggcaauaauuaauagcuuaccaaccaaaaaaaguccaggaccacauggauucacagcugaauucuaccagagguacaaggaggagcugguaccauuccuucugaaacuauuccaaucaauagaaaaagagggaacccucccuaacucauuuuaugaggccagcaucauccugauaccaaagccaggcagagacacaacaaaaaauagaauuuuagaccaauaucccugaugaacaucgauacaaagauccucaauaaaauacuggcaaaccaaauccagcaguacaucaaaaagcuuauccaccaugaucaagugggcuucaucccugggaugcaaggcugguucaacauaugcaaaucaauaaacguaauccagcauauaaacggcaccaaugacaaaaaccauaugauuaucacaauagaugcagaaaaggccuuugacaaaauucaacaaugcuucaugcuaaaaacucucaauaaauuagguauugauggacguaucucaaaauaauaagagcuaugacaaacccacagccaauaucauaccgaaugggcaaaaacuggaagcauucccuuugaaaacuggcacaagacagggaugcccucucucaccacuacuauucaacauaguguuggaaguucuggccagggcaaucaggcaggagaaggaaauaaaggguauucaauuaggaaaagagaaagucaaauugucccuguuugcagaugacaugauuguauaucuagaaaaccccaacaucucagcccaaaaucuccuuaagcugauaggcaacuucagcaaagucucaggauacaaaaucaauguacaaaaauuacaagcauucuuauacaccaauaacagacaaacagagagccaaaucaugagugaacucccauucacaauugcuuuaaagagaguaaaauacccaggaauccaacuuacaagggaugugaaggaccucuucaaggagaacuacaaacuacugcucaaugaaauaaaagaggacacaaacaaauggaagaacauuccaagcucauggguaggaagaaucaauaucaugaaaauggccauacugcccaagguaauuuauagauucaaugccauccccaucaagcuaccaaugacuuucuucacagaauuggaaaaaacuacuuuaaaguucauauggaaccaaaaaagagcccacacugccaagucaauccuaagccaaaaggacaaagcuggaggcaucacgcuaccugacuucaaacuauacuacaaggcuacaguaacgaaaacagcaugguacugguacuaaaacagagauauagaccaauggaacagaacagagaccucagaaguaaugccgcauaucuacaaccaucugaucuuugacaaaccugacaaaaacaagaaauggggaaaggauucccuauuuaauaaauggugcugggaaaacuagcuagcauuauguagaaagcugaaacuggauuccuuccuuacaccuuauacaaaaauuaauucaagauggauuacagacuuaaauguuagaccuaaaagccuagaagaaaaccuaggcaauaccauucaggacauaggcaugggcaaggacuucaugucuaaaacaccaaaagcaauggcaacagaagucaaaauugacgaacgggaucuaauuaaacuaaacagcuuccacacagcaaaagaaacuaccaucagagugaacaggcaaccuacaaaaugggagaaaauuucugcaaucuacucaagugacaaagggcuaauauucagaaucuacaaugaacuuaaacaaauuuacaagaaaaaaacaaccccaucaaaaagugggcgaaggauaugaacagacacuucucgaaagaagacauuuaugcagccaaaagacacaugaaaagaugcucaucaucacuggucaucagagaaaugcaaaucaaaaccucaaugagauaccaucucacaccaguuagaauggugaucauuaaaaagucaggaaacaacaggugcuggagaggauguggagaaauaggaacacuuuuacacuguugguggacuguaaacuaguucaaccauuguggaagucacuguggcaaauccucagggaucuagaacuacaaauaccauuugacccagcaaucccauuacuggguauguacccaaaggauuauaaaucaugcugcuauaaagacacaugcacauguauguuuauugcggcacuauucacgauagcaaagacuuggaaccaacccaaauguccaacaaugauagacuggauuaagaaaauguggcacauauacaccauggaauacuaugcagccauaaaaaaugaugaguucauguccuuuguagggauauggaugaagcuggagaccaucauucucagcaaacuauugcaaggacaaaaaaccaaacaccgcauguucucacucauaggugggaauugaacaaugagaacacauggacacuggaaggggaacaucacacucuggggacuguugugggguagggggagggaggagggauagcauuaggagauauaccuaauguuaaaugaugaguuaaugggugcagcacaccaacauggcacauguauacauauguaacuaaccugcacguugugcacauguacccuaaaacuuaaaguauaauuaaaaaaaaaaaaagaaguaaauuaugucauuugugacaggaagauaaauacugcaugaucucacuuauauguggaaucuagaaaauucaaacucauagaaguagggaguagaauggugguuaccagggucuaggggagaggaguguauagggaaagggagauguugaucaaaagacacaaaguuucagauagacagaaguaauaaauuuuagcgaucuauugggcagaauggugacuacaauaaugcacugcauauucugauacugacaaaacaguaguuuuuuuguuugagacagagucuugcuuugugcccaggcuggagugucguggcgagaucucggcucacugcaaccucugccucccaaguucgagcuauucugcugccucagucucccgaguaguuggggucuacaggcacacgccaccaugcuuggcuauguuuuguauuuuuaguagagacgggguuucgccauguuggccaggcuggucuugaacucccgaccucaaguaauccauccaccuuggccucccaaagugcugggauuacaggcgugagccacugugcccagccaaagaguagaguuaaaauguuuucuucaauggcuguuucgagcuguguuaaaaaaaaaauuauuuuaaaaauguuuucaccaccaaaauagguaugugaugugacugauuucuuaauuaucuugauugaagcccuccacagguaaacaccaaaacaucacacacauaaacauauacaauuauuugucaauaaaaaauaaauuggccgggugcgguggcucacgccuguaaucccagcacuuugacaggccaaggugggcagaucaccugaggucaggaguucgagaccagccuggccaacauggcaaaaccucaucucuacuaaaaguacaaaaauuagccaggcaugguggcaggcgccuguaauuccagcuacucaggaggcuaaagcugaagaacagcuugaacccaggaggcguagguuguuacagugagccgagaucacgccacugcacuacagccugggcgacaacagugagacuccaucuuaaauaaauaaauuaauuuuaaaagcaucugauggccagaugcgguggcucaugccuguaaucccagcacuuugagaggccaaggcgggcggaucacgaggucaggagauuaagaccauccuggguaaaaugaugaaaccccgucucuacugaaaacacaaaaaaaauuagccaagcguggugacgggcgccuguagucccagcuacucgcgaggcugaggcaggagaauagugugaaccugggaagcggagcuugcagugagccgagaucaugacacugcgugccacugcacuccagccugggugacagagcgagacuccaucucaaaaaaaaaaguauuugauucuguaaguaucuuauagaaaaaaaaaaaugaucaaaugaaagugguauuuuaaaucugaaugcagagaacaggaggggcucaaagagaaaucuaaaagcaagcagaacuaacaaagcauuccaagauaaauguauggaccaaaagaccacuggaaaaaaaaaaaaaagaaaaaacuuuacagaacaagaaguucauuacaacuaugaagagauaaaaguacuacuaaaguuugacacuagguaccugggagaaacuacuaccacuuaaaacacacgugugcacacacacacagagacaaaucaaaaaccuaguccuaaaauaaaacguuacauaaagaagguuaaaagauaaaagacaagcucacgaaaaauacuugcuaaugccgcaaaaaaaaaaaaaaacaaguuaguagcuauaacacacaaguaggucuugcaaguuaauuuaaaaaaaaaaaaaucaagaaauuagaacaucuggccaggugcagugguucacaccuguaauccccgcacuuugaaaggccaaggcaggcagacugcuugagcucaagaguucgagaccagccuuggcaacacggugaaacgcugucucuaccaaaaauaaaaaauuuaacugggcaugcuggcaugcaucugcgaucccagcuacucgggaggcugaggugagagaucacuugagcugggagguggagguugcagugagcagauggugccacugcacuccagccugggugacagagugagacccggucucaauuaaaaaaaaaaaagaaagaaaaaggccaggcacgguggcucacgccuguaaucccagcacucugggaggcugaagcggguggaucaccugaggccaggaguucgagaccagucugaccaacauggaaaaaccucgucucuacuaaaaauacaaaauuagcugggcaugguggcgcaugccuguaaucccagcuacucggaaggcugaagaaggagaaucgcuugaacccgggaggcagagguugcggugagccgagaucgcaccauuccagccugggcaacaagagcaaaaaaaaaaaaagaaagaaauuaaaauauccaguaaacagaugaaaauauauuaaaccuuauuaaauaucaaagaaaugcaaaugaaugaaacgauaauggugccaggcaccaauaggggcucacaacuauaaucccagcacuuuggaaggccaaggugggcagaucauuugaggucaggaguucaagaucagccuggccaacauggcaaaaccccaucucuacuaaaaauacaaaacaacaaaaaaaaccaauaauggaauaugugacaacuccaaguguuggugagacucaggaaauggguaauuccacacuguugggaaauguaaauuuguaaaagccuucugaaaggcauuuugaaaguguaucaauguuacaaauguauauaccaccuuugccucaaaaauuuuauccccaggaaauucaaucuaaagauaauggaacaaauacacaaaaaaaaauuugcuuuagauauacacacauagcaaaaauuaaaaaaaaaacaaaacuaagaauuuaucaaaguggauucagccaaacaauuuaugcuauauccauacaacagaauacuaggagcuacuaauaaaaaugguaugcuguacuguggaguacaggcuacaagacagcauuguuacauguucccgcuuauggaaaaaucauacaucccugugcauauaugcauaaaaaagucuagaaaaauauuuaucaaaaugucaugagugaucaucucaucagguagcuggaccuaaggggccuuuuaaucucuuauacuuuucuauacuaacggaaaauuucuaccauuagccucuauuaugcuugcaaacaggugaaaaauaauaaagagcaguaacagaaaaaaaaugacucuaagaaaggugaaauaauuuaauguuagguaaauugaguuuggaaugccaauaaaauaucccagugaaagugccccuaugcaacugaaaaugcaaacagaaaagcagggaggcguguagaucauuuaccauuuucgguuccucucacuaaccucauuuccauuuuacuuacauuccaguuuuaccuauauuuauccucuaauguacaucaauuuuacuuuccaaauacauaaaaaacacuagguucuuccacaauuuaaaugugcaggaauucaaggaacaaaaucacugcaaacaaguaaugcuucugauuuuagcuugguacuuuugcuuccaacacccacuucaaagcuuauaaauuuauagaaaacaaagccaaccaaaaccaaaauaacaacaacaaaaugauauucacacaaaaaaaguccaaaauaaaggaaaaaauuaaaauuaucuuauaugugaauauuaagcaacauucacuuccaacugguuuuucaaaaauagcuacaauuuuucagaguugggaaauaaguuugacauaaugucugcucagaaaauuuucucuuuaaagauuaauucaaacgcaccaagaauuuaucuugaucagcacaacagagggcaaauauaaacacuaggucugaauuuauuccauucacacuaaagugacucccagcauccucuacucauucuaauaaaguagaagcuagaaggagguucuuaaauucccuccuuauaaaucgaaacaauuaccugcccuauccuagaguaugagaguguauguaaaccaaaauaccaagcaaguuuacagauauaacucgcaucugugcagacugguuugcacuaaucuguagagaaaaaauguauuuaaauuaaaccaccaauaaauaagcucuguaauuuguccucuaggagcuuacaaucuaguagggaaaacacaaaggcagccagccaacuaagcagauauuaaacagaauuuuuuaaaacucuacaacaaagauaaagugcugugggggcacaggaaaaaaaacuaacuuuuaucuagaugaauggaaaaaggucucaagauagugggauuuaaggcuggacacacuggcucaugccuguaaucccaacacuuugggaggcaaggacaggaggauuguucaaccccaggagaccagccugagcaacacaguaaaacaccaucucuaccaaaacacacacacacacacacacacacacacacacacacacacacgacagugggauuuuugagcugaguuuuaaaugcaaagcuggagaugaagagcaaaagagaguuuggagugucucuuaucauuuaagcuaacagaacagcaaguauaaaaauagaaauaaaaaugucuuugaaaacagaacugugauagaauggagccagaucauaaaaggcauuaacugauggaacauuaggaaguuuagacuuggccaugcacagcugcucuugccuguaaucccaacacuuugggaggcccaggcgggaggauugucugaggccaggaguucaagacaagucagagcaacaugguaaaacccaucacuacaaaaaacacaaaaauuagccaggcaugguggcaugcaccuguaaucccagcuacucgggaggcugaagcaggaggauccucugggcccaggaguucgaagcugcugugagccaugaucacaucaucacugcacuccagggugggcaagugaccuagacacuaucccuaaaaaaaaaaguuuagguuuauucuaauaauaauucuaauauaaugggagugacaugagcuaaacaaagauauuaagaaaacucuccugauacagaaugaacugagaagaauggaugaaacgagaagaauguucacaguaacaugaagucuagcuaauuaaccugaaauggugauagaaauggaaagaaauaaauauuagcguuagcggaaaagaaaugugauaaggacugaguagauguaaaugucaggugaaguuuggucagagaaggagcaaaacacaaggccaucacuuugagaaugaaaauaaugauuacagcuuuggaaauuuaagacaguuaaccuaaacuuccauucccuucugagaguuucuccauuuguucuaguauccuauuuuuugacacuuuuuaaaagcauuuuaagaauuccauucaccuagggauuuucaugacuuauuucuauuaaguauauauuaaaucaguggcauauuuuuugaguuuuuuuuucauuacggaauaucuucauuucauauacuuuugaacuauaguuuucaggacaaaacacuaaauaauccauuacagagguaccacauauaacaauaauuuuucuuauuuauauuuagaguccacccaucuuuuucagauucuuagguucuuauuauuccauaaugaaugcuucugugcuucuugguggaauggaacuuccauagguuuagagaaagaacaaaacacacauaauaauuucuugcacggauuuuaaucugacaucaguaacuucagaucaaaauaauucuggaaaaccaccaccaauaacuaagaguaauuaaugucuucaagaaauguuuuuagccaaucuuuguaaagacaaaguaggaaaaacauccacaagauuuaaacccaauuguucauaaaaacuacaaauaaacacaaauaagcugaaagaaucuuuagaagauucaucuuuuaaaaucuucaaaaugcugauaaaauggccaaggaacagaaaccaacacauaaauacccaagcagaagcugauuuuucaccaaaacaggucauuaugugagguggccagcgccccugaaugccaacuaaauuucaauaaagcauaugcuuuaagugguaaguggcccauguucuuuaaugaauagacugcuguuagaauucuucauauuguaaccaaaauccaccuucauauuguaaccaaaauccaugcucuuuaauauuaagagcauguacuuucaaaucagccuaggguuugaauccaagcugaccuuggaacaaaucgcuuaaaaccuuuuagagcucccguuucccaauccaucaaugggaauguuuccaacuaucacauggauuuugguggucaauauauguuaaauauuuaucaaugccuggcacacaguaaaacacuacaaacgguacccuccccucuuuucagcacacccucacauuuauuauagggccagucagcaagauuacgugaccuuccacaccccaacagucaaguaguaaagaaaauacggcaaacagauuauacaggggaaaaaguaaagcuaagagggaacugaugaaaagaaaugcaugagccgaggacugaagauucaaaugaagacaaagaacaaguugugaaguggaaaucacuaaaaugaaaaggauuuauuuaucugacaucaaaaaaagcuucaggcuggaugugguggcucacaccuguaaucccuggacuuugggaggcugaugcagcagguggaucauuugagcccaggaguuugacaccagccugggcaacauggugaaacccuaucucuauuuucagcuuauuuaaaauuguuuuucaucuucauaccacgauuucaauacuauuuugaauguguaugcauuuccuugaaaauaucuacgcugacaauucauuaauauguaaguucugcauaggcuggggaaauauuacacuguuucuuacagcauuacacauggucuguauuaaauauuuugaaugaaguuuguaauacaaagcccacauuaauauuuuguauguucaguaaacuccagcaucccuucauuuacaccuauucaacauuuauuaagaguguacuugugccagauacagugcugagcacuagaaauacaaugauggauaagacagcccaguugccuucauggaacucacagcaguccauucauuaaagaacaugggccacuuaccacaaguaauaaauucugaaaauaaauaaaacuuuuccauuaaucuguacaagugaguucaauuaaccguuccuaaaaaguaacaauacacuuauuauauuuuaaaaucuuuagauuuuuccaaucaacuauuuuagcuauuaauucuaggcccuauguuuuaagcuggacauuugacaaacuagauauaaugugaaaaaucugaaaaccguaugaguuuuuuagucuagaagacucagaaaucaugacaacugucuuuauauuuuaaaggguuagcauacacgugugcucuguaccauuccaaaggguuaaacuuggagcaaugguucgaagguggauuuuggucacaauaugaagaauucuaacaauuugggauauugaauaauucaacgaccuuaaauauuucuguaaggcugcaugcuuuaaaaagauaaauuuucacuuaauccuugaaauaauccagaaaaacaaguguuucccuguuacaguuuaggaaacugagucuucaaggaucuugcuaaaacacucaagucccaaaucuagugaacagguugccucuaacuaacgugcuucccaccucuagauguauuucaggcacauaccaaauggccaucugucagcaauguuagccaagacacccuaaaguuccuuccaaauucaacucuuuagaaauacugguggucaauguaaacaccaugaaaagauuauguguugaacgguccuccagaaugcaagcucuaugagggcaaguaacuuuuucuuuccugcuacaucccaauaccuaaaacaguauauggcauacaauacagggucaaaaaauacuugcuaaauaugaauaguccuagucauacauaccacgauuauauauuucauauauguauauaaaaaauacauaccacuauuauacaauaaaggaucucgcugaaguauccagcaacuaaaaaaccugauaaguacaaaauccauucuuaaaauugcaucaagcacuuuaaauuguucaagugcugaaacuucaaccaaccaguuugcaaaacaaauucaacugcaaaaacugcaaacccuuuggcaaaguauuauaguuaaaaguaacauacaaagucuuacaagauacaauggcuaauuuugaugaaugaguuuuucaauucuucgcuaagguaucaacuaacauuuuaaguaugcuucaacacucuuuaagagugaagcaauuuauagaacuuuuuuggcuuaaagacaaacucacgcucagaucucuauaaacaucacaccuuuacauuuauuauggugauacuucaaaaaggucugcuaauuuugcagaugcauauucguauuauguugagauuccacauaacccauacuuagagguacuguacauccacuugccauuacugaaacccaggaggaaaaacugauacaaaugucauuuugcaauacucuacacuauaaggucuggaauguccaaacaucucaaggaauauaagaacccauaaaauacucgaaaguuguuuuuaaugcacuuugcuuaguggauaaguauauuuuaaggcacacuuuuuaaaaagaauauuauauaacaaaaaaggcaagaaagcuacagaaaaguuuuacuccaauuucauuaaauuaaauuacaccuuuuaaagauuucuggacaaagauccugauauuuaaaggucuaguuauauuguguuuuuauccuucggguauauaucuaagaaaaagucuacuuagcuuuuaaaguaagcaguuacaggcuuauaauaguauaagaauguacucagccauucacuugguuacacuagguuacaccacccagauuuauaauguuauuagcaacugggugucaucacaaaccaacaaagaaaccacagucuugucauuuuuucuaccuucuauaauuaugacuuugaaagaucagguaaaaacuaucccacacaagaauaucacuaaauagauaccuuuuuuaacuucaguauucagaacuaucggcuuccaccuaagcuuuuuuaacauacuaaaagaauaaacuuuacagaaaggcugcuucucccauuucuguaauaaucauaagaaacaucugcaauccacaucuaacucugacaucaguaccugauucuuauuccccuguacaauacuagaucuuaaguugcaguccauuccuaaauucccaacaaugaaaccucuucacagaacuuucaaaauuaagacuuaaaccaccucuagguuuacccaaauuguaccagaaaagcaaagagcaacugagagaaaccuguuaacacauuaaugcaacaagucugaaacuuuuaauucuuccuuagaaaucuucccugccacagcuaggagaaaaguucccuucgcccaguugcuuugucccuucgacccccuaaaaaagugucacgcgcgcgaaaacgccuauccuuccugggaggcucaggcgguguugucucgucucggugguggaccugagucguucugaggacccgggcaccacuuucccuuccuccuggggaucuggccagcgcagccaaggcacacacaggcagaacggcagaacucaccugagcacagggcuguagggacugcgagagcggcgccagcugcugcugcuguagggacuaggggacacgucgccgccccgcucguaggagcuguggcggcuguagcugggggagcggcggcgacuguaggggcucggggagcgcggcagccgccgagaauaggggcugcugccaccuccugccgggcugggggacuugcggcuccucaggcucugagaggcccugugggacaccgggcugucgucccggccucccagugggcugagggaccgccgccgccuguaggccuuaggcucggucuuguccucccgguaggccuugggcgguuccuuguaggccgaaggcggcuccuuggacgacuuaguccggcugcggugggccuucgagucccgguccuugcggcugcuacugcugcuggauguggccgaagcgcuuuuccggcggccgccgcugcugcugcugcugccgcucuuggcgaccucggcccguuccucgccgcuguggcuguggcggcugcgggacuuggaggccucgcugccaccgcgcugcccaucccgccgccggugcucgcgguggcgcuccuugcugcggccacugcugcugcggcggucccggcggggccugcgcuccgaccccuccccgcgccgcugggugccggaggaggaggccggacucccgccgcugccccccguucccccggcagccgucgccgccguugccgcgcuggccccccccagcagcagccccugcucggacugggagcucacauccucguauuccaccagcggggucacacccccgccgcuacuagcaccgccaccgccguccugcugcggcuggggcagcgagaagacccgacgcuucuccgccuccugcccggcgcggggcccgcgacgccgcuucugccgcccuccugcgcgccucuugccucucgccagccgcuugaccuccagaggggggcccgggcugaagcaagaggaggaggccgcggcggcggcggcugcggcggcggccgugccgggagcagccaggaagagcagaggcggcgggggcggcggcgguugcaggagcugcggcugcaggagcggcaacagcagcggcggcugcugaggggacaggaaucgccuccgcuugcggcguuccuccaacuucuucuccgcccagcucaggcccccgccuccccccagcgccguguccgagcugcucggcaucgccuagagccagccgcagagcgcggcgcgggugcggccuccucccgggucagauccuggccaucucccccgccggaaacgggagcggcggcggagggacaccgagcaccagagccggccgggaaaagcgccacgauaauccgggucgggacucgggucccuggguuccaggucacagugggguacgcagcagccuccgggccccagggaagcaggaauccgggcggcggagcucccgauugcgcucgucguccuauccucggcagcgaaaacaccagaugc

SEQ ID NO: 192409 - RNA, 146775 nt, Homo sapiens
gcaucugguguuuucgcugccgaggauaggacgacgagcgcaaucgggagcuccgccgcccggauuccugcuucccuggggcccggaggcugcugcguaccccacugugaccuggaacccagggacccgagucccgacccggauuaucguggcgcuuuucccggccggcucuggugcucggugucccuccgccgccgcucccguuuccggcgggggagauggccaggaucugacccgggaggaggccgcacccgcgccgcgcucugcggcuggcucuaggcgaugccgagcagcucggacacggcgcuggggggaggcgggggccugagcugggcggagaagaaguuggaggaacgccgcaagcggaggcgauuccuguccccucagcagccgccgcugcuguugccgcuccugcagccgcagcuccugcaaccgccgccgcccccgccgccucugcucuuccuggcugcucccggcacggccgccgccgcagccgccgccgccgcggccuccuccucuugcuucagcccgggccccccucuggaggucaagcggcuggcgagaggcaagaggcgcgcaggagggcggcagaagcggcgucgcgggccccgcgccgggcaggaggcggagaagcgucgggucuucucgcugccccagccgcagcaggacggcgguggcggugcuaguagcggcgggggugugaccccgcugguggaauacgaggaugugagcucccaguccgagcaggggcugcugcuggggggggccagcgcggcaacggcggcgacggcugccgggggaacggggggcagcggcgggaguccggccuccuccuccggcacccagcggcgcggggaggggucggagcgcaggccccgccgggaccgccgcagcagcaguggccgcagcaaggagcgccaccgcgagcaccggcggcgggaugggcagcgcgguggcagcgaggccuccaagucccgcagccgccacagccacagcggcgaggaacgggccgaggucgccaagagcggcagcagcagcagcagcggcggccgccggaaaagcgcuucggccacauccagcagcaguagcagccgcaaggaccgggacucgaaggcccaccgcagccggacuaagucguccaaggagccgccuucggccuacaaggaaccgcccaaggccuaccgggaggacaagaccgagccuaaggccuacaggcggcggcggucccucagcccacugggaggccgggacgacagcccggugucccacagggccucucagagccugaggagccgcaagucccccagcccggcaggagguggcagcagccccuauucucggcggcugccgcgcuccccgagccccuacagucgccgccgcucccccagcuacagccgccacagcuccuacgagcggggcggcgacguguccccuagucccuacagcagcagcagcuggcgccgcucucgcagucccuacagcccugugcucaggugaguucugccguucugccugugugugccuuggcugcgcuggccagauccccaggaggaagggaaaguggugcccggguccucagaacgacucagguccaccaccgagacgagacaacaccgccugagccucccaggaaggauaggcguuuucgcgcgcgugacacuuuuuuagggggucgaagggacaaagcaacugggcgaagggaacuuuucuccuagcuguggcagggaagauuucuaaggaagaauuaaaaguuucagacuuguugcauuaauguguuaacagguuucucucaguugcucuuugcuuuucugguacaauuuggguaaaccuagaggugguuuaagucuuaauuuugaaaguucugugaagagguuucauuguugggaauuuaggaauggacugcaacuuaagaucuaguauuguacaggggaauaagaaucagguacugaugucagaguuagauguggauugcagauguuucuuaugauuauuacagaaaugggagaagcagccuuucuguaaaguuuauucuuuuaguauguuaaaaaagcuuagguggaagccgauaguucugaauacugaaguuaaaaaagguaucuauuuagugauauucuugugugggauaguuuuuaccugaucuuucaaagucauaauuauagaagguagaaaaaaugacaagacugugguuucuuuguugguuugugaugacacccaguugcuaauaacauuauaaaucugggugguguaaccuaguguaaccaagugaauggcugaguacauucuuauacuauuauaagccuguaacugcuuacuuuaaaagcuaaguagacuuuuucuuagauauauacccgaaggauaaaaacacaauauaacuagaccuuuaaauaucaggaucuuuguccagaaaucuuuaaaagguguaauuuaauuuaaugaaauuggaguaaaacuuuucuguagcuuucuugccuuuuuuguuauauaauauucuuuuuaaaaagugugccuuaaaauauacuuauccacuaagcaaagugcauuaaaaacaacuuucgaguauuuuauggguucuuauauuccuugagauguuuggacauuccagaccuuauaguguagaguauugcaaaaugacauuuguaucaguuuuuccuccuggguuucaguaauggcaaguggauguacaguaccucuaaguauggguuauguggaaucucaacauaauacgaauaugcaucugcaaaauuagcagaccuuuuugaaguaucaccauaauaaauguaaaggugugauguuuauagagaucugagcgugaguuugucuuuaagccaaaaaaguucuauaaauugcuucacucuuaaagaguguugaagcauacuuaaaauguuaguugauaccuuagcgaagaauugaaaaacucauucaucaaaauuagccauuguaucuuguaagacuuuguauguuacuuuuaacuauaauacuuugccaaaggguuugcaguuuuugcaguugaauuuguuuugcaaacugguugguugaaguuucagcacuugaacaauuuaaagugcuugaugcaauuuuaagaauggauuuuguacuuaucagguuuuuuaguugcuggauacuucagcgagauccuuuauuguauaauagugguauguauuuuuuauauacauauaugaaauauauaaucgugguauguaugacuaggacuauucauauuuagcaaguauuuuuugacccuguauuguaugccauauacuguuuuagguauugggauguagcaggaaagaaaaaguuacuugcccucauagagcuugcauucuggaggaccguucaacacauaaucuuuucaugguguuuacauugaccaccaguauuucuaaagaguugaauuuggaaggaacuuuagggugucuuggcuaacauugcugacagauggccauuugguaugugccugaaauacaucuagaggugggaagcacguuaguuagaggcaaccuguucacuagauuugggacuugaguguuuuagcaagauccuugaagacucaguuuccuaaacuguaacagggaaacacuuguuuuucuggauuauuucaaggauuaagugaaaauuuaucuuuuuaaagcaugcagccuuacagaaauauuuaaggucguugaauuauucaauaucccaaauuguuagaauucuucauauugugaccaaaauccaccuucgaaccauugcuccaaguuuaacccuuuggaaugguacagagcacacguguaugcuaacccuuuaaaauauaaagacaguugucaugauuucugagucuucuagacuaaaaaacucauacgguuuucagauuuuucacauuauaucuaguuugucaaauguccagcuuaaaacauagggccuagaauuaauagcuaaaauaguugauuggaaaaaucuaaagauuuuaaaauauaauaaguguauuguuacuuuuuaggaacgguuaauugaacucacuuguacagauuaauggaaaaguuuuauuuauuuucagaauuuauuacuugugguaaguggcccauguucuuuaaugaauggacugcugugaguuccaugaaggcaacugggcugucuuauccaucauuguauuucuagugcucagcacuguaucuggcacaaguacacucuuaauaaauguugaauagguguaaaugaagggaugcuggaguuuacugaacauacaaaauauuaaugugggcuuuguauuacaaacuucauucaaaauauuuaauacagaccauguguaaugcuguaagaaacaguguaauauuuccccagccuaugcagaacuuacauauuaaugaauugucagcguagauauuuucaaggaaaugcauacacauucaaaauaguauugaaaucgugguaugaagaugaaaaacaauuuuaaauaagcugaaaauagagauaggguuucaccauguugcccaggcuggugucaaacuccugggcucaaaugauccaccugcugcaucagccucccaaaguccagggauuacaggugugagccaccacauccagccugaagcuuuuuuugaugucagauaaauaaauccuuuucauuuuagugauuuccacuucacaacuuguucuuugucuucauuugaaucuucaguccucggcucaugcauuucuuuucaucaguucccucuuagcuuuacuuuuuccccuguauaaucuguuugccguauuuucuuuacuacuugacuguugggguguggaaggucacguaaucuugcugacuggcccuauaauaaaugugagggugugcugaaaagaggggaggguaccguuuguaguguuuuacugugugccaggcauugauaaauauuuaacauauauugaccaccaaaauccaugugauaguuggaaacauucccauugauggauugggaaacgggagcucuaaaagguuuuaagcgauuuguuccaaggucagcuuggauucaaacccuaggcugauuugaaaguacaugcucuuaauauuaaagagcauggauuuugguuacaauaugaagguggauuuugguuacaauaugaagaauucuaacagcagucuauucauuaaagaacaugggccacuuaccacuuaaagcauaugcuuuauugaaauuuaguuggcauucaggggcgcuggccaccucacauaaugaccuguuuuggugaaaaaucagcuucugcuuggguauuuauguguugguuucuguuccuuggccauuuuaucagcauuuugaagauuuuaaaagaugaaucuucuaaagauucuuucagcuuauuuguguuuauuuguaguuuuuaugaacaauuggguuuaaaucuuguggauguuuuuccuacuuugucuuuacaaagauuggcuaaaaacauuucuugaagacauuaauuacucuuaguuauugguggugguuuuccagaauuauuuugaucugaaguuacugaugucagauuaaaauccgugcaagaaauuauuauguguguuuuguucuuucucuaaaccuauggaaguuccauuccaccaagaagcacagaagcauucauuauggaauaauaagaaccuaagaaucugaaaaagauggguggacucuaaauauaaauaagaaaaauuauuguuauaugugguaccucuguaauggauuauuuaguguuuuguccugaaaacuauaguucaaaaguauaugaaaugaagauauuccguaaugaaaaaaaaacucaaaaaauaugccacugauuuaauauauacuuaauagaaauaagucaugaaaaucccuaggugaauggaauucuuaaaaugcuuuuaaaaagugucaaaaaauaggauacuagaacaaauggagaaacucucagaagggaauggaaguuuagguuaacugucuuaaauuuccaaagcuguaaucauuauuuucauucucaaagugauggccuuguguuuugcuccuucucugaccaaacuucaccugacauuuacaucuacucaguccuuaucacauuucuuuuccgcuaacgcuaauauuuauuucuuuccauuucuaucaccauuucagguuaauuagcuagacuucauguuacugugaacauucuucucguuucauccauucuucucaguucauucuguaucaggagaguuuucuuaauaucuuuguuuagcucaugucacucccauuauauuagaauuauuauuagaauaaaccuaaacuuuuuuuuuuagggauagugucuaggucacuugcccacccuggagugcagugaugaugugaucauggcucacagcagcuucgaacuccugggcccagaggauccuccugcuucagccucccgaguagcugggauuacaggugcaugccaccaugccuggcuaauuuuuguguuuuuuguagugauggguuuuaccauguugcucugacuugucuugaacuccuggccucagacaauccucccgccugggccucccaaaguguugggauuacaggcaagagcagcugugcauggccaagucuaaacuuccuaauguuccaucaguuaaugccuuuuaugaucuggcuccauucuaucacaguucuguuuucaaagacauuuuuauuucuauuuuuauacuugcuguucuguuagcuuaaaugauaagagacacuccaaacucucuuuugcucuucaucuccagcuuugcauuuaaaacucagcucaaaaaucccacugucguguguguguguguguguguguguguguguguguguguguguuuugguagagaugguguuuuacuguguugcucaggcuggucuccugggguugaacaauccuccuguccuugccucccaaaguguugggauuacaggcaugagccaguguguccagccuuaaaucccacuaucuugagaccuuuuuccauucaucuagauaaaaguuaguuuuuuuuccugugcccccacagcacuuuaucuuuguuguagaguuuuaaaaaauucuguuuaauaucugcuuaguuggcuggcugccuuuguguuuucccuacuagauuguaagcuccuagaggacaaauuacagagcuuauuuauuggugguuuaauuuaaauacauuuuuucucuacagauuagugcaaaccagucugcacagaugcgaguuauaucuguaaacuugcuugguauuuugguuuacauacacucucauacucuaggauagggcagguaauuguuucgauuuauaaggagggaauuuaagaaccuccuucuagcuucuacuuuauuagaaugaguagaggaugcugggagucacuuuagugugaauggaauaaauucagaccuaguguuuauauuugcccucuguugugcugaucaagauaaauucuuggugcguuugaauuaaucuuuaaagagaaaauuuucugagcagacauuaugucaaacuuauuucccaacucugaaaaauuguagcuauuuuugaaaaaccaguuggaagugaauguugcuuaauauucacauauaagauaauuuuaauuuuuuccuuuauuuuggacuuuuuuugugugaauaucauuuuguuguuguuauuuugguuuugguuggcuuuguuuucuauaaauuuauaagcuuugaaguggguguuggaagcaaaaguaccaagcuaaaaucagaagcauuacuuguuugcagugauuuuguuccuugaauuccugcacauuuaaauuguggaagaaccuaguguuuuuuauguauuuggaaaguaaaauugauguacauuagaggauaaauauagguaaaacuggaauguaaguaaaauggaaaugagguuagugagaggaaccgaaaaugguaaaugaucuacacgccucccugcuuuucuguuugcauuuucaguugcauaggggcacuuucacugggauauuuuauuggcauuccaaacucaauuuaccuaacauuaaauuauuucaccuuucuuagagucauuuuuuuucuguuacugcucuuuauuauuuuucaccuguuugcaagcauaauagaggcuaaugguagaaauuuuccguuaguauagaaaaguauaagagauuaaaaggccccuuagguccagcuaccugaugagaugaucacucaugacauuuugauaaauauuuuucuagacuuuuuuaugcauauaugcacagggauguaugauuuuuccauaagcgggaacauguaacaaugcugucuuguagccuguacuccacaguacagcauaccauuuuuauuaguagcuccuaguauucuguuguauggauauagcauaaauuguuuggcugaauccacuuugauaaauucuuaguuuuguuuuuuuuuuaauuuuugcuauguguguauaucuaaagcaaauuuuuuuuuguguauuuguuccauuaucuuuagauugaauuuccuggggauaaaauuuuugaggcaaaggugguauauacauuuguaacauugauacacuuucaaaaugccuuucagaaggcuuuuacaaauuuacauuucccaacaguguggaauuacccauuuccugagucucaccaacacuuggaguugucacauauuccauuauugguuuuuuuuguuguuuuguauuuuuaguagagaugggguuuugccauguuggccaggcugaucuugaacuccugaccucaaaugaucugcccaccuuggccuuccaaagugcugggauuauaguugugagccccuauuggugccuggcaccauuaucguuucauucauuugcauuucuuugauauuuaauaagguuuaauauauuuucaucuguuuacuggauauuuuaauuucuuucuuuuuuuuuuuuugcucuuguugcccaggcuggaauggugcgaucucggcucaccgcaaccucugccucccggguucaagcgauucuccuucuucagccuuccgaguagcugggauuacaggcaugcgccaccaugcccagcuaauuuuguauuuuuaguagagacgagguuuuuccauguuggucagacuggucucgaacuccuggccucaggugauccacccgcuucagccucccagagugcugggauuacaggcgugagccaccgugccuggccuuuuucuuucuuuuuuuuuuuuaauugagaccgggucucacucugucacccaggcuggagugcaguggcaccaucugcucacugcaaccuccaccucccagcucaagugaucucucaccucagccucccgaguagcugggaucgcagaugcaugccagcaugcccaguuaaauuuuuuauuuuugguagagacagcguuucaccguguugccaaggcuggucucgaacucuugagcucaagcagucugccugccuuggccuuucaaagugcggggauuacaggugugaaccacugcaccuggccagauguucuaauuucuugauuuuuuuuuuuuuaaauuaacuugcaagaccuacuuguguguuauagcuacuaacuuguuuuuuuuuuuuuuugcggcauuagcaaguauuuuucgugagcuugucuuuuaucuuuuaaccuucuuuauguaacguuuuauuuuaggacuagguuuuugauuugucucugugugugugugcacacguguguuuuaagugguaguaguuucucccagguaccuagugucaaacuuuaguaguacuuuuaucucuucauaguuguaaugaacuucuuguucuguaaaguuuuuucuuuuuuuuuuuuuuccaguggucuuuugguccauacauuuaucuuggaaugcuuuguuaguucugcuugcuuuuagauuucucuuugagccccuccuguucucugcauucagauuuaaaauaccacuuucauuugaucauuuuuuuuuuucuauaagauacuuacagaaucaaauacuuuuuuuuuugagauggagucucgcucugucacccaggcuggagugcaguggcacgcagugucaugaucucggcucacugcaagcuccgcuucccagguucacacuauucuccugccucagccucgcgaguagcugggacuacaggcgcccgucaccacgcuuggcuaauuuuuuuuguguuuucaguagagacgggguuucaucauuuuacccaggauggucuuaaucuccugaccucgugauccgcccgccuuggccucucaaagugcugggauuacaggcaugagccaccgcaucuggccaucagaugcuuuuaaaauuaauuuauuuauuuaagauggagucucacuguugucgcccaggcuguagugcaguggcgugaucucggcucacuguaacaaccuacgccuccuggguucaagcuguucuucagcuuuagccuccugaguagcuggaauuacaggcgccugccaccaugccuggcuaauuuuuguacuuuuaguagagaugagguuuugccauguuggccaggcuggucucgaacuccugaccucaggugaucugcccaccuuggccugucaaagugcugggauuacaggcgugagccaccgcacccggccaauuuauuuuuuauugacaaauaauuguauauguuuaugugugugauguuuugguguuuaccuguggagggcuucaaucaagauaauuaagaaaucagucacaucacauaccuauuuugguggugaaaacauuuuuaaaauaauuuuuuuuuuaacacagcucgaaacagccauugaagaaaacauuuuaacucuacucuuuggcugggcacaguggcucacgccuguaaucccagcacuuugggaggccaagguggauggauuacuugaggucgggaguucaagaccagccuggccaacauggcgaaaccccgucucuacuaaaaauacaaaacauagccaagcaugguggcgugugccuguagaccccaacuacucgggagacugaggcagcagaauagcucgaacuugggaggcagagguugcagugagccgagaucucgccacgacacuccagccugggcacaaagcaagacucugucucaaacaaaaaaacuacuguuuugucaguaucagaauaugcagugcauuauuguagucaccauucugcccaauagaucgcuaaaauuuauuacuucugucuaucugaaacuuugugucuuuugaucaacaucucccuuucccuauacacuccucuccccuagacccugguaaccaccauucuacucccuacuucuaugaguuugaauuuucuagauuccacauauaagugagaucaugcaguauuuaucuuccugucacaaaugacauaauuuacuucuuuuuuuuuuuuuaauuauacuuuaaguuuuaggguacaugugcacaacgugcagguuaguuacauauguauacaugugccauguuggugugcugcacccauuaacucaucauuuaacauuagguauaucuccuaaugcuaucccuccucccucccccuaccccacaacaguccccagagugugauguuccccuuccaguguccauguguucucauuguucaauucccaccuaugagugagaacaugcgguguuugguuuuuuguccuugcaauaguuugcugagaaugauggucuccagcuucauccauaucccuacaaaggacaugaacucaucauuuuuuauggcugcauaguauuccaugguguauaugugccacauuuucuuaauccagucuaucauuguuggacauuuggguugguuccaagucuuugcuaucgugaauagugccgcaauaaacauacaugugcaugugucuuuauagcagcaugauuuauaauccuuuggguacauacccaguaaugggauugcugggucaaaugguauuuguaguucuagaucccugaggauuugccacagugacuuccacaaugguugaacuaguuuacaguccaccaacaguguaaaaguguuccuauuucuccacauccucuccagcaccuguuguuuccugacuuuuuaaugaucaccauucuaacuggugugagaugguaucucauugagguuuugauuugcauuucucugaugaccagugaugaugagcaucuuuucaugugucuuuuggcugcauaaaugucuucuuucgagaagugucuguucauauccuucgcccacuuuuugaugggguuguuuuuuucuuguaaauuuguuuaaguucauuguagauucugaauauuagcccuuugucacuugaguagauugcagaaauuuucucccauuuuguagguugccuguucacucugaugguaguuucuuuugcuguguggaagcuguuuaguuuaauuagaucccguucgucaauuuugacuucuguugccauugcuuuugguguuuuagacaugaaguccuugcccaugccuauguccugaaugguauugccuagguuuucuucuaggcuuuuaggucuaacauuuaagucuguaauccaucuugaauuaauuuuuguauaagguguaaggaaggaauccaguuucagcuuucuacauaaugcuagcuaguuuucccagcaccauuuauuaaauagggaauccuuuccccauuucuuguuuuugucagguuugucaaagaucagaugguuguagauaugcggcauuacuucugaggucucuguucuguuccauuggucuauaucucuguuuuaguaccaguaccaugcuguuuucguuacuguagccuuguaguauaguuugaagucagguagcgugaugccuccagcuuuguccuuuuggcuuaggauugacuuggcagugugggcucuuuuuugguuccauaugaacuuuaaaguaguuuuuuccaauucugugaagaaagucauugguagcuugauggggauggcauugaaucuauaaauuaccuugggcaguauggccauuuucaugauauugauucuuccuacccaugagcuuggaauguucuuccauuuguuuguguccucuuuuauuucauugagcaguaguuuguaguucuccuugaagagguccuucacaucccuuguaaguuggauuccuggguauuuuacucucuuuaaagcaauugugaaugggaguucacucaugauuuggcucucuguuugucuguuauugguguauaagaaugcuuguaauuuuuguacauugauuuuguauccugagacuuugcugaaguugccuaucagcuuaaggagauuuugggcugagauguugggguuuucuagauauacaaucaugucaucugcaaacagggacaauuugacuuucucuuuuccuaauugaauacccuuuauuuccuucuccugccugauugcccuggccagaacuuccaacacuauguugaauaguaguggugagagagggcaucccugucuugugccaguuuucaaagggaaugcuuccaguuuuugcccauucgguaugauauuggcuguggguuugucauagcucuuauuauuuugagauacguccaucaauaccuaauuuauugagaguuuuuagcaugaagcauuguugaauuuugucaaaggccuuuucugcaucuauugugauaaucauaugguuuuugucauuggugccguuuauaugcuggauuacguuuauugauuugcauauguugaaccagccuugcaucccagggaugaagcccacuugaucaugguggauaagcuuuuugauguacugcuggauuugguuugccaguauuuuauugaggaucuuuguaucgauguucaucagggauauuggucuaaaauucuauuuuuuguugugucucugccuggcuuugguaucaggaugaugcuggccucauaaaaugaguuagggaggguucccucuuuuucuauugauuggaauaguuucagaaggaaugguaccagcuccuccuuguaccucugguagaauucagcugugaauccaugugguccuggacuuuuuuugguugguaagcuauuaauuauugccucaauuucagagccuguuauuggucuauucagauauucagcuucuuccugguuuagucuugggaggguguauguguccaggaauuuauucauuucuucuagagauuuucuacuuuauuugcguagagguguuuauaguauucccugaugguaguuuguauuucugugggaucaguggugauauccccuuuaucauuuuuuauugcaucuauuugauucuucucucuuuuuucuuuauuagucuugcuagcggucugucaauuuuguugaucuuuuaaaaaaaccagcuccuggauucauugauuuuuuuuuuuuugaagggauuuuugugucucuauuuccuucaguucugcucugaucuuaguuauuucuugccuucugcuagcuuuugaauguguuugcucuugcuucucuaguucaguuguaauguuagggugucaauuuuagaucuuuccugcuuucucuugugggcuuuagugcuuauaaauuucccucuacacacugcuuugaaugugucccagagauucugguauguugugucuuuguucucguugguuucaaagaacaucuuuauuucugccuucauuucguuauguauccaguagucauucagcagcagguuguucaguuuccauguaguugagcgguuuggagugaguuucuuaauccugaguucuaguuugauugcacuguggucugagagacaguuuguuauaauuucuguucuuuuacauuugcugaggagugcuuuacuuccaaguauguggucaauuuuggaauaggugugguguggugcugaaaagaauguauauucuguugauuugggguggagaguucuguagaugucuauuagguuagcuuggugcagagcugaguucaauuccuggauauccuuguuaacuuucugucucguugaucugucuaauguugacagugggguguuaaagucucccauuauuuuugugugggagucucucuuuguaggucucuaaggacuugcuuuauaaaucugggugcuccuguauugggugcauauauauuuaggauaguuagcucuuguugaauugaucccuuuaccauuauguaauggccuucuuuguuucuuuugaucuuuguuggcuuaaagucuguuuuaucugagacuaggauugcgaccacugccuuuuuuuguuuuccauuugcuugguagaucuuccuccaucucuuuauuuugagccuaugugugucucugcacgugagauggguuuccugaauacagcaugcugaugggucuugacucuuuauccaauuugcccaucugugucuuuuaauuggagcauuuagcccauuuacauuuaagguuauuauuguugugugugaauuugauccugucauuaugauguuagcugguuauuuugcucauuaguugaugcaguuucuuccuagccucaauggucuuuacaauuugguauguuuuugcaguggcucuuaccgguuguuccuuuccauguuuagugcuuccuucaggagcucuuguagggcaggccugguggugacaaaaucucucagcauuugcuugucuguuaaggauuuuauuucuccuucacuuaugaagcuuaguuuggcuggauaugaaauucuggguugaaaauucuuuucuuuaagaauguugaauauuggcccccacucucuucuggcuuguagaguaucugcugagagaucagcuguuagucugaugggcuucccuuuguggguaacccgaccuuucucucuggcugcccuuaacauuuuuuccuucauuucaacuuuggugaaucugacaauuacgugucuuggaguagcucuucucgaggagcaucuuuguggcguucucugcauuuccugaaucugaauguuggccuaccuugcuagauuagggaaguucuccuggauaauauccugcagaguguuuuccaacuugguuccauucucccugucacuuucagguacaccaaucagauguagauuugguguuuucacaugguuccauauuucuuggaggcuuuguucguuucuuuuuauucuuuuuuuucuaaacuucucuucuugcuucauuucaucuuccaucacugauacccuuucuuccaguugaucgaaucagcuacugaggcuugugcauucaucacguaguucuugugccuugauuuucagcuccaucagguccuuuaaggacuucugugcguugguuauucuaguuagccauucaucuaauuuuuuuucaagguuuuuaacuucuuugccauggguucgaauuuccuccuuuagcucggaguaguuugauugucugaaugaagccuucuucucugaacucgucgaagucauucucuguccagcuuuguuccguugcuggugaggagcugcguuccuuuggaggaggagaggcgcucugauuuuuagauuuuucaguuuuuccgcucuguuuuuccccaucuuugugguuuuaucuaccuuuggucuuugaugauggugauguacagaugggguuuugguguggauguccuuucugcuuguuagcuuuccuucuaacagucaggacccucagcugcagguccguuggaguuugcuggagguccacuccagacccuguuugccuggguaucagcagcggaggcugcagaccagcggauauuguugaacaguaaauguugcugccugaucguuccucuguaaguuuugugucagaggaguaccuggccgugugaggugucagucugccccuacucgggggugccucccaguuaggcuacucgggguucagggacccacuugaggaggccggcugucuguucucagaucuccagcugcgugcugggagaaccacaauuuacuucuuuuuaaagcuaagccgagugcaguggcacacgccuguaaucccaguacuuugggagccugaggugggcagaucgcuugagcucaggaguuugagacuagcccuggcaacguggugaaaucucuucucuacaaauacagaaaaaucagcccagcaugguggcauguaccuguaguuccagauacuugugaggcagaacugggagaauugcaugagcccuggagguaaaggcuacaguaagcugagaucgcgccacgccucugcacuccagccugggcaacagagugagacccugucucaaaaacaaaauaaaacaaaaaacaaaccugaaccacauuaaaaaaaaaaaaauccguucaucuaacaauggacaccuagguugcuuccauaucugagcuauugugaauaaugcugcaaugaacaugggaguggagacaucuccuaagcauacugauuucaguuccuuuggguauauacccagaagugggaucaugugguaaucuuguuuuuacuuuuuugaggaaccuccauaccauuauccaugauggcuauaguaauuuacauucauaccagcagugcacaagggucuccuuuucuguauacacuugccaacacuuguuaucuuucauuuuuuugaugcuagccauucuaacaggugggaggugguaucucauagugguuuuaguuugcauuuccuuggugauuauugaugaugaugagcauuuuuucauguaucuguuggccauuuguauguccuuuuuaaaaaaaaaaauugagaugggaucuugcuauguugcccaggcuggucucaaacuccugggcucaaggagucuucccaccucacccacuucagccucccaaguagcugggauucaagcacuaaucaccaaauccaacuguauucccucuuuugaggaaugucuauuuagguccuuugcccguuuuugaaauuggguuauuuucuuucuguugauuugaguugcuaauauauuuugaauauuaauguguuaucagauaugugguuuguagguauuuucuccuuauccacagguugucacuuuacuucauuguuuccuuugcuuugcagaggcuuuuuaauuugauuccaucccuuuguuuauuuuuguuuuuguucccuguacuuuuggguuuauaaccacgaaaccuuugcccaaacuaaugucauggagcuuuucuucuccuuucuacuguauaaggugugagaugagagucuauuuucauuauucuccauguggauauccaguuuucccaccccuguuuauuuuuaagacacagggucuugcuguguugccaaggcuggucuuggaacuccuagguucaagcaguccucccgccuagccucugcaguagcugggacuacagacaugcaccacugugccucacucccaucaccauuuauugaagaggcuguccuuuucuuacuguaugcucuuggcuacuuugccaaaaaucaguugacuauaaauggguuuauuucuggguucucuauuguguuccuucaguuaaugucucuguuuguaugccaguaccauacucuuuggauuaacauagcuuuggaauaaacuuugaagucagguagugggauaccuccagccuuguucuuuuugcucaggauugcuuuggccauuugggaucuuuugaggguuugaguauuccacugaaucagagucuugaauggggcauuuaagacccccaacacagacugaaccaaacuacucuuacuucuuaccguauauccugaucacaauacaaacuggacuguuuacuauuuucuuauaucuuaguuuguauccuuccuucaguuugccagucuggcuugcucauucuuucaaccuuaguucagguggguuuuuuuguuuguuuguuuguuuguuuguuuugagauggagccucgcucuguggcuggagugcaguggugugaucucagcuaacugcaaccucuaccucccagguucaagcgauuccccugucucagccucccaaguaguugggauuacaggcacacaccaccacgccuggcuaguuguuuuuguauuuuuaguagagacaggguuucaccauguuggccagcuggucucgaacuccucaccucaggugauccaccugccucagccucccaaagugcugggauuacaguuaugagcuacggcaccuagccucagguguuauuuuuaucuaugaagucuucauuaaucucguucagaagugauuuuuaaaaauaccuuuagaacugagaucacuuugugaguacuuauuacauccaguuuacccaguugguaggcauuugaguuauuuccaguuuuuggcuguuaugagcaaagcuacugaacauuugaguacaggucuuuuguuuuuguuucucuugaauaaguuaggagaggguuugcuguguuguuguaugggaagcgaaugcuugacuuccuacagucccaugguguuuuucaaaaugucuuugccauuugcauuccagucaguagaguaugggauuccagaugccucaccuccucaauaagacuuauuuuuuuuuuugucagucuuugauuuuagccauucuaguggauguguauugguaucucauugugguuuuauuugcaauucccuaaugauaaguaauguugaguauacuuccauauguuuauuugcccuuccuauuuuuugcuaagugucucaaaauguucauucuucaugaauuggguuguugucuuacuaaaguuguaagaauucuguguauaugcuagauacaaauaaauguuuugcaaacguuuuuuccucagucuguggcucacuuucccuaacaguaauuuccaagagcaaacguuuuaaauuuuaaugaaaaaccaguuuagcauuugugugauuuaugcuuuuuuuuuuuuuuuuugagacagcgugucucacucugucgcccaggcauguucucagcucacugcaaccuccgccuccuggguucaagcgauucucgugucucagccuccugaguggcugggauuauaggcaugugccaucacgcccagcuaaauuuuguauuuuuaguagagacaggguuucaccauguuggccaggcuggucucaaacuccugaccucaaccugcuucugccucccaaagugcugggauuacaggcgugagccagccacuguguucggccagauuuaugcauuuuauguccaaaaaaauuuuugccuaacccacaguaacagauauuuucuccuuaggcuuauaaugugcauguuucucagucuacuuuuauguauaauguuaacauuaugauagcauacuuacauuuucaucuugucuuuuguacuguugucaucuuuuuuuuuuuugagacggagucuuacuucuucgucuagacuggagugcaauggcaugaucuuggcucacugcaaccuccgccucccagguucaagcaauucucuugccucagccuccccaguagcugggauuacaggcaugugccaccacgcccagcuaauuuuuguauuuuuaguagagcugggauuucacccuguuggccaggcuggucuugaacuccugaccucaagugauccacccacuucagccucccaaagugcugggauuacaggcaugagccacugcgccuggccuguugucaucuguuuuaugucuguuugcaugguguauguguguuaaauacagacauaaaauuuaaaaugagaagaggcacuuauauuuacucaaauguuuaccuuuucaaaugcuuuuccuuuuuacagauccaacuuuccauguaguaucauuuuccucuggcuggaggaauggcuuugaacauuuuuuauuauguaggucugcuuuuucuaugucugauaaagucuccauuuugaaagauuguuuuacuggguguggaauccuaaacugaaauuuuuuccuuaauauuuugacuuguugcauuucuagcugauaaauuucuguaauauuuugguuuugcuucaaccauuggauuucaaguccugugacuuuuuaaauauuugugguucuuaagcaccuaguacagcauuugauaguagguaccuagcaagugagauuaaauugccugucuuguuuuauaauuuuauuuucuagggcugggugugguggcucaugccuguaaucccagcaguuugggaggcuagggcagcagaucaacugaggccaggaguucaagacuagccuggccaacaugacaaaaccccaucucugcuaaggguacaaaaacuagcuggguguggugaugugcaccuguaaucccagcuacucggaaggcugaaguaggagaaucacuugagcccaggaggcggagguugccaugagccaagaucuugccacuacacuccagccugggcaacagaguaagacucggucucaaaaaaacaaaacaaaaaacaaaaaaaacacuuuguauuuucuagcaaacuauuccuucagcauaaauugcuuuggauuaaaaaaaaaaagagguccaggcugggugugguggcucgcagcacuuugggaggccaaggcaggcagaucacgaggucaggaguucgagaccagccuggccaauauggugaaacucugucuuuacuaaaaauacaaaaauuagccggacgugguggcgggcgccuauagucccagcuacuugggaggcugaggcagaagaaucacuugaaccugggagguggagcuugcaaugagcugagauugcaccacugccugggcaacagagcaagacuccaucucaaaaagacaaaaaaugaaaaacaaaaaaaacaaaaaaagguccagccccacacgguuagaaaaauucuguugauauuaauaaggucugguaauacacuuugaacaaauucuugauggcuacagagagacuaaucaaaguaugugcuuuugugcaugucaaguacugagcucccuucuacucuucucaccugcuuuucauuuucugucuucaaaaauacauaucaaggcaugguucagggaaacaugaagacaaacacagaauuuaugcucaguggacuagaacauguuugcuugagcaaaucugcaaaaagucagccacgugucuuuuuguuguuguugucguuacuuuuaauauggcauaagaaccauaaaggaaguguauuuuuagaauaaacacaaaacauuucaguuuuauguuaucuuuucuaguuuuaaaaauaacauguuuauugaaauguauuucacauacuguacaguuacuguuuuaaacuauaauuuauuagucuuuagucucuucauagcuuuguguaaccacuaauuugagaauauuucagucacuccagagagaaacuccauggcuauuuagcagucacuccccauucccacauuccacaguuuuggcaaccaacgguuggugauuucuuucugucuuuguagauuuaccuaugcuggauauuucauuucaguggaaucauauaauguaugaucuuuuauggcuggauucuuucacuaaagcauaauguuuucaagguuuaucuguguuguaguauauggaucaauauuccuuuuauuggccaaauaucccauuguaugguuaugccacauuuuaucauuagucauggaccuuuggguuaacuuuuuggcuauuuuuuuaaugcugcuaugaacauuuguguacaaguuuuugcaugagcauuuguuuuucucuugagcauauaucuaggaguagaauugcugggucauaugauaauucuauguuuaagauuuuaaagagcugucaagcuguuuuuuaaaguagcugcaucauuuuuauauucauaucagcaacauaugaggguuccaguuucuucacauccucaacaagaguugucuuuuugauuguagccaucuugguauuugcagugggaucacauuuugguuuagauuugcauuucucuaaugacaaauaaaguugagcaucuuuucauguguuuuugaccauuugagaaauggccaaaaucuuuuuuugagaaaugucuacaugaaucucuuguccacccccacuacccccucuuuuuuuugagacagggucucacucuguugcccaggcuaaagugcaguggcacaauuuuggcucacugcagccuccaucucuaggacucaaacaauuucccuaucuuagccuccugagcagcugggaccacagguacacgccaccacaccuggcuaauuuuuucguauuuuuguauagaugagguuuugccgugcugcccagucuggucucaaacucaagcucaagcaauccucccaccuuggccuccccaaaugcugggauuaugggcaugagacaccaugccuggccuucuuugcccauuuuuaaauugggcugucgucuuauuauaggaucuuaagaguuuuuuauacugucuauucuagauguaaguccuuuaucagauacaugauuuacaaauaauuucuuucauucuaucacuuuguugauggugucuuuuaaagcacaaaaguauuuuauuuugauggaguccaauuuauuauuuauugcuuguguuuuuuggucucaaaucuaagaaggcuuugccuaaucuguguucacaaagauuuucugcauuuucuucuaaaaauuuuauaguuauagcuccuacuuugauccauuuucaguuaguuuuuuguauggugaaaggaagaggucuagcuucauucuuuuguguguggauauacaguugucccagcaccauuuguugaaaagaguauuccuuuuccauugaauugucuuagcacccuuguugaaaaucaacugaucacaaauguuaggauuuauuuauguacucugaauucuguuccauugauuuauguauccguccguaugccaguaccacacagucuugcuuacucugauuuugcaguaauuuuugaaaucaggaagugugaaucuuccaacuuaggucuuuuuuaagauuguuuugacuguuuggguucuuggcauuuucaaaugaauuuuagaaucagcuugccaguuaguucaaaaaagcagcuaggauuuugauagggaguacauugauuuuaaaaauuuuuuguuucaucacuacagaacugcaauacauugacuuuuuagauuaauuuggggaguauuaucuuguuaauuuuuuuuuuuucuuuuugagacaggguuucacuauguugcucaggguggucuugaacuccuaggcucaagcgcuccuccugccuuggccucccaagguguugggaucauaggcaugagccagcgcgccuggccagggaguauuaccuuuuaacaauuuaagucaucuaauacgugaacacgggaugucuuuccuuuuauuuagauuuuccuuaauauuuuuuaguguguuuuguaguuuucaggguauaagccuugcacuuuuuaaacuuuuagguauuucauccuuuuaaaggcuauugcaaugggauuguuuucuuuuuuucuuuuuuuuuuuuuuuuuuuguuuuuugagaugaagucucgcugugucacccaggcuggagugcaguggcacggucuuggcucacugcaacucugccuccuggguucaagugauucuccugccucagccuccuauguagcugggauuacaggugagugccaccauggcuggcuaauuuuuguauuuuuaguagaaacaggguuuugccauguuggucaggcuggucucaaacuccugaccucaggugauccacccaccuugaccucccaaaguacugggauuacaggcgugagccacagugcccagccggaauuccuuuuauuucuuauccuugacuaauuacaauggcuagaaccucaaauacaauguugaacagaggaaugagaagggacuuucuugucuuguuccucauuuagucuuuauucgcaaaguaguuagcugcagauucgucauaaauggcuaguuuuauuuuuuaauaaaaauaaugacuuugauuccaagucauugcagaagucaggaaaaaaaaaagacuuuguuucucucaaagucuuaagcucugguguaaaaaaaauucuggguugggcaugguggcucacaccuguuaucccagcacuuugggaggccgaggcaggagggucacuugaacccaagaguuugagauuagccugggaaacauggcaaaaacuugucucuacagaaaauacaaaaauuugccgggccugguggugugcacuugucccaucuacuugaggggcugaggcaggagaaucgcuuugagccugggagguugaggcugcagugagccaagauugcaccacugcacuccagccugggcaacagagugagacccugucucaaagcaaaacaaaaaaaaccccucaaauaccuuguuugaccccuauaugugagcauauauuaauauaaguauucauuacuauucuaggggccaugaaaaaaggaaaucuccuauuuuguaguauguguguaaugauugccacauugguuucucauauaccauguguacagaaacauuugaacaguguuuuauaaugaauaauguaugcauuaauguugaaaugaugagagagagcccgccaugugaugaucuaagcaucccaggaaaagaaaaugaugcaugcuuaggcaccaagucaagaagaagcuugaccuucugcaaaagcagaaaggagaccagcauggcuggagucugguaaauaaagaaggguauaauaaagauggaaggcgguuuaggccuugugagucacaacacagaguuuuauuuuuauuuuaaaugcaguuggaaaccacuacagaguuuuaagcaaggacauggcauaauccaauuuauguuuuuaaaagacaaagacauaaaauacaagccaaccuguaacaaguacugugugaucagcaaauagggaagugauagagaugagacuuuagcuugacccaugcaaaauagauaagaauuaaacaggaucacaccuguacucccagcacuuugggaggccgagaugggcggaucaccugaggucaggaguuugagaccagccuaacauggugaaaccccgucucuacuaaaaauacaaaauuuagcuggguguaguggugggugccguaaucccagcuacuugggaggcuaaggcaggagaaucacuugaacccgggaggcggagguugcagugagccgagaucaugccauugcacuccagccugggcaacagagcgagauuccgucucucucucucucucucucucucucucucucucucacacacacacacacacacacacacacacacacacagaaacaaauggaggagaaagagauagugugguagcaauaaauagugcuuggcuuugaagugaaagacuuggguuugaauauugacucugccucuucuuaguucccccaucugcuuucucuauaccuugguugcacaugaggagcaaaucaaaugaaaaaugcuuauaaaugugaaccugugaggguuagugugguauacagucauguccccaguuuuccauggggcauauauucuaauacucccagcgguugucugaaaccaccaaaauaguacuccacucuaaauauacuauguuuuuuucuauacauacauaccugugauaaaguuuaauuuauaaauuaggcacaguaagagauuaacaacaauaauaaaauagaacaauuauaacaauacccuaaaauaaaaguuaugugaauguagggucucucucaacauaucuuauuauaccguaccuugcauaagagaaaccauggaaagugaaauugaggacgaggggacugcuguacgguauuuguuuuauucagugaauaaaacacugaauuaugcuaggggcuguggagugauacaacaaugaauuagacucgguuucugcuccucaaagagggugcagucugauagacaaugugguugauaucuaaaaugugaaguuaagaguuaucauaagaagggugcagauaaaaugcuaugggaguucauagaauggagaccgugcugcuuguuuggauuuggcuucuuucuucauaaggcuuuaugaaguccuuuaugcuaguccuugagagauggauaagccuugaauagaagauggagggcaagaugauauucucacuaggccaguaugugggaauauaaaggcauggaaguauugggcaaauuuaguacuugauaagcaaagguagguuaggaccagacaaauuaugcaguaccuugauacuaggcugcugugaauucuuuucaauaggaauacuaucagcagugucuuuaauuguguaaauauuuauugagcaucuaccacugcuagguuuaugauagaagucaaggcuugaggauagaauaucucaguuuaguuggggaagauagauuaucugauuauuuuuauucugagauauaaacagaauugugaugggaucguaggacaaguaccagcucuagcugacuggcguaauaagagagggcuuuauaaaggugguaaacacugugcugagauacgaaguauccuuuuguuuccuacauaaaggaggugaagagaggaauaugagagaaacauucuaggccugacacuuccuauauuuugugauggcuggacaaggacuuuauaugcaagucaagcagggccgaaggcuuugggguaacugaaagauuauucaagugcagaguuaauuggaaaggguggagacucgaggugggaaccugguagggagacuugcacugggcccagugugugaugauguaguaccuaauguggaauaguagcuauggggauaaagagcauggaaaaauggagagaugcuugagauguagaauugguggagcuuggaaaccaaauagaucugugagaagagauaaaagagaucauguggaauguagaauaauuuccagguuucugcuguuuuagagggugccacugccucagaauaggguguauuuaaggagaaggaggguggauuugaagaggaagcuuaauaguuuuagcuguauuguguugaagauacaugucagaguuggaaguagagaggaugauuugcgggggugaugggggacgaauugacaacauuuagguaaucauuuaagccacacauagcauaaauuaaacuugugggagaaugaauauaggaaggaagaaaaaccucaaggugcggaaacagccauagaaguaagaaaaucaugaagaugaaagguaguagaaauagcuaggaagugcuccaaauaauugcagcagagagagacuuuuaagguuguagccaacauuaucacagacagugacguuuuuuucuuuuucuuuuuuugaaagguaggucauugguugcuucagaggugaccaguugcagaauggauguauguauaagccagauuguagugauuugaggauugaaaggacaaaagagauuuuggccguaacuggaaggacagauaaagauaauaucaguaugucaucauuuucucuuuguuuuguuuucuugucuguuuuuaaauaucuuagagauuugaguaauuuauuccuucaggggaauuaacaaaugaacagcaaagguuaacaucacaauuaauagaguaagccagcuauugucauagaguagccuagcauagugcaucucagacuuuaauggauaucuuguuaaaaugcagauugugguucaguaggucugggcuggagucugagacacagcauuucugacaagcucacaauuggugcugaugcugccugucuauggacuacacucuaagaaguaaggcucuagagaguaugagauugaugcauuauaggggaguuagccuuagauagaaagaggaacaccuccuuucuuaauugagguggaguguacgguggaugaaggcacaggaaauacagauuaaauuugcaggcaagagacaugccugguagucuuuguuuuuuucugugaaacaauaaguaaagcuaugcuaugagaagacuaggaaugggauugugugagcuugaugaaaguugugaaaguuuggaauagcuacuaagaggaggaaaaugagugaauuugggacauguaauaaucgcugaacagugaggauuaguuugguuauggugucuguagaaauggagcagacacagacuaguaauaaaguaaaaaagacuaguaacguagauuuuuuucuuucuuuuuuuucuuuuuuuuuuuuuuuugagacagaguuuucgcucuuguugcccaggcuggagugcaauggcaugaucucgguucaccgcaaccuccgccucccagguucaagcgauucuccugccucagccucccaaguggcugggauuacaggcaugcgccaccacacccgucugauuuuguauuuuuaguagagacaggguuucuccauguuggucagguuggucucgaacuucugcccucaggugaucugcccaucucggcuucccaaagugcugugauuacaggucugagccaccacacguggccaagagauugcuuauuuuuuuaagaugauaugguacucuagggaagugguaaugaggucuaaaguagaacaguguccucgagaauggaagaggaggaugugguaggccgaauaauacucacccaacaccacacccccuccaggugccaugcccuaaucuuuucaaucucugacuguuacaccuuacauuuuaagaggaacuucguagauaugauuaaauuaaguauguugauauggcgggguuauucuggguuaucuggauggguccuguguaaucacaaggauuuuuauaaaagagaggcuguagggucuagucagagaacucacgugaugacaggaauaggagagagaaaaugucaugaugaaaguagaggcccaggugauguaagguuuugagccaaggaauguagacagccuguggaagcuggaaaaggcaagggaacauuuucccaagagacuccagaaggaacaaagcucuggugacauguugauuuuaguucacugagacugauuuuggacuucugacaugcagaacugcaagaaaauaaauuuguguuguucuaaacugcugacuuuguggaguuuucuguuacaacaacgaucagacacauucagaggguauggauauaagggaauaguauagaguuagaaucaguaaaaugagacaauuaagagguugugguaugggaacugggaaacuagauuucuagccuggguaaaugaguggagaguagugaaauuaaaaauagagaaugguaaggaguagauguuacaggaggguauauuugcuuugcaagucauaauuucaggaacuggugagaauaguauuuugcgucuaguaauauagauuagaguggaagaaaauuugaaacaaggagaugaauuuaagaggcuaccacagugcuguuacauauaguuaauagagcuguuauaauaacguuacaugacaaaauacacaggaucaucacuuuauauagugauuuucaguuugggagucauauucauaccuuuuuggggggguuaauaaguuuuugaaauggacacagcugcuauuagcaugagaaauaagcagaguggaaacauuggccucaaagauguuguggauagcagcuacuguauugggcaucauauguauagaacauuucugucauccagaaaguuccauugagugaugcugcucuguguuauuuucaacaguggaggacuggauauuaucaguauuacaguaaaauuuuuaggacacaguauuugcuaauuagaaauaauuuucagaagaccuagacuccuggagaaacugugagauaauagucaagugaacaauauacauugcucuccaaggaacacuaaauagucuaacaacgagcacuaaccaguuggguuucaggauacuggguuuuuauucugguacuacuuuguguuguguguauuugggaaaaccuguuagaaacauagaaaguucucuucuuaaagagguccuguagccucuuaaaaacaucacaagcaagaaacagguaauauguauucauuaauuucuacaacagugucggaauauuaggaaaacauuuuuagaaagaaaaaucuuggcugggugcaguggcucaugccuguaacccuaggccaaaguggacagaucacuugaguccaggaguuugagaucagccuggacaauauggcgaaaccccuaucccugcaaaacauacaaaaauuagucgagugugguggugcgcgccuguaguccccgcuacuuuugggggguggaggugggacgaucacuugaccccagaggucaaggcugcagugagccuuguuugcgccacugcacuccagccugugcgaaaaagugagagacccugucuuaaaaaaaaaaaaaauuaucuauuaaacaaggagguuggaccugcuaccuaccuccauuucaguucuuuuaguaaaacauuaucaugccauaauucauuauauaguuuuaaagaugcacuucucucuuauucucauaacuuuuuauggcugaaauguuaaucauuaguaaaaauggccuaaacugaaauuuguuuaguuuuagguucccaaaccauguuuguuauaaacaguaaauauauuuuuggaauuuauuagcaaaucacaauaucugagagaauggaaacuuacuaagacgaaauaaauaguuuaaggaaggaacuuuuguagagaaauaaaagaguuggagaggaacggaaguuguauguagaagaauucaguugauauagugaucaaauacuauaaaaaguagcuuccaaaauaucuuuuuuuuuuuuuuuuugagacggagucucgcucugucacccaggcuggagugcagcggcacaaucucggcucacugcaagcucugccucccggguucaugccauucuccugccucagccucccaaauagcugggaccacaggcgcccgccacuacgcccggcuaauuuuuuuuuuuuucacuauuguguauuuuuucuuuuuucuucuuuuuuucuuuuuuuuuaauuauuauuauuauacuuuaaguuuuaggggacaugugcacaaugugcagguuaguuacauauguauacaugugccaugcuggugugcuguacccauuaacucgucauuuagcauuagguauaucuccuaaugcuaucccuccccccucccccuaccccacaacaguccccagagugugauguuccccuuccuguguccauguguucucauuguucaauucccacuuaugagugagaacaugcgguguuugguuuuuuguccuugugauaguuuacugagaaugaugauuuccaguuucauccaugucccuacaaaggacaugaacucaucauuuuuuauggcugcauagcauuccaugguguauaugugccacauuuucuuaauccagucuaucauuguuggacauuuggguugguuccaagucuuugcuauugugaauagugccgcaguaaacauacaugugcaugugucuuuauagcagcaugauuuauaguccuuuggguauauacccaguaaugggauggcugggucaaaugguauuucuaguucuagaucccugaggaaucgccacacugacuuccacaaugguugaacuaguuuacagucacaccaacaguguaaaaguguuccuauuucuccacauccucuccagcaccuguuguuuccugacuuuucaaugauugccauucuaacuggugugagaugguaucucauugugguuuugauuugcauuucucugauggccagugaugaugagcauuuuuucaugugucuucuggcugcauaaaugucuucuuuugagaauugucuguucauauccucugcccacuuuuugaugggguuguuuguuuuuuucuuguaaauuuguuugaguucauuguagauucuggguauuagcccuuugucagaugaguagguugugaaaauuuucucccauguuguagguugccuguucacucugaugguuguuucuuuugcugugcagaagcucuuuaguuuaauuagaucccauuugucaauuuuggcuuuuguugccauugcuuuugguguuuuauuagacaugaaguccuugcccaugccuauguccugaaugguaaugccuagguuuucuucuaggguuuuuaugguuuuagguauaacguuuaagucuuuaauccaucuugaauuaauuuuuauauaagguuuaaggaagggauccaguuucagcuuucuacauauggcuagccaguuuucccagcaccauuuauuaaauagggaauccuuuccccauugcuuguuuuuucaguagagaugggguuucaccauguuagccaggaugaucuugaucuccugaccucgugauccgcccaccucagccucccaaagugcugggauuacaggcgugagcaacugcgcccggccccaaaauaucuuuauauagaacaaaaguuuucugagucuuuaucucuguuauucagauucugucuaaaagagauuaauaguucagaagaaugaauuguguugggauuuuaccuauuaucuuuguaucucuuuucuuagauaagauucacugauuguaaauuucaauuaaauauaguuuaugugucugaaugaaauugaugaccagaaucuugccaguguaggaaaaguugauuuccuacacugcuuucuucugcugcuuaccuuucugcuacucaucaguaucugaucaggggauagaaacaugacguauaucagacuuguuuggagcuccaacaaaaucugaagggagaggaaauuaaaaauguggcugaguauuucauguuaugacacuuuugguuccuauauuaaaguuaaccaaguuauuucacaaccagcuuacaaucacuucauauuuagccaaacauuucuucucauuucuauguauaauuauaagcuuauugauauuaaaguguggguuuuuaugaaaugcuuccucaauacugaaccuuaguugacccaaagcacauacuuguuuuugaaagagggggguagauguugaauuuguguuugaguuuauccuaaaccuaaucaucauuuuguuuuuguccuagaauuagaauguuucuaaacacuucccuccacacuguauuaaugucaacuaagaacggaaauuuucaguguccaggcacgguggcucaugccuguaaucccagcacuuugcgaugccaaggcaggaggaucccuggagcccaggaguucaagaccagcuugggcagcagagugagacccugucucuacaaaguuagcugggcaugguggcgcacaccuguugucccagcuacucaggaagcugagguggaggauugcuuuagcccaagaagucgaggcugcagugagcuguggguaguaucucugcacuccagccugggugacagugagacccuguuucaaaaaaaaaaaaaaaauuaucugccuauuuauuauuuuuuuugaauuaaaaaaauucacgaaauaaaaauuuaaaaaaauuuugugggugcauaguagauguauauauuuauggguuacaugagauauuuugauacaggcaugcaugcauauuagucaugucaggguaaauggggcauccuuuuauccuuuguguuacaagcauuuauccuuuguguuacagacaauccaacuauccucuuaugguuuuuuguaaauguacacuuaaauuauuuuugacuguuggcuggguguggugguucacaccuguaaucccagcacuuugggaggccgaggcaggcagaucaccugaggucaggaguucgagaccagccuggcuaacauggugaaacccugucucuacuaaaaauacaaauacuagccaggcauggugcaggcaugccuguaguaucagcuaucaggaggcugaggcaggagaaucgcuugaacccaggaggcaggauaaucgcuugaacccgguaggcaaaggcugcaaugagccgagauugcaccacugcacuccagccagggcuggagcgagacucugacuaaaaacaaaaaaaaaaagaaaaaaaaugugacuauagucagccuauugugcuagcaaauaguaggucaccuucauucuuuguauuuuuugugcccauuaacccucccccgacccuccaccaugucacuaccccuccagccucugguaaccguccuucuacucucuaucuccaugaguugaauuguuuuaauuuuuagcucccacaaauaagugagaacaugcaaaguuugccuuucugugccucacuuauuuuacguaacaugaugaccucuaguuccauccaugcuguugcaagugacgggaucucauuuucuuuuuauggcugaauaguacuagauuguuuauauguaccacauuuucuuuauccauucaucuguugauggacacuuagguuacuuccaaaucuuggcuaaugugaauagugcugcaauaaacaugggagugcagguaucucuuuaguauuauugauuuccuuucuuugggguauguaccuaggagugggauugccgaauuauaagauagcucuaguuuuagcuuuuugaggaaccuccaaacuguucuucacagugguuauacuaauuuacauucccaucuacaguguacaaggguucccuuuucuccacauucucgccagcuagcuccuuggcaguguguuaauguguuaaccugccuacuuuagaguuaaaaaaaaugcugaguuucagaccugaguuguagauaaaaauagaauccaacucagaucuuauaagagacuuuaaugcagggacuacagaggugccguggauuaagggaacccauaaggcauguuuuuacuagcagcagagaagcccaaagggccaggaaaaauacaguguuauuggagucucuugagagcugugaagagggugccucacagcaaccauggcgguggagggaugcagcuucuuccagaaaauguggccaugaggagggagggagcuaggaagaaauaauccagccuuucucugccuccuucugucaguggcagaacagcccuggaacucagaaggcauaucuguuggggucagcaucauugggcacagaguagggcagaaagguauugggagauagggcaguuguaguaagauaauaagcaacacaacuacuaaugaguucagguguugacuucagguaacguaauauuuuacccaauuucuuaucuguuaacuaugcauacuuuacuggguugaugagggcauuaaaugagauaaugugaaaguacuaucauaaugucuuugucuugugaguauauuuuaaaagucuugguaaugcauggauuugaaaaccucagcuuccuuucacuugguacuguguuaaauuugugggaacuuugcuugccacuauacuuuuaaauauauguuuuccaauaauuuuugagaagugaauggccucauuauuaucaaguaguuuccaagauuuaguuugucauuguuuuauagagccagaagccugaaaaccuaaguccuaguucagacuauacuacuauuuguggcauaguucuuugugggaauuauuuuuacuuugccucucugugcuuuuccuuucuaagaaauugaguaauaauacuuaacuaguaaauguuuaauauuaugguaaaauaauaguugucaaguacuuugaagacuuaaaugauauguauauuaacuuuuuuacucucauucauuuugaaaaguaucagagccucagauuaagagugauuggauaguuuuuacuuuguugcauuuucugugugaaauuauguagcucauaagcuauuaucuuguauauguguguuuacgugaguaaagugauuaugcuuaugucuauuuuaguuacugugugugaauguaauuuuuuaauuuuuuugaauggagcccuccgccucccagguucaaguaauucuccugcccuagccuccugaguggcugggacuacaggcgugugccaccaugccgggcuaauuuuuauaguuuuaguagagacgggguuucauucacuauguuggccaggcuggucucgaacuccugaccucgugauccgcccgccuuggccucccaaagugcugugauuacaggcgugagacaucacgccuggcuguaaauuuucuuaaaacuaucuuucugaaacgaacucuaagagacucuacuuauugcccaguaguaagucuugucuuuuucacucuugccauagacagagcacugcuuacuucugaacuuacaguugaggaagguacuuuugagauguggcaacugucuccugguaaaagauuugucagacuuuacccugcugcuacuacuaccauugauguagccuuauugccuacuucuuuuuucugagacagcagugaugccuugucacauuuuucguccuaauuuuuacauuuguagaccagagcgagaucagggcaauccauuuugaagaaaacuaugaucaccaaauaauacucuacuuuaaagaaauuuuuauuuuucaaaacuucaaaaauguaacuuugaaauuaaguaaauuucuauuuuauuucauaaacuugaauuagcacugucuuuguaaauuccaaacugaaccuuucucaauuacugauuaaaucuuaauuauuucucaccagacggucuggaaaaucccgaagcagaagcccguauucaucuaggcauucaagaucucguagcaggcacagauugucuagauccagaagucgucauucuaguauuucuccuagcacacuaacucugaagaguagccuggcagcugaauugaacaagaauaaaaaagcacgagcagcagaggcagcaagagccgcagaagcagcgaaagcugcagaagcaacuaaggcugcugaggcugcugccaaggcugcaaaagcuucaaacacuucuacaccuaccaaggggaacacggaaacuagugccagugcaucacaaacaaaccaugugaaggaugugaagaaaauuaaaauugaacaugcaccuucucccucaagugguggaacuuuaaaaaaugacaaagcaaaaacaaagccaccucuucagguaacgaagguggaaaauaauuugauuguagauaaagccaccaagaaagcagucauaguuggaaaggagaguaaaucugcugcuacaaaggaggaaucaguaucucuuaaagagaaaaccaaaccacuuacaccaagcauaggagccaaggagaaggagcaacauguagcuuuagucaccucuacauuaccaccguuaccuuugccucccaugcugccugaagauaaagaagcugauagguaagugcaaaaaguauuugucaauaacuguucaaagaaaaaauguaagucugaagugagaaaugaguugaccuccccuaacccccucgaaacaacuuuagugaaaaagacuacaagugaaugaauuuucuugauuauaugcaucuuaaaaugaagcacauugcauacaagauggcaaaauuaaaguuuauacuaagacauucagggaaaaauugccauugucuugggauacaaugaauauuucaauaugauuuuggguauuagaaaugccaguauucucuuugguuuaguuuuccuugaugauguaaucagagacagaauauuuuaugaauaaguuggcccuaguuaauauacaucucacaagcauuugucucauuuauuucuaaguuucuucaguggccuuguaaauuuaucacugucagugauuuuguuaucacuuuuuaguuuagucuuuucuuaacucuuuuaauuaaaaaaaaauuuuuuuagccugucuugcaguugggauuaaucacauuauauuauagaaaacucauaauguggccaggccugguggcucaagccuguaaucccagcacuuugggaggccgaggcggguggaucaccugaggucaggaguucaagaccagccuggccaacauggugaaaccccgucucuacuaaaaauacaaaaaacuuagcugggcgcaguggcaggugccuguaaucccagcuacuagggaggcugaggcaggagagucacuugaaccugggagguggagguugcagugagccgagauugcgccacugcacuccagccugggugacacaguaagaccgugucucaccaaaaaaaaaaaaaaaaaaaaaaaaagagaaaauucauaaugugauuaugcuuuccuuuaagauguuuaaaaauuucuauuaugaacagugaggguauggcuuauuuuuuauugagaaacauauucuuaagaggcaguaaaaauacagcuaagaauguuucuuuuuuguauccuaguguagaaaaauuagacuugugugguuuaucugccuguuacaccaccuagcuguuuuuauuuuuaugaagaaauuagagcuuccacccccucccacuccccauuaaaaagcaacuauaugaguaguuuuccuagcugauuuuuuuuuuuuuaauagauuuugaagucagauggauaaaaaugccauguggacaagugcuuacuuuggcauuaugaaaauuuuauaauuuaacacaaacaaaagugaaauaauaauucuugaguuucaugcccuuugaggugccuuuuuaaaaauaaucaaaauguuguugggagaccccauccaauuuaaucggguguuauuuaauuauacuacuauaauuguuguauuugcagguuugacuguucucagggaacgcugaagguucauaacaguagugauuuguaauugugaggcuugaguguggaauugaauuacuucauuagagaguaaccaguuacugagaauccauguuucauugagacugguguuucucuacuuuauccuuuuuuuuuuuuuuuugagacggagucuugcucuuuugccgaggcuggagugcaguggcgcucucucggcucacugcaagcucugccuccuggguucaugccguucuucugccucagccucccgaguaggugggacuacaggcgcccgccaccaagcccggcuaauuuuuuguauuuuuaguagagacggggggcuucaccauguuagccaggauggucucgaucuccugaccucacgauccacuugccuuggccucccaaaguguugggauuacaggcgugagccacugcgcccaaccuacuuuauucuucauguaugcuuuaggaguaaauuuuuacuagguuauuuucaagaacucuuacguauacaugugagugcuuaaugaggauauuccuuaugcaucugucuuuaauuaguugguggcacauuuaauucuuguucauuacuuuuuuuuuuugauucaccuuuucugucuccucuccuuuucccccuuuuuguugucucuucuuucuuugaauguguuuguauguuuaauggauacggaaguuucuaaagauucaugagcacuucuacuacaugucuguguggccaaagauuaacucaucaccaauggaacuuuccuuauuuugaugucuauaauuuaccuaaauguauguacuaacuacauaugaggaagagacuugauauuguuuuacuuuuuauaaaaguuuuuaggugauuaaauaaaaauguauuguaaaaagaaaugguuagaagugauuacuuuuggaaauaaaugggcgcugaagggaauggauggcacaggagacuuauuuuauauuuacuauuuauaauacuguuagaaguacaauaacauuuguuagugggcuguaguagaaagcuuaguuuuuagugccaguuguaccucuuacuacucucaugaguuaaucuuucugugccccaguccauaguucuauucaugggugaaaauauuuacaguuuaaccucacagauuaguuguaaagauuaaauuaguugauggacugaauuuugcaagcuguaaaguguuaugcaucucaguuauuguaauuagucauaguauaaaucagcacugcuggaaauacuacagauauuuaaaacugcuuuagauuauugaaaaaaaguaaaaauuacaaaauaugauuuacauuguauaauauauaaaccauuauauguguaacauguagauccgguguguaacgaauagaccuagugcuucauuugaaaaggauugguuuuuguaaaagaggaacuauugguugguuuuccauccccuuuuauaaugaagggggaccacccccaggccauuuuuuucauguaucugaaaguaaugcucuugguaauuuuguuuacaaguuucuuuuuaguaaccauuguauacuuuuuguuuuuugcugaacagcuauuaguugaaagugguuuauaaacuauuucucuugagguaaagaaacaaucuuuucuguuacaacauacuuuaggaaacccgaauaugggagguaucuuuauuuacuuguuacucacuguaaauguaaagaucacuuuaaagaagagugaguaauggucugcauaaucucauugcuguaucuuaaggaaagcuuuugaucuuugcuuucuuugagcaugccuguaucuauauuccugguugacuuucacuguuguauccacaaauacauuagcaaaaguguguguguguguguguguguguguguguguguguguguuuuggauggccucuugauuuugcaaaccuguacuccacuugcuuuugcuguuuuauuauauguccaaguaaauucuccccuucccucauaaauucuuuauuuuuaaaauauucaagcacuuagaaaaauugaaauaauaauacaauuagcaucuguguaacuacuggaacuacuggauggaaguuauccaucuagauuaacgaaguguuaacauuuuguuuuauaugcuccaucucagcaggugugguggcucacaguuguaaucccaaaguguaauaagcacuuugggaagccaaggugggcagauggcugaauccaggaguuugagaggagccucggcaacauggugaaaccccaucucuucaaaaaauacaaaaauuagccugcugugguggugcaggccuguagucccagcuacuugggaggcugaggugggagcaucaccugagcccaagaggucgaggaugcagugagcugugauugcaccacugcacuccugccugggugacagagugagacccugucucaaaaaaaggaaaaaauuauacacacacacacacacacacacacacacacacacgcacacacacacacaagcacacacgcuccaucucuaguuguuuaagagaacuaaugaggguguguguguguguguguguguguguguguguguguguauacacuucuccccgagaugaagucuugcccuguugcccaggcuggaaugcaguggcgccaucuaggcucgcugcaaccuccgccuccuggguucaagcaguuccccugccucagcuuccggaguagcugggguuacaggcgcacaccagcaugcccagcuaaauuuuguauuuuuaguugagaugggguuucaccguguuggccaggcuggucucaaaccccugaccuugugauccuccugccucggccucccaaaauguugggauuacaggcaugagccaccgcucccagcuguguauacuuuucuuuuuacuauacuguaaauacuuaagucaucucccaagaauaaggucagucuccugcuugaucacaguaucauugugauaacaaggaaaucaacaguaguuaaucuaacagaaauaaauaauaauaucauccacuauauauaaucaauaaucaguacucccccccuacccccugcccccagcccuaugacuuuuugaagagucuaggccaguaaucuuacagaaugucucaccuuuggauuuaucugauuauuucuucuugguaucguuuaacuuguucuucucuaaccccuuuauuucccauaaucuggaaauuacuugugcuuuguuuauauaaagaauacacaguuuuuuagccagaauauuuaagaggugauuuuauguacuuuaugcuguuguuacaggaggaccaaaauaucagauuguuuuacucuacuaguagugaugugaucacuugguuaaggugaugagcaacguuaaggucucuccauauaugagggugcauuuuccucuuugcaauuagaagugagcuguaggguaauauuuuuggcagugauugaauauccuuuuucccaacaaccuaucaccuaaugguuuagcaaccguuaaugguauuugucuaauucaguuacuguaguagggacugcacauggugauuuuuuuuuccauugcugcugcacaaauuaaaaaugguuauuuucuaauucugccauuccuuuuaacauuagcuggccuuguuuuguaaauacguguuuccccauaucccauuuaaucauucuacucucauggauuuuuauuuauuuucuguguuacaaauaguaauagccacuacucuuuuuuacccucacauuguccgaaauuuggccaguggaagcuccuauaagcugacuccuuuauucuuuugacaugaccucguuuguuuuuuuguguuuccuugcuuucuaguuaaagguauauguuagguucacuuugaauuuugcuucauucucaaaauuacagucuguuuucccacaaaaucaugagauagaugguaaucuguguguuuucacagaauguaguuguuuuauuauuauuuuuaaaauuagaaucauaccauggauaauguuucuugacuugcuuuuucauuuaauauguuagagaucuuuccauguugguauagaugggcccaauauucuuauuacaggaauggauguaucguguucuucuguugauuaauggauacuuagguuuauaauuauucgcuauuaaacucuccuuauauauuaauauuuuguguauauuuagguaauuuuuauaggauaguuacaugucaaaguauacacauuaaaaauuugauacaaacugucacauuaugucuuaguaaggcuguguaacaauuuaugcacccagauguaugaaauugccuuaacaguuuuggauagugucaauuuugacagucuuuaaaauauguaauuaauuuugcauuuuucugauaauaagguaugguauuuucuugaauguuuauugguuguuuauuauuuuucuggugaauugcuugcuuguauucugugcuggauuuuccuuaaaguuguuucccuuuuucgaauugauguuuaguagauauguuagggauguugaccuuugcuucucagagucuguugcuuauuuuugacauuuguuuugcuuuugguuauaugaauguuuuccauuuuuaucuagucaaaucuauuauucucuuuccuuuaaaacuucuagguuuauaaaauuuaaaaagguuaagucagaucugauagaaguuugguuuugguuauuguguaaagaaguguucugauucuucacuccccccaacccaguguuguuacugguaccguuuauuguauaauucaucucacuaauuuccauauauaaaaauucuuacauauaucuguuucucuacuuucuuuucuuuuaacauauuguauuugucaguaucuuaacuguuguagugucuuuagauacauucuauauuggcucccaaacucaaauuucuauuuuaggggcagacaguaauauaaaaaugaaggggauggaguaaauuagugaugcguaaauggcucugcuguugagccucaacaucaauguugcucuacaagaauuuaagcuugucuuagaacuuuugcuuuuuuaaaagaggaagccuagaaccugaauauuauguaaaucuuuggauuuaaaauuacaauucauaguucuuuauaaaacauuggauagacugaguaauauauauccuuugacuucagccaccguuuggcuuuuaguucuggaucucugaauagguugacagggcaaaugccacuuaauuuuucuuuuugagaaacuucuuggcaguucuuuugccguuauucuuagacaaauuuuauaaucagguugucaaguuguauuuaaaaaaaaaaacaacucuuccuugaauuuuuuuuggaacucuauuaaaucuaauacagucauaauuuggagacagcuuuauaauauuaguuucccauauuaaaacaugguuucuuuucauucguucagaucuaauuuuauuucuucagucaaauguuuuauuuuuuucuguugcugguguguauuucuuuuuaaggcauuuuauuuuuguugcugggguguauagaaguguuuuuaaaaagcucauuuucuauuuuauuauugcaaauauucaauaaaaauguuuuaaauuauguaacauuguucuuggaaaguaauauucgauaauacacuggacauuuaauauagauagucuuuuaaguuuuaaauuauaagugaaauuaagacuuuaguuuuuugcucuaaaaaauguugauuugaaucuucaaauaagaacucuugacuaaagccucauuacaaguuagagacuauaguuuccuaaauaaguuauucuaaauaggccuauuuucaguuggcauucaggugauaccuuuucuagaaagaagccuuuacuguauuucagaccugauuuagccacccuuuagcuacuucauuacucuaggaaucuguuuguguaacacuuuauccuacuuccuaccugucuuccagacuguaagcucuuuuugaaagaaacuauagcuuaauguguuuguuguuaaauuuccagugccuuacaaauaccuagcacauggaagcucacaaccaauauuugcugaauggagggagaggcaaauugagaagugggcuguguaauauauuacuuuaaaaauaaaacugcaggccuggcaugguggcucacgccuguaaucccagcucucugggaggccgaggcagguggaucaucugaggucgggaguacaagaccagccuggccaacauggugaaaccccaucucuacuagaaauacaaaaaaauuagccgggcaugguggcacgcaccuguagucccagcuacucaggaggcugaggcaggagaaucgcuugaacucgggagauggagguugcacuccgucuggaucaugccacugcacuccagccugggugacaaagcaagacugucuuaaagaaacaaaacaaaacuacaaaccaauuuguuuuaaagcauguuuuuucucuguuaaagaaccuuccagugaguaacacaggacauaaauuuacuaugauaauuaagucguuuuuaucagaugguauuauuaaguuguuuuuaucaagugguauuaaaggauucauuuguuuuacaguauuauucaacacgaauaggaggauaauuacaauuacauuauuuacauugauaauaucuucaguaauuucugaucacagcaguguaguugcaauaaauuuuuucauuaugggacucaacugcuaugaaaguaugugaaguccaaauuuuauuaucauuaugagauucucuuucaacaugucacauuauauuagaugacagacuuugucauaucagggaaauuuaaaauaaauugccaaguuaagauauacuuuaaaacucagagcucuuuaugcauucauaaaaaguacaaagcuaauggaguuuaaauuucagcuguaauucuagaaagcuggaaucuuaaaaaaauuagaagaauaauuguccaauuuagaaaaauuaauuaacccugaaaagggucaaagcugaauuagcuguugcuugugguuauuuaaaugggcaagauaaauauuaucaugugcuuucuuuuauuucuuacgguaaaauguuuugugucucuaccagaaucaaacuaaaugcuuugcagcugagcguugugaggccaaggcggguggaucacuugagguugggaguucaagaccagccuggccaacauggugaaaccccgucucuauuaaaaauacaaaaauuagcugguugugguggcgggcaccuguaaucccagcuauuugggaggcuugagacaagauaaucgcuugaacccaggagguggagguugcagugagccaggaucuugccacugcacuccagcuugggugacagugagauuccaucucaaaaaaaaaaaaaaagaaaaaaaaaaagaaaaaugcuuugcaaaacugaguuuuuaugcaaagcauguuuaguugauuuucaauuuuaauguacaguuuuauaguuaauucuguaucguuuuaaaaaauaaacuuuauuuuuauaacagucuuacauuuauagaaaaauuaugaagauacuacagggacccugaauaccccguacccaguuucuuuacuguuaauaucuuacaucaguaugguacauucguuaacaauuaaucaauauugauacaaaguuaucauuaaaguuccuacuuuauacagauuuccuuaguuuuuaccuaauucuauaucauuuuuacuccaaauuuugcauuauacaguugaguauaguguauuacuuuagcuggaaagaaacuuggacaauagucuuauaaugugaaauacuguugaauauucaugacuauugcuacuuaaauguaagucauaagcauauuuuuauuagucaacaaaauuuuuguuuuauuugucugacuucuuucacuuucagcuuacgaggaaauauuucaguaaaagcaguuaaaaaagaaguagaaaagaaacuccgaugucuucuugcugauuuaccgcugcccccugagcuaccaggaggagaugaucuuucaaagaguccagaggaaaagaaaacagcaacacaguuacauaguaaaaggaggccuaaguaugugcuugcuuucuaccugcucuuaaauugaccagcagugauucugggucaucagaaguucauaaaacacuaaauuaagguuuaaaauaaaaaauguacuuauucuuucaacuuaaauauaugaauucuauuagaguuuugaaaaaaaucauaauugcuugcauuccuauucacaaugacuaauaaaaccaaauuuaauuuucucucguaauuuguaauguauuaauuuccugggguauuguauauguuaaagauacuuucuguuauuaagagauugaaauaacacaaacacugaaauugggcagaguagaagucagcauuuagugagaccaaauaaaauuaguaaugggcaagcugcuguuuccuuugcuuuuagcuccauuuucucccauaaacaaauauauucuucacuuugcaagagauggaguagaagaaguuuugaaauuuguauccuaaauuagcuucaaguaagugccuaaagagaccucuuucccuuaaaaccuguuaaucaguuaaaggcggggaacacuggugccuuuuuuuuuuuuuuuuuaacuucuuaaccaagggacagugaagacuuuaaguuagaucugauuuuagaauugcaguugagguagugccuagugugugaauuugaggucauuuucuaaacuggccgggcacaguggcucaugccuguaaucccagcacuuugggaggcccaggugggagaaucacuugaguccaggaguuugauaccagccugagcaacacagggagaccccaucucuaccaaaaaaaaaaaaaaaaaaaaaaaaaaaaagccgggugugguggugcaugccugugguuccagcuacucaggaggcuaaggcaggaggaucaccagagccaaagaggucaaggcuguaaugagcugugaucgugugccacuguacuccagccugggcgacaaggcaagacccuguuucaaaaaaauaagauaaaauaaaauagcuaaaaaauacucucuucuugagcacuguaguuuuauucuuuuacuugaauuucugugauuuacuauaauauuaaaauacuacaaaauuauguaucuuuuugaagaauguaagauuuuuguccuaccuguccauuuguaucugcuuaaacguggcuuccugagaguugguuauauuaauaucuuuuguacucucuuagacugaaaaaucuuuuuuuuuugauguuuuucagaugauuucauccagucauaagucuaaauuugucaauaaguuuuauaguuagauuuuuguucacauucuuuaucaaacucuuguuucguaaaaguagauuauauauauuauuguuaauggaugcaaaauaaaacuuucuggagauugguuagagaauuuugacucuacuaguguugguuucaucuucucacugaaaaauuauauuuuauuucugaaaagccuucauacaagcucuacuacuuuuuuucucaguuuaaauacuugucuacagaagaagagucaguauguagaaaugauaccucaguuuuuacgauaacuuacaauaccaaaucaguguuacuuguuugggauagaugaugauaaauacugcaaggguagggaaaaauaaagaauauacaauuggguggcgaguagauauugaguuauuagacaguuuauucaauuugcuugauuguauauaaaaacuuuagaacuauauuugauagaauaugugggccucgcuauggugaaaccaaagaaaaagauauugacuggggaaaacgcugcguggauaaauuugauaucaucggaauuauuggagaagguacuuacggacaaguuuacaaagccagggauaaagacacugguaagaaugccaaguucuggggaucuuugggccuacggaauguacuuaguuuguguuucucuucugauguuuggcuucagaaauuuuccaaaaaauuaaauucaauuuuauugugcuuuuguuucaucuuguuuuuuuauucuauauaugcauuuuguaagauaugaguacauguaagugggucuguauauguguauauuuuaaaaaguguuccuuuaguauuugugauauacuguaugguaggauuuaguuuuucuuuccucuuuuauggugaauaauucuuauacuguuauuaaucagagggaaagguaucuugaccugaauuaauuuuaguaguaaauuuuuuuugucauaagccuuacacaacacuuucauuuagccuucaguuuuuuuuccugcaguaacuauccuuggaggccaguuuuagcagcuuaaucuuucagaacauaaucaggaauucagagaaaguuuuaaaaggcuucacaggagagcaaaaaguagcugugucagaagcuauguauuuuacuuaauaaugcauagagcuaguauuuuaucuuucuuuacucauaacugcuuauugaaauaaaccaauaggccgggcgugauugcucaugccuauaauccuagcacuuugggaggcugagacaggcagaucaccuaaggccaggaguucgagaccagccuggccaacaugaagaaacccugucucuaccaaagacacaaaaguuagccgggcauaguggcacaugccuguaaacccagcuacucgggaggcuugaggcuugaacccagggaguggagguuguagugagcugagaucacaccacugcacuccagccugagcgacagagcgagacuccaucucagaaaauaauaaaauaaaaacacaaaaauuagccaggugugguggugggcaccuauaaucccagcuacuugggaggcugaggcaggagaauugcuugaaccuuggagguggagguugcagugagccgagauuggaccacugcacuccagucagggccacagaacgagacucugucucaaagaaagaaacaaauagauuaaaauagcacagcuauuagaggccauauaguauaugggagaugaccuuacgguuagaaacuacugagggcaauuacugcauagaguaauaauugguguuuauaaugauguguuaucaaaaagauuaaaugacaacuuuuaaaacuguuaaguaaaacggacucauacacaauauagaaggcauuccauaaaaauuaauagaauaaguuuaaugauuaaaagaauaugcuuccuucuuuuagaaaauuuguaagaacauuuuuuuucuccaaggaaguggaaugaacaaaccuuuauuauagugaauuuuuucuuguaauaggcuucguguauguguguauauuucauuuucuauuuggaucauuucugauacaaagcugacucauacuuaaauuauguggcaauuuaguguaguggggaagaacauauauuuuugagacaaguaacuggauuuugaauuccaguuuuacugcuagguaacuggccagguuuggucaaguaauaugucugagcguauuuuuuucacugauagaguuuuucuucucuguucagagaaauuuuuaugcauacauaagcauauuggcuauauuugucuuucccucguuuacuuaaaaaaaauaaaaaugacagugugauauacccagucuucagcaucuuuuuuuuuuuuuuuugagacggagucuugcacuguugccagggcuggagugcagagugcaguggcgugucgugaucuuggcucacugcaaccuccaccucccggguucaagugauucuccugccucaaacacccagguagcugagguuacaggcgcccagcuaauuuuuuguauuuuuaguagaguugggguuucacuauguuggccaggcugaucucgaacuccugaccucgugaucugcccuccucagccucccaaagugcugggauuacaggugugaacuaccacgccuggccuagcaucuuucuguuuucuuuuuauuuuuucccaagugaauguaaaagcaucuuaguuuuuucacuaaauauauaaauggggagcauaguauauuuggacuuaccucauucuuucuaaugguuguauaguauucccugguuuauguaaauauuccauaauuuguuuaaugacagacuuaauuuuuugaacuauaaauauuauuugguauauuggaaacugaaacauacuuugugguucuauuuuugagaaauaagaacagaauugaauuaaaauacauuuaaaguuaagaaaaaugucaucugcuuuuguuaacugguaaccugauuuuauuaaauuccuuaauaggagaaaugguagccuuaaaaaaaguacgucuggauaaugaaaaggaaggcuuuccaauuacagcaauucgagaaauuaaaauucuccggcagcuuacccaucagaguauuaucaauaugaaggaaauagugacugauaaagaagaugcuuuggauuucaagaaggacaaagguaugugugcauauuuaaauaacgaauuuuuuguauucaugauugauguugcuaacuuggaaauuuuuuuuauagaugugacuauuugaguaauuacaaacuauugcucuaaucgugaaacuauauuuuuaaguuugguagaguugaauaaugaauugauuuacuuuagugguuuuugaguaaacuucguaaaggguauuugccaauauuacacauaaaguauucacuaguaauauauguuuuauugggcaucaguguauaguuuuuaguauucauuuuuuaguaguugaaaaaccaguucauaguaguaguauuuuuacccuacauuuuuauguuacaaaugccuuaacauauaaggaaacuuuacaguaggcauauguauuauuucugaaaguguggaggcaaaaaucauacuugaaauugccuuuaauaaucuauagugggguauguauauauguauaguuauuauuuagcagagaagcugacaaaaaauuagccugcuuauuaaaguaguuauuauagggcauaugaugggugaaagcagugcucuacuguugguauguuuuacaucuucguaagauuuuagauuuaaaucuucauaaaaucuuaaaucuuauauuuuagauguaaauauaggaucuuuauauaaaucuuacauuuaaaucuuuaugagauuuuagaaccaaaguuuacugacuguauucugagguuugcaaacagcaaaacuuuuucucaaacuaaaucuaacauaaagcagacacagugucucacaucuauaagccaaacacuuugggaguccagggugugaggaucacuugagcccaggagcucaagaccagccuagguaacauaacgagagcccaucucuacaaaaaaaaaaaaaaaaacaaccagaaaauuggcccugcuuggugguacaugccuuugguuccauuuacucaggaggcugaggcaggaggaucucuugagugcaggagauagaggcuucagugagcugugauugcacccugcacuccaaccucggugacagagcaagaccuuaucucuaaaaacgaaaagaaaaagauuaaaguagguauguucugauugaacaugguacuuagacuccugucuuccccagcuacacacacacacacacacacacacacacacacacacacacacacacacacacacucucucucucucucucucuuacucuguugagggacacaauucaaaaugauugauaaacuacaugguaguuauuuugcauaaaggaacuguuugaaaguacaauauggaguucagaaucaucauuuuaauugaugucacuucuguuaguuuuugucccuaguaaagcuuucauuucucagccugacuuuuacccugguuugucuuuuuaacuuuauuuuucauuacuacuuauugugugguugaugggguacuggugugacuuaaauuagaaugucugggucuugagacuuaguguauuagugguguggccuuauuagcaagacuuuuagcccuuuugagucuguuaucccuucauccauaaaagggaaacauugucuuucauaguuagaauuaagacuuuuaaacaugaaaguuugugcaaaugcuguuuguuuugcauuaaccucaggcucuagccaaaucaguguauuugauuuuccuccagcauaccagggacguccugcuuuuuugaucugugagaucaccucccugccuacuucuccaaucccaucuaugccauuuugauugcccaccaagcuugacagacacacacauacccacacacucauucacacaugcacgcaugcacaauuugaaaggcuaauuucucacgccugaggucucagccugaauguugcuuuauucauuagugaggccuuaccugaucagucuucccacuuucuacuacguauagacacagacaauuuaauguuuccuaauaagugggaauaauuauaaugguuuguuacuuguuucuguacagauagcugggaaccauaccuguuuucuucacuguugugccuccuaccuagcucaguggcuggaccauagaaugugcugaaugacuaauuguugaaugaauauaugagcucuauuuuuuuuaauaauccuauuuauacuuuaauacuuaaacaguacuacuugugaauauauuaauagucuuccugguauuauaauuauggucauaauuuauuuucuuuaucagguuauaaauucccagagccuuuguauuuugcuuuguuuuuaguuuuguuucuccucagugccuagcgcugcauuucagaaaucauagauuuuuguguuauuugcacccuucaucaucuuucuuccuaccauaauccuguuuguaauucuaugcaucaugauaaauaagaauguguucuacuaugugagaaguuacauguagguaccuagaauuacuuaaaugcauuagagaaugugagagguuauaaaauuuaaaacauaauuauuucuuaaaugaaucuaauaauuuugaugggaacuaugaugaagcaacaugauuuuccgaaaagggaacuagauuugaagucuaauccugagcaugcuagcuguaugacauuacacuaauugugauugccaugcugugugguauuaaacuaaauuugauugucuaguuagagcauaaagacaguucaauaacacugguuaaauguuaugggcuaaucuaaaaugaguguauuagaacauauaaacauuaaaaagcaaaaguuaaacaauguaaauaugcaaauuagaaacaauacaaaaaucaaguaaaaauauuaacuuuuaaaaauauaaacauuugcacuguuauaacuaacuaagcuauuaguuguguaagagaaacaucauaaaugccuggcauaguggcuuaaaccuguaaucccagcacuuagggaaggccgagguagguggaucacccgacugaggucaagaguuguuugagaccagccuggccaacauggugaaacccaucucaacuaaaaauacaaaaauuagccaggcaugguggugcaugccuauagucccagcuacucaggaggcugaagcaggagaauuguuugaaccugggagguggagguugcagugagccgagauugcaccauugcacuccagccuaagugacagagcgagacucuugucucaaaaaaaaaaaaaaggaaaacaucauaaauauauuuuuuuaaaacuuagcuuuacuuaaaaaugagaaaaaguuaaucacgaagguuauuaauuucaauuaauuauuuaaagugaauuuuuuuuuuuuuuuugagacccaagucuugcucuguugcccaggcuggagugcaguggcauggucucagcucauugcaaucucugccucucagauucaagcuauucucgugccucagccuuccaaguagccagcauuacaggugugugucacuacacccaucuaauuuuuaauuuuuauguuuuuaguagagacaggguuucgcuauguuggccaggcuggucuggaacuccugaccucaagugaucugccugccuuggccgcccaaagugcuuagauuacaggcgugagccccugugcccugccaaaagugaaauuuuauugcgucuuaaaaaaggaauuauucuuaagaaacagaggguuaagugguaucaccaagucauggguauauuuuuguguagaaacuugcagaugcugaagaagauuuuucuuguuuuuuguuuuguuuuuucuuugagacagggucucauucugucacccaagcuagcgugcgguggcaugcaaucagggcuuacugcagccuugaccucaggcaguccuccugccucagccucccaaguagcugggaccacacacgcaugacagcgugccuggcuaauuuuuuaaaaagugauuuguagagaugaggcuugucauguuccccaaggccggcgucaaacuccuggcucaauugauccuccugccuuggccucccaaagugcugggacuggcgugagucaucacacuuggccugaagaaacuuuuucuaaacuaauugggugaauggacaggggauaaacugauucugaaauuuccuccuaacgcuuucaucugcauauaguuucaucucuuuuaaucacuuugaggggaacuuugaaccuuuuugucugauuuuuaaucuuuuauuguuagcaaggugggguuuugggaucagagagagccuuucguguuccucuagguacucaguuucuucauguauggaaggagagugggaugcaguuacuuacauuaguuucaguauuuauguucauauuugacuguucaaaaagucuuugaacuguuggguguuuauacugcaacagauuauggauggagaugcauuugcugaaaauaaaagaauuauuuugcaacauaagcuuuucuuuguuacuuucuuccuuucacugaggauuacaaaguuguagaaaaauacuuucugaaugaguaaaauaauauuuaauuaaauauuaaacauuuuagugcuguuuauaauucucuggguaggcugagugugguggcuaacaccuguaaucccagcacuuugguuggcugaggcgggcggaucaccagaggucaggaguuccagaccagccuggccaagaggccagcuggguguggggacacacgccuguaaucccagcuacuauggaggcugaggcaggagaaucgcuugaacccgggaggcagagguugcagugagccgagauugcgccacugcacuccagccugggcgacagagugagacugugucucaaauuaucuugcuagagaagauuuuuaugcuguaugaaguaaaaacucgagucauugaucuuuauuucaagauguaaauauuucaguauucagauuaaaaaaauuccuaaacugaaauguaccagucucugcugguaagaccuacacauuaacauucuucuuuuuccucuucugcccuacccucaaaaagguacuaacucugcauaguaacaguacuacacagagggguagaauccuaaaacuaugaaucugugaccuuauaccuuaacuguaaauuucacauaaaaucuuccuacuuaacaguguuuugguacuuaaacuuaacaugguauccuggacacccaaacaucaguauuauaauuacuaucccguaauuaauuuagcuauaauacuuggaauauuaguguuuuuauaaugagggaauuugagcacucuaguguggaauuuuccuaaaaaucaagaagacaguauucuauagcaaaugcuuguggcaacaugucacuguuugguccggggaagaaguccucacaugucacucccuguguacucucugauucccaaacaguguuaggugcuccuguauacuugaauugcaugucauacguaauucuguaauaguacuuucauauaacuuguauuuuugcuuugguuuguuuuuguuuugagacggagucucgcucugucacccaggcuggagugcagugguaugaucuuggcucacugcgaccucugccucccggguucaagugauucuccugucucagccccugaauagcugggauuacagauguccgccaccacacccagcuaauuuuuuucuauuuuuaguagagacgggguuucaccauguuggccagccugguuuugaacucuugaccucaagugauccacccaccucggccucccaaagugcaaggauuacaggcaugaaccaccgcgcccagccauaacuuguauuuucauauaacuugucauguuuucauaucuuauucuuacuguauuucugagagcagggacucaauuuuauucuuuguguucauugugugcagcacacaguugauuaucauuaaauuuugaguaagugaaugaaugaaauggagagguaggaauguucuguggaauagguggaauguuaaaggugggugcaguuuggauagguauaguggagggcauucuaauuauuagugucaugacuuguuuuuacaagacaaugaaagaucggcauaucuccuaaagaauaccuagcuuccaaauuauuuaccuuguguuuuucuaggucugaauuuauauucccgcaguuuagaacugcugauaucuccugagguuugagaagaaagcaacauugauuuguucauucuuucuuuccacaaauguuuauugugcuaguuucuagauagaucugggcuggccagugcaguagccacuagccacauguagcuauuuaaguuaauuaguauuacauaaaaucaaaaguuuaguucuuuaacugcacuauucauguuccaagugcucuguagcuacguguagcuacuggcuacauuuuggacaaugaaguuacagaacauuuucaucaucuuagcauugaauaauguccaucuaaauacuggggauauuaaacaaacaaacaucuggucccugacucaaccuaguuucuggaaccagaagaaucagcaaacacugccagaacugaaucagacuaauacaugaaugacaaaccuguuucugccuagagauuuuucuuuauuguuaguuaaucuguaauuguuggaauuucaguugaagguguugaguuucaaaagaagugaaaaaacuuaaacaguaacucacuguggaaccuacccaauaagucagggagcuuugcuaaggagucuguucuuagcaacuguaaacuauguaucuuuuuuuccccuccuaaaaagagaaaugaacuugcaggguuuuuuuaauugaaaauaacauguuccuguaacagugcggcuuccagcagcauguuaaggcaggguugaaagucacucauaaguuacuuuaucauguuauucauuauguuauguaaaagauaaaacuuacaaaauagucugcguucuacauuuuauuuuuaucuggaauuuuauaucaaauuuacaauuaagguauaaggucaggcauucauaguuuuaggauucugccccuuuguuggcauaguacuguuacuguguagaguuaguaccuuuuuggggguggggcagaagaggagaaagaagaauguuaauguguagguuuucuuuacuugaugauaaaauaaauauuugucauauauuugaaaaacaaaguguaaaagagaaaauaagaugacccagauaaugucacuaucaucauuugucuauauuuuccucuagugucucuuuucucacaucuguaugauuauugauuaccaaauggaagguucugcuucuuuuauugucuuauuuaauaaaaugcuuuuguaauggcauaaugucacuugggugaaauguagccugaacuauauuuuauuccuccauuuugcauauuuaaguuccuuuaggcauuucauuauaguuccuucuauugaaguuuuaugcuuggauauucuagcagguaccugccacuauucauaugccuuuaguuaaagcagaggcuucaugugcuaagaaaaguccuaaucaauucugaauuacugguuugguuaggaaugaagaauugaggacaaaagucuuacauaaugagcagcuguugcaucaauccuagcagucagugggucauagauacuagaaccagauuuccuuccauucugaauguccuuagggguaaacauuucuuuuuuuaacauuugauuauuuccuuaaauagaucaauaggaauugaauugauagaccgaaguuuuuaaauucugaaacuucuugacauauauuaccaaguuguuuuccagaaaaaaggugccaauuuauacucccaaauccaggguacacucagcaaccuagaaguagaagggaacugccucaaccugauaaaggacaucuuaugaaaaacagggauaucugcuucuaccaccuguauucagcauuguacuagagguucuugccagggcaauuagucaagaaacugaaauaaaaaguguccaaaugggaaaggaagaaguaaaacugucuuuaguuuguguguguguauauuuaugcaugagaaaauccuguggaauccaccaaaacaguggacgccaaccuuuuugacaccagggacugguuucaugccauuuuuccacagacugugggggagguggggaugguuuuggggugauucaagcacguuagauuuaucguguacuuuauuuuuauuauuaucguaauauaauaaaauaauuaacaacucaccauaauguugaaucacugggagcccugagcuuguuuuccugcaacuagauggucccaucucagggcaaugggagacagugacagaucaucaggcaucagauucuuguaaguagugugcaaccuagaucccucacaugcacaguucauacuagaguuugugcuccuaugagaaucugaugcugcugcugaucugacagaaggcggagcucaggcaguaaugcgagcaguggggagugacuguaaauacagauggaggaccaggcgugguggcucacaccuguaaucccagcaccuugggaggccaaggcaggcagaucacuugaggucaggaauuccagaccagccugaacaacauggggaaaccccgucucuacuaaaaauacaaaaauuagcugggcaugguggcaugcaccuguaaucccagcuacuugggaugcauaggcagauuucacuugaaacugggagacagagguuguagugagcugaaaucaugcgucuguacuccagccugggugacagagggagacuccaucucaaaacaaaacaaaaaacaguuggaacuucgcucaccugccacucaucugcugugcggccugguuccuaacaggccacaggccaguacuaggauuggggaccccugcacuaaaaaacuguuagaacuaauaaguaaguucagcaaaguggcagcauaaaagaugcagaaauugauuguucuguauacaaguaaugaacaaaguagaauuaagaaaacaauuuaaaaaggccuuaaagagaauaaaacaucuagaaauaaauugauaaaagaagugcaagacauguaucuugaauacuagaaaacauaauugaaagaaauugaagacaaugaaaaggcauuccauguucaucgauuagaaaauucaguauuauuaagauggcaguacuucucaaagugaucuacauauucaacacaauuccuaucaaaucucagcugacuucagaaucugacaagcugauucugagauucauaugcaaauucaaaggagcuagaauaaccaaaagaaucuuagaagaacaaaguuggaacccucacaauuuucaauuuuaaaucuuccuacaggcugggcacguuugcucaugcccauaaucccaaccccuuggaggccgaggcaggaggaucaguugaguccaggagcuugagaccauccugggccacauagugagacccugucucuauuuuuauaaauuuacauaaaucaaaaucuuccuacaaagcuagagugcucaagauugugugguacuggcauuaugauaaacguauagaucaauaauagaauugagagucuagaaauuaauuccacacauuuuauaagcucaacugauuuucgacaagguggcaggaugauucagagggaaagaauagcuuuucagcaacuggugcugggauaacuggauauccacacacagaagaauuaaguuggaccccuucauaccucauacaauaauuaacuuaaaauggaucagugacuuaaauguaagcacuaaaaccauaaaccuauuagaagaaaagguaggaguaagacuuuaugaucuuggauugggcagaugcuuauuagauaugacaccaaaagcaggggcaacaaaagaaaaaaaauagauaaauugaacuucaucaaaauuacuuuuguccuuuagguggauacuaucaucagcaugagaagacaacacuuagaacggggaagauauuuguauauuguauaucuuauaaggaacuuguaucuuaaauguauaaauaacucuuagaacuaaauaaugaaaaaagacaacgugauuaaaaagugggcaagggaucugaacauauauuucuccaaagaagauaugcagauggccaauaagcacaugaaaagauguucaacaacuuaguuauuagggaagugcaaaucaaaaccacagugaguuaccacuuuauauccauuaagauggcuauuauaaaaaacaaaacaccaccaacaacaacaaaaaaaacccuaggaaauaaguguuguccaggauguggagaaguuggaacccuuacucuuugcuacagagagaguacaauggugcaguugcuuuggaaaacaguauggccuuucccccaaaaaucaaaaauagaauucuagaaauucuacuacuggaucuccaaaagaauugucauuaggugugguggcucauagcuauaaucccagcacuuugggaggaggccaaggugggaggauaaccugaggccaggaguucaagaccagccugggcaacauagcaagaccacaucuccucagaaaauuaaaaaauuuaaccaggugagguggcacaugccuguagucccagcuacucaggaggcugaggugggaggauugcuugagcccaggaguuugaagcugcagugagcuaugaucacuccauugcacuucagccugggugacagagugagauguugucaaauaaaacauuuaaaagauaauaaaaaaucugaaggccgggugcaguggcucacgccuguaaccccagcacuuugggaggcugaggugggcggaucaccugaggucaguucaagacuagccuggccaaaauggugcaaccccgucucuacuaaaaauacaaaaaucagcugggcgcaguggugggcgccuguaaucccagcuacuugggaggcugaggcaggauaauuacuugaacccgggaggcggagguugcagugaaccaagauugcaccacugcacuccagccugggcgaccaagugagacucugugucaaaaaaaaaaaaaaaaagggaaacagcauuuccaagagauuuguuaagcucauguucauagcagcauuauucacaguagccgcaagguggaagcaacccaaguguccuuggauggaagaauugauaagcaaaaugugguguguaccuacaauuaaguacuguuaagccuugaaaaugaaggaaauuuuuacacaugcuuacaacauagauauaucuucaggacaugccaagugaaauaagccagucacaaagauaauauaugugugauucuacuuaugugagguaccuacaguagucaaauucauagggacagaaaguagaaugaugguuacuaggggcuuaagagagagaggaauggggaguuacuguuuaaugaguuucaguuuugcaagauuaaaagaguuguggagaggggugguagucaugguugcacaacaguaugaauaugcuaaugccacugaacuguacauuuuaaaaugguuaagauuauguuguguguauuucgccacaauuuaaaaaaauuaaacgagaugaaguaauacaugcuacuauuuggguaaaccaagaaaacgugcuaagugaaagaaagcuagucacaacagacuauguauuauaugauuccauuuauaugaaauaucuagaauaggugccaaauauuaucagaauauagauuggugauugccagagacauggggaggggauuggaaauggagaaugacugcuaaugcgugugagguuucuuucuagggucaugaaaauguucuaaaauucauuguagugaugaugguugcagaacuccaaguacacucaaaccaauugaacacuuuaagugguugaauguaugauaugugaauuauaucucaauaaagcuguuauuuaaggaaaaaaacgauaacuagcuccuaugaauucuguguuuaaugaaaauagaguccaaauugagagggauagacgggugaggggugucucuguuauaaaagaugagacuguaaaggugcuagacguuugaauacuaugccaaggaaccaaaauaucaaaaaacuucuacuuuuuucaaaaaauaauacagugcuuauuguacauuucaaccagcauuuauaguaauuuuaucuuugggcauuugauaggcaaaaaaugcugucuugucuuuuuuuuuuuuuuuuuuuuuuuuuuugagacaagcauuucacucuauugcccaggcuggagugcaguggugcggucuuggcucacugcagucuccgacucccggguucaagcgauuuuucugccucagccuccugaguagcugagacuacaggcaagugcugccacgcccagcuaauuuuuguauuuuuaauggaaacgggguuucaccauguuggucaggcuggucucgaacuccugaccucgugaucugcccgccucagccucccaaagugcugggauuacaggugugagccacugcccccagccugucuugucuuuuuaauacacauuuuuuaauuucuguggagcuugaauaguuucuuauacuuagaggccauguguauuucucucucuuuuuuuuuuuuuuuuuuugagauggccuugcccugucacccaggcuggaguacaguggcacaaucaucucagcucacugcagccuugaccucaugugcucaagugauccaccuaccucagccucccgaggagcugggaugacaggcacauuccagcacaccuggcucauuuuuguaauuuuuuguagagaugugguuucaacauguugccgaggccagucucgaacuccugggcucaagugauccaccugccuuggccucccaaaaugcugggauuacaggcgugugccacuguguccagcccauuuauauuucuuuaaccauacauuuucauguuuagguccuuugcucuuuuuuaacuaggguauuaguguuuuucuuaauugauuauaauuguauguuuuacauaguaauaauguucaucuuuugaguaacauugaaagcuguucaggcaucugguuuucuggcucucaguguuuuucuuauguuagugaucaauaaauuuuuuugaggggugaguugaauugagaagaaaaauauguauaaaauagauuguagucuguuucagaauaaucaaauaauuaguagaagaugauagaggaauguguuuuaguuaagauacaccaaauaaugucuuaaaggaaaaaagcucaaaucuuaauuuggaaugacuuucuucucuggguuucaaggaaauguagaguuaguaccacguuuugaaauuuaaagaacguagaacagaauguguuagaugcacaucaggagaugacacauggcaaagggacuguuaggaguuuaauggaaagggaaacugugggcaaguagggaagggaguuggauaggaauggaaaguaggguggggaguacauuucccaugucacuauuuccugaacagugcaguagagcacuagaaauaugugcucuuggaacaggugguauaagguaauagugaugguaauauguauaauggguuaagagcaugaauuagaauccuauacucuguuuucuucaucugcaaaaugggguaauaaugacuaacucacagguuuguuguaauuauuuagugauauagugcaugugaaggacuucacauagaauauggcacauaguaagcacacaucaguaaaguuuagcuugguaguagauugauuuugagggcagaauuagauuauuaauacaauaauuauuaggcagguaggauggaauuuuggaagaaauaaaaauuuuaguuuuaguccucuagugaaauuuuauuauguggagaucagaccucaggaauggaguugauccagaaguuuaaaaaaaaaauuuuuuucugaaagcuuagaagcagucucuaauugugaagaguuucagucacaucugacuagcugugaguaauugguuaacccaccagaaagaaaaaaacgagucauugguugcgaucaaacccaaacuggcagugaaaggaagacugacaagugaaacucaagagcagauaauaagggaaaugcaaagagcagaugccuugguacagguuagaaauggaggguagaagaggaaguuaaggagcagauacuguugagauugagauaacuauagccaacaagaacagauagaauucugcaguuaaauucugcacugggagaaaugccagcagugaaggguggaaguggcagagugccauuuagagcacauuaagcuaaaagauacuuguuacguugcugugcaguuuuugguaccucuuggaggaagcuaaugauuaacugcuguuucuucauugugaaaaguagaggacaaugaggcugggggauuguuuuacuuuugccacacaguaguuaugucaacgugggcaaauuauuuauugucucugagcuugaguguuacaagaagaucauuauacuuuuuggguuguugugagaccuaagugagacaauaugugaaguauuuucaccauucuucaugauuaccauuagagucuaccuauauguacuagaugucacuguuacuaugccaugugauaggagagacuuuauauaguaguugauccaucauacaguuaccauauaaaacuuccagguuucuuacuuguuuugguuuguguuuagaauuuuguugaaagucagauguuaaaguuugggaguaccagguguuauguauuuauagaaauacaucaucugauguugagaaauaugaacuguggcauaacuuuuaaacaaggaggcauaguucuucuuuauaccucauuaaagauuuacuauaaaaguacauaagguggggcaaaaagaagaaaauaauuucugguaaauguaagaaaaaagaaaaaauauccagccucacuauaauaaaagaaauguaauuuaaacgauacaaacuuuuuaucucucaaaagugguaguguuuuaaaaaauuuuucucguuuguuuuuuuagaauuauaaaauuauauuugguuuaguuaaaacaauggaaauauggaaauaaaaagcauaaauggauagaaugggaauaugcauauguagcagauaagaauaccauggccagugaugaagagacaccagagucacguuuuuucaguuuccacaaauuuuuugugcaaaacaagcaugugcauuauucuauucaugaauuuuuucaaaauugaggcauuaauaugcaauauucugcaaaauagauauuuuuauaugccaugauauagccacuuaaaaaacagagauaguauucuguaauucuauaauuuggauauauuuuguauuuuauuaggcuugcccauauagaugaauauuucgguuauugguuuuuagcgucuuccaacagugcuuuaccaaacaucguuaaguguaaaucuauguguauuuguuugggacuuucauaggauacauucauaaaacuggaauugcuaguuagaugauacaauucuuuuguauauuaauaguuauagcuaaauuaacuuauaaggaaguuuauucaauuuuuuuacauucuaauaaaauuuugugggaauagguacuuuacugaagcacaguauauuauugauuuuaugguuuugcccaucugauaagagaaaguaauaccuuuuucccuauuugugaagucaaaccuuuuuuuccauaauuuuugccauuucuucugugaauuugccuguuccuuugacauuuucuacugauuuagagagauacuaaaauacagauauuaauguuuuauguguuucauaugucagauaauuuucccauuuauauugcuugcccuuuguuuuucuuuguuauuuuaaaucuuuaaauauggucacaucugucuguuugguggcuuuuuuuuaauuuuggaagggugguuucucucaugcuuaggaaggcugaauccuuggcagaauaauaggaauuuuuuuauauuaaaaaaaauucuauuauaguuugaaaaaguauucagguaucuuaaucuuuuauuuuuaucuuacaguguucugccaucuuuagccuguaugaaauucccacguucuuuuuuuuuuuuaaauucccacauguucugaggauuccuguuucacugauguuuuuguauguccugccaccauauuauaucgcuuuaauuaucaccacccuauagcauauuuuaguuucugguggauaaagaucgccuucucuuuccccuuuaaaaaaaaagauuuuauuuuugugcauuuuagauggauaugaggucugaaaacauacugauggaaauuuggcuggaauuacauugauguuagugugggaggaagaaugcuuuuuaaaaaauuggucagggugugggaucauugacaagcauauuaauguaaugcuggagaguaaaaauuguuagagaguaauuagggauguaguauagaaccuggugugugcuaaauacuagauaaacauuuuauguuacuauuauaauaaucauuauuucuuaaaauauaauguguucuuuaauucugcaauuguauuuuuggaaacauaagggaaguagucauacccaagagaaaacaagucauuauaucagaaagacacgugcauguguguguuuauugcagcacaauucacaauugcaaagauauggaaccaaccuaagugcccaucagcugaggaguggauaaagaaaaugugguuuguauacaccauggaauacuacucagccauaaaaaagaaugagagugucuuuugcugcaacuuggauggaacuggaggccauuauucuaagugaaguaacucaggaauggaaaaccaaauacuguuauguucucacuuauaagugggagcuaagcuguggguaugcaaauacauucaaagugguauaaaggaugcuggagacucagaaagggggagagugggaggcaggguacaguguacacuacucgggugacaggggcacuaaaauuucauacuucaccgcuauacaauucauccauguaaccaaaaaccacuuguaccccuaaagcuauuaaaauugaaaaaaaauuuuaaaguaaucaggacuagauauagcuacaagaauguucuucauuguauuguuuauaauaacaaaacguuagcaucaacauaaauaucucaacaauagagaauuguugaacagaacuaugguauauuauuacuagagaaugcuaugugguuauauacauuguguaaaaguuaaauuauaaggaagguuauucauacuguuuacaaaggacuagguaaaguuucauccaaaguuuuguuaaaauuuauuccaggaacacaagaaaacuuuugagggugguggauauauuuacugucuuaauaguagccacagucuuaauggguacauaccuaugugaaaacuauuuaagucauucccucuaaauaugugcagcuuauuauugucacuuaacacaucgaagcuguaaaagaaaauuuucuguuaaaauguaacaaacuuaagcuaaaauucaguuuauuccuuuaagaaagaaccaacaggauguauauuuacauauguguagagagauuuauauuaaggaauuaggucacacaauuguaggggcuggcaagucugaaauuuguagggguggccagcagucuugagucugaagguaaucuggaaucagaauuuuuuccuuuuugguggaccucauucuuuucuuucaaggccucaacugcuuggaugaagcccacccacauugugaggguucaucuuuucuccccaaagucuucugauuuaaacguuaaucguauguaagaaauaccuucauagcaacauguaggcugguuuugaccaagcaacugggcacuauagccuagccaaguuggcacaugaaauuaaccuucaaacuguaacaaguugauuuuggcagaaugacaaaauaccuaacugagagacuuuuaaaccguaugggaaucuguuagcuuacaugagaagagacccagagauaagggcaggguuuaggguugguugauuuaguggcauaaagauguuaucagaaacucaguguaugccauaaugcaugaugcuucauucucacgcucaagaauuuggauaacaggaacugaaugauuuuugcacuuucaugaaguuuuuuuguuauuugucucuggcuuuaaauguguuuucugaaagugaauuggaauuuuacaauauguucuagauuuaauauaaauaauaaacuuucaacuuuauuuuauuuuuuuugagaccgggucuugcucugucaccuaggcuggagugcagugucacaaucuuggcucacugcaaccuucagcuccugggcucaagggauucuccugcuucagcuucccaaguagcugggacuacaggugcaugccaccaugcccagcuacuuuuuguauuuucaguagagaugggguuucucuguguugcccaaacuggucuccaacuccuaggcucaaacaauccucccaccuccucccggcaaagcucugggauuacaggugugagccgcugcacccggcccaaauuguuuuaucgccucauguuacuaaugcagcagccacuuuaccaaccaggauuccuuuauugcuacuuucauacuccuuuacucuucaguuuugaagcucuuccuuucccuccugcuguucccccaauguauuucguugccuaagaaaggcuaaacuggcaugcuacuccuaaaauguuaacagugauugcauuugucuuagaauguuauugagguuacacauacuucuugcaacauuuccaacucuuauaacagacacuacauuaaaugauggcaguucaauggaauauucauaauuaagcuaaauaaaaguugcuuaaacauaaauaugcuuuuaaugguaauauuauagcuauaggugaaaugcuuuguagguaaaauuuuuaaaaagcaagguagcuuuuaaggaauagauugcuuuaaauauauuaaaaaguaggggugggcacgguggcucacgcccauaaucccagcacuuugggaggccaagguggguggaucacaaggucaagagauggagaccauccuggccaacauggugaaacaccaucucuaccaaaaauacaaaaauuagcagggcgugguagugggugccuguagucccagcuacuugggaggcugaggcaggagaaucacuugaacgcaggaggcagagguugcagugagcugagauugcgccacugcacuccagccuggugacagagcgagauuccaucucagagcaaacaaacguauauauauauauauauauacacacacacacacacacacacacacacauaaaguuuuaagucugaaauucccaaagaucaguucauacgcuuucuuagaaauaguaauuuugacugggcgcgguggcucacgccuguaaucccagcacuuugggaggcugaggcggguggaucacuugaggucaggaguuugagaccagccugaccaacauggugaaaccccaucucuacuaaaaauacaaaaauuagccggcuucguguugcaugccuguaguuccagcuacuugggaggcugaggcaggagaaucgcuugaauccaagagguguagguugcggugagcugagauccugccaccgcacuccagccugggugauagagacugucucaaaaaaaaaggaaauaauaauuugucuguuuuaacuugauaauuuucuuacacauaaaacuccaaaaaauuuuugaaaauaucacuaaaaaaguagaaccaacauacuuuuuuuugaaaacuaguuagaaacuuaacaaaucuaaaaaaguaguguuuuauuuaauuaaaauauauauguauaaugcuuacugugggcuagacacugcuuuaagcuaauuagaaauauucaguuaaucaucauaacaaaucuaugaaggauagagaaggaaaugagguacagggguauaggaaaaguuagaauuuuugucaugcacuaaauaugugaaaaauagcaacuaaaauuuuucuuuucaagcagauaguuauuucuguugguuugauuuuaacaggauguagagaaucucauuauuuaucaagguauauuuaugggaaaauguguuuggaacucagauuuugaggcaagaugcacaccuguucccacucccaguuguagugucauuaaauggauuuuuacucuuuauauuccuaccaccuuucacguugagggcgaguauuuacuuaggcagcucacuaucacuaguggccuuaaggccugaaauuuggaauggaaaagagccaggaggucuuaaguuuucagcauucgaagguuugaggaccagaguuuucuuagggccucuuuuugguguaaacaccucuggguuugagauauauauuugguuucaugucagcacagugaccagaucuuucucuuuugccauuucagggauugaucuaguuuuucuuuucauugcuacugcccccaucagccacaaacuucuuguaaugugcauguaucaauuuuuagguuuccuaccacugauacuaacgagaaauggaauaguauagguuccuucucuuccaauacucauacuacaccuucuaccuucaggcauaguuuuuucauaugucuucuacaggucauggcuuugggguaaauagaaauguugaaauaagaucccugaauacuuuuaaaagaaauauuguaacaaauauuuguugagcaccaauuauauaccaaacauuguucuagguguuuggaauagacaagguagacccuauguugugucauaauggcugaggauuggggcuggggugggguuaggggaauagaggaaguaucuuuuuuuuuuuuuuuccucucugucccaauugaaccagggucaaagcagaguagaggaauguccugaucuaccuccaucgauacuguaugacuugggacucuaauguuagguuaauuugcuuacuccuguuaaaacuagaauuguuuucuagcaauuacagauuaaagguagauccauaggaagaaaguuuuuuuucuuuucgucuucuuuuuuuuuuuuuugcaguuaggcagaaaugguuuugaauuucauaugaauguccugaaaacuuugcaaauagucugauucuuuuacuuguuuucucaaguaaagaucaaugcaauuguugcagcccuuaguuuuacagucagaacuguuaaaucuuguuucugaaauuaucuuccuuaguuauuucuguuguugaauuugagaaagcagaguucuaguacaacuuauacuuaacuuuuuuuuuuuuuuuuugagacagagucuuacucuguugaccaggcugcagugcagugacgcuaucucggcuuaccacaaccucugccucccagguucaagagauucucaugucucagucuccugaguaacugggacuacagguguaugccaucaugcccagcuaauuuuuguguuucugguagaggagaugaacuccuggccucaagugauuugcccaccuuguccucccaaaguguugcgauuauaggcaugagccaccgugcccugcaaacuucugauuauacauuuucauaagguauucgugguugaaauaggugauuuucugagacuuugaucgggaaguuuauaccucugauauuuugucuucuggugucacaccugcccuagccuucaaccuuggauugaucucuuuuuuuuuuuuugagacugagucucgcucugucacccgggcuggagugcaguggcaugaucucggcucacugcaagcuccgccuccuggguucacgccauucuccugccucagccuucagaguggcugggacugcaggcgcccgccaccacgccuggcuaauuuuuuguauuuuuaauagagacgggguuucaccauguuagccaggauggucucgugauccgcccgccucggccucccaaagugcugagauuacaggcgugagccaccacgcccggcccuggauugaucucuuaauacuaaaacugcuggagaagaaucauuacagccaucuagguuauuuucuucucagauuuauggucaacaaagauaggauuucagggcuaccaaaguauccuuuuauuuguccuuagucagcucugucuuccauucugcaaagcaaagauucuuguucaacuucuauuucuuuucucuuaaauagaagauauugcuucauuuucugcagggaaaguaacaccagccaagaacucacucucagcuuuuaacuuuccauguauuuaccucacucuguacccguuuuacucauuuaucucagaggaaguaauauuucucuuuccuacuugaagcagauucccucaaguuccuagguacuuugacguguguguguuaccucuucuguauuuucaacugcuucccucuccacucacuccuuaccuucagcgcuaacccuacccacauauuuccuguauuaaaacaaaaaaacccuucucuaauuugagucugcuuuauggaucauuacucuguacacuacuucuuuuuguugucagacuuugugaaagaguaaucaguagaugccaguuguacugccucgcuuugucauucacccauuggucugaauuuucucgccacuuuauaaagauaaggacaguaguaauuucuugcuaaaaguaauaacaauuucucagguuuucuuaguugacuuggccagcguuuauuauguugacuugcucuuaaaaauucuaccuuuucugaaagaguucuauucagguuggcuuucucucucucuggcuguugcuucauagucuuucuuaguggugucuacuuggugguggucuucuuccaagauaucuguagcucuguguuuuuuuuuuuuuuuuuuuuuuuuuuuuuuuuuccugagacagagucuugcucuuuuguccaggcuggagugcaguggcaugaucucugcucacugcagccuccgccucccggguucgagcgauuccccugcgucuaccuccugaguagcugggauuacacgugugcgccagcacgccuggcuaauuuuuguauuuuuaguaaagaugggguuucaccauguuagccaggcuggucucuaacuccugaccucaagugauucgcccgccuuggccucccaaagugcugggauuacaagugugagccaccgcacccagcuguagcucugugguuuuuuaaucaucauaucucugugccauuaccuuaugaaaacauucccagaucuuagcuucagauagcuacagcuauucacuagguaucucaauguucauauuucacaaagguaucucaaacucaugcuccugaucccuaucagccugcuugcucuuaguccugcuuuaaaucucagcuuaaguaucucuucugauagcugaaucagguuuuaucuuuugggauaccacugcauuuuuaagccuaucaaagcauuauaauacuacaguuacuuuacuuacauauuuaucugcagugguauuaauaaauuuccagccuccugaugugaacaagucuuacuugucuuuguacuuguaaucaauaaacuucuguuguuuuguugaauagucucacaaagaaaaaauuccaaaauaauugguagaguuuauauaaaauuauaauuuaaaaauuauuuaaauuauauuuguaaauguaaacuuguaguuuuuugauccacuuucaccauugcuauuccuuguaucuacuuucaaccuuugccaacuuacuagucuuaacagguaggaucuauauuaauucagauaauuucuagaauugguaauuaaaaguugauugggcauuuacagccuuuuucuugagaugggauuuucuuccauuaggaauaaucuuauugaagaauuuuaaaacacauuuuuauaaauagugcuaccuugcuuuccauaauguuuuggucaugugugaaauuuuauuuuggaauuaguaauaagugaaaacuuugguuucaucuaaaccaaugugccauugaauuuauuguuuuauugguauuguuucccccuucuugccuuauaugaacacuuagagaagaaaauuaagaaaaucaaaugcuuuauucucucuuaguuuuaauaccaguucugcuaacagguauuuuucuaugugaagcaauuuuuuuuguugccaaaguaagccaagguuuagauucuaacugugugaaguaguggauaaggacacucaggguuaguucuugguucuaucuggcugucuuuccuugcaccccugaccccuuuugcucugauucuuucuaacccaugguuagcagucucaaaagcacuaguggcaucucuuuuaaguacuaaacauguggggagaguauuucaguagaauugguuauggccacuauaucuuuucuagagaacaaaaguaccucaccguugaaauuaaaagagaaauaaauucuguguaaguauaccauuuaggccagaugcaguggcacaugccuguaaucccagcacuuugggaggccaaggcaggaggaucucuugagcucaggaguuugagaccugccuggacaacauagcuagacccuaucucuaaaacaauaaaauacauuagcugagcaugguggcacaugccuguagucccagcuacuuggggggcugagguaggaggaucccuugcuugagcccaggaggucaaggcuuuagugagcugcgauugcagcacugcacuccagccuggacaacagaaugagacccugccucagaaauaaauaaauaacaaucuaccauuuaaaaauaaucugaauauguuuuucuuacucuuuccuuaaauaaccucauaaauaaccauaaaauuuauucacuuugucuacaagguacuuaaagcaguuuuuguucugguuuuuccuugaaauagccaaaacaugcuguuggaaaggcagaugguagauuaagcagauuucauagaccuuugcggugauugucauucauuuccuuuccagccuucauuuuaaaaugaaaauacuaggagaaaauugggaaauaauccgaauaauaaaauacugugguguaguuaaaguuguagucuggaacuguuugcuucaagauauuucauuagcuuuuuugaacaacaaacaauuucaaguuauauauagacuuagcugguuucucuucaagcuauuagcugguuagggagaugauucgcaccuuucugauaaauaaugcuaaccguguauguaaauuuuaaauguucuaaaaaccccauuuaaacuaaaaagacaagcgaaauuauuuuaauauuaucuuuuauuaggcugagugcaguggcucaugcuuguaaucccagcauuuugggagcccgaggcggguggaucgcuggaggucaggaguucgagaccagccuggccaccauggugaaaccccgucucuacuaaaaauacagaacauuugcuggacgugguggcgugugccuguaaucccaguuacucaggaggcugaggcaggagagucucgagcccagcaggcgaagguuacaguaagcugagauugugccacugcacuccagccuagaugacagagugagacucugucucacacaaacacacaaacaaacaaaaaaacuuuuauuuaaccccagauauaaaaauuauuuagcuacuuuagauuuuuugguacuaaaucuucacaauccacuuuguauuguacacucacagcauauuuuaucucagcugggucuaaccacauuucaacugugcaauagccacauguuaagacuaaagccuuccgaauggacaacuuaguucuaaacagcuugguauuugcccuacuuugggagagauaugguauuugacauguuuuggggccacccaccacugguuuaccuuacuuucuauaacacccuugggcuuuuuuuuuuuuuuuuuuuuuuugaggauucaccuuuuuucuguucucagucuguguagcugugaagccugcucuguuucuacggguacaugacucagauugggcaguuggagccuuacaguucucuuacgagguugagacuuaacgcugagauuuccuauacagagugagguccucuuaccugugcagugugagugugaggguaaucaucuugagacaggauagguucugagaauagagcaagcacugagaaauggagagaaggaacguaggcccuugccauaggauuuugauagcucuguuuuuuccauaauuacaguagaagcucagaagauugagaaauuaaccuuguuuuuuuuuuuuuuuaaauuaguguacauuggguuuucugucacuugcaagagugacauuccaaguaaauaaguauggauuagggagguucaguaugguguuagaaugccccagcagcugaaggucguucucuuguugaucagaguggggguuuucaccagguagaagucagauccuuugugauucccaggaucucagaugcuugaauugacuuuuuuuuuuuuuuuuuuugagauggagucucacucugucgccaggcuggagugcaguggccugaucuaggcucacuacaagcuccgccucccagguucacgucauucugcugccucagccuccugaguagcugggacgacaggcaccugccaccaugcuuggcuaauuuuuuguauuuuuaguagagacgagguuucaccauguuggccaggauggucuuaaucucuugaccucaugaucugcccgccuuggccucccaaagugcugggauuacaggugugagccaccacgcccagccugaguugacuuuuuaccaggguuuuuacagaccuguuggugggcagauacuuaacuaucuacucaaugaaaaggaucagaaaugcaaauaacacaauuauuuauuccccugaugguggucucacugagucuuauuugcuuugccugugaguuuagaacuuauuguuuccaacuuuuauugaauuuuaaaucucuugucuuuuagggacuuuuuaacuauaaauuccuuaauauuuuucuuuucaaaauaaaguuccucuguaagaaguauaaaugaguuuacuaugaccacaguaaugcaaauauauauaaauauauauaauaaugcaaauauacauaaagagaaaauuaauuucccauuuucuuuugccacuuuuugccaaauccaguguuaacagcuuaguauauaucauugauacuauauuacaaaaaaaggaaaacagaaauggaaaaauauauuagauauaugguugacccuugaacaucauggguuugagcugcauggguucacuuauaugcagauuuuuaaaauaaauauauuggaaaauuuuuuuuuuuggagauuugcaacaauuugagaaaacucagaugaaccauguagccuagaauuuuaaaaaauuaagaaaaaggcugggcgugguggcucacaccuguaaucccagcacuuugggaggccgaggcaaguggaucacuugaggucaggaguucaagaccagccuggccaacauggcgaaaccccaucucuaccaaaaaauacaaaaaucauucgaucguggugauggacgccuguagccccagcuacuugggaggcugaggcaggagaaucacuugaaccgggaggcagaaguugcagugagccgagaucgugccacugcacaccagccuaggugacagcaagacuguguggaaaaaaaaaaaauuuaguccgggugcaguggcucacccccguaaucccagcacuuugggaggcugaggugggcggaucacaaggucaagagauugagaucauccuggccaacauggugaaaccccgucucuacuaaaaauacaaaaauuagcugggcgugauggcgcgcgccuguaguuucaguuucucgggaggcugagagagagagagagagagagaaaagauucuuuuuuuuuuucuuuuuuuugagacagcgucucgcucuguugcccaggcuggaguacagugcugugaucuuggcucaccacaaccucugccucccggguucaagcgauucuccugccucagccucccgcguagcugggacuacaggcuugcaccaccgugcccugcuaauuuuuuguaguuuuaguagagacggaguuucacuaugcuggccaggcuggucucgaacuccugacguugugauacgccugccuuggccucccaaaguacugggauugcaggcaugagucacugcgccuggccuagauuagauucuuacugucugaaguaguggauaaggacacucagggucauuucuugauucuaucuggcugucuuucauugcauccccuaccccuuuugcucugauucuuucuaacccauguuuagcggucucaaaagcacuaguagcaucucuuuuaaguacuaaccauguggggagaguauuucaguaguaguaguuauagccacuauacacuauaucuuuucuagagaacagaaguaccucaccauugaaauuagaagagaaaauuauauauauauauauguguguguguguguauauguguguguguauauauauauauagagagagagagagagagaaagucauucagucagucuggcaugcaaagacagagaaucugagagugacacaaaaauaaacaauaguuuuucugcuuuaaaaguccaguguucauccuuccccaccccugcaacucuggcaaccacugauuuuuuuuuuuuuuuuuuuuuuuuuuugagauaagagucuuggucugacacccaggcuggagugcaguugugccauuucagcucacugcaaccucagccuccugagcagcugggauuacaggugcgcaccaccaugccuggcuaauuuguauuuuuaauacagacaggguuuugcuguguuggccaggcugguaugcaacuucugaccucaagugaucugucugccuuggccucccaaagugcugggauuacaggugugaguuacugcaugcugucacugauuuuuuuuuuuaaacuuuauccauaguuuugccuuuucagaaugucauguaguuggaaucauacaauacguagacuauucagauuggcuucuuuuacuuaacaguaugcaccuaaaguuccuccuugucuuucuguggcuuuauaacucaguuauuuuuucacucaaaauauuccauuguauggguguaccacaguucguugaaccauucacccacugaaggauauuuuggguacuuccaagucuugacaguuaugaauaaauauuuguaugcagguuuuuguguuaauuucagcuccuuuggguaaacaccagggauugauggauuauauaugguaagagaauguuuaccuuuuaagaaacugccaaacugucuuccguagugucugcauaagcaauaaaugaaaguuuguguuguuucacauuuuuaccagcauuugguguugucaguguuuuggauuuuucaauucuaauagauauguagugguaucuuauuguuguuuuaauuugccguucucugaugaaauaugauguuaaggccgggugugguggcucaugccuguaaucccagcacuuugggaggccaaggugggcggaucacuugaggucaggaguucaagaccagcccggccaacauggugaaaccuggucacuacuaaaaauacaaaaaauaacuugacgugguggcacgugccugcagaccccgcuacuugggaggcugaggcaggagauuugcuucaaccuagggggcagaggcugcagugagccgagaucaugccacugcacuccauccugggcaacagagugagacucugucucgaaaaaaagaaaagaaauaugauauuaagcauuuuuucacuugcuuauuugccauugguauaucaucuuuggugagaugucuguucaaauguuuugccuucuuuuuaauugggcuguuuguuuucuuuuuucuuuuauuuuggagacaggaucucgcucugucauccacgcuggagugugguggcacaaucauggcuuacuguagccucaaacucccagucucaagugauccucccgccucagccuccugaguagccgggacugcaggcacucaccaccaagcucggcuaauuuauuauuauuauuguuauuauuauuauuauuauuauuauuauuauuauuauugggagaaauggggucuuguuauguugcccaggguagucuccaacuccugccuucaagcuauccuccugccucggccucccaaagugcuaggauuauagacgugagccaccaugccuaguggauaccaaucucccagucugacuugucuuuucguuuucuuagcagugucuuuugaagagcagaaguuguucuucgguuguuuuguuuuguuucagguccugcucugucacccaggccuggagugcaguggugugacuuugguucacugcagccucuuccccacaggcucaagccgucuucccaccucagccuccugaguagcugggaccaaaggcgcaugccacugcaccuggcuaauuuuuguaugguuuuaaaaauauuuuuuggagagacaggguuuugccacguugcccagacugguuucgaacuccuggguucaagcaauccguaugccuuguucucccaaagugcugggauuauaggcaugagccacugcacccugccaaagagcagaaguuuuaaauuuuaacgcuauccaacauauuaguuucuucuuuucacauauugugauuuuggugucuuguauaaaacgucauugccaaacucaagaucaccuagauuuucuucuguguucuagaaauuuaguuuugcaguuuacacucaagucuuugauccauuuugaguuaauuuuugugaaagguauaagguuugugucuaaauuucauuuuguucacuuguugguguccccuuguuuaagcagcaguugcugaaaagacuauccuuucuccauugaagugcuuuaacuccauuaucaaagaucaguugacuguuuuuuuaauggaugcauuucugagcuuuuguauuguguuuuauuagucuaguuauguuuuuuuuuucccacugauaccauacuguauuaauuacuguagcuuuauggucagucuuaaaguuggauagugucagcccucuaacuuugcucucauaaaauguuuucuugcuacucugaaucuuuuacuaucuauauaaacguuagaaucaauuuguugauaauccacacaauaacuugcugggauuuugauugggauugcuuuaaaugcauacagcaaguugggaaagaacugacgucuugacaguguggagucugucuaugugcauggcauuucucuucauucuuuugauuucuuucauuagaguuuuauuguuuuccucauauagaguacuugggauuauaugugugagccaccauguuuggcuaauuucuguauuuuuaguagagauggggucucaccauguuggccuggcugaucucgaacucuugaccucaggugaucugcccaccucagcuucccaaagugcugggauuacaggcaugagccaccaugccuggccugaacauuguccuuugauucuuucuuagaguuuccauuucucugcuuuugcauuuugcccaccuuuuuuccauuagagcucuaggaauauuaauuagagcuuuaaaaaaauuaguagucugauaaugccaguauuucugcuauaucugagucugacucugaugcuuguuucuucaaacuguguuuuagcgugcuuuaaaauuuuucauugaaagucagagauaguacgugguguagaaggaacugagguaaauaggccuuuaguguaagguuuuguguuuaucuggcuagggguuaggcuauguucacuguuugcuguaccuguaaguaucagaggccaaaauuuccucuaguguucauguuuuugucuucccuguugucuuuugguuucuuuggaauuucuucuuaaauaaggucugaggugugcaauuuguuuaguuguauucuccacuuaguauacaggagccauauuuguauagugguaaggcguagagggagggaaguguucuauagccuaaagauuuguucucagucuuuuagugaaccugugucccuggucuguagucucuacaaguacuucuaaguuuugguuuuucccugcagugagacaggagugcuagaggaugcugguauuggguauuucauuacccuaagucuaaggcuagaaugcucuggaguugaauauuucccuucuagauugguaaggcucugguggaacccugguagguuagucucugauaauuaauuucucuugaagucaggccuuguuaaggacagaaugcucugggcauauuucaucauaacuacauauuuuuuucugaucuucgcuaugauaaucuggcagggcuucugguuguuaaaaacugacaaaauguggaggccucucagacaggguccugcuguaguuuuuaauuaaaacuuguucacacugaaccuccagcuugguuuaggcuuuccuaccuugguaaugguucccaaggagcuuucugcaguuguaaguugugguucucuguauccugaaccugccugccucucucucuaauuuugggggcagugguuugcccugugacuccaauuucugcaauggcuuuacgaagaguuguugcuuuucaccuuugcuuuucuuuuguuuugaguauggaauggcaguuuuuaacuccuuaaauuccagaccagaaaccggucaucugcagggcuaauuuuuuuucuauauuuuacuuuucuuauuaaagauuauaacauaucucuagcugcauaauauacuacaauauggauauacuagauuuauucaaccuuuguuuauugauggacauucaaguuuucucagcuuuuuuacauuauaaauaguacugcuaaaaauauuccuguacauguauauuugcauacuagugcuguuauuucuuuacauuuacucuuaaaagugggauagcuaagucaaaggauauuuguguuuuuaauaauacauauugucugauuacuuugcccaaacauagcaguguaugaguuuccuuucuuuggcuauuacuggauguugucagucugguagaagagaaugguaucucaucauugcuuugauuaguacuuucuugaaaacuggugagguauggagcaucuuacauauguuuauuaacauuauaauuuccucucuggauucuuuauuuguggacauugacauuuacuuucaguuggguuauuugcuguuccccuuauucaucuguuaggcacaauugauaauauuucuuaaaauuauacuucuagaaaaauuuagaaaauugcagcauaagagaaaguaaaaaucacuuaucuguucacacagauaaacucuuagaguuuugauacuaauauuuuucuaaggauauguauauauaucagcuuuccuaccauaaugaaauuuuauguggcauguuauaguuccacaacuacauuacauaugauuuuauuaauuuuuaaauacaauaucggaaaaauaugaagcaauauaaaaauguuuuuaaaaaugcaggucaugaccuacucaauugauugcaugacccacaguuugaaaaacaucgccuuaaaccaggguuucccagcccccaggccauggacagguacuggucuguggcugguuaggaacugggccgcacaguaggaggugaguggaaggugagcgagugaagcuucaucuguauuugcaguggcuccccauagcucccauaacugccugagcucuuccugcugucagaucagugacagcauuagauucucauaggagcacaaacccuauugugaacugcacaugcaagggaucuagguuguguacuccuuaugagaaucuaaugucugaugaucugucacugucucccaucauccccagaugggaccaucuaguugcaggaaaaccagcucagggcccccacugauuguacauuauggugaguuguauaacuauuucauuauauguuacaguguaauaacaauagaaauaaaguguacaagaaauguaauguacuugaaucaucccaaaaccaucccuccacccacccguccccccauccccccauccccaguccauggaaaaauugucuuccaugaaacuggucccugaugccaagaagguugggaaucgcugcuuuaaacuacauaaauauauaaccuuggcuuccacccguaauccagcacuuugggaggcuaaggcaggaggauagcuugagcccccaggaguuugagaccagccugggugauauaguaagaccucgucucuauaaaaaauuacagaaauuagcaaagugugguggcacacaccuuuagucccagcugcugggguggcugaggcaggaggaggagcacuugagccuaggaagugguggcaagauuguaccacugcacuccagccugggcaacagagugagacccugucucaaaauaaauaaauaaauuacacacacacacacacacacacacauauaaaaccuugauaaaaagugaaaaccaguuuuaaaauauaggaacaugaaauuuaucucuuaauucaauuuaauaauuucaaagccuucuaaaauuuuauuuacauuuuuaagagacucauuauuacuaaaauauucaaacaucuaaaaguagaugaggucaggaguuugagaccagccuggccaacauggcgaaacccugucucuaccaaaaguacaacaauuagccaggugugguggcagguaccuguaaucccagcuacucuggaggcugaggcaggagaauugccugaaccugggagguggaggcugcagugaguugagaucgugcacuguacuccagucugggugacagcgcgagacuccgucucaaaaaaaauuaaauuaaauuacauuaaaauauaaaaauaaaaguagaggaaauaguauaaugaaccccaguguccccaucuuucacuuuuauaguuaacacauuuugcuaaauuuacuuaucccugucaacuuaaaaaaaaaaacaaaaaacuccuggauuauuuuuaagugaaucucaggcucauuguauuauaaaaguuagucuuugauuauggagagacaauagauaaugaaauuguaguuacauuuaaaaagaaaagagaccuuauaguuaacaaaaucagccauaauuuuaugucaucuaaugauauacauucacguuuacccaguugucucaaaaauguuuuuuauagcugcuuuguuugaaccuggauacaaacaagauggcauguuauucauauuaauuaauauuuuaagucucauaauuuauaguagcucuucuugccuuuuaaacauuuuauuccauuuauuuauuggagaguagacugcauuuucaauuuggccaaaugcuuccuuuggguguuaguuagcuuguucuucuaucccucuuuuuuccucuaaauaguaauuaaauccagaaguuuauuuagauacaaauucaauucuuuggcaguuguacuuaaaagauuaugguagaagcuacuauaucuugaaguuucugugggcaggaauuugggagaaucuuggcuuggcaguuuugguuuggggucucucauaagauugcagugagauguuagcuaggguugucguuagaaggcuugacugggguuagagaauccacuuccaagauggcuccccucacauggcuagcaaguuguucucuugaugggaggucucacuuauucuuuacaugggccuuccacaaaguugcuuaaauauccugacagccuugguggcuggcuucucccagguugaaugaucuaaaaaaguaagguagacgcugcauugucuuuaugaccuagacuuggaagucacaucauucacucuccaauauucuguuggucacacagaccguccuugaaucacuguggcguggcauggaugccagauagugaggaucauuuaggaccauuuuggaggcuugcuacuguagaugauuucaguuucaauuucagaguacaggauuuauacaucuuugaccuuaucuuucuuguaaacuaaaagcccugguuccuaaaauauuaacauagcuugcuuuguucuaccauauacauguaauaauuucaaaguaacaaugcugauauuaauuacuaaaaagacuacugaaugcaguuuaagauuucuuagugauucuuuuuguccuuaaaauauaccccccagcuguauauagucaguauacucuauuguagacaguuuaugcaaccaauuugauaaacauaaauccaccuaaauguggauauguuuccaguuuuuuagggauugcuuuuuuucccuuuuugauuuaauaauguauuuuaauuauauaaaacauuuacuugguuucaaacucuaaacuauaaaacagguacauucagaauagugucacuuccauucuucuuuuucuuguucucucccuuacccauggguaacuauuuuaaauguuuguuucauccuccaauguuucuuuuguacauauucacauuccuuuuuuuauauauaaaaaaagguagcaauguuguaagugcucugcuguaccuuuuucuuuucauuuaaccauauaugcugaaguuuacuccauguuaguagacaaaaaucauuuuguuaguagacaaaaaucacgcauugcuuagaggcacugcacuguguggguaugcuauaguuuauucagcuaguuuccuaaugauagauauuuucauuguguaaauaaugcugcauugaauagcccuaugcauacaucauuuuguauuuuggccagugaauuuuugguacaaguuccuagaauugggauuguuaagucaaagggaaauacugaaugugauuuagcuagauauugccaaauuucucuucagagggcuuuuuuuuguguuauuucuacuaccaauguaugaaaguguuucuuacagcuuugucaguagacucuggaguucuacuuuuagauuuuugucaauuuaguaucuuggucaaguuuuaguuugggaaauuaauuaauuuauauuuauuuugagacggaguuucgcucuuguugcccaggcuggagugcaauggcaugaucuuggcuuaccgcagccucugccuccuggguucaagcgauucucuugucucagccucccaaguaguugggauuacagucaugcaccaccaugccuggcuaauuuuauauuuuuagcagaaacgggguuucuucguguuaguuagucuggucucgaucgcccgaccucaggugaucugcccaccucagcgucccaaagugcugggauuauaggcgugagccacugugccuggccacaaauuuuuauugugagcaagauuaagcuacuuugcauucacuuaggggcgcuucgcucuuuuuucggaugagcuaauugucucucuuucucacuuuuuuguaaggucguugaucuuuucucccccuaauuuagaguuuuuaacuuugcauucacuuaggggcacuuugcucuuuuuucggaugagcuaauugucucuuuuucucacuuucuguaaggucguugaucuuuuuucccccuaauuuagagaguuuuuauuuuauuuauauauacagauagagagagagagagugucuugcuuuguugcccaggcuggagugcaggagugcaguggcacgauugugacucacugcaaccuccgccuccuggcuuaagugauucuccugcuucagccucccaaguagccaggauuacaggugcccacgaccaugcccggcuaauuuuuuuuuuuuuuuuuuuuuuugcgacagagugucgcccaggcgggaaugcaguggcaggaucucagcucacugcaaccuccacuuccugcauucaagugauucucaugccucagccuccugaauagcugggauuauaggcaugaaccaccaugcccggcuaauuuuuguauuuuuaguagagagagaguuucaccauguuggccaggcuggucucgaacuccugaccucaagugauccaccugccucagccucccaaaguacugggauuacaggcgugagccaccgugccuggacuguaguugauacuaauaaucacucugcaguguaaguugcagcuaauuuuuuuccagguugcuauauucuuuuaauuuugcuugugguauuuuuagccaugcagaggauuuuuauuuuuacauagucguauuugucauauuuauuauuucuugguauaaauuauuucuugauuccuaguuggaacuuuuuuucuacucuuagguuauuaaggaauucuguguuuuuuuaaaaguacuuuuauaguucuuuaaaaaaauuuagauaacugauucauuugcuuuuuuuuuuuuuuugagauugaguuuugcucauguuguucauccaggauggauugcaauggcacaaucucagcucacugcaaccucugucucccagauucaagcgauucuccugccucugccuccccaguagcugggauuacaggcacccaccaccacaccuggcuaauuuuuuguaauuuuguagauucauuugcuuuuuaugcugguguauagugugagagacagacaaguuuuaucuuuuucuggcuauucaguuaucccaauaccaccaauuaaaaaguccaucuuuuccacacugaauugauaugccaucuuuaucauauaguaaagguccauauguauguggauauauuucugaauuuucuguuuuauuucauguuuauuuaccaguaucacacuuuuuaacgauggaaauguauacugguuuaauaucugauaguguguacacauacccccuuucucuuucagguguuacuuugcuauucuuaauuauuuuucuacguggauauacauuacagaaaaacaaccaauaaguauugugaaaaauugggcugugucuaauuuauaaacuaacauagggauaauuaacaucuuuaucauguuuagcccugcuauccauuugcucauguguacuuuucugucuuguaagaguguuuauaguuuaaaggauuucucacauuucuuaugugagcuuuuuaaauuuaauuaauugauuagcuauuacuaauggggucuuccauuuuauauuuuaacuggugguugauguuagugacuauuauauguaauauucuacuuuuuuaaccuguuuaacuguaauaauuuuuuuguugucauugaguguuuauggcucuccggaggccaaaaacuuguuaucugcauuuaaagauaguuuuagcuuuccuaugucaauucuuaaaucucgaauuaagugcuguuuaauggaaauagaaugugagccauugcauuuuaauuuaaaaucaucugguaacuucauuuuaaaaaaagaaagguugaaauuaauaacguauuuaacccaggcacaguggcucgugccuguaaucccagcucuuugaggggcugagguggguggaucaccugagguuaggaguucaagaccagccuggccaacauugugaaaccccaucucuacuaaaaauacaaaaauuagccaggagugguggugcacaccaguaaucccagcugcuugggaggcugaggcaugagaaucacuugaacccaggaggcggagguugcagugagccaagaucgugccacugcacuccagccugggcaacagagugagacucugucucaaaaaaaccaacuaaacaaauaauacauuuaacccaauguaucuaauagauuauuucaguauguaaucaagaccacaaauuauugagauauuuuauauucuuuuauuuuguacugucuucaaaauucaguauguguuuugcacucauagcauuuuuauuuuuaauuuuuuucuauauacuuuuaauaauucucaaagucauaccagaacucguagcauuuuuuaacuagccacauuucaagagcucauuagccacauguggcuaguggcuaguagcuacuguauuggaccaugcaacucuuaaugcugucuuuuaucuuucuguguuacauaaugccaccaauauaauguuaaauaacagcagagauagcgguauguguauauuugauaacugacuuccuuuuacucagcaugcucaguacauuuccacaucaauaauuacaucucuacaacauuuuucaaaguuacauggaguggcauaagauauaccagaagaacuuuuuugacauauuguuuuguuuuuaaguguuuuauuauuacauugcuuuagugaucaugcuuacagcuaaaucuuugcagucuugccacgugaaagaguaugcaauuuaaaaguguuauacaguugcuuugauuuguauauuuuguuuaguaaugagauuaaauauuuuucguguguuuuuuggacauaggcauucuuuugcauauugacaguucauuugauuucuuauuuucuguugugggauugguauuuuuuuguauugauucuuuuuuuguuguuguaguuguuugagaucuuggucugucucccaggcuggcgcgaucucggcucacugcaaccuccgccucucggguucaagugauucuccucgucagccucccgaguagcugggauuacaggcuuguaccaccaagcccagcuaauuuuuuuguauuuuuaguagagacgggguuucaccauguuggccaggcuggucucgaacuccugagcugaagugauccgcccaccucggccucccaaagugcugggauaacagucgugagccaccacacccagccguuuuuguauugauuuguaagaucucauuuuauauuaaggauauuaaucuaguauauguuauagauacuucuccaguuuguccuuuucuuuucuuucuuuuuuuuuuuuuuuuuuuuuugacaggguucacucuaucacccgggcuggagugcaguggcgcaaucacagcuaacugcaaccuugaccucccaggcuuaggugauccucccaccucagccucccaaguagcugggauuacaggcaugugccccacauccagcuguuuuuuuuguauuuuagcagagacgggguuuuaccauguuguccaggcuagucucaaaacuuacggccucaagcgauccacccaccucggccuccgaaaguguugggauuacaggugugagccaccgugcuccagcccuccuuuuuuuuuuuuugagacugggucugucuccuucugucacccaggcuggaaugcaguggcccugcagccacagucuccaaacucuggggcucaaguaguccuccugccucagccccccaaguagcuagaauuacaggugugcacuaccacaccuggcuaauuuuuaaauuucuguagagacaggaucucuccaugucgccccaggcuagucucaaaccccuggccucaagcaguccucucgccccgaucucccaaagugcuuggauuacuggcgugagcuaccaugcgcagccaucauuugccuuuuaucucucuuccauauuguuuccuuaggcaguacuucuacauuuucauuuaaugaauugaaaucuguuggcuuuuuauugcauuuuucuuugauguaacuguccaccuccuugugggauuauacauuugucaaaacacuauuuuaucuauucuuucuucacugacuuaaauuggcuauuuuuauaauuauuagauauauaacugggauuuguuuucugguguguauuauuuccacuguucugucagucccuaugguaugacacaggucagauuaauuucuaguagggcaaguguuuauuuucagaaauguuuuggcuaguacucugguuuguuuucuucaaggauaauuuuagaauuauuuugucaaguuaagucuccucgcuccuggugacaaaagagaaaaaccauugguccuuuuauugaaauugcuuuaaaauacagaguuuuauaugugcgugguaccucaaaccuguaaucugccacuuugggagccaaggugggaggaucucuugagucggggaauucaagacuaaccuggguaacauagagagaccccaucucuaccagaaauaaaacaaacagaaaaauuagccagaugugguggugggagcccaugaccccaacuauacuuggaaggcugagguaggaagaucacuugagcucagaggucagggauauagugaguugugauggugccacuguacuccagucugggugacagagugagugagacccugucucaaaaaaaaaaaagaaaagaaaaauacagaguuuuacaauuugguguuuauuaaugaauuuuguauaauuuuuuuuuuuuuuuugagauggaaucuugcucuguugcacaggcuggagugcaguggcaccaccucggcucacugcaaccuccaccucccugguucaagugauucuucugccucagccucuggagcagcugggauuacaggugcacgccaccaugccuggcuaguuuuuguauuuuuaguagagaugggguuucacuauguuggccaggcuggucucuaacuccugaccucaggugauccgcccacuuuggccucucaaagugcugggauuauaggugugagccaccacgccuggcucaguuuuguauaauucuuguuaaaguuuaguccuggucauuaguaguaauuuuuuucuauugugaagucauuuaaauuuuauuuucuagugaauuguuucuucauauaugaagucuuuugcuuuuuuuuuuuucuucuuugagacaaagucuggcucuguugcccaggcuggaguacaguggcucaaucucagcuuacugcaaccucugccuccugggcucaagccauccuccuacuucagucccccgaguagcugggauuaagauaacacaccaccacgccaggcuaauuuuuguaguuuuuguagagacaggguuucgacauguugcccaggcugguuucauguuccugaccucagaugauccaccugccucagccucccaaagugcugggauuauaggcaugagccacagcgcccggcugucuuuugcuuuuugaguauugauuuuucuuuuuuugagacggagucucgcucugucacccaggcuagagugcaguagcgugaucucggcucacugcaagcucugccucccggguucaugccauucuccugccucagccucccgaguagcuggaacuacaggcauccaccaccaugccaggcuaauuuuuuguauauuuauuagagacgggguuucacugugucaaccaggauggucuugaucuccugaccucaugauccgcccaccuuggccucccaaagcccugggauuacaggcaugagccacuggcaauuuuuguuuuuaaucucauacauaauaucuagccuuuccuauuaaauaugacauugguuguugguuucagggagguaccauaauaaacuuuuaagaaagacuccuucuguugcaaguuuaccgagaguucuuugcucuguuuuaaaaauuaggaacuuaucugaaccaaguucagaugcuuuuuuugucuucguguuaguuuuucugcuuuucacaaauguaaugaauuauauuucucauucaguuuguguguaaguuucuuuuaggauuucuaaaucucucguaaguacguuuguauaguuugugugugugugcuaugugcuauuuuagguuuugguagcaggacuaagcuguuuuuuauaaaauaaaguuguaauuucaaauuauauuguuuuuccucaaauucuugcuuuuagguacucuggagcuguauaaacagaauuaaauuacauguuuauugaggcauuuagaagucgccuaacaucuuucuuggccuguacucuuuuuuuuuuuuuuuuuaauuaaaagcaguucuuuuaccaacuuuuaauuuuuugauaaacuauauugacuuuauucagcuucuaagagacaauuugacgucuaaaacauuaaucacaccuagaaacuauacaauauggagaacagcagggugauuuuuuuuuuuuuuaaaaucauaacuguuuuuuugcggggagaagaaaauagauuagauguuuuccuugggauuuauuuauuaauauuauuaaguccagagagaaagaugaauguuauuaaaguaacaaaguaacacuucuuuucaaggauuaauucuuccucuaccagccuuuuauuguuaaaaauugugaauuuauggaaagguuguaggaauaaguuucuaauguauuaauuauucucauucuuaggugcauuuuaucugguguuugaauauauggaccaugaucugaugggacuacuggaaucaggcuugguucauuuuaaugaaaaucacauaaagucauuuaugagacagcucauggagggucuggauuauugucauaagaagaacuuuuugcauagagauauuaaauguuccaauauccuucuaaauaauagguauggguaugaacuuuauauauauuuaaaaugaguuuuaccauggacauguacauggagagaauagacuggaaaccguagcggcggggaaugucggggguggugagcguugaaaguuaccuauuagguacaguguccaacguuugggugauggguaccccagaagccuaaccccuacuauuacacuuguaauacccaugucaccaacaaacacauauacccccgaaucuaaaauuuuuaaaauaaagauacgguguuacaugauguugcaccuugauuauguuaaaaaagauuuaaaauuuaguuuacuuuauacaaacuauguaaaaauaaucaggccagccacaguggcucacgccuguaaucccagcaccuugagaaguagagacgggcggaucacuugagaccaggaguucaugaccagccuggccaacguugaugaaacccugucucuaccaaaaaaauagaaaaguuagccuagcgugguggagcaugccugugaugccagcuacacaggaggcugaggcaugagaauugcuugaaucuaggagguggagguugcagugagcugagaucaugccacuguacuccagccuaggugacacagcgagacucuggcucaaaaauaaaaauaaaaauaaucaacaauauuauaacuugggauaccucaaaaguuguguuacauagcuguuaguggccggguggggcagcucagccuguaaucccaacacuuugggaggaugaggcagauggaucacuugaggccaggaguucaagaccagccuggccaacauggugaaacccugucucuacuaaaaauacaaaaauaaacccggugugguggcacacacccguaaucccagcugcuagaaagccugaggaacgagaaucgcuugaaucccagaaguggaguugaguggagucagugagcugagauagugccacugcacuccagccugggugacaaagcaagcaagacucggucucaaaaaaaaaaaaaaaaaaaaaaaucuaauaauagucuguaaugcauauaaaauaauacuuaguugacuuuucuguuugcuauuauuccaaguaaugugaauggaucaucugauaagcaauguaacuucagcuuuagguuaagaauagauuuuagaaaauuuuaaaaaagcagucacaguuguaaagugaacuucuuggaaguguguacacacacauacacauucacauauuuaaaacuuauguaaauaagcuuagauuuguaacaucuuauauuugaacccugauaauucucuuguaauugguacuguuuguuaauuuaaauaaggcauggcugguucucauuuuaauuaauagacaguguucuaugcaccuagccccucuaaaacuggagaauuaaacaaauuaaaagugaugucacuucguucuugagcacuguuaccuugaacaagaaauuugucuuacugcuaaguaauaaaaaggaucucauuuuauuuucauugaaguaugcuuuucuaaauaggaacugaauaguaauaaaauacuauucuaauauuauaauacaguaauuauaauaaucauauuacuauaauaauuuuaagacuauccaaggauaguuuacuuucuuguuuugugaauuuauccacuacuugccuuucccuguauuaccuugaugauauugcagugugagcagaguuaaaguuuacauagguuuuuuuuuuuuaaucaguucuaggcauagaauauaaauguguauugucaauuaagaguaaauuaauaccuuuuguucauuuugucuuauuuccaccagagggcagauaaaacuugcagacuuuggacuugcucgauuguauagcucagaagaaagguaagcauaccuucaaaugaauauuguagauacuagaguuuaguauuagaagcuauacuaagaauaccuuauugauaguuuuauuuuuuaaaagagaaguuuacuuuucaugguuaguacauaaaacauugaaauuuuauaccauauuggguugauuauuguaauuacaauauuuuauacauuaucucaauuuaaaaauugaucuucaacagguaaaaaugauuuuuuuaaaugaacaucuuuaaguguaacugaagugaacuuaaauuucuaauacguauucagauauuaaauauucuuaaugaaaaccuuuuaaauugcauuuuuaaacuuauaaacuuugguuucauuauuauuuuagacagauuuuauuguuauaucuacaguucuuuguuuuuuuaacucccuagaacccuuuauuuaaaccaacuguugggaggauguucacuguauaagacacaaaaauguagaacuuuucuggcuaaaguuggauuauauacccaacuuggcuuucuuugugccuggugguagugaaauaugauuugucuuauuaaaacuaauaugggauuucaaaauaaaauauuuuugugcaauaguagguuuuauguaaauaaaauacggaauuaauuuggcuuaauaaaucuuuaguccauuuaccccauuccuuuuuugucuuuauuuccauauguguauauauauaucugaaauaauauaguuaaagaauuuuaaaauuauuuuaugacaauuuugucauuucuuuaauaucaccauaauuuaauauaaugaaacaucaguugauugcagucuuaggaauagauguuuacuuucauuuaaucuuugcuuuuuuugguuaaagcaauaaacaaaaacucucguuugaauuuuucagaguaaaaagucuuauuuuguuaaaucuugcagcgccugugacauaauucuggaaaguauuuuccuuauauaguguucuagaguagagguuuauaagugauauguuuuggaucuauucaaguuccaugaaaccccucagaaagugugcagugggccaggcgcaguggcucaugcuuguacaaaucccagcacuuugggaggcagaggcaggcggaucacuugagggucagcacuuggagaccagccuggccaacauggugaaaccccaucucuacuaaaaauagcugggcuugguggugcacgccuauaaucccagcuacuugggaggcugaggcacaagaaucacuuaaaccugggaggcggagguugcagugagccgagaucacaccacuguacuccagcaagacugucuccaaaaaaaaaaaaaaaaaaaaaaaaaaaggaagggaggagagagggaaggaggaaggaaggaaagagagacagagagagagaaaggaaagaaaguguucuguggaugggguuuugugauuggaccuccaguccucuguaccaacuuucaccagaguuacuugguuuuuauuuguuuuaacuacuacacuuaaaauuaacauuuuauuuuaggaaaggguuguaugaguguuuuuuuuuuuuugaaguuuaaaacuguuuuaaagcucaaaagcuaugucccucauuuugcauuugagcgaauugagacccagaaagggcugaguuaguuuccuuuuuuaauuuugaaauauguauacauugugaaauggcuacauugagcuaauuacuaugcauuaccccacauuuuuuuugugugugccaacacuuaaaaaucuacucucaacaauuuucaagaauacauuguuauuaaguguagcugccaaguuguacaauaaaucucuugaauuuacuuuugucuaacugaacuuuuauauccuuaggccagcaucuuccccccauacucccuaugccccguaucugguaacuaccagcucuacucucuaccucuaugaguugagguuuuuuagauuucacguauaagugaaaugaugaguuauuugucuuuaugugccugccuuauuccacuuaacacaaugcgcuucacguucauccauguugucauaaaugacaggauuuccuuguuuuuuaaagacuugaauaguauuucauugugcguauaugccacauuuuccuuuuuuuguuuuguuuuguuuuuuuuugagacagagucucacucugucgcccaggcuggagugcaguggugcaaucucagcucacuacagccuccaccuccgggguccaagugauucuccugccucagccuaccgauagcugggauuacaggccacauuuucuuuauccguccaucucuuaguggacgcuuaacguugauucccuauccuggcuauugugaaggguugagugacuuuaaagaucaaaaaauguuagcagagccaaggguguauaguuaaguuuucaauucgcaauuuuuuauucuuucugucauauauaauagugccucuugguagaaguugaaaggaaaaauuggucugaacuguacuuaauccaaaacuuaacuugaaguauauuuuuuucuucugcuguuuaagaagcauauguauuuuauuuuauuugagacagucucacucugucgccuaggcuggagugcaguggcgugaucucagcucacugcaaccuccgccucccggguucuagcgauucuccagcuucagccuuccgaguagcugggacugcagaugugcaccaccaugcccagcuaauuuuuguauuuuuuaguagagacaggauuucgccauguuggccaggcuggucucgaacucgugaccacaagugaucugccugccuuggccucccaaagugcugggauuauaggcaugagccaccaugcccagcugagaagcauauauaugacuaaauuaauguggcuauuauuuugggcaaguucugguuaauuaagaauucuaucugcuaagcugguugagauuucacuguaguuagauuuugcuuaauauaaguuugugucuguuguuaauuauguaaauccuuuccuauggaauggaaaacagcuaauuaccauuuuaaucuaauagauucuuguuaugcagauauuugugcacauuuggaauagauauguuucagaaaagcugauuauaaagccaaauuuuauauuaugaggcuuaauuuucccauugauuuucauuuuaaaauauaauuuggguuccauuggagugccggggugugguguguucacugggccauggucccuguugcccugcuggauugauguagaaauuuugaguuuagagaaccagaguuuuaaagucccauaacuuugcaucuucagguaauguauacugaauuuuucugcucaguuaaauguauaagaggaaaauucagucugucauuuuguuuuaagagcaaauauccuaucauuaugggguuuauauacuccuuuaaaacuucucuuuuuuuuuuuuaagagaauaauucugauuucuucagaaucuccuggagagguaguauuaauauaauggaauaccuuuaaaauacauauguugcucuagugaaccuuaauaacugugauuuuaaaagaaaucuaccuuuaacagauuuauuguauugucucaaauuuucuagauauuuuuugagauaaauauguaacaaaugauuuuucauucauauuucugcuucauuauaaacagagagccagguagggccuuacuguaauacucaugcaaguauaaagucacuuugaaguguuuuuauuuucuaaguaguuaauauagaucgaauaacugaauuguucaagaauuuuguguaagguuuuuuguuuguaaauagagcaguuuucagcuuacaacuguaauagcaucaaccacagcucucauuagauuuuggauguuccuuuuuugaauuugaggaaagcuggguggaguuacagcuaguacuugggggucugugaccaauguggaucugcucuucaugugccuauugaagaaagaaagagaaccacuggauuaaaauuagaggggaaaaugauuucuuaaauuucagucauuuucucauuuugaacauugggauuuauacuuugucccauucugcauugggaauuuuaaaacuugagaauagagauuuuugccccauuucuucauuaacuguucaucuuuuaguauaugguuuuuuaaguauaguuuuucugacagcuacaauguuucccucuucuuaguuuuuauuuuaccaagucauugcuccagugguuuucaaaaggauggaguaucuuucucucuuuaugugaccguccuguaugaaaaaaaguuuuccauauuaauugaaacuagccucauuuucuagagaagaaacuauaaugugacacuuuauuuguuuauuuauauuuaugagacggagucucacucugucacucaagcugcagugcacuggugugaucucggcucacugcaaccuccgccuccuagguuuaagcgauucuccugccucagccuccugaguagaugggauuacaggcaccugccaccacgcccagcuaauuuuuguguuuuuaguagagacgggguuucaccauguuggccaggcuggccucgaacuccugaccucaagugaucuacccaccucugccucccaaagugcuaggauuacaggugugagccacugugcccagcccugaaaaacguaucuuuaauaauauuacuaugaucaaaaugaaaguuuuuuaaacaauaaccagaaagcauacuacauuuccauaugaugauccaguaaggagagagaagggaaaaaugaaaagggccuuagagcauuagcucacuaauaccacccucccaaaacgcacacaccuuuuugaaggcaguaucgccaucuaguggcuuuucagaacauuguuauugaaagcaaaacuaaauuuuccuaaaguugaagguauuaaugagagaggaagauaguauuaccauauuuuauucuuuuguguuuuauguucccuaaaacauugacugcauucaugauaagugcuugguugaugcugaucugggagaaggugaucuucaucuggaggauccuccugaugcagaugagugcagggagcuuuggggauucuagguaaugaaaaggaucuucugagaaucacuagacaagauuggaaccaugguaauaaaaaaauuacuaauaacagaugaaugacaauaaauaauaugauuaaacaagcuucaggaaaggagaucucauuuagaucauugacuuuuaacuguaagaucaagauuaaauuguucucccuucaacucuaauggaguagucuucauuuuugagcauauaaaguggaaagaauuccccccuccuucuguuggggguauaucauccgagacauuacugcugaauacuuacaaaacugaauuccaauccuugaucuuucuucuggucuccagaccuuuuguuuauuggaaaucucuacccaggugauuuggguacccuaaauuaaaccuuguuacaaaaccuaucuauuucauuccccagaaaaaugucuacuccuuuuccuuuauuucccguuuuaguuaaagguuuccagucaccucauauaggccauuguaaauagaauuguauugguuuuucuguccucuggucuuucucccuuauggucuucucuucugccauuccagccccccugauaauagcaauguugaacuauuuguaguucccuaaacuugcugugcucuugaaugccuuugugaaucuacauaagcuguuucuuuuguauguaauuauacuucucaccugaguuugacaaauuuuuuuuuucuuucagugugcaauucaggcccuaccgccuuugaaaucuguccugaaucccacaggcaucauugggcacaucuucuuuuauguguuuagaguauauuauucauucuauguauuauuuauaguacaugauuauaauuuauauuaccaccauuuuucuuuuuuuuuuuuaagaaaaagaagggaaaaggaaagaacaaacuuaacuaacguuuguguacaucacuuuauuauacauaguuuccuuucacaagaauuauuuuaaaagaaaguugagauggaugauguagguaucauucuuauguacauuuuaaaguuacagaaguuuagaaaauuuaagugcauuugcaagaucacacaaccaauaaguaguagagcucaggaucuuuugacagaaagauuauuuucauuauaugggagugcuucucugguaagacucugaauucagccuugauuaccuagaaguaucuuccagguagagaacucuaggggccucucaagucugcuuuagagguaccauuaggcugauggcaauuuuuagaguucuuuuuuaguaaagggucugcugaauuuugcuuuuugucuuugcauccuccaaauauauuuuugacaaaugaguuaugcuguagguuuaaucuuccagcagauuaggaaguuaugugauauuucuacuuuugaaucucccuuugucauauuggauuuaauuauauuuuaagcaguuugaaagcucuugaaauaucuaaugagaaaucuauaaacaaaaaauauuuugauagcaacaaauauuuaaaauuaccuguaauuuuucccaugaaaguuauauuaaagucugaugacuuuuuuuuuuuugagauggaguuucgcucuugucucccaagcuggagugcaauggcgcagucucggcucaacccaaccucugucuccugaguucaagcgauucuccugccucagucucccaaguagcugggauuacaggcaccugccaccacacccagcgaauuuuuguaauuuuaguagagaugggauuucacuguguuguccaggcuggucuugaacuccugaccucaggugauccacccaccuuggccuuccaaagugcugggauuacaggggucagccacggcaccuggccugacuuuaaauuuuaauacuugguuaaucacuuaagguuuaaggaaaaacaaaagaauuguuugauuuuguuuucuaauguguuacuuuccuggcagacaaagaaauagugucugccuucuuuuaaaaaauauuaaugagauuuacaaaugaaaguauuuagcagaaggacuggccuuggugucucuugccuguaauccuagcacuuuggaaggccaagauguggagauuacuugagccuagaaguucgaguccagccugggcaacauagugagaucucuauuuuaaaaaaaguagaaauugaaaugcacaauaguuaacguugagaccauuauuuuugggucuuuacaaaguuuaguuucuugccauccaauaacaacuuauugaaguuacuaaauuuuguuuuccaauuuaauggcagaaggacuguguguguguguguguguguguguguguguguguguguguuuuccuggguuauugaguuuauugcuuggaauugaucuaauuauguaaaguggagugguucauuucauuuuuagauuuuucuuuuuuguauguacacauuuauuugauaacaucuaagaagucgacuauauguuuuucaguccuguuucuuuuucauugugaguuaauuugcuuuuugugcaaauacuggguauagacacaccacaagaauguaauuuguuuuuuaauccaugaaagaaaaaagcaucguauauguagugucacaucaguuugcuucuucuuugugugaucuaaacaagaucaucucuacgauguugacaguugguagccaaaucuaauagcgcaaguuugaaauucauuuuugaggauucuggauuuuuuuuuuuuuuuuuuuugagacagagucuuucuugcucugucaaccaggcuggggugcaguggugucaucuagguucacugcaaccucugccuccuggguucaagcaauucucaugccucagccuucucagcagcugggauuacaggcaugcaccgugauaccuggcuaauuuguuuuguauuuuuaguagaggugggguuucaccauguuggccaggcugguuccgaacuccugggcucaagcaauccuuaggccucugccucucaaagugcugggauuacaggcaugagccaccacgcccggauggauuuucuuuuauuugucugucuuuggauaauguauuuucauauuacaacgugcuuuaauuuuccugggcuuuaaauuuccuggaaccaaaacauaguuucagucucuuuuacuuuugucuuuacauuuguaaacgguuaacgggauuuaauauuagcauccuaaucguaacguggauuuuuguuugauaguauacuauauuacugaauugggugauaccugaaauuguccuuauucucuucugacuccaccuacguuggaacuugcuuuuaugauuaaauacuucugucugcacacuuucucaauauuugcuucuuuuucauuagagagguagaaagugaggcaugguaccuauuaugcaaaauuuuugaguaaaucagguguuuuuccuuguccuuaguaacggucauuuucauuugucuuuugucauuguuaccuuuuaaaagcuuuuuaaaaaauaguuuauuaaaaauauuuaaaauacaauuaaaguaccacuaacuucuuuaaaguuuucuugccagcucuguucucucccuggcuuuauccccuuucucuggaaaaugaacauuugcucacccgccucagggaacugaagguuuagugugauuggaacaaaaaccaaaugauaauggauuuuauaggccuuguguagguauucucuagauggaagcaauguguacuauagccauaacauauucauguuucauuucacgcuaucacuuugacugcacuuuggaaagugguuuggccuuauacgucuggaagcaagaacaaucacuuaagaaagcuguugcaguaaaucuaaauaggaugacuauagcuagaaccaaggaaugggcacagguaguggaaagacagauuaauuauaucauaaggauguagacuuguuagaccuugaugguugaauguguugugagauacaucccugccuccacccccuacuguaagguuucugcuuaagcaacuggaugaaugauuuguugguuaggauagucuaaacuuuuguaacaaagagaaccacaaaaguuaguggcuuaaagaaugagaaguuuauauauguauuucucacuuaauaaucuugagugguggcugggcgugguggcucacgccuguaaucccagcacuuugggaggccaaggcagauggaucaccugaggucaggaguucaagaccagccuggccaauauggugaaaccgcaucucuacuaaaacuacaaaaauuagcugugugugguggcagaugccuguaaucccagcuacuugggaggcugaggcaggagaaucgcuugaacccaggagguggagguugcagugagccgagaucacgccacugcacuccagccuaggugacaagagcaaaacugucucaaaagaaaaaaaaaauuuugagcaguuguugcuuaccccugugcacaauuaagauuauuuaaccauaccaccaagucaaauggugacugcuucaauacagcuauucagagaagaagacuggaagaucugucaucuucuacacaugccuuccaaugcuggugccagaggugagaaaagaggagggaggagaguaaugagccaggccuagaaauggcacuuaucacacgugcuuauguuccacuggagagcacuuggucauguggccacaccuaacugcagugaggaugggaaauguagcagagcuggacagcugccauagaagggaggaguaacagauuuuuagagggcagcuaugaguaucugccacgaauggugaggcuguuugcugagacaguaaagaagaacagagaugcauuuuuuagcaaaagguaauaauguagguacuuauaggacuucuaaauuugcuuguguaauaagaaugggcaaguaagacagcugaucuuagaugacagcaucaguugggaaaaaauugguuuuguuucucuauagcacugugaugauagaggaauuuaaaaguuauuuuucuuggaagauaucaaaaggagaaaaacaggaguucaaauagggggaaagaacaugagagaaaagauuguguuuauuguuauguaguuauguuauaugaaaguauuaauaaguuaggcaaugcauauguagggugaggaauuuaaaauagcugagugcuacaaagcaaauaaaauaacgacuauagugucaaaguaggggugguaguggauaauuggguaauuuucguuaggggaguuaagauaggccucuuuuaggaaguaaauuggagcuaagaccagagugaugagaaagggaaaacuuaaugaagaccugggccaagaacauuccaaguacaaaggagaaggaacucaguacggccugagaacagacuugggagguuuaaggucaaagguugcccaguguaauaggagguaagauccuugcuguacagucuuaucaacugaaguaaaguuuaaauuuuauuugauugcagugggaaaucacugggcaguuuuaagcaagcaguugauaccugguuuuaugcuuaauaaaaaaacugaaaagaaguuaaggguagcugggcaugguggugcaugccuguaauccaagcuacuccagaggcaggagaauugcuugaauccaggaggcagagguugcagugagccaagauugcaccacugaauuccauucagggcaacagagcgagacucugucucaaaaaaaauaaauaaaauaauaaaaacaaaaacgggcagggcgggcgggggggugcaauuagagauggaagccaggaaaccaguuaagauauuguuguggucauaccagugaaaagaauaauggcuuggacuagguauuuggauuggggaucuauuuuggauguagaauuggcagaaguuguuuggaaauuugagggaaagaugaaucaagaaugacacuuggauuuuugacauuaaaagcuggguagguguuagaaaauagaucccagauuucuuuuguagguuugauagauuuuucugcaauggauugugaaugucuuaaagaugacauggcauuuuguguauaugaugaauuuaguuuacugaagacucucuuugucucaaaacaguaugaauuauaguauaaaagaaguacauggggggguugccuucaagcaggaagaaagaaguacagacuuuaucauauguuguuggaaaaaugaaacauuuuagagcugguuuagguauuucauuuuauaugauuuuuuucacuuagaauggucuuuaacaaaggcagcaacccugcuuuauaaauuuuaacugagauuaucuagaacccccaaauacuucaaggaucuaggauuuuguucuguuuuucuauauauaucuagaccaguaggagguggaaaacgugccagccaaggggcacacuccuuaucacacugcuugguuuguuguggauacggugcagcuuaucaggccuuaagguagggaaggccauaaccguaucucaucuucccugcccuccaucucuggaauuccugggauugcuuuuuguuuuuuguuuuguuuuguuuuguuuuuugagacagagucucgcucugucacccgggcuggagugcaguggcacgaugucagcucacugcaaccucugccuccaggguuuaagcaauucucugccucagccucccaauuagcugggauuacagaugcaugccaccacgccuggcuaauuuuuguauuuucgguagagauggaguuuuaccaucuuggccaggcuggucuugaaugccugaccucgugauccacccaccucggccucccaaagugcugggauuacaggcaugagccacugcacccagccuucuugggauuguucagaggcaaaguauuggaaucuaucaaugaacagauagucuuugaucucuacuccguugacacuuccuugaauguaaaaauaauuuuuagagugugguacuuuuuguuuuauaaaaaguauguaucagucugaauguuuguuugcuucauaaaucaaaacauuuccauauuuuugaaauuacaucaguguuuuaaaauucaacuuccuagauuaaauuuuacaguugaauguuuugucucaguauuuugccuaguucuuauuucuugucuaacagaaacuaagcauuuggaaaggccauuaauuaguacacguuaaauauuuuucuguacaguuagaaauauauuucaugugguuuuguguuuauuuuugaaaauuuacuauuuucacgucugaauuaauaaaacauuauagcaauuaauaaaaaguauauucuaguuugcuaaggugacugcuaaauauugcauuagaugaugcuacauauugcuuagaauuugauauacaauauauaaaauaaucuuuuacuuauuccuuuuuagucaccugaauuuguuuaguuucucuacgauucaacauacuuuuaauuuuuaagauuuuuuaaaaaauacaagacacuaaaaauauuuuuuaaaguaaaauaaaaauuaacuauuuguagauagauuuauauaaauuuaaacauuuccuugagccuaguuauccaguugcacuuuuauaacaccauuguauagguuugauauacucauagauccuugauguguuugagaaacuaguugucauaauuuuuacaaauuuuguucuuccacccaguaaaucaugugucaucuaaaguuagagggcaauauacauuaaggugccugaccugugcccagcauuguuugggcuuugugugugggguucauaauaaagaauguuacgagguuuuuuaacuuucugggaaaauacaaaauagggaguuaagacagguaaguaugauguaaauuuaagaaugugaagauaaauauauuauuaauagagauuagacuuuaugaauaugcaucuuuuacuguguuguaaaggaaguauagcacuugaaugagaaaaauagggaaaggauuuuauuaaaaggggauaaggcagcugggcacaguggcucacgccuauaaucccagcacuuugggaggccgaggugcgcagaucaccugaggucaggaauuugagaccagccuggccaacauggcaaaacccugucucuacuaaaaguacaaaaauuagccaggagugguggcgggugccuguaaucccagcuacucaggaggcugaggcaggacaaucgcuugaacccgggaggcggagguugcagugagcugagauugcgccacuguacuccagccugggcgacaagagugagacuccagcgcaaaaaaaaaaaagggcgggggggcuaaagcauaaagaggugagcauaauuuuaaagaauuacuaaguucaguuuaacuagaguagcuaaaauuugaaagacuugcucauuaugugaagauaagugauuccaguaaacaagcaaaaaucacugagaaaaguacauuaauaauguuagaaaaaccuaaucuuaauuuacuauuaaaaauauucaucuuauucuguccucuuuucacaguuuuuaccaaagucaaauguuuuugcuagcuuuggagcacuguuaacuauaguccuaucugugguaaugcuauaaugcccaaauugauaguuuuauaaugcuagugcuuaaguuauuuggagaaauuuggcuggaugggggcagagcaggucaggcagaucuuacacugccuggaacugcaaaucuauagguggcaagagggaauugcuuucuaaauugaaugcuccauuuccuuaacaagacugguccaggaccaagccaagcuuagguaaaugggcuuggaauacagccuuucuggggaauuugcuauggcuuuugaguccuugugauuuggaaaacaucuggauauaaagagauguuuauagcugaucugaauauauaugugaucucccugaaguaaguaacuacagaucagccgaagaaccuccucugacuacuuaggauucucuucaagcgugucaaucagcuagaacgugaccauucucugagcguugaacacuuuacauugccagauaauuugugcuguuuucgucaaaccugacccuaauauaacuugacuaaauaaucuugucuguggcaaauaaagagguagcaguauauuuauguccucuuuucggaaggugauaaaggaauuauuugauaaaguacgauauguauugcuacuuugcagaguagaccucaaguagauacuugaguagacacucugcauuugugugcuuuuuucuauucacacacuacaguggguaugugaaucagugaaaaauugccaaaaauaugaucaauugaaaacuuuuguuagguggucuuuauuugaacuauaucuugucauccauuaguaauuuagcaagauuugaucagaaccagucaacgcucuuuaaaucaguuaaucccauuaaagguuuuuauggaaaggaaaaacagugcucaacaauugaguugauacuaaagcuuugcuuugaccaaauugcaguuaauaccaguaaacuacuuuuuuuuuuugagacggagucuugcucugucacccagacuggagugcagugacgcuaucuuggcucacugcaagcucugccucccggguucacaucauucuccugccucagcuuccugaguagcuggggcuaugggcacccgucaccacgccugguuaauuuuuuuuuaguacagaugggguuucaccguguuagccaggauggucucgaucuccugaccucgugaucugccagccucggccucccagagugcugggauuacaggcgugagccaccgugcccagccuaucagucaacuacuuuuuguuuuuaucuucauauauuaagggaauuuuuaguuaaacagguugcccucacauacauuuuaugaucuuauauuagauaccuuuggaugucuguauuuuuuaguaggcagaugaaaguguuuuuaguuaggauuauagggauugcuuuaguaaaauaauauuuccucagagaaucugucuuacuccaacaaauacuaacucuaaagacuguuuucuguguuuuuuagucggccguauacuaacaagguaauuacuuuaugguaccguccaccugaacugcuacugggagaagaacgauacacaccagccauugauguauggagcuguggguaagauagccuuauuuacugguuuauuuuacuugaaacuuuugguagugaauuaaaauagaucauuugguaaugacggguauuuuuuccauuagcuguauccuuggcgaacucuucacuaaaaaaccuauauuucaagcaaaucaggaacuugcacaacuagaauuaauaagguaagcugcugauuauaauauuggugggaauugggagagugucauacuccacaggaaauuuaaacucucccaaguuugucuuuucaggaagagaacaacaugguucucuggagggcuuaugacugcuaaauggaggacaaacugaaauguaggcacuuugauacuuguuccagugaaauuaaggauaucaaagccccugggugggugcauguguauguguacaugcgugcgugcaugugugcguuuuuuuaagucaaaggacuugaggcccaaaagauaagacuggcaaggaagaguaaauguaggagagaaugaaugcuagauacauauuuuuuaauuaugaaagaaaugaaaaauucauguuuugggguauuguuuaaaaauacucuuguaaauacacauaaaaauaugugucuauauauguguguauacacacuaaaauacaugcauauacccccuagcguagaccuucauuauuuggagccuaucauaggaccuaguucauaagcaauuacucauacauuuuagucgcuuuucucuuuaucuuuuauuuuauuuuauuauuuuauuuuuuugagauagagucucacucugucaccuaggcuggagugcaguggcaugaucuccacucacugcaacuucugccuccuggguucaagcaauucuccugccucagccucccgaguagcucagauuacgggugcccaccaccaugcccagcuaauuuuuguauuuguagcagagacgggguuucaccaugucggccaggcuggucuugaacuuccaaccucaggugacugccccccgccucguucucccaaagugcugugauuacaggcaugagccaccucauccagcccgucuuauauuuuaaaauaauuuuaauuuuaaaaaugggcuuuggccaggcacgguuucucacgcccguaaucccagcacuuugggaggccuagguggguggaucaccugagguugggaguuugagaccagccugaccaacauggagaaacccugucucuacuaaaaauacaaaauuagcccggcgugguggcccacgccuauaaucccaacuacuugggaggcugaggcaggagaaucauuugaacccaggaggcgaagguugcugugagccgagauugugccacggcacuccagccugggcaacaagagcgaaauuaugucucaaaaaaaaaaaaaaaaaaaggugggggggcuucaguuucauauguaauaauguaaacgugcaacuuauaaaauuuccaugaaaguuucaaaauauauaugaaguuuuuuaggaaagauauugauaggggguacagauuuacagaauuuuacuuuaccaacugaacaaaaugaacauaaagcaacaaauaguaaccagagaaggaccucaacaucauaucauaaacagacaaauugaaucaaacuaaaaaucuuacuauugcccuuuuuggugguuaggcaagguuuuuacuauaggguacagcagggaaagaugagugcccuaguuagagccugcuucuucucuggggauaacuuggcuauagucagaaguacccgaagccagaaacuaguagugcuucaacuccaaagcagccaguugccucacuuuuaauaacauuaugaaaaagaagaagggaagggaaggaguucaccugaaacauagaaaacuuuuauguuacuuuuuuuuuuuuuuuuuccuguuuuuugagacaguaucucacuuuguugccuaggcuggagugcauuggggcagucauggcucacugcagccuugaccuccuggagccaaacaauccuccugccucagccuuccaaguagcugggaccacaggcaugcaccaccaugcugggugauuuuuuuuuuuuuuuuuuuuuuuuuuuuuuuuuuggagaccggcuuucucuauguugcccaggcuggucuccaacucuuggacucaagcgaucauccugucucagccucccaaaaugugucauaccuuuuuaauugugcaauagacaaguaaaaaggguuaagaagaacugauacucuuggaaaaaagaaauauaccuuucagugcuaauugggcauuuacaaaaguuaguuauauauuaauagaggaaggaacuccaaaacguugaaauacuauaggcuaaauucucuaaaauagaauaaaacuagaaauuaauauaaacauggaaacaacaaagucucuuaacuaucuaaaaauuuacauaugcuaaaaaauccuggauuaaagagaaaucaaacuuuaagacaggguuguccagucuuuugguuucccuggaccacacuggaagaagaauaguugucuuagaccacacauaaaauacaguaacacuaaugauagcugauugauaggcuaaaaaaaaaauuccaaaaaaaaaaucucauaauauuuuaagaaaguaugaauuuguguugggcugcauucgaagccauccuggguugcaugcagcccauggacugcaaguuggacaagcuugcuuuagaacaucuagguuuaaaaagagugauaaguauaaaaauccaugggcuaauaacccugugcuuaggagaaaaucacaaccuuaaauauacuacuaaauaagaaaaggaaagcaaauuaauuaagcauucuacagacaaacuagacaaaagcagcaaaauaaacccaggaaauaaaaaugaauuauaauacauaaaauguaaaauuuaugaagaaaccuaugaucuggucuuggguuuauucacacauauaugcaauauaaauuagucuacuaguuuaacuucauaugaaaagagaguauaaagaaauuaaaagacugaaugcgguggcucaugccuguaaucuccgcauuugggaggccgaggcaggaucacucgagcccaggaguuuuagaccagccugagcaauauagugagaacuugucucuacaaauuaaaacaaacaaacaaaaacaacaacaacaaauuagcuagucauuggagggugagcaugugguccguacuacucgugaagcugaggugagaggauuacuugagcccaggaagucgagacugcagugagcuaaugacaccaccgcauuccagccugguugacagagugagaccaugucuccaaaauaaaaaaccagccccauuauuuucuuugauaaauuauuacacaucuuuuagaaaccaguacuuguaauguucuuuaaacuauuccagaacauaagaauaauucaguacaagcuuucuuauucagucuucucuugaagagucuuauuagauuaauugaugcucuucauucccucuguaaagaaaaacuggcuugauaacauggcaagcugaaugcuuguagcuaguaggcugucacuuucuaguaagacuauguauuuaucccaccaguugaagaguaugcugaacaggagguaguuguuaguuuucaauuuuuaugcuuuuuauuauuauaauuacauaguuuaagcguagauacagugcuuuacaaaaacuuuaagacauugcugucuaauuagggauggacaaguaauuguguaaguuagaaaaguuauaaaaauccaagaugugguauuagauugcuuugaaaguguuuuuaauuucuagauuuauuuaaagaaaucaaaacuaaaaauccuugaugauguguuaugggugugguuuguacaagagagcuaauacagaauuccauucagugaauccucuguuuaaagagaaagccuuggccuuugucagaagaugggaaaacaaauguacauuuauaaacuuucaguuaaaauaaaauguuuaaauuauauaucuguguaucuuuuuuuuuaaacgauuccuucuaaccuuuuuuuuuuaaacgauuccuucuaacccauuuuuuuuuuguuaaacccaaccagccaacucuugguccugauuguauuggaaacuagggcuucuauuaaagauaguuaacaucuauuuaguucauauacaauaucagcauuauucgaagaguuucacuugaauuaucucaguuaagcuucguaacaacccuaugucuucucuuuauaguuaagaaaacugaaccuuagagaggugaagaauucguccagggucauaaaacuagcaaguggcaaaauugagauuuaaacacugcuagguguuaccuuaggaucuaaacuuuuaaccauuacuccaaaguacaggcugggugcgguggcucacgccuguaaucgcagcacuuugggaggccaagacggguggaucacuugagcccaggaguucaagaccagacuaggcaacaugacaaaaccccguauauacuaaaaacaaaaauuagccgggcaugguagcacacaccugcaaucccagcuccuugggaggcugaggcaugagaauugcuugaaccugggaggcagagguugcagucagccaagaucgcaccacuccacuacagccugggugacagagugagaauuggucucaaaaaauaaauaaauaaacuacauaggaaauaaaacuaccuggaaucuuuucuuuuacaaaaucaauaugacacacauaucgguacuugacaaagacaacaugaaaaauuuuauaagauauuaggccgggaacgguggcucaugccuguaaucccagcacuuugggaggccgaggugggagggucacuugaggccaggagucugaaaccaugccuggccaacauggugaacgcccccaucccccauaucuacuaaaaauauaaaaauuaggcugggcaugguggcucaugccuguaaucccagcacuuugggaggcugaggcggguggaucacuugaggucaggaguuugagaccagcccggccagcauggcgaaacccuaucucuacuaaaaauacaaaaacuaaccgggcguggugguaggcgccuguagucccagcuccucaggaggcugaaacacaauaauugcuugaacccagaaggcggagguugcagugagccgagauugcucugccgcgcuccagccugggcgauugagacugucucaaaaaaaaaaaaaaagaaaaauuguauaagauauuaauccaagaauucuaagggagguacuagcaaauaguauccagcuuuuuaucacaaaguuaaccugcagaaaaaugaugggagcuaagaugauacagagggucaagaaagguaucucccuuuaagugacauuugagcagagaucugaaugaagaaauggcaaaguaauaaagacucugaggcauauuugguuuuuuuuuuuuaggaauauguucucagugaaccauauggggggaaagcuugguuuauccauuuuauagcaugcuguacuguuacuaagaaggaaauaguuggucaggcacaauggcucacgccucuagucccaacacuuugggaggccaaggcgggcggaucacuugaggucgaguucaggaccagccuugccaacauggugaaucccugucucuacuaaaaauacaaaaauuaccugggcgcaguggugugugccuguaaucccagcuacuuggaaggcugaggcaggaacauccugccucagguagcuugaaccugggaggcagagguugcagugagucgagauugugccacugcacuccagccugggugacagagugagacuaugucucagaaaaaaaaaaaaaaaaaaaaaaaaggaaacaguugauuuggagauaaagaaauggaaaagcagcaugaauaguuacagaaggcuauauugagauugaucucauuuagguaaaacaaaagacucaaauuguuaaucugaacauggacuuucaagaagacuagggaggagaaauuuucauuuucuaguuuauauauuucagcauguuuuuauuuuguuaagauacuuauaauuuuauaaagagauugaccgggcacaguggcucacaccuguaaucucagcacuuuggaaggccaaggcagguggaucacuagagcccaggaguuugagaccagccugggcaacguggccaaaccccgucucuacaaaaaauacaaaaauuaggugggugugguagcacacaccuauagccugagcuauugggaggcugcgguacaaggaucacccgaacccaagggaggucgaggcuacagugaacugugauugcaccacugcccuuuagucugggcagcagagcgagaccuugucucaaaaaaacagaaauaaaacaacaaaacauaaaaagaugcuucaauuuugauuucauagcauuaauuucuuuucagacaugaagaaaaugaaguuucugauaaacaaaucugacuauaaugaggcaacggaguauaccgaaaaguguguggccuuuagaaucuuacaggguuggguucuaaugccagcucagcuacuuccugcgcuuaugguuuagggucccauaugcucuuaaguuuuuuucuucaaaaguaaaagaggacugauaacaugcuuaggguugugagaauuaaauguaaauaaguuuucaguacauauuucuucccucaccuuauuuacaguaaugcuagguuguuuauaggcucaggaaugaugagaccuagugucaguauaguacagauacauguaaaacugaucaagagugauaacacuaauuugcuuuaaauggcuuuacaccauagugaaugaguuauuuuauuuauaauuugcuuuguuccagaaaguauuuuaggcagauuacaaauauuuuauaauagaaguagcauagauuaaaaagugauggagggaggccgggcacgguggcucauaccuauaaucccagcacuucgggaggccgaggcagguagaucaucugaggucagcaguuugagaccagccuggccaacauagugaaaccccgucucugcuaaaauacaaaacaagccgggcacaguggcucaugccuguaauccuagcacuuugggaggccgaggcggacaggucaugaggucaugaggucaggagaucaagaccauccgggcuaacacggugaaaccccgucucuaccaaaacuacaaaaaaaaaaaaaaaaaaaaaaaaaaagccgggcauggcggcgggcaccuguagucccagcuacucaggaggcugaggcaggagaauggcaugaacccaggaggcagagcuugcagucagccgagauggcgccacugcacuccagccugggcaagagagcgacacuccaucucaaaaauaaauaaaaaaacaauuagcugagugugguggcacacaccuguaaucccagguacuugggagucugaggcaggagaacugcuugaaccugggagguggagguugcaguaagcggagauugugccacugcacuccagccugggcaacagcaagacuccaucccaaaaaaaaaaaaaaaaaaaaaagugauagagggcacaaugacucacgccuguaaucccaguacuuugggaggcuaaggccggugguuuacuugaagucaggaguuugagaccagccuggccaccauggugaaaccccaucucuacaaaaauacagaauuagcgggcgugguagcuagcaccuguaaucccagccgcugggaaggcugaggcaggagaaucgcuugaaccuggaagguggaggcugcagugagccaagaucgugccacugcacuccagccugggcaacagagcgagacugugucucaaaaaacaaaacaaaacaaaaagugauggaggaagagaauggaaaacacacauugggacaaaaugggaugaaugaaggcagaaagcucuguguggccauauauauauauauauauuuaauuguuuuuaaacaugaggaucacauuacccuaagccuucuagcagucagcugaagagccuuuauaucacacaauguacauugcuuaugagauaaaaaggauuauaaucagugaagaaauugaaaguagauuagaauuaaaugaauccuuuucucuaucugccaccucacccaguacacacaaacccucaggccuaggugguuuacacaggugaaauuuuuuaaacuuuaaaggaauuagauuuugguuguaccagaagauaggaaaagagggaagcuucccauauugaaagaaaugaaucauguauaccuucauaaacugauggcauaaaauauucuguagaguugugcuucucaaacuuuuugguuucauaacuucuuuaugcucaaauuauuaaagaucccgggaguuuuuguaucuacugagauuuaccguauuagaaauuaaagauauuuaugaauucauuuuaacauaauaauguuaacauguuuuaaagucuauaacgucuauaguuucuaaaauaaaaguuguuggaauggcagaucugucugguuuaauagacaugacacuuggauccucauaucugugaugugcuguuuucaauagccuuuuuggauaauggugcauauucuucuuagaaaccacaaaaauuagaugauugcuaguuuuuuacagguuguaauguguaaucugaaaccauaugaaggaauauuuuauaguguacuauauugaaauccauuguucugucuuacacuuugaauggaucuuuuaucugugaugauuuugugauauuaugcauuggucauuugaaaaaugcugcuucacugaacagaucuuccaaauguaauguuuuauguuauauaauuuguaccaccacugaucucaucagaaaagcuuuucaguauuuugaaacuguuaagcucacgguggaggauauaaguuuucuaauauucuaauuucucuggaaaguuccaauuuuauaauugacaauaaauacuguuguuuuccuucaagugacaagcugacuuuguuccuauuugagaaaaugucuggaaaauacccaaguuuggaugacuguaguuuguuaguuuucuuugccgguaaaaauagugguccaugaaaaaagcagcugccucaguucgcaagucaaaucauugcacaucuucucaagauaacuaucauauuuuguuguacaguagaagugcuuaugaguauuucccauuucaucgcagagaauauuaaaaagauacauacucaaauaucagaauuaaaugccauuaacaauuuguacugcuucaacaaguacauucuuuuuuugagagagucugguucugucacccaagcuggagggcagugguauaaucucagcucacugcaaccucugccucccggguucaagcaauucucaugccucagccuccugaguagcugggacuacaggugcgcaccaccacacccggcuaauuuuuguauuuucaguagagacaggguuuugccauguuggccagguuggucucgaacucaugaccucaggugauccgcccaccuuggccucccaagugcuggaguuacaggcaugagccacugcaccucacuuaacaaguacauucuuaagugaaacuggcuuuucuccccacccugaaauuugcaugauaaugaagacuacauccuguuaauauaguuuguugccacugaguugaaucauguuaaggugcugguaguuuuaccacugguuuuguaccauuagugcaaaucaacacauggaaaaaggcaaauaauggcuuaguaauagcuuugaccugccagaccuugaagugucuaggggacgcucagugguccuuggaccccacuugugaaaacuguugcuguauaucagucuuacauacgaauacugauguacaacaucuaacuuaacaaguggaaaauacagcauuacauugaaauaauaguacuuuuauuaggcuuggaugguauucuuccuuugaauauaaugaugaauauguauuaggaagucuguugauaaaauucacauuaaguagccuggggagaaaaugcagaugaugaugguuauagaaguucuaaaaaaucaaaacugauaaaacuaaagcacucuuagaauauaaaagccacaaaaauuaaaauccauaguagagaggaauaaaugaaugcuuccuuaacaggaaauaugugugaauuuguauguguauaugugaguauauuucuguuauguguuuuucaaacccaaaggcaucauucuucccagggcuaaacaaugaaugugcucccauuaaaaucagaaaauaaaguuacccaauauuguguacugucauuaucauuuuaacauuguuuaguaauugccacauaauguaacauaccacagugauaaagauacauuugaaaaaaauauagaugaauucuaacauggguuauaugauuuauauaccuggaauaccucaaagaaacaacugcuaaaacugguaggaacccuacgaucucagauggcuacauauuauuaaauuuuuguuuguggccaggaaugaugacugacaccuguaaugcuagcacuuugggaggcugagaugggaggauugcuggaguccaguaggucaagguugcacugagccuuguuugcaccccugcacuccagccugggugacagugagaccuugucucaaaaauaaauaaauaaauaaaauuugaaaccuuuccuguaauaaagcuuuucuuucuuuuucuuuuucuuucuuuuucuuuuucuuucuuucuuuuuuuuuuuuauuugagacagagccucgcuguguugccaggcuggagugcaguggcgcaaucucggcucacugcaaccucugccucccagguucaagugagucuccugccucagccuccugaguaacugggacuagaggcgcacgccaccaugcccagcuaauuuuuguauuuuuaguagagacgggguuucaccauguuggccaggauggccuugauaucgcgaccuugugaucugcccaccucagccuccuaaagugcugggauuacaggcgugagcaaccgugccuggccuuucuuuuuuuccuuuuuuuuuuuuuuuuaagauaaagucuugcugucugucauccaggcuggagugcaguggccugaucucagcucacugcaaccuccaccucccagguucaagugauucucugccucagccucccaaguagcugggauuacaggugugcgccaccaugcccagcuaauuuuuguguuuuuaguagagacaggguuuccccaucuugccgagccuagucucaaacuccugcucaagcaauccaccugcaucggccuuccaaagugcugugauuagaggcaugagccaucaugccuggccaagcuuuucuaauuaauugcuuagaaaauauaaugggcaugggccaggugcgguggcucacgcccauaaucccagcacuuugggaggccgaggugggcggaucacuaggucaggagaucgagaccauccuggcuaacacagugaaacccugucucuacuaaaaauacaaaaaaauuagccgggugugguggcaggugcuuguagucccagcuacgugggaggcugaggcaggagaauggcaugaaccugggagguggagcuugcagugagccgagauggugccacugcacuccagccugggcgacagagcaagacaccaucucaaaaaaaaaaaaaaaaaagaaaguaaauauaaugggcuaaaaacauguuuaaggcugggcucaguggcuuaugccuguaaucccaauacuuugauagacugaggcaggaggaucacuugaggcuaggaguuugaggccagcuugggucucaaauuagauggauguaguggcauauuccuguagucucagcugguaagcugaggcaggaggaucauuugagaccgggaggucgaggcuucagggagcuaugauugcaucacugaccuccagccugggguagcaguggaacccugugucuauuuaaaaaaaaaaacaaaauauuuaaaaaacaaaaagcccguaaaggaaauacacaaaaucucacugaaaauagauaaauaaauaaauaaaggaaagaaauagaaacacuaauucuaagauagaaauauuaagcauuguaaaggcaguaguugguucuaaaucuauaaauuuagaguggcgguugaauccuagcaggauucucuuuuggaguguuauaguauugauuauaauucauguguaauaaaauuuugaggagaauaaguaaagagguggauaggagauuuguccuaucagacuuucaaggaauauuaaaagcacaauaugguauugacaccagaguagauugauggaaucacgauagauucccaaaguauaccucagguaauuggggauuuagcauauaccuuaguguaugaugcaucucaguaguaaaugguguugggaguaguugacuggccaccaggcacagauuuuguaaaugcaguuaucaguugcugucaugucuaccucucuaguuucuaggaacuuuccuugcaucgguauguguauuccauuguguauccugcuuucaguuagauaaauucgguacucagauaucuuucaacaucacauaugauaaaauaauugaaauuuuuauugaaauaaaauuucaauaaaauaaaauuuuauugaaauaaaauuuuaguauaaugaaacuguuguuuauuauaagacuauuaaugggccagaugcuagcucauuuaauuucguagcuucaaaauaaaauuaaucuuaaguuuccaaaagaggagcagauuccuaagcaauguaauuugaccgaugucagacaagagucaaauauaaaacuugcuuuuaaauucugucuucauuauacauaggcaaaguaccuuagaacuguauuguggacugggugcagcggcccaugcuuguaaucccaacacuuuaggagacugaggugggaggaucacuugaagccaggcguucaagaccagccugggcaacauagcaaaaaccugucuacagacaaaccuaccgcaguauuaucuagacccagguuaugcuuccagcugagccucccugagcccuguauucccccuacacugauuuacauaguguuccucccaaaugucuauacuuugcuacuuccaugccuuugccuguguucucucuucugguaacauaauuuaucuuauuccauuucccaccugucuaugguuuacuuauccuuggaauuauaaccaaaauucuucacucuuucccuaacuuaaguuuucuuguauuucugcaucuugaaaguaucuuugccuuccuggauuccaguaugcuuuauacuucuauuauagugcacaacagucugccugggguugauuaauuguguuuacaugguuucuuggaaaaguauacaaaaacaagaaauagaaaagagaccuguaaacaacuaaaauacagagcaggaugaaagaaaugucaaaccaguagcaugcaaggaguaauucugaguagcauuggagaauacagaagacuuuuauuaauuagauuacuuuugaucugaaucuugagaagugaaaauaauucagcuauauagaauuuagggagaaggagcauuagcauagacaugaaggaguggccuguggggagagaugcauugggaaaugagacuaggaaggcagauugggaccagaucuagagagcccaugcuacaggaguugggcuuucuuuucaagggaguaggguugaggagguugugaaaauuggacuuuaagacaaaagagaguagaacuauguaaagaauaaguucuuaguaucuuuaaagcuuggguuuauaaaaaugcuaaauauauugagacaaaaaaguacauuucagugacauacggcuuuaaaaacauaaaaggucuccuauaaauauguguuucugagguaucauucuaaagcucagcuaaaaaaaugucuggcaacuugagccauuacuuguucauauacauuuauacaugcauuuguauuuacguauguuuggaauauuuuuacuuuuaaucagugauacaucaacguuuucuuuuuacauaugcagaccagcugacaauuuuauauauaauaaacauccuugaaauuugguauacuaaaaauaaguagauuuaagcaaauuuucaucuaccuauuacuaaaucaguuaguuuuuaaauguuuaccagcuggaguugccuauuuguuauagcauuucuucuacaaauuaccauaacaaggauuuacuaguuaaugcuaaaauaaugaggauuuucaagauacagauaaacgagaguaaagcaguuaaaauuucuuuaugacuuaagaucagcagcacuacuuaaauugaagaacuuuaauguuucaagaguguuauguuuaggguccuuccauugauggcaguuagcaguagucuuuacacuacaguuaccuuccugaggucauauagaaauccguuucugcuauuauuguagacugccuuauauucaugggaaggaggagugacagguaccaaaaaaccagagagggacauauauucaacucuaguuccuuaauuuaugggcauaaauuuuuuauguugguuuuaagguguaagucacauauuuugagugucaucauguuuuaagauuucauuuugcaaauaaugaaaguccucuaagaauuggaaugcuuggauuguuaaaaguauccacugaaaauaaauuaauuucuuaaauaauuaaauucggaugacuaaaauauuuaacgagggccgggcgugguggcucaugccuguaauuccagcacuuugggaggccuaggcagguggaucacuugagaacagggguucaagaccagccuggccaacauggggaaauccugucucuacuaaaaauacaaaaacuagcugggccgugguggcgcaugccuauaaucccagcuacucaggaggcugaggcaggagaaucacuugaacccaggaggcagagauugcagugagcugagauugugccacuguacuccagccugggugacagagugagacucugucucaaaaaaaagaaagaauaaaauaacaaaaguuuuuauagaccaaggcuucaauuuuuguguauuuaaaaaugaguugauguuuuguauaacaguuguauguauucuuuauguaguugauagugauguacuuccuuuuguguguugcuuagccgaauaugugggaguccauguccugcaguguggccugauguaaucaaacuaccauauuucaacaccaugaaaccaaagaagcaauaucgucgaaaguuaagagaagaauuuguuuuguaagaaggggauguguaaacauccuuauugcaugaauguuuuacuuuaauucuagugaauuauaaauguuagucuauucucuagugaucugagguaaaccuauaauucuucuagggcauuuaauuuugaguucuguuugcuacaugcagauuaccauuuuaccauuauuauggaaucagugauuugagauuguguguuugguuuggugcuuacgugaaagaacuuuaauaagaucauuuaaauguuacuggaacagcuuucaaguuacuugagcucaaguuuucauuuugcuuuagaaaaaacuauacuguucaguucuuaauuuguauaauaacagcaaauuaccgauaaguaacaauauauacuauuguuuagaaagugguuacaaaaauuauguaaaaaugaaauauuuauucaaaggaaaauucggauuuauugaaguaaaguauuaugcacauauuaaaaaaguauuuacaauuauuuuuaaaugaucuuaguuuuaguuuuaaaauuuaauuaaaaauaauuuaagcuccuaaagaaacauaagcuugugucuaaagaacacaucuaacuuuuguaauccucucaugcuaguauuccugcagcugcgcuagacuuauuugauuacaugcuugccuuggauccuaguaagcgcugcacugcugaacaggcucuucagugcgaguuccuccgagauguggaacccucaaaaaugccuccaccagaguaagugacuuuuuauccuauuauuauuauauauuauuauuauauuuauuauauuaaaacaguuuuaauaacauauauaauaagauauuucaugucugguuaugagaaaaauauaauaaaggaaagauaaaacagcaguaauacacauaauuugcacaucugggauauagaugcuugcuuaauguuuacccauagggcuagcaaaaacagcugccuucuagcuaauuuuaggcuugauugaccucaagauuuaauaauauauuucaacucuaagaaaauauuacugcugccgggcgcgguggcucacgccuauaaucccagcacuuugggaggccgaggugggcggaucaugaggucaggaguuugagaccagucuggccaacauggcaaaaccccgucucuacuaaaauuacaaaaauuagccagacgugguggcaggcgccuguaaucccagcuacuugggaggcugaggcaggagaaucgcuugaacccgcgaggcggagguugcagugagccaagaucauggcauugcacuccagccugggugacaagagcaagacuccgucucaaaaaaaaaaaaauauuacugcuguugcuauucuaauacuacuucuacuaaauacuuaacacuacuacugguacagcuauagccauaauuuugagugccaugcuaagcauuuuucauuuauuacauuaaucuuuauaaccuuauaagguagguauuaguauuauuaucaucaccacuucacagaggaggaagcaggcucagagagguuaagaaacuugcccaagaauacaaaucuaguaaaggguacagccagcucucaaauucacauuaguccaauaaguaagagagguucugaaaauacuuuauagcauaguauacaauauaaauuucuuaucauugaaugaaaagaauguuaguaucagaagccuguauagaaggaauuauugucugaugggggaaauauauagaguuugggagucaaaauagcuggcuucucuugaaccuguaacuucaaauggcuccuguuauuucucuaggauugauuuggggaguaggggggaaggaaaacguucauuugcauuccuugacaggaucuagaaaccuuguagguauuuucuuaguaauuuuuauuuuauuuuuuugucuugagacaaagucucacucugucucccaggcuggggugcaguggcacgaucucagcucacuacaaccucugcgucucagguucaagugauucuccugcuucagccucccgaguagcugggauuacaggcaugcaccaccacaucuggcuaauuuuuguauuuuuaguagagaugggauuucaccauguuggccaggcuggucuugaacucuugaccucaggugauccacccaccuuggccuccuaaacugcuaggauuacagauuugagccaccacgcccagccuuuucuuaauaauuuuuaaaaugauaaggagcaucauuaaaagcaagccuauuaucuauaauaauaaaauguuuccauguaauaaaaauagcauauuuuaaaugaacagacaugggcucuggaguucaaauccugguucuucugcuuaucaguuagauagugcuuauuauauuucuaugaggcugucauauucagcuucaguaagcuuuuauugagcuguacaugguuggccuuuaugggaugauuugggagccaaaaaggaucuauuaccugacaucaugagggaccugaauuuuucacuguugaauuauuguuucauguuugcuuuuuucuuaguguguaucaguaaucuuaaaacuugggcucaguaccccuucaaauaacauuuuuuaaacuucugauuuggaaaaauuucaacucuauagaaaaauaggaagaauaguacaaagaguauucauguauauccuuuaccuagauucaacaguuaauaauaguuggacacauuugcuuuaucacugucuacuuuuuuccugaacuaguuggauaucauguuguggaggugacacuuauaaauauguaaucauaucuguaagaacuaggacuuuauucuacaugcauaccauauaaagcauaugaaauuuaacaugagaauauuuaauggucaauccacauucagauuuccccaguugacccaauaauuucucuuauagacuuuuuuuuuuaagauaaagaauuuuucaaaguucagcauucuguuuauuuguuauguccuuuucaucuuuaaucacucucuagggaagagaucuuuugacauucaacauuuuuuaagauuccaagcuagcucuuugguaaaauauuucacaauuuggauuugauugccuucuuuuuaucagaauuagauuaagaguuuggggggcaagaauguaauguugauggugauccugcucugugauaauuauguucaagagaacauaauguuacuuuguaccauuauuauugguaaugguaacuuugaccaagagauguaaccacuguacuuaaaaaugucaacauaguaaaugcugacauuuuuaaguagagcaauuauaucacucuuguaaauauaucaaguggaaagcaacuaucauagcauuuugauauccaccaccaauagucauuuggaaaauguugagcaguuguacguuguuccauuuucaucuugaacuuauguuacucccguaggcuuuuauucuaauguaaaguauuuaugcuagaaaguauuuuauugauuacuguaucauauauuuuaaaaaacaaauacauguauauaaauggaaauuaaauuucacguuuccugugacuaaaagcucuuuucuugauuaaauugucauuguaaauaucaguaaugaauauuuccuuauuuauuuauugauugauugauggaguuuuacucuuguugccucagccuccugaguaccugggauuacaggcaugcgcuaccacgcccggcuaauuuuguauuuuuaguagagacaggguuucuccauguuggucaggcuggucucgaacuccagaccucaggugauccgccugccuuggccucccaaagugcugggauuacaggugugagccaccgugcccagcccaaauauuuccauuuuaaauaaagaaaaaauuaguaaauuuuguuggaaguacaaccuaaugaaagagagggcugagauuuuuuucccaaguaguuugcauaucuguugauuaauauugcuuauucuagaaugagacauauuuccauaugaauuccaauuuuauuuuuuaguucuauaaguaugcuuguaaauuagcauuugagaauguaaggaguuuugucauaguuauaucacugaguucuuggaacuccuucgacauuaugugugaaaagccuuucaucaaaaaugauuuuaggcugggcgcaguggcucacgccuguaaucccagcacuuugggaggccaaggcggauagaucacaaggccaggaguucaagaccagccuggccaggauggugaaauccugucucuacuaaaaaugcaaaaauuagccaggugugguggcgggugccuguaaucccggcuacucgggaggcugaggcagagaacugcuugaaccugggaggcagagguuguagugagccaagauggcgccacugcacuccagucugggcgacagagugagacuccauuuccaaaaaaaaaaaaaaaaaaaaaaaaaaagauuuaaaggacgggcacaauggcucaugccuguaaucucagcacugcaggaggaucacuugaugccagcaguuugagaucaaccuggccgacauggcgaaacccuagcuguacuaaaaauacaaaaauuagcugggcaugguggcgugugccuguaaucccagcuacucagaaggcugaggcaggagagucacuugagccugggagguggagauugcagugagccaagaucuugccgcugcacuccagccugggugacagagcaagacucugccucaaaaaaaaaaaaaaaaaaaguuauuuuaggccgggugcaguggcucaugccuguaaucccagcacuuugagaggccaaggcagguggaucccuugagcccaugaguuugagaccaaucugggcaacaugguaaaauccuaucucuacuaaaaauacuaaaaaauuagccaggcgugguggcacacgccuguaaucccagcuacuccagagggugaggcacgagaauugcuugagcuugggaaacggaggcugcagugagccgagaucgcgccacugcgcuccagcuugggcaacagagugagacucugucuccaaaaaaaaaaaaaaaaaaagauucuaaugaccuucuagguguuaagauucuuucuccuucaguuuuuuggauaguaaagaauuggaggcugggcauggugacucaugccuguaaucccagcacuuugggaaccaacgcaggaggauugcuugaggccaggaguuugagaccuaccuggguaacauaaggagacccugucuuuacaaaaaaaaaaaaaaaagaugaagaauuagagaucacaugaucuaaagaaggauuucuugucuaguaauuauuugccuuuucaguugucuuaccaaugcuuaugaaaugacauuuucuaguacuuguuacuguuucuuuucacagcacauuuaauccaguauaccuagaaaagauuaggaaaucagcauguaauaucagugcuacuuugccaguccauuuuuaaaauuguuucuuaauuauguuuuuuaaguauuuugccaaaacuuggaacuauagguuuaucccacucaauuuaugggaaaugccuaccuuauauucuaaucauaaacuguguccuuauuguaaagcaaaucaccuaaaucagacuuaauuuuaucagaacacaccugacugcauuuuuucauuaaaaacaaacauguuaaaaacacauucaaggaacauucuguaagcuaucuguaacaaauuauggaauguaucuuguuagauacauuacuaaagcaaucaaguaaagaguaucagauugauccaauauuuaaauaaaaacauuuuauaaacaauauaauauaauaucucucacuauuuugcaauaugauauaaugaguaguuaaaauuaugcauuacuuaugagguaaggacuaugaagaaauacaugguauuccuuuagaaaguuggaagguguaucaaacucuuuugaucaauuuuuuaggaauaaucaaaugagagaaugggguauuuaaaaaucggaaauaggcugggcacgguggcaguggcucaugccuauaauuccagcacuuugggaggccgaggcggaccuaucacuugaggccgggaguucaagaccagccuggccaacauggugaaaccccgucucuaguaaaaauacaaaaauuaggccgggcgcaguggcucacaccuguaaucacagcaguuugggaggccgaggugggcagaucacgaggucaagagauugauaccauccuggccaacauggugaaaccccaucucuacuaaaaauacaaaauuagcaggguauggugacacaugccuguaaucccaacuacuugagaggcugagguacaagaauugcuugaauccaggaggcagagguugcaaugagcugagaucacaccauugcacuccacccugggugacaagagugaaacucugucucaaaaacaaacaaaaaaguuagaaauaacuccauuaauuguauuagaugcccugucaaacguaaaguauauauagcuggaaagugaauuagacuagcagccagccuguaagcuuucuuuaacagcaaguaaaaagcauuaagccauuuauaagacaaaauaucaguugccauuagaaugaauauuucacaauaaugauuugauggaaauaguuguaaacuaugaauuaaaugaucagugaugucaaacaugaauuaauacauugccuacuuuguaagaggcacugcugaagagcuugcacauguuaacauacaguacuaccccaugagguagauaguauuguuaaucccauuuuuaaagacaaggaaaaugaggcacagagguccaguuauuugccuaagacacaucaaguaagugacugagcuggcauuugaaccuucaagaaagcaaauaaaaguuugguuaucuggaagacauuccugauccaucugaaaguaucagcaucaguaaccuguacuauuuuagcuauuucuuggguaaaauuuaucuuuccuagagaugaguauuaagaucauccauaaagaaucucuuacuuuuaagggggccagguacgguagcucaugccuguaaucccagcacuuugggaggccaagacuggcagaucaccugaggucaggaguucaagaccagccuggucaacauggggaaaccccgucucuacuaaaaauacgaaaauuagccaggcaugguggcaugugccuguaauuccagcuacuggggaggcugaggcaggagaauugcuugaaccugggaggcggagguuggagugagccgggauagcaccacugcacuccagccugggugacagagcacgagagcaagauuccaucucaaaaaaaaaaaaaggaaagaaaauaaucucuuacuuuuaaauugugggagggaacaaaagcccuuuuuaauggauuacuuugcuuugcucucauggggcuguccuucaagagcaaugcauucccugagcuucaggauagaaagguggaaucacuccaguuaccccacugugcaguacuacaguauaucugaauuuaagguaucccaacagagacugagacccacaucauaucauacaaacacuuagaaaggaaauucuuuggcggguuuaugaugccugaaagcuucccaauaucgauauuucaaauugucccuuuguuuguuacuccaggagguuuuuacacgcugaggcaaugcaucauaguaagauggcugagagguaugccuuuguuuuguuuuuggaccucaggugcauagacuugguuuaaucauaauccuugugucacucaucauugguccaugcauggcucucuuuuauuuauuuuaguuacuuuaguuauuuuuaauaauguuaauaagcagccaugaaccuaccaaacaaaagcuagaaugcugaaaauaacauacuguaaucauauuaccccuacccccaccaaccuauccccuugccuuccuccaccugagguaaccaucaucccuguuuucuuuuguauauacuuuuuguugccaucuauauguacucauaaaagguuauauuuuaaaaauuuuaguuguuaauuuuauaaaagcgcgucaugcuguuuguaauauuuugggaaugacuuuuuaaacuaauauugcuaagauucaaccauauuauugcaucugccuuuauuuuauaacaugacuaauugugaaagaggagauguaaaagaacuugcuuaaacaagcaggccauccucaaagcucagucuuaggaaagcagacauauggauauggaaauuccuuuaaaaaaauuccagguguacccucuuggagagucuucggguaccuccuagagguaaacagauccagguugaggauuauagguauauauuaccaggugggguugcuuaagggaauuuguagauauucugggcaaguuuauucaccuuucuaagccucaaguuucucaucuuuaaaauagguacaacaguaacguuccauuaaauacuuaauuaggguaagaagaaagcauuuauaaaccaaauauuuguaucuuuaagcaaaaguuauucucuaguguuaucaguuguaugaaguuacuuuaagauagaauugacuaggaauugugggcaguuuugauaguuguuauucgcaacucuguugauaaaugaugagccgcucuaugccaggauuaccuauuuugaaaacucgucuguagcaucaguuuaauucuagagcauuuggauagacaagcaaguuaguaaaaaguaagcuuuuacuguuaaguucuucacaaauguuauguucuagccuuacucuuuuuuuuuuuuuuuuuuuuugagauagggucuggcucugucacccaggccagagugcaguggcaugaucuuggcucucugcagccucugccuccugggcugaagccauccucccaccucagcuucccgaguagcugggacuacagacaugugccaccaugacuggcuaauuuuuuuauagagacaggguuucagcauguugcccaugcuggugaacuccugagcucaagugauccacccaccuuagccucccaaagugccaggauuacaggcaugagcugcugcgccuggcccuuuacuacuuuuuuaucccauaucugguuucugcaaauggcauguuuuucuuuuuugugugacagggccugguucugucgccuaggcuggagugcaguuacaugaucucagcucacugcaaccaccaccaccugggcucaagcuauucucccacuucagccucccaaguagcugggacugcagugcacaacaucaugcccaacuaauuuuuguauuuuuggcaaagacaggguuuugccauguugcccaggcuggucuugaacuccugggcucaagcaauccucccgucuuggccucccuaagcacugggauuauaggcgugagccacugugccuggcuggaaauggcauauuuuucugccuucuuuuucaugucuuauucaguguaugauguacuaucauaagaacugacuuugaaagguugcaccaacagcaauagugguguuuuuuuuuuuuuuuuuuuugagacggagucucgcugugucacccaggcuggagugcaguggcgcaaucucggcucaccgcaaccuccaccucccggguucaugccauucuccugccucagccuccugaguagcugggauuacaggugcccgccaccacgccuggcuaauuuuuguauuuuuaguagaaacgggguuuugccauguuggccaggcugaucucaaacuccugaccucagaugauccaccuaugucggccucccaaagugcugggauuacaggcaugcccagcauaguagccuauuuuuaugaauauauauucuucauucauaauuuugauaaaugauuauuuauugauuauucaaaagccaaagaaaaauagauuaucuguaaaggcaaagcaagcccugaaggaagugggacaauaaggaugauuuuuauuggaagaguuuuacagagccauucuaugaagucuucaagaacuauuuggggugggggcauaacuuuguugcuauauaguaacuguagcauuuuuuguuaagaaaugccauuuacaauuuaauuccuuuuuuuuuuucagucucccuuuauggcaagauugucaugaguuauggaguaaaaagcgaagaagacagaagcagaugggcaugacugaugauguuuccacaauuaaagcccccaggaaggacuugucucugggcuuggaugacagcagaaccaacacaccccagggugugcugccaucuucacagcugaaaucucagggcagcucaaauguggcaccuggucaguaaugcuuccauggguugguuuucuucacauuguuuugcaguuaauucugaucauauugcucuaauguuaaagcaucuuguggcuaacaaugaaaauuaacauuuauucacugaacuagacauuucuuugugccaguacagaaguuucauugcuauuggcaccacaauuuuaaguaaucuuaagguaacuuauaaagaagcaucaaauuaccugacuggcaaguccucggauuucuguauuuccuuuuuacucuuagugcaggagugaguaggucuuuuacugacacuacucucagugaggcucagcauucaaugucuauagaugcuuaagcaguaggaagaaagguauaagaaaacagccaaaaaucauaaugagagcucuuucauaccauuuauagcguccucaugucacuccuaauguuauaauuucucugguuauauuaaagaaucuuaaagauuggggccaggcaugcuggcucacgccuguaauccuagcacuuugggagacugaggcggauggaucaccugagaucaggaguucgagacuagccuggccaacaucgcgaaaccccgucucuacuaaaaauacaaaaauuagccgggcgugguggcacacaccuguaaucccagcuacucggaugcugaggaagaagaaucgcuugaacuggggagguggagguugcagugagccgagauugcgccacugcacuccagccugugcgacaggagcgagacuccaucucaaaauaugugugugugugugugugagugaaucugauauuugugcccaaaauaacuuaaaauaugagaagggaaggccaggcaugguggcucacaucuguaaucccagcucuuugggaggccacgaugggcagaccacuugagcccaugaguucgagaccagcccagacaacuuccugaaacucugucucuacuaaaaauacaaaaaaaaaauuagcugggcaugguggcacacaccuguaaucccagcuacucaggaggcucaggcacgauaauugcuugaacccaggaggcagauguugcagugagccaagauugaaccacugcacuccagccugggugacagagcgagacugucucaaaaaaaaaaaaaaaaaggauaucuuauaucuaguuauuuuagggaaacuuaaauuucuuccuuugacucagucugucauagaguaagcuuuuugaugcaaagucugccucuucaauguugucaagaguguuaaaaucauuuaacaacuuuuuaaaaggaccuccacucccucauuuugccuaaaacauccagaaacacccaucuuuaauuuaacaccaucuuuaguugaaguuuuaugaaaacagagacugauauaaaauagagagagagagagagagagagagaguguguguguguguguguguguguguguguguaggugguggcuuauuaaacaugaaaaaauagacuagcacuucuuaagagaugaguauauguugauugaugaguuaguugauuaaaacagauguguggaucagacugaacuuuuggugguugaagauaaauauagauuaacugagaaagcuuuaggaagauaaccauuaaugcuugccaauguagucuacaagcuucuacuugaccuugguucaacugcauacuuaaaguacucauucaaugaauaccaaaagcaauuguuauuuguuguucaaaaguauucuuucuugaaauagugaguuccccuuauacauuaaaauauuuguccugcuaacaaaaggaugugaaauggcaauaacagaaauuuuggauggugaucuguuuucccaggcaacaguugucauauuuggcaagacucucaggucuuuauuucugguccucuucauggaacugaugucuuaaacucuaccaaacguaguaguuuacucauuuuagcugguaaaaaaugauuugcccuuucugggcucauuuuguuguuaauuugcucuaacuuacuuuacaacccuguuuuaaugguggauaauuuuauuuuuuauuuuccuuuuuuaacuuuaauuuuuuuuugagacagucucugucacccaggcuggaguacagugacacgaucucagcucacugcaaucuccgccucccagguucaagugauucuccugccucagacuccagaguaacugggauuacaggcaugugccaucacgcucagcuaauuuuuguauuuuuaauagagaugagguuuugccauguuggccaggcuggucucgaacuccugaccuugaguuaucuauaaauagcugggugugguggcucaugcccguaaucccagcacucugggaggccggggcgggcuguuugcuuauguucgggauuucgagaccagccuagguaacauggcaaaaccccgucucuacaaaaaauacaaaaauuagccuggccuauauucccaguuacuugcggggcugaagcaggaaagauugcuugagccuaggaggucgagacugcagugagcugagauugugccacuggcacuguggccuggaugauaaagugagacccugucuuaaaaaaucaagagaaaagagaagaaucaguauugugauuaagaagugagaauuccaggcugggcaugguggcucaugccuguaaucccagcacuuugggaggccgagguggauggaucaccugaggucaggaguucgagaccagccuggccaacauggcaaaaccaugucucuacuaaaaauaaaacaacuggccgggcaugguggcucacgccuguaaucccagcacuuugggaggcugaggcgggcggaucaugaggucaggagaucgagaccauccuggcuaacacggugaaaucccaucucuacuaaaaauacaaaaaauuagccgggcguggugguggcaggcgccuguagucccagcuacucgggaggcugaggcaggagaauggcgugaacccagaaggcggagcuugcagugagccgagaucgugccacugcauuccagccugggccacagggcgagacuccgucucaaaaaaaauaaauaaauaaaacaauuagccaggcaugguggcacgcgccuguaaucccagcuccuagugggggcuggggcaggaaaauugcuugaacaugggaggcagagauuacauaucaugccacugcacuccagccuggggaacagagcaagacucugucucaaaaaaaaaaaagaaggagaauucugguuuuuugaaaaaaggaugaauccucugagucauuuucuucuccgucaucaguaaguaugcugaaauaagaaaacgccccuucagcaaaagaggcaccucaauuaaagaccacaucccugaauucauauggagagacuaccugugguaauagggaaaugaaaauaaggaaaaaugacuuuugauuuguagcaaacaagcaugcucacggaucauaagaagaacuugcagaaguaucucaaaauauauaaagagaauauaaaagcauuaaacaccaguuuuucaucaucuuagaguuccucuucuaucaaucugucaucugugauuaugggaauugcuuaucauugcagucuuauaguuaccauauaugguauuauaugcauuugagccuugucguuauaugugauucagauaagcuugcgugagggaggaccuguguaaauuaucccaagucuaaacugaaaguuggaaaaacaacugaauccuuauuacuggugaugaguuaauacuaucauaugcauauauuaauaauaagcauauuucuguaggcauuccuaacuuacccaaaguuacaaaaaaaaaaagguaauuugaagaaaaacacaggcauuuuaucagaaucugaaaaaugucaugauuucaauauagugcaaagauaaccuuagauuuugcauaauaaacuuuauuuuagagaaaguacgguguaguuaagagcucagauuguggaaucagaauaucagauucagaucucaccucugccacuuacagaauauuugcccuugggcaaguugcuuggucucuuucggugucaguuucuucuucucaguaaaaggaggcuaauaauagagucugccuucuaagguuguuguaaggaauaaaggauauuaaaugcuuagaagguaugugacacucccuuagcugucaucauuaucauuauucauuucccauucacaaugugcuguuuccugguuaaauccauaacaugagguuuuaguaguggucuugauuuuccuuuugaaguauuuaccccuaaagauuuauucaaaauugacugcaguucuuuuuauguacagguacauuuuaaauguacaugauauuuaacuagacuugagguucucuuuuuacaguauuucuuaaauacucucccucaaauauauauuuucauaugguaauacagagccauuuuggugugggagugggaggagcugugaauuaugacaguucuaauuaauauaauuuugucuuuaguaaaaacaggcccuggacagcacuuaaaccacagugaauuggcaauucuacuaaaccuacuacaaucuaaaacaaguguuaauauggcugauuuuguccaaguguugaacauuaagguaaacucugagacucaacagcagcuaaauaaaauaaaccuuccugcuggaauuuuggcaacaggugaaaaacagacagauccaucaacaccacaacaggagucuucgaaaccguugggaggaauucagccuucuucucagaccauccagccuaaaguggagacugaugcugcccaggcggcugugcagagugcauuugcaguucuguugacucaguuaauaaaggcucagcagucaaagcagaaagaugugcuacuagaagagagggaaaauggaucgggacaugaagcgucauuacaacucaggccaccuccagaaccuagcacuccggugucggguaagugugcagauaccagaccacuaacacagcugcauuacauugucuacucaguguugcugacuauauauaauguguauaguucagugacauugccaaaagauguccugaagaaucucagguaacuggcaauagguugguuuuucagucuguuuacuuccaggaauggauucuuuaacaaauuauccaugugagauagaacucauugugaaugauaaagauauuucuaagguaaaccuaugguuaagaaauaauauuuaacuccaaauacgaaaggaugcuugacuaaggcauaauuuauguacacaguagcuuuuguuccucaagcaaugaaguauacgugaauucugcaccuagccguaauuagcuuuaaaaagccaauuacggcugggugcaguggcucacaccuguaaucccagcacuuugagaagcugaagugggaagauugccugaacccaggaauucaguaccuaucugugcaacauagugagacccugucucuaaaacaauuuuuuuuaauuaacugggcaugguagcacaugccugugauuccagcuacuuggaaggcugagguggguggaucacuugagcccaggaggucaaggcugcagugagcugugaucacuccacugcacuccagucugggugacagagugagaccgugucaccaaaaaaaaaaaaaaaaauuuuuuuuuuuuuaaagagaagccauauacaguaaaauuuaccaguuaccauaguacuuguaaacuuuuugcuuuuuucauuuaacauuuugccagagauggaacuucuaaucaucuuuagaacuaccuacaggaaacacugaguauuuugaauauuuaguuuuccaugguaacuuuugaccuuguuuuugcucuguuucacuuaggacaagaugaccucauccagcaucaagauaugaggaucuuggagcuaacgccagaaccagaccggccucgaauucugccuccugaccaacgaccucccgagccuccugaaccaccaccagucacugaggaagaucuagauuaucggacagaaaaccagcauguacccaccaccaguucuucauuaacugacccucaugccggagugaaggcagcccuguuacagcugcuugcucagcaucagccccaggaugaccccaaaagagaaggugggauugauuaucaagcaggagacacuuacguguccacuucagacuacaaggacaacuuuggauccucuucuuucucuucugcuccuuauguuagcaaugauggucuaggaagcaguucugcuccaccacuagaacgacguaguuucauuggaaauucagauauucagucuuuggauaacuacaguacugcuucaucucauucuggugguccaccucagccuucugccuuuucugagucauuucccaguucaguagcuggauauggagacauuuaccucaaugcuggucccauguuguuuaguggagacaaggaccauagauuugaauauagccaugguccuauugcaguccuggcaaacagcagugacccuuccacggggccagagaguacucauccuuugccagcaaagaugcacaacuauaacuauggugguaacuuacaggaaaauccgaguggccccagccucaugcauggacagaccuggacuucuccugcccaaggaccuggauauucacaaggauacaggggacauauuagcacaucaacuggcagaggcagaggcagaggguuaccauacugaguaucuguuuuuccucaggcacaucauuuuuaucuggaaagacuuuucuagcugcaauuuaaggcagcaauccaagagacuugaauaauaauaauucaacaacagcuuuauuuuuauguggagaagggucuugcauacaauaguuuaaaaaagacaaaaaaaaccuuugcuuaaauucaugcuguucuaaaaacuagaucgauuguacaucuucacaaauucuaguuaacaauuuuauuuuguauucuugcaguuuuaaguggaugcuaauuuuaggggcauaagccuuuuauggcccucuugcagaucuucugaacuaugcacauuugugcuuuuuuuguaaguuuggaccaacuuuuauguaacaaacagccccuccccaccuccaguuuuacaacaaucagaaagggcacugauuuauuugguauuuuucuuuuuacaaagcuaccuuuagucaaaggucacugucagucuuugcaccugcuuucaguguuauugugaaagguguacuuugugcucauuucagaaaauaaaacacaaccuuucucuugaugcaacaguuuuauaaaaaaaaaaauggucaacguuauuuuuguuuuguuuugcagauuaucaaagccuagcaaaaugcauuuaaaugaaauaguggguuuuauaugaaaacuaugggugggguggggagggaaaguaagugccuuaacagguaagcuuaaggucugaaaaaaauaguuaacuuuuacccccauuugucuuuuaaagggaaucaaugcauuaaaaaggcaagaaacucugaaguuucaggggcugccuguucaguuccuguuagguccauucccucugcuugucacacuuucuccuuuucugccugucuuugggcuguguugccuuucacuaccaccuucucuugauaggggagugagagcaaagaaagggaguagaacugcaaucaguacauauuguuugagaaguucuacaaaguuuugucauuuaaaugguugaaaguaauagcuccaggagaauuuuagaguaccauuuucuuucaggcugccauauuaucccuguuuccauuugccauggauaauuggagggucaugguauagaagcaagaguuaauaacagaacuugccuaaauguguuaaaguucaugggggagggguggcaaauaccguauuuuaaguuaugcaauugcccuuuuaagaaagucaauucuauucacuuguuaacuagaaacauugcuuagauugaauuuauugaagcaaaaagaaaaggcaaugagagagaacuuuuaucuuccuuccugucacauucuguaaaguugauuaugacuucugccagacuuagagcaacaacuuuaguucauuuuaacauuuuuuuuuaaugaagagcaucaaagaauggaguaguccuuauuuaaacuguaauggugucaagucucacugugugcacacucucacacauacacacacaauuauacuaauucuagaaaggaaccaaagguaaauaaccaguguuuccauuaucacuaaauggaaaaauugacuggaaguuagaguugugccaauuaaucauuuuguucaucaacuguucugguaacuuauuuuuuuuuauuggaaucuuaaauuggaacaacuguuacagaauguauauugcuccaguucuaaagccaguuaacccugugcccucuaacuuaugaaccuucauuucaaaacaguaugugggaaguccuguaguuugauaagaguaaaauuauuuuaaagaggauaauuuaccauuuuacuacuauaaaauaaguugauaucaguugaccauuuuauuuuuugauggacucuuuuuguugggagaaagaaaugaauggaagaaaaaaauauguugcuuuuauuugaauauugauuacuaacaacuuauaaacuacauugcaggaaaugaagaaauauuuugaaauuagcaaaauagcaacaguauucaaguaucugaaauuuuaauauggugagucuuagagcuuuagacuuuccuauaagugacaguaucuaaguuauucuuaauagucacacuugauaauucugcugaccauaagcagcuaaccuacaguugaagauauuuaugugacaugaauagccuguguuuuaaaaauuaaauauuuuauauaaaauugaa

SEQ ID NO: 192410 - RNA, 942 nt, Homo sapiens
augaauuggguaaaugacagcaucauacaggaguuuauucugcuggguuucucagaucgaccuuggcuggaguuuccacuccuuguggucuucuugauuucuuacacugugaccaucuuuggcaaucugaccauuauucuagugucacgccuggacaccaaacuucauacccccauguauuuuuuucuuaccaaucuaucacuccuggaucuuuguuacaccacauguacagucccacaaaugcuaguaaauuuaugcagcaucaggaaaguaaucaguuaucguggcuguguagcccagcuuuucauauuucuggccuugggggcuacugaauaucuucuccuggccgucauguccuuugauagguuuguagcuauuugucggccucuccauuacucaguuaucaugcaccagagacucugccuccaguuggcagcugcauccuggguuacugguuuuaguaacucagugugguugucuacccugacucuccagcugccacucugugaccccuaugugauagaucacuuucucugugaagucccugcacugcucaaguuaucuuguguugagacaacagcaaaugaggcugaacuauuccuugucagugagcucuuccaucuaauaccccugacacucauccuuauaucauaugcuuuuauuguccgagcaguauugaggauacagucugcugaaggucgacaaaaagcauuugggacaugugguucccaucuaauuguggugucucuuuuuuauaguacagccgucucuguguaccugcaaccaccuucgcccagcuccaaggaccaaggaaagaugguuucucucuucuauggaaucauugcacccaugcugaauccccuuauauauacacuuaggaacaaggagguaaaggaaggcuuuaaaagguugguugcaagagucuucuuaaucaagaaauaa

SEQ ID NO: 192411 - RNA, 3107 nt, Homo sapiens
aaggcacuuuacggccgucgugccgcucgugucagucaacauggaggcagaggaaucggagaaggccgcaacggagcaagagccgcuggaagggacagaacagacacuagaugcggaggaggagcaggaggaauccgaagaagcggccuguggcagcaagaaacggguagugccagguauuguguaccugggccauaucccgccgcgcuuccggccccugcacguccgcaaccuucucagcgccuauggcgaggucggacgcgucuucuuucaggcugaggguaaguaugcaggcccugacggugacaggaggagguugucgcucgcuggcggggugcaagcaugcauguccuguugcuucgcugcgcgaggcugaggcacgaguugcuggauuuuggggguggggagugcggugcuuggcuccuggcuggugaaucagucugugaggaugcuggggugggcgggcggaggggauauggggagaguggguagcgcagugugucuggugguucuuuaguucucggauuguuacuauuuguguucuuaucccggcucuguucaccucucuuuccggaccuguuuacugguuuguuacaugaauacaaccugaguaaaagucucgucagcuuuucuacaaaacugaacauaacucuuuagcauugcugccuaggucaagaaacuauuugaucaaccgccccucuucuuuccacccucaauuuuacauugaggcugaggacuugugccgguuuuaagcagcguucagggcuggccagauuaaggaguggacaauuaaggaaagaauugaguuagcuagaggaaagggugcgauuuacaguucccuuccuccugggcaaaaacucuucaggugggacucccacuggcagaugugaagaacguugcgggcagugggaggugcuuuugagugagugcugcauaggcguccuggacgggucuuugucuuuggcgcgcagaccgguucgugagacgcaagaagaaggcagcagcagcugccggaggaaaaaagcgguccuacaccaaggacuacaccgagggauggguggaguuccgugacaagcgcauagccaagcgcguggcggccagucuacacaacacgccuaugggugcccgcaggcgcagccccuuccguuaugaucuuuggaaccucaaggugagaagauagaucuuucugccacaccucucacccucccuucuccccaacucuggcccaaguauccccauggccucucauuggccuuguccccuugucucaucuuucucccuaaucugcacuauccugaucuuuucuucuuuucugcccacaguacuugcaccguuucaccuggucccaccucagcgagcaccucgccuuugagcgccaggugcgcaggcagcgcuugagagcggagguugcucaagccaagcgugagaccgacuucuaucuucaaaguguggaacggggacaacgcuuucuugcggccgauggggacccugcucgcccagauggcuccuggacauuugcccagcguccuacugagcaggaacugagggcccguaaagcagcacggccagggggacgugaacgggcucgccuggcaacugcccaggacaaggcccgcuccaacaaagggcuccuggccaggaucuuuggagccccgccacccucagagagcauggagggaccuucccuugucagggacuccugagggccuggguggccccuuccauuuccuggcccugcucugcuuccugucuaccucauacuagaaugaucgugacuacccgggcagacauuuuacuguguuucucagaccaagugucuacugauggcccaaacauggaguuuugugggcuuccacuguccccacuccgaacuccuguaugugccuggcugagucaccuaauucauacugucauacuagcauaauuaugacuauugcauaugcuuguuuuguuugacucuuggcugccuacgucuguaggguccccugaaaaucccacuuccugcccccagaaagggccuuuauuuccaacuaggaggauaaugccuaguccaggcaaucuuucucuguuuagcagucacaggugagggugguauuagcaucuuuuuuauguagaaaaaauugaguuaaugggguggacuggguugggaagaaauacauuuccuaauguauuuauagaaaauaaaaauauuuuuaugugccuuuuuauuuuuguugguggggaggucauuggacaaguuccaacuuucaucuuguguucccuucaccuucauauccugaucuuagagccccccucccccugccacccaccuuacuguuuaaccuggauuuuuuuuucuauuuaauuuuugucuaauaucuuagcccaguuuaucaaucaguuaucuuaagucagcauuuucuaagccauuguuugaggaaacagugacaauagguaauaacacaucuuaguauuaagaguuuuacaggccacuaguauaagauaggcaucgugguagaugcauauaaaggguggaaugggagccauggcaggucauagaguccucucaaugggaaccugauugaugaucacagucuucaguggugagucaguccucaccaaguuuuccagaucauuccuacaaaguaaacugggagaauaauaagucugaaagaguguggagugcucccacaauuacaaagaaugcuuccuggguggaguguugaguuggaaccauuguaaaggugggcaaagccuaguagagaaccagugcaccucaggugcacuuacauaugguggggcugaggcaaagcagcccuguaggcuucaaagaaucaguguaagccacuaaaaggaacugaaaaccuaggugucacaauaaacagucuacacagucucacguagaccaaaauucugaucauuuuccaggcuguugcaugaagugauagaguaugauuauaauuucuguuugcuugugcuguuuguuuuuguuuuucaucugucaaugugaugaucuguguuuuauaggguagaguggauuugucuacuuuggcuguaaaauacccuaaucacauuaugaucuugacaggugcacuuuacuggggagaauaaaaaggaccauacgguaa

SEQ ID NO: 192412 - RNA, 425 nt, Homo sapiens
augccugauccagcuaaguccgcucccgccccgaagaagggcuccaagaaggcggugaccaaggcgcagaagaaggauggcaagaagcguaaacgcagccgcaaggagagcuacuccguauacguuuacaaggugcugaagcaaguccaccccgacaccggcaucuccuccaaagccauggggaucaugaauuccuuugucaacgauaucuucgagcgcaucgccggcgaggcuucccgccuggcucauuacaacaagcguucgaccaucaccuccagggagauccagacagccgugcgccugcugcugccuggggaacuggccaagcacgccguguccgagggcacuaaggccgucaccaaguacaccagcuccaaauaaauggacgcauguucaaacccaaaggcucuuuucagagccacuua

SEQ ID NO: 192413 - RNA, 777 nt, Homo sapiens
caugcuguucugacaguuugagauuacuuauugucuuuucugggaagacaaaaacaugucggagacugcuccacuugcuccuaccauuccugcacccgcagaaaaaacaccugugaagaaaaaggcgaagaaggcaggcgcaacugcugggaaacgcaaagcauccggacccccaguaucugagcuuaucaccaaggcaguggcagcuucuaaggagcgcagcggcguuucucuggccgcgcuuaagaaagcgcuugcggcugcuggcuacgauguagaaaaaaacaacagccguaucaagcuuggccucaagagcuuggugagcaaagguacucuggugcagaccaaagguaccggugcuucuggcuccuucaaacucaacaagaaagcggcuuccggggaaggcaaacccaaggccaaaaaggcuggcgcagccaagccuaggaagccugcuggggcagccaagaagcccaagaagguggcuggcgccgcuaccccgaagaaaagcaucaaaaagacuccuaagaagguaaagaagccagcaaccgcugcugggaccaagaaaguggccaagagugcgaaaaaggugaaaacaccucagccaaaaaaagcugccaagaguccagcuaaggccaaagccccuaagcccaaggcggccaagccuaagucggggaagccgaagguuacaaaggcaaagaaggcagcuccgaagaaaaagugaaacuggcgggacguuccccuuugaaaauuuuaaacggcucuuuucagagccaccca

SEQ ID NO: 192414 - RNA, 38033 nt, Homo sapiens
aagcgcgcaugcgcgcuucgucacaagggugcgaggaaagucagugagcaaaucgcggaccaccggggcugccagcucgccugacucccggccucuugcgcuccuaggggcggagaagggugcgggcucuucgcccuuuguguccuccuucuuucacuaacuucuggacuuuccagcucuuccgaaguucguucuugcgcaaagcccaaaggcuggaaaaccguccacgaugaccagcaugacucagucucugcgggaggugauaaaggccaugaccaaggcucgcaauuuugagagaguuuugggaaagguaugggaaagguaggggagaagccguggcuucuaaugaaggaaaagaaagcaccgugcuuggugccguugugagcuuugaauaauuaucucuuguuagguuguguucuaguacgccuguaaauucaccuuaguaauaaugauuauuacuuuaauggagccccuaaauaugcugggucgaacgcguaaguucucuaucuaaacauagauaaguaugguuaugacucguggagacaguuccaaggcugggagggacuuuggaguuugauccuucaaccaacaaacgucugcauugcuccagagaagaguaagagaaaccucugcauuuaaggcacauuacagucuaauucucuaggcucuagaagauuagaagauaaauaauugcaauaagguacaaaagccaagugcuugguagaguggugaacgaagggagaaguuguuccucuguagugguuugggaaauuucucaaaggcacccaacuccugaagaaguaaguuagcccuuggaggaagacugagugcuuuucugagaccagcacucacaaagcccgaagguguuuguuuguuuuuguuuuuuuaggaugagguuucgcccuuguugccuaggcuggagugcaauggcgcgaucucggcucacugcaaccuccaccucccugguucaaacaauucuccugccucacucagccucccgaguggcugggauuacaggcaugcgccaccaugcccagcuaauauuguacuuuuaguagagacaggguuucuccauguuggucaggcugcucucgaacucccgaccucaggugaaacgccugccuccgccucccaaagugcugggauuacuggugugagccgccacgccagaccuugaagguguuuguuguuguuguuguuuugagauggagucuugcucuguugcccaugcgggagugcagugacacgaucucggcucacugcaaccuccgccuccuggguucaagugauucucaugccucagccuuccaaguagcugggaugauuacaggcaugcgccaccaagccuggcuaauucuuuauuuuuauuagagacaggguuucaucauguuggucaggcuggucucaaacugcugaccucaggugauccaccugccuuggccucccgaagugcugggauuacaggcaugagccaccaugccccgccaaaagcagggauuuacugaaaaugaaaggacacuccuguguuugggguguggagcagcagcucaggggcccuaauaccccauugaagucuccuauuggccacuugguacucaucucauguaaaugaaguggugacccacaauuggcugugaaaagcaaccaaugaaaggcuaaagugaaguuacaaaguugcccuuauaugcaaacgaagacguggcgugcaaucagauggugaaguuacauaguuacacuccuaugggaagaucugauugguugcagaaagaauaauuuuuuuuaagggauaacuuacuucuuagcguaauuuugcuuuuugcaaccaaucagagguacuuucaauuucccaucugccacacagaaaagguggggguuuggaaagggagaagccucugguucuuuuguuacuuggugugggaaguuaggguuuuacuuucaauuuaguucuaggaagucagcgugaaacagcccuagguucccugccuccagauccgauucuccugccucgcuuguaagaaaaucaugcuccauaagaagcauuuauaacuaaaccuugugaaccccaaaaauuugagacagguaucaguuaauuuagaaaguuuauuuugccaagguugaggaugcgcacgcagugacacagccucaggagguccugacaacaugugcccaagguggucagagcacagcuugguuuuaugcguuuuagggacauauaagacaucaaucaauauauguaaaaugaacacugguuggguucggaaaggcgggacaacuugaagcgggaagggggcuuccaggucacggguaggugggagacaaaugguugcauucuuuugaguuucugauuuaccuuuccuaaggaggcagucagauacacauuuaucucaaugagcagagggaugacuuugaauagaaugggaggcaaguuugucuuaaguaguuccuagcuugaauuuuccuuuuaacuuagugauuugggggcccaagauauuuuccuuuacauuugcccccuuuucuuuuuuuuaaaaaaaauuuuuuuuuggagaaagcauuuuagaagaaaaaugagucuuuggucccagauuucaucugaucgcucaugcuaggaugguuuauuccuagacagguaagucccaaguuauuaggaaagcuaauuuuuagaaggcugugaacucccaugucuugugaagagaaaauagggggaggaagggugaaaaacaacaaacaaaagaacaauccuggaaaauauacauaggccacguuauucugaaguccauacaucaguaggcagguaugaaaguggcuuaugcguguaaauagguugcuguuauuuucuucugaaguuuaaguugucuagcuucaguuugcagggcuuuacaaaagcacagcuguuuucagugacuccuaauuaggaaaaaaaaggaaaagaaaagaaaaaaauuaaaaauauuauuuuggagacuuguagccaggaaaaauuagaauucagccuaaacuguagaaaauaauaaaaauugaaaaaauuaggcaagacuaguaucuaacaacaaguggacuguaaguuuugaaacaauuuuucucucuccaguuuuccauuuuuacuaaagacaaaucaugguaggacugauuugcuuuauuauauuugaccagauuauuuauauaaaguguagcaagaauaauuauuuuucacauaggcuuuuuaaaauuggcuuugaaggaacuuuguuccauagaaggaaucucagauaagauucuuuuuaaagccaagcucagccauggauuuguaccaucaaauaccuaugaguagggugaauuuccucuuuuugauguuccaugauaaaccaggggcuccuggaccugucagaaaaugacauucuuuacuuagcacauaucagaaacccuguacagggacuuuguaaagugugaggccaguuuucccaagggcuuuuauuggcuccauaagucagguuugauuacuuaaaggaaaguacaccuuuccacucaaagccuugguaaaauaaucaguuucuccaacuguguccuguuacaaaugaaaacagauucuuacugcacuuaugcaaauaacuguauuggcacaaguuaagaauacucacaaauaguuuacaaauucuggagaaaucagguagagagaaacaaauaugcuccaaauuuuguugauuggaguauacuaaauuguuaaaagcugucaauagcucaaaagaaaaguuucaaggcucugaaaaacaaagcaaaagaucagcaauguuuaagcaaaaagucaaaaagauuaguucaguccccuuaguuaauuccuauucugcuugauauucaugagcauuuuagcucuccaugaguucugaaaguuuuuccucuauucucauguaacaaucuccaaaguuaauggagaccugcauucaagaggaaacaacaggugcuggagaggauguggaggaauaguuacguuuuuacacuguuggugggaguguaaacuaggucaaccauuguggaagacacuguggugauuccucaaggaucuagaacuagaaauaccauuugacccagccaucccauuacuggguauauacccaaaggauuauaaaucaugcuacgauaaagacacaugcacauguauguuuauugcagcacuauucaccauagcaaagacuuggaaccaacccaaauguccaucaaugauagacuggauuaagaaaaaaugacacauauacacgauggaauacuaugcagccauaaaaaaggaugaguucauguccuuuguagggacauggaugaagcuggaaaccaucauucucagcaaacuaucacaaggacagaaaaccaaauaccgcauguucucacucauaguugggaauugaacaaugagaacauuuggacacagggcagggaacaucacacacuggggccugucgugggguggggggaugggggagggauagcacuaggagaaauaccuaauguaaaugacgaauuaaugggugcagcaaaccaacauggcacauguauacauauguaacaaaacugcacguugugcacauguacccuagaacuuaaaguauaauuuaaaaaaacaaauuuaacaaagaaaacauuaucaagaauaaauaaugaaucucaaaaaacaacaacagcaacaacaaaaaaaaacacuuucuaaagaggaccaaaacaacacaacaauugugcguggaugacuaaaaguuuuagggcagccauaggcaaagacacaauugacaaggaaauuugauaccucuccucuguagcacacaauaauuuuaacguaacaauuaugauuauuacugauaauguacacuaggucauaucagaauuacaggaauuucccauaauuuuggaacacauaccaauaacauauuuauacaaauacaucucaaagaaagccaaacacuguugcauauuugacaaugcuuccuguguaauuuuuguaccaaauaagccaaauuaugccauuuuuggacuucagggaaucuaauaucuuaaaggacuaauuaggucagaaaaagacauaauuuauaauuugauuuuggaaaguuugucaaauaucaaauguuuaaaacaccugauaucacaaaaauaggaucacaggucauuauaaaauaaaucauucauuuaaccaaagugauaacucaaggauuucauaaaaaggugaaaaccuucauucuuugagagaggggacuuaacuuuccaaacaauaagcccuaauaaaaacagcaugaagcuaauuaaauuuguuuucaaaauuuuauaaacaaucuauaaaauuuuaaacuugaccauaagauauaauuucuaacugggcgugguggcucacgccuauaaucccagcacuuugggaggccgaggugggcagaucaggaggucaggagaucaagaccauccuggccaacauggugaaaccccuucucuacuaaaaauacaaaaauuagcugagugugguggcacgcgucuguagucccagcuacucgggaggcugaggcaggagaaucgcuugaagccaggaggcggagguuacagugagcugagauugagccacugcaguuccagccugggugacagggcgagacuccaucucaaaaaaagaaaagaaaacaaaagauauaacuuccauaagccuuuauaaccuuuauuaaggagucaguuaaugugucaagaaaaccuuguuaaucugauuacaggggcccauaagcugaucuugcaucauugugccuuugacguuaaucauuaauuuauagagaaacugaacuuauuuuaucuuucaaauuuggaccuuacagucuuaccugcccaccucuucuucgauagucucugggccuugaggaguugaaugccuuuaauuucuggccguguaucucaggaaugcaguuuauuuugauuggcgucuucuacggggccugaagaugacagcuucaauugcugucaguguuuaagauuuaguaggacuugguguccuuuuuagacccaggagucaaagcccuguaaccuaaggucacaaggacuuuaaaagcacauacaggaaaauacccaguuguaaucauguuaauuaaaaaaucuuuuuuuaaucucaguuuuuuccuaaacauaggaauuauuucaacaaaauguaaacucuguuaggucaguuaccaaaaagcaaaagaaaagaccuucugcaaugcacagaacaugauguuggaagaaaacacuuccuuuagaccuuuaagacagugugccuuuuuaaaggggagagaaagcugaaaaaaaauggcaagaugcaauaaaaauugaacuuucaguuuuaaaaaaaaauuaaauucucuuauaauuuuuuuuuugaaauagagucucgcacuguugcccaguuuggagugcacuggugcaaucuuggcucacugcagccucugccucuuggguucaagcaauucuugugccucagccugccaaguagcugggacuacaggcacaugccaccaggccuggcuaauuuuuguauuuuuguuagagacgaggugucacuacguuggccgggcuagucuacaacuccugaccucaagugauccaccugucuuggccucccaaagugcugggauuacaggcagaagccaccauucguaggcaaauucucuuauaauuuauuaagaguaaguuaaccccuuaagaaaaguuuauuuuucuaaccaauaauuucguguauaugugucuuuuuuaacaugaagcccagucucuagaaagagcauuauaauuuccuuuuaauuguaaacaugaucauauacaauuuuuuuaaaacaaauccucuuauugugacauacacagaccauucaugacaugcuugaacuuuuaucuuaggacuaaauuuaccauacaguauucuuucucauguaaaauuauuucuaagcuuucuuaccacauacaaaaaaaauuuguuuuauaacuuccuuuacaacaucucucuuauuuccugauuccuuuaccuuguuguauacauaaccuuuaaauaaguuuugugggguuuuuuuuguuuguuuguuuuuuaucugagacagagucuugcucuggcacccaggcuggaaggcaauggcccgaucuuggcucacugcaaccuccaccuccuggguucaagugauucuccugccucagccucucgagucgcugggauuacacgugcaccacaaugcccaacuaauuuuauauuuauaguagggacaggguuucaccauguugaucaagcuggucuugaacugacuucaagugaucugcaugccacggccucccaaagugcugggauugcaggcaugagccgcugccccuggccuaaauaagcuuugaauuagacaaaacuuguucaccguuuuugggggguuuuguuuguuuuuuuguuuuuuugagauagagucucauucugucacccaggcuggagugcaguugcgugauuucagcugagugcagcgucugcuuccuguguucaaguuauucuccugcgucagccuccugaguaggugggauuacaggcgccugccaccacgccuggcuaauuuucauuuuuuguauauuuaguagagacaggguuucaccauguuggccaagcuagucucaaacuccugaccucaagugaucugacugccuuggccucccaaaaugcugggauuacaggcaugagucagugcacccagcccuagaguucaacuguuuuuuuauuuucuuauuauacuuuaaguucuaggguacaugugugcaacgugcagguuuguuacauauguauacaugugccauguuggugugcugcacccauuaacucaucauuuacauuagguauaucuccuaaugcuaucccuccccccuccccccaccccacgacaggccccggugugugauguuccccacccuguguccaaguguucucauuguucaguucccaucuaugagugagaacaugugguguuugguuuucuuuccuugaaauaguuugcugagaaugaugguuuccagcuucauccgugucccuacaaaggacaugaacucauccuuuuuuauggcugcauaguauuccaugguauauaugugccacauuuucuuauuccagucuaucauucauggacauuuguguugguuccaagucuuugcuauggugaauagugcugcaguaaacauacaugugcaugugucuuuacagcagcaugauuuauaauccuuuggguauauacccaguaaugggauggcugggucaaaugguauuucuagguguagauccuugaggaauugccagugucuucuacaaugguugaacuaguuuacagucccaccaacaguguaaaaguguuccuauuucuccacauccuguccagcaccuguuguuuccugacuuuuuaaugaucaccauucuaacuggugugagaugguaucucauugugguuuugauuugcauuucucugauggccagugaugaagagcauuuuuucauguaucuguuggcugcauaaaugucuuauuuugagaagugucuguucauauccuuugcccacuuuucgaugggguuguuugauuuuuucuuguaaauuuguuuaaguucuuuguagauucuggauauuagcccuuugucaguuggguagauuguaaaaauuuucucccauccuguagguugccuguucacucuaaugguaguuucuuuugcugugcagaagcucuuuaguuuaauuagcucccauuugucaauuuuggcuuuuguugccauugcuuuugguguuuuagacaugaagucuuugccuaugcccugaaugguauugucuagguuuucuucuaggguuuuuaugguuuuaagccuaacauuuaagucuuuaauccaucuugaauuaaguuuuguguaagguguaaggaagggauccaguuucagcuuucuacauauggcuaaccuguuuucccagcaccauuuauuaaaagggaauccuuuccccauuucuuguuuuugucagguuugucaaagaugagaugguuguagaugugugguauuauuucugagggcucuguucuguuccauuggucuauaucucuguuuugguaccaguaccaugcuguuuugguuacuguagccuuguaguauaguuugaagucagguagcgugaugccucuccagcuuuguucuuuuggcuuaggauugucuuggcaaugcaggcucuuuuuugguuccauaugaacuuuaaaguaguuuuuuccaauucugugaagaaagucauugguagcuugauggggauggcauugaaucuauaaauuaccuugggcaguauggccauuuucacgauauugauucuuccuauccaugagcauggaauguucuuccauuuguuuguguccucuuuuauuucguugagcagugguuuguaguucuccuugaagagguccuucacaucccuuguaaguuggauuccuagguauuuuauucucuuugaagcaauugugaaugggaguucacucaugauuuggcuguuugucuguuauugguguauaggaaugcuugugauuuuugcacauugauuuuguauccugagacuuugcugaaguugcuuauccgcuuaaggagauuuugggcugagaugaugggguuuucuaaauauacaaucaugucaucuacaaacagggacaauuauagaaggacuggggguccuucuauaagcauuucuaauagaggguccugccuugccgcucuuuuggcuucaauauccgcuuggcaguuccuuucuguuucccuuuccuuucuggugacucuggcaguguaagacugccaccucuuuagguuucuguacagccaauaguaaucuccuaauggcuuccugauguuugauagguguucccucggaaguuaggaauuccccucucuccauauugcugcaugggcauggaggacuagguaagcguacuuagagucuguauauauauuuacccuuuucccuucuccuaauucuagugcccgagugagggcuauuaguucugcaugcugagcacuaguuccuggagugaggggauuaguuucaaguauuccauuaucacugaccacugcauaccccgcuuuucaaaguccuuuuucugcaaaggaacuuccaucaguauacaaguugagguugggaucagucaagggaaccccuaaaagguccccuugagcagcauuagguuugagcaaucacauguuggcauuuauguucuaucuuuucuucauugucuggaagaaauguggcuguguuaagaguugcacaagugcgcagucacaccacuggcccaucaaguaauagagccugauauuuaaguaaacgguugucugacagccacaagucuccuuuagcagugaguaugccauucacaucaugagauguucacacaguaagaucucuucccuguauuacuuuaacugcuucagauacuaagacugcuacuguugccacuacccguaaacaaugaggccaacccuuugccaguacaucaauuuccuuacucagguaugccacagguugcaagcuggucccucggaccuguauaaggacuccuagagcuauuccuguuucuuuugcgacauauaaagaaaagucuugccccauuggcaagcuuaccacuggggcuuggguuagggccuucuuuagggccugaaaagccacuucugcuucagguguccaucuuacuaaauggguauuggcuuucugaguuuccuuaguguguauaauggccugacuauuucgcuguaccugggaauccauauucggcagaagcuuguuaugccaaggaacccucuuaguugcuuuaggguuuugggaugaggauaagccaguauaggcuggauacguuccucacugagggcccuugugccuuuggauaauuuuagcccuaaguuuuuaaccugcugugagcagagcugagcauuuuguuuggaaaccuuguagccacagguagcaaggaaauuuaagagugcuuggguggcuugauggcaccagguuucugaucggguggcuaaaauuaaaucauccccguacugaaggacaagaguguccagguaugagaauuggcucaagucuugggcuaaugccuggccaaauagaugggcgcuaugcuugaacccuugggguaaaacaguccaggugaguugagacauuggguucaaaggaucuucaaaggcaaacaagaauugagagucaggguguacagggaugcagaaaaaggcauccuuaagguccaggacuguaaaccacucugcuuucugugguuuuugggaaagcagaguacaaggguuagguauagcaggguauagaggaagaacagccucauugauaauccugagaucuugcacuaaccuccacuguccauuagguuucuguacuccuaaaacuggaguauugcaggggcuauugcaugguuuuacuaggccuugggcuuuuaaguccuuaacaaucuuuuggaguccuuguugggccucaggucuaaggguacugccuuugguagggaaaggagguagaauccuuuaauuuaacuugaauaggacaggcauucuuugcucauccauauuguccuucuguugcccagacgucaggauuaauuccuuccucaagcaggggaaaacaaacagguguuccuucuccuauguucagauauauaauggccccugcuuuugcuagaaugucucccccuaacaagggaguggggcuuucaggcauaauuagaaaagcaugugaaaagaguaaaguuccccagucacaacuuaguggcuguccuaggaccccucggauagugacagaucuggaggacaguugucugggacaggagaguaagacugagaaggccaugccaguguccaggagacaguuaaccuccuggccuucaauguucaagcauacccggggcccugugagggugauggcaugggcuggugcuugccccgggcacccucaguccugcugcuggaucaucugguuaguggcuucugacucagaggaccuucguccccuggggcaaugggccuuccagugauucccuugacauaaggggcauggacgagggggcagcuuacuucuacuuggacaaucuuuuuuaaaguguccuuguagaccacacuggaagcaagccauauuaggcauucgauuugcccagcuuuucccuuuuccagagacuccaaaguccgcuugccugagggccaugacuaaagcaguggccuuuuuuuuuaucccguuugucccauuccgccugcuucuccugaucuguauuauaaaaaaccgagguugccaaguucaauagggucuaaguuuugcucugggccuaaggcggacuuuugaaguuuuuuucuaaugucugcaguugacugagugauaaacuuauccuuuaagauuaguuggccuucaauagagucaggugacagagagguaugcuuccucaaugccucccuuagucucaccagaaaggcaguaggauuuucuuccuuucccuguguuauaguggacaucauugcauaauucauaggcuucuuccuaguuuuccuuaguccuagcacacaaguuagcaaaugucugcggcaccaauuuccauguucugauucugugucccaaugagggucuacacugggaacugccugcuggccuguggggaauuguucucuuuccucuguugucauccuaucauugaccugacugagauaccagagaucaccaaacucuucgggcugcaguuauggcgacacuucucucauuugggguuagugucugauuuagcaguaacauuauaucucuccacaucagaucaaaagauuguccuaacccuuauaaaacuucaguauagccaucaggguuaucugagaauuuaccuaggucuauuuuaauuugcuuuaagucugagagagaaaaagguacaugcacucuggcugggccgaauucugcuccucacauugcuuggagggggcauaaucggggaauauuggcacuguuugguucauuguuuaucccuuugucuaucuucuuuggaccuuuggguaaaaggggggucccuuauuaguugcagaaggagucggggggaugcugagauagggaggcagacucugagggcuuccuguagggcauaaaccacacuuuuuacauaauugcgaguugucucuuaaugaaaaggaaguuugcacauauggcacuucacuccauuugcccuccuuucuacagaagaggucaagcuguaagaugguguuauaauuuauacuucccucaagaggccagguuucucccccuugaagaggauaucauggccaggcaguacugcagaagaauauaagucauuucuuucuuagcgucugagggucaaauugguccuuauucuccagaauacaucuuaagggcguuuuugccuugggguguggggaacguuuccgaucugaaaaaagaacauagggaugccagcaccccuagucauuuuccgaugagcauuaguccuaaagcauccucuaagggccuaaugcuuauucuuuuccagggugcguaaccacccauggaccucugcuuaucggauuaguuacgcucaccaauguagcaguccugcaccuauuuuuccaccucucuugaccacaaagaaaggggucugggcugcuggauucuagugguccuuuaccagcgugcccgacauugcuuuugcgcucaggggugaguccuagagcugggcuggguuccuggguauuucauaacaacccagcugccccaucaagaugcauucccauaaacaacacucuuaugcaaauucguuucagagagguguagcgaaccuuuugagucaggauugaaauagucuuuugauuauguaaguaugggcuuggcugagugcaaacagcucgcacguuugaggagaccaauuauuaggcaauuuuucuaacucugcuuccacagagucucuguauuaauuacugaauaccuauugugguuuuuucccucaaucaccugggaggaaccaucuaucguccuguccugaagggaguuccuccuaggucuggucggaccuuuguaugguaauuaagauuuaaauccuuuguuaggaaaucugcuggguuaagugaauuaucagugguuggaguuacauuacccuuuucuaacauaauagccccauacuuuaagauuuuugauuuaguaagcuaccuuuuugcuuuuuuuuuaacuuagaauaauguaacuggugaggugugcucacaagaagguuuccucuaaaaguuacuuuucuacuuuuagcaaagcaguugccgcuaccgacugaaugcauuuggcccauccgcggguuacuggguuaaggauuuuuuauaggaaagcuacagguugccaguggccucagugcuuuugggcuacgcccuuauuuacauugacaacagugguauuggaguauuauagagucauagagaagaccuucaauuaucaauuacagguuuuaaauuuacgcuggcuuuuaaaggaauagggcacacuuuuuuuuuuuauucuaucuuuuucuuucuuuuucucuuugacucugucuuugucucucucuccgucucucccucucucuccgucucucucucucucagccauuacaaacuuggggcccuggcaaggguaguggggaacgggucccacauaacugcccaugucgagagcugcauaccugaaucaggagggacaccagggauaagacucccuggguuacagcccaggugccuaaggacacaacgcagagccucccuagaucccuuuggagauacaacuugcuagaggaaaugaaagugugaaccauuaguaccuaggaggcagggaucagaggaaguagauucaaagguaaggagaauuuuggggcuacacuuucaagaaagucguggucaggacccaugagguaugggucagaaggaaagguaggggcgcacccaugggcgacuguugaguagagacuucuggcugcgccaugaucucaacaggcuaaugccgggaguucuggacgacagcuuucugccucuagucagcccucggauuccccaagaaaauugaaaguggaagcuggcuccaagcagaccaacguccccaacccagaaggguuggggguuguuagaaagcccuuccgcagauagcguaacaccugagucuuaaguccggcggccacgcuaaucguuuuuaacuggcugacaggugcccaguauuuuccuccaauucuaaggaaggauaggacagaauaacaagcgaaagugguccaauauuacucaccgcuuuggaugucccuucguggucaccaaaauguuaccggggguccuugcuuccagagcucccaagaugguugugggccacuuccacaaugguggcaggccacuuccaagaugguggcaagccucguguucucuuaccugggguucuuggccucacggauuccaaggaauggaaucuugggccaugcggugaguguuauagcucuauuagaagacaugggucacggaagagaaccguggaacccagugacuaguguucagcuugauuaggaugaacccaggcacuuagcugugcaggaacaauggcaagccuuuagccugauugggaguggcaauggacaccucgcuggaucaggagcacagcggacacccugcuggauccggagggaugggagucaguggugggucugcaguggcaggucugcgguggcgggucugcgauggcggcaaacagcagugguggauggcgagcgaaagcucagcucgagccauaacaaacauggaccagaagagugcaguuacaagauuuaauagagugaaauagagugaaaacagagcucccacacaaagagaggggacccaaagaggguugcuguugccagcuugaacgccuggguuuguaucccgauccuugucccucccacugugcucucaggcaauagaugauuggcuauuucuuugccuccuguuuuugccuaauuagcauuuuagugagcucucugauugguugggugugagcuaaguugcaagccccguguuuaaagguggaugcggucaccuucccagcuaggcuuagggauucuuaguuggccuaggaaauccagcuaguccugucugucaguuugagccauaaaguuagcucaugcugguaccaagcacugauaggagauuugucaaaggucaggggcaccuccacucagaucccuuuaugguuaccaaaugugaaccccaaaaauuugagacaggucucaguuaauuuagaaaguuuauuuugcaguugggcccgguggcucacgccuguaaucccagcacuuugggaggccaaggcaggcagaucaucugaggucaggaguucaagaccagccuggccaacauggugaaacccugucucuaccaaaauacaaaaauuagccaggugugguggcaaaugccuguaaucccagcuacucaggaggcugaaacaugaaaaucgcuugcaccaagaggcggaguuugcagugagccgagauugugcugcugcgcuccagccuggguggacagagugagacugucucucucaaaaaaaaaauuaaguuuauuuugccaagguugguucugaugacgugcccaagguggucagaucacagcuugguuuuauacauuuuaggagacaugaaacaucagucaauauauauaaaaugaacauugguucggucuggaaagguaggacaacucgaaguagggagggggcuuccaggucacagguaggugggagaccaacugcugcauucuuuugaguuucuaauuagccuuucuaaaggaagcaaucagauacgcguuuaucucagugagcagagggaugacuuugaauagaaugggaggcagguuugcccuaagcaguucccagcuugaauuuuccuuguagcuuagugauuuuggggcccaagauauuuucuuucacagcgugaaaaacaaaagcccuugguauugucagcuucuugaguuaguuaaccuaagaacguuuaggggguuucauaaauguuuuaaugcaugcaugucuguuuuucugauuaagauagaauacugggaaauuuggaaguggaguuuaaacacagaaucagcugcagucauguauagguccccuccugaaacacaacucucaggcuguguuguaacaacguauauaauaacugucccuaacuaucucucagggcuuuugugaaaaauagaggaaauaauacuuagacaaauacauuuaauguuuucaaauggcaaauggcauaaaauccaagggcauacuauuugauaguaacucuuugaaagauaaguuauccagaaaaggauguauuggccuaaggggaucuuugaauuccuuaaaaaucuguagucauuuuccuugguaagcuuucaacaacuucaugaguguguaucuucuugugauaaucuugccauggguuggauugccuuugaguauccgguuaaaauccucauaccuugaacagacacacuggaauagucauaaacuacauccuugccuaaguuggcagugaugguaacuugccuuccaagaagacugauaugcccguugaaccagaaguugcaguacggcugaaguguccagauuagugcuaacugguggaaauacaauguaagcuacaaugugagugauaucuguaguuauaaauuguaaaauagccacguuuuaaaaagugaaaagaaauaggugaaauuaauuuuaguaauacagguaacaguauauaaaaaguguuaaucaggcagacauggucucaugccuauaaucccagugcuuugggaggcccaggugggaagguuacuugaggcuaggaguuugagacuagccugggcaacauagcaagaccccuucucuacaaaaaauuaaaaauuuuccaggcaugauagugcguagauguggucuccucuucucugaaggcugaggcaagaggaucccuugagcccaggauuucaaggcugcagugagcuaugauuguaccacugcacuccagccuggugacaaagugagacccugucucuaaaaaaaauuuuuuuuuaauuuuuuugagucuuaaaucuuuccauacuuaauuuuugaaauccagugugaauuuuauacuuacaguacgucugaguucagacuagccacauugcaagugcucaguacugacguggcuacuggcuguugaacuguacagauugauaccauuguagguacuuuguauuugcuaauuugaucuaaaagagguuuuguggcuguuuauguuuuguauaggcagaguugcuagggauaaaguauguauuuaugcauaguaauucauaaaucuaguuguagacauggucucuuuccuuuuacuguacuuuuuuuuuuuuuuuuuuuuuuuuuuuuuuuugauacagagucuugcucuguugcccaggcuggagugcaguggugcaaucucggcucacugcaagcuccgccucccggguucacaccauucuccugccucagccucccgaguagcugggacuacaggcgccugccaccacgcccggcuaauuuuuuguauuuuuaguagagacaggguuucaccauguuagccaggauggucucgaucuccugaccucaugauccacacgccucagccucccaaagugcugggauuacaggcguaagccaccgcgcccggcccuuuuacuguacuuuuuaagguaauauuaacuacacaagcuguucucaguuggaggugauuuugcuccccgagggacauuggcaaagucuggagacauuuuugagggacacuacuggcaucuaauggauagagaccagaaguggugcuaaauaucuuacaguguacaaaucugugcccuauucccccacaacaaaaaaguaugcaguccaaauguucauagugcuaaagugaaaagcauugacuuagaacaaagauuaacagucaggcugaguaccauagcgcacacuuguaaucccagcacuuugggaggccuaggugggagaauugcuugagggcaggaguucaagaccacccuggcuaacauaggguguuagacucaaucucaauuuaaaaaaaggaaaaaaaaaaagguuaaccgucagacuaaauguccugcucuugauauaaagaucacuuuuaaauuugucaacaaacuaaguacugugggacuauaaagaaauacuaaccauaguucuuggccucuaggaauuuauaaccuaggaauggaaaguguauugcaaggaagagucccaucagagguacuguuuagaaaaggaguuucaugaguaaguucaggaaacacugauguauccuuuuuuaaaaauuuugguaaaauacacauaacauaaaauuuaauaccuguguuaguccauuugcguugcuauaaaggaauaccugagacuggguaauuuauaaagaaaagaggauuauuuugacucacaguucugcaggcuguacaagaaguggggugcuugcuucuggugagggcucaggaagcuuacaaucaugucugaaagcaaagugcaagcaggugcgucaaauggcaagagagagggagugccacacucuuuuuuuucuuuucuuuucuauuuuauuuuauucuauucuuuuuucuuuucuuuccuuccuuccuuucuuucuuuucuuccucuccuuucuuucucuuucacucuuucucucuuucuucucucucuuucucucucucucuuuucugucuucucuucucuucuucuuuucuuuucuuuucuuuuuucuuacaggaucuuacccugucacccaggcuagaguacaguggcacauucacagcucacugcagccucaaccuccugggcucaagcaauccuccuugucucagccucccauguagcugggaccacaggggcgugccaccaucuccagcuaauuuuuaaaauuuuuuguaaaaacaggccucacuuuguugccuaggcugcuacacucuuuuaaacaaucagaucuugcaugagcaagaggggcaccaaaccauucgugagaaaucuauccccauuacccaaacaccucucacuaggcccuaccucagcauuagggaucacauuucaacaggagauucggaggagacacacaccaucuuaaccauuucuaaguguacaguuuuguaauauuaauuacauccucauuguuuugcaaugauuaccacuauccaucuacggaagucuuuccaucuugcaaaacuggaacuacgacccauuaaacaauaacucuccauuucuccuugcccccagcucuggcuaccaccauucuacuuucugucucuaugaacugacuacucuagguacuucauauaaguggauauguuguaucccuuuuacauauuaaaacuuuugaguaguucugcaguaaauaaauaugcuuaacauuaucguguuuaaguuaguugccauugaaacuuuucucccacaguaacacguggaggaacauacguugggaauaucaacugacacgcacugugcuaggaucuagaaauaccauguggacuccaacacacauagaaauaaggaaguggaauuccaaaggaaggcaaaguguaaagucaucuuuauggaaaugagugaugaaggugaauaccugaaugagaugucaagaggaggaacacacuggagagaagcaguaaagauuuaggacugaaccuuaaagacauacaggcuugagagaaagaaagcauguaaagaagacagaaaugguuagaaagguaagaauagaauuuuuuuuuuuuuuuuuuuuuuugagacagagucucacuuuauugcccaggcuggaguacaaugguacgaucuuggcucaacugcaaccucugccucccagguucaaguauuucuccugcuucagccuccagagcagcugggauuacaggcacgcgccaccaugccuggcuaauuuguguauuuuuagcagagauggggguuucaccguauuggcgaggcuggucucaaacuccugaccucaagugauccuccugccucagccucccaaagugcuaggauuacaggugugagccaccgcacccagccagaagaauagaucuuauacuuacuauuaauagaaaaacuuauagauuuuggacugacuacaaaagggcagugauauucaaaauugaucaacaugauacacaaauagauauuuucaaguucauuggucauuaaaacugucuuauguauaagcaauacacaagacaaaauaaggcauuuuuuuuucaaagaucuaugcacaaaaaaauuuguugcagcauuauuugugauaucaaaagugggaaauagcugggcaugguggcucaugccuguaaucccaacacuuuaggaggugaaggcaguaggauagcuugagcccaggaguuugagaccagccuaggcaacaaaaugagaucccaucucuacaaaaaaauaaaaaaauuaaccaggugugguggugugugccuguggccccagcugugcaggaggcuaaggugagaggaacccuugagcccaggaggucgaggcugcagugagcuaugaucaugccacugcacuccagccuggacaacaaagugagacccugucucaaaaaaaaaaaaaaaaaaaauugugugaggggaaauaaccuaaauguccaaccaugggagaauuaguaaaagaaaucacagcaacugcaugugacugaguccuguguuacuauaagucacaucuuaaaaaugacuuacuaacaggagcaugucauuaaaugaugugcaccuuaaaaacuuagaaauuucaauuguuuauuuuuaaaaacaucuacauagcacuaugugucaggcacuaugcacuuuguucaucugaacucaucuuuuuauggcgagagauacaauaaaagucaaaauacaacggucuggaauuucaccauaugaauugguguuaaaaucugauagguaaaaagaacuguagagacagacuguaauagguaaguaggcacaaaagacauaaauaggcuguucacagaaaaaaggcaauaaacauuaaaggaugcuuaaaagcacugugagucuggcuaaugcaaauuaaaaccaugagauacuauguuuugcuugucagaguguaaaaauuaagguaauaugcaucuuugaaccuaggagguggaggcuacagugagcugagauugugccacugcacuccagccugggcaacgagaaaaagacuccgucucaaaaaaaaaacaaacuuuaaaauauauacucuuaauacccagcuaucuaauuuugucagucugucauauacaaauaaagcaucuuugugaugguaaaaaaaauauagaaauaacacauuuuaagaaauaguuugauaaauuguaguauauucauaguagggaauaccacacagcuauugaaagagaucuauauacauugggcuggaggcugcgcaugguggcgugccuucuccuuuugggucacuuaagcccaggaguuugaguccagccugggcaaaauagagagaccccaucucuaaaaaaauuaaaaauaaauaaauugagcuagagaaaugacugugauacauugggaagagaaaaaugaaagcugccaaguaauguauauaauaugaucccauuuuuguaauugaauaaaaggcaagaaaaacacccuuuaagaaaauuuuguauacccuguguauauaugaguaagccuagggaaugguauagaaugauauucagcaccgaaagaguaguagguaggaaauuguacuucuaugcugcuuuauauauguaaaaugaauguuuuuauuuuuauaauuaaaaaucuaauaaaaacaguaaguuagauggcgcagagauaggauugaaggaaucagcauacaauuagugaaguaaugaacucaagaguuauucauauuuuagaggaaaggaauguggcauaaacucacagcaaauauaaguauuuuauaaaauuaauuaauuuuagcaguagugaauggaugaccaauuucaagagaaaugaugaauacauuuucucugccauggaacauagucaagauuuaguucuuucuauguagauccucugagcuacugcugaauuaaaaacagcacuaagaaaaaacuguaguuuuuacuuggccauccuaggaguuccaggacuuuguagcauacaaagugaacagagaugauuuaaacuucuuugugccuguuuuguuuuguaugacuaaugggcuguuccccuggccuugauuugccagauuugcauuccuucagagcaucauccccuccugggaacuaccguacuagauuccaaacugaagcucaauugcaaaaauucuacacaauuugcgcuuucccucuuuaaaggagaacuggaagugugaacaagcauuucccaaauccucaaucuauggaagacaggauaagaaaggcuccuucccugucagcccccuuuucccagguucaaggcaguagagaaccuguguaucagagaagucuugccaauaagauccaugugauagaggccuucagagcacccaccuuuauaggcauuccagaaugauucaauaaaaucugccacuuaccagccuuuggggaagaaaaauauagugauuucuuuuuuaaucauuaaacuuuguuuuagugggauaguaauuguuuuuauucuuuuguagcauaucugucaccaccaccacuaucucagugaacaaaaagaguguuacuuaagcuuagcuaacuaaccuucagggaauauuuaauuuaauuccuguuugcucuucccuagggcuuuguuuugcuucccauggcauuaguuugccaacucuuguuauuuuuggccuucucuuauaacccuugcuguuuuguacacucccugaggauuagggcaacaucguacucaccuuuggauccucuacccuugccccauuugccugccauuuucacuuauccuucaaaguccuuugcaggugacaccugcuaucucugagaaggcuucccuggcagccccaaaugucuuccucugaucuacuucuacaccuugacuaacuuuuguuauagaacuuucuguauauuauugaaaauaucugcugauuuguuugucuucccucuauacuuuuuccuugggagccaaguccauaugcuuaauaaccauuugucaaagggaacuuuagugccuaguggaaggugcccaguugaaugccuuuuacauagaagauucuccccauaguuuguucaguuaguugcugaagccacuaaauauugggcauauuguuauagaaugcuccuuguugaccuucagguuucaguguauucauucacucaacaaauauuugagugccuacuaugugccuacacccuuacugagccagagacauacauuccuuuaggaauguauuuagcuacuaaaacauuccuagucuagguacuggagauacaucagugaacacaacugacaaaaacgccugcacgcaauggaaguucuauuuuaguggagcaaaucaaacacuaaacaaaauagguaaagagaauauauaguauguuagauggugauaauugcuauaaaggaaaauaaagguggaagauagagaguauuggugcaggagaacuuaaauccaccccccacccugccccaagauguguauuccuguaaguucuuuuuuuaagaauucaauuuuaaaucuuaucuggaaagauaucacugaaacagugacguuucaauaaagaccugagaaagucaugaauacugaaggaggagaguguuccaggaaggggaacagaagguguaaaggcccucagacuuuccauugcugugcuuuccauuguuugagggccccauuagagaggguuuuaagcagaugaguaacauaauuugacuucuacagcugcucuuugacuuacgaugaggucgcauugggauaagcccaucauaaauugagauacuuucaacuuaacaauaguuucaucugaacauaaagucaaggaucaugcugaaggcauaucacuuuugcacuguuguuuucugucaagcagucuauauuuucaaaggagcauucuuguagcuacuauugagacuaaacauggggaugguggcaagggcagaaauagggagauaaauuggaagucaguugcaacagcucaggagagaaauauauccuauauccuucugagugaguccaguaucaagucuggucuuugaacgacuaguuaacucuaagacuuaagagccagcaaaggagacuggggaguggcugggagaguaggaggaaaaccaggaggagguggugucaugggaguuaagggaaggcuaggaaaaguucacgacgucaccaaaugcugagaggucacuuaagggaaagagaggcugccaaggguccuuugaguuuuguaguuaggucauaguugaccucggcaauagaaauaauuuuaagaaaauucaugccaaacuauacaaaccaaaguuucuguuugauaauaguuuuuauaauaaggaugcaaauuaaagugguguuguuuuggggacagggucucacucugucagccaagcuguagugcaguggcacgaucacagcuuacuguaaccuugaccucuugggcucaagcgauccuccccaccccagcuucccucggagcugggacugcaggcacaugccaccaugccuggcuaauuuuaaaaaauuuuucuagaguuggggucuugcuguguugcccaggcuggucucaaacuccugggcucaagcaauccucccaccucagucucccaaaauuaaaauguuuugaucaccugugauauaccaggccuuguccuaauuugaauuuuaaucuuaauuuuuacaaaacccuauaagggcaguacaguacauuaucucuaucaauggggaaaccucaguucagggucuugccuaagucugcuuccagagccaguacucucaaccauuaagcggaagccaccuguguaaugaagcuacugaaacauacauuauaaagcagaaaugcuggacugauaacagcaauaugguugaaccaugguacuuuuauagcaucuaccuuucuagagccccuugaacauaaaugucaucuguguuuguugcuguugcuaccccaucacacugccacauccugucuuuuuaccuccuuuccugcuuauaugaaggugcauucauacacuguccuuagacacaccuccugucaucugcagugucacacacaaaguuagcaacauccauggucagggaaaauugcuugaaaacagccuuauucacaaauauacacauacaaaauugucauccauuaagauugucuguuuuucuuugugcuucuguagacagucuucuuuuggggguggcucacguguuuauguacacagauuuucucauaccauaugucacacuccugugcuugaggcccauuacagacacccuuacugagccagagacauacauuccuuuaucuguuuagcagaggcaguggaggcagugguggugagcugcauagcagccagcagcaguuacagugauggcaguggcuuguuuaucccacugcucagcagaaugcaacccuuuuaaaaaaagaccagaaugaucugagaugccaaggcuuaaagagaauucuugguucucagcuucauaaaggaccaucucagugaugaauaacagcaucuucacugcuguuauuaggcagcccuucucccuaucuaucuuugcugaaaaagugaggaaaggagagacucugugucauguggagugucucuuugugaugaauuguaucucagaugggagagggagggugaggggcuauggcaaccugagucuuuuuuuuuuuuuuugagacggagucucacucugucgccuaggcuggagugcaguggugcgaacucggcuaaccuccacuuccaccucccaggcucaagggauucuccugccucagccucccaaguaguugggauuauacgugugccccaucaugcuuggcugauuuuuguauuuuuaguagauacaggguuucaccauguuggccaggcuggucuugaacuacugaccucaagugaucugccugccucggccucccaaagugcugggauuacacagacgaaguugcauaaacucauaugaaugcaugaagugcaaggaagagacagcacgauauaaggccauauauaaaagggacagauuauuguauauguguguguacauguaagaauuguuaugauauacugaggagcccauuguggcaaauagugcugagccauaaaaguucuugccaaccuacugcaauuguccaaccugcaggauccugggacugaacacaucuggacaguucucuguauuguuaggccauggcagguaaauuuuugaccccuugacaucauaaaagccuccauaccaucuucaccaagacaccuaaggaaucagaacccaguugucuguagcaguccaggugauauuugaggguaggcuguuuugcauaaugguuaaaccugagacauccuaguuaaacuuuucgacaguuucucaucuguaaaauggagacaauaguauucacuucaaacauuggcagcacugagacagcacaugucaaauugcucagcauggucucuaacauggaguuagcuauguugauauaacugaauaaacaagugugugcccuacagcccaucuuuaccaaggcugagauguuuuuuucacaagguucucucccuacuccccuuccucaucagaaagaaguuagcuuugcauuggccucuuccccagcaagacuacuuauuagcucugggagggugggcaggacauuccuucaucaucuuccguugguuuaauucucuuauuugaccugaggagacaagaauugagaacauauaaaggcauuuauauugccauaucaggcugcccaguaaaaaauucucucuauuccaauguaaauuuuaaaacaauuuuauuaguauguccuuuggccuuucaaguuggggggaaaaaucaaaaccaguauucuguacuagaaaaaucuaacugacauuugucuuacauuuugucaucccagccaaaguuagguaaucaaauggaacuuuaagaacuaagcuuuacugaacaaacugugccuuaaaauacacuuaaacugaggcgcgguggcucaugccuguaaucccagcauuuugggaggccgagguggguggaucaccugaggucaagaguucaagaccaaccuggcuaacauggcaaaaccccaucucuacuaaaaauacaaaaauuagccaggcaugguggcacgcaccuguagucccaucuacucaggaggcugaggcaggagaaucacuugaaccugggaugcagaggucgcagugagccgagauuacaccacugcacuccagccugggugacagagcgagacucugucucaaaaaacaaaaacaaaaacaacacauuaaaacuaccuuugcugucuacaagccgcucguauuuaguucuauuucuucaacugccuggcuuuuucccuuaucuucaccuggauaacuccugccuguucuucaagacucagaugucguucuccaggaagccuuuccuaaugucuuuucccuggaaauauacauuuuuaaaaguuagauaucuuuacuccaagaaaccuguauuuauucugucuacaacaguuucuuccucugcaguuuuuguacuugucucuuccuuuagacacugaacccgcuaagagcagggauuaaacuucauucauuuuuuacauugccaaugccugcuauaaagaaucacauaaaugugugaaugagguuaaguuuacaccuuauuccugcucgguguguauuauuuaguuuaugaggacaucuuguggcuagaucauuuauugcuauaaacagacgaucauaggccaggcgcgguggcucacgacucuaaucccagcacuuugggaggccaagguggguggaucaccugaggucaggaguucgagaccagcauggugaaaccucaucucuccuaaaaauacaaaaauuagcugggugugguggcaugugccuguaaucccagcuacuugggaggcugaggcgggaggauugcuugaaccuggagggcagagguugcagugagccgagaucaagccacugcacuccagccucagcaacagaaaaggacuucaucucaaaacaaaaaacaaacaaaaaaacaaaaaacaaaaaacccaacaacaaaaauccuguucuaaaauuuauuuuugacauugauuuaccuguuuugcaaaacaugacauaauauuguuuaggauguuuuauaucgcgugguucuguuuuccuucagggccuucaacaauaaaaccacuaaauaggugguuugugaaacucucaaaugucuuccuggugggagucauaccuagagguuacucauauauaguuagugauugggagaugugaagguggaaagaccuacaucuacaucucaguuuccaucacaucuugggugaucuugaaaauaaaucacucugaauuuaaguucucugcaaaauggauguugucucuuccuuacuauauaguauauguaaagugcuuggcacagugccuagcauaucaaagugccuaauaaaugguacuuaucuagaauauaaccaaccauuuaaugcuugagacaucccccuacucccaaacacaacagacacaccaaauacucauccauauucuuccugaacaccucuagugaggguggaaauuacuguuuuggaugcagcacauuccacucacagcucagcucuaacuuauaccaugauauuauacccugaugguuuuuccuaguaauuuaaacacaaauauauaagaaaacuuaccuuuccauaaguugccuuuuuaaagauguuugauauaaaaaucauaaauucuuuuuuuuuuugagacugagucucccucugucauccaggcuggaguguaauggcaugaucucagcucacugcaaccuccaccucccggguucaagcgauucuccugccucagccuccugaguagcugagauuacaagggcacgccaccacacccggcuaauuuuuguauuuuuaguagagacuggguuucaccauguugguaaggcuggucucaaacuccugaucucgugauccaccugccucagccucccaaaaugcugggauuacaggcgugagccaccgugcccagccaaaaaucauaaaauuuuaaaugcauuguugcauauguuuaucuuucauguaauacuuuuuccuuauacuuacuauaaaugggccaaaaccuuaaaagcaguaacuuacuuugcuggauuuuauuguuacauuuacacuuuauacuaacauggguuuauaguauaaaaguuuuuuuuaaaugcuaguaacucaaugacugaauuugucuuuuaaguugaacuguucauuaagugacuuaaaauguuauuauucugcuuguacaaaacuaggaaacaacaaauuaaaccuauaaugaguuaacagaucucagcuggguggcuuuguuggcgucaaaguuccaaugagauaaaugcuaguaacucaaugacugaauuugucuuuuaaauugaacuguucauuaagugacuuaaaauguuauuauuauucugcuuguacaaaacuaggaaacaacaaaucaaaccuauaaugaguuaacagaucucagcuggguggcuuuguuggcgucgaaguuccaaugagacauuaaaaaaugccaggcgucauacauaugacugaaaagcucagacugaauguuuaauuucugcagaggagugaagaucagcaaaaacuacuauuuuuucacuaaacacuccuuuuucuuuaaaaauaacuugcauaaggguuaauuucuaucagagauuggcaauuuacuugaauuucugagucaacuuuuuucagaagauucaguucaauccauuguucuucaugggcuuuuuuggcuuuucuaauucuacagaauuaauguucaggauucuuuuuuuuacacuuagauuacucuugucucugcugcuccugggaaagugauuugugaaaugaaaguagaagaagagcauaccaaugcaauaggcacucuccacggcgguuugacagccacguuaguagauaacauaucaacaauggcucugcuaugcacggaaaggggagcacccggagucagugucgauaugaacauaacguauguauccaaacuguauuccaaaucccuucugugugauaacugucuaaacaacugagacuaaacacauuuauauuauuaguaacgcaugagauucaauuagcugcuuaucuccuuaacugcaccuauagauuuuguccuaaaauauuccagccuuaaaaucuagaacuagagcaguuaauuugcaaguacaguguguaucaauaguaaaaagggaaugaucccaaacauucaaaagagcaacauucagcuuuuaauguguauacugaugcagggggaaaaaucacaaacugauggcucauaacuguuucauacaguccuuaaaagugccauucagggccagacgcaguggcucacgccuauaaucccagcacuuugggaggccgaggcaagaggauugcuugaagccuggaguucaagacccccaucucuacaaaaaauaaauauuauuuaauuuuaaaaauaccacuuauaacacuaugaggauuguauugaguacauacaauucaaaguaaaguuagaguucauauacacauuauaaucuuacucuaacaaacugaacaccauugcugggguuuuuuuuuuuuuuuggacacggagucuccccaucacccaggcuggagugcagcggcacaaucuggcucacuucagccuccgccucuggggcucaaguaauucuccugccucagccucccuaguagcugggauuacaggugugcgccaccaugcugggcuaauuuuuguguuuuuaguaaagacgggguuucaccauguuggccaggcuggucuugaacuccugaccuccaguguccacccaccucagccucccaaaguguugaguuuuaagaaugggcagcaauccuggaucucucccugugacuacacagacauguucugugaguuaaacuacaugaucagggaacagugccccucagggucaaacuuccaaaauguaagaaacucaauuccaacauaaacugguacuacugcagccccauucaauaaagaaagagcugggcacagggauuuaguuucaagacaacugcuuuuuccaccuaagcaacaaaaauguaacuaacugagaggucagguugagagagccauugugaguagauaugaggguaauggaaauaauguaggcuuuuuuuuuuuuuuuuuuugagacggagucucgcuuuguggcccaggcuggagugcaguggugcagucucggcucacugcaagcuccgccucccggguucacaccauucuccugccucagccucccgaguagcugggacuacaggcgccugccaccaugcccgacuaauuuguuuguauuuuuaguagagaugggguuucaccguguuagccaggcuggucucgaucuccucaccuugugaucugcccgccuuggccucccaaagugcugggauuacaggcgugagccaccgcgcccagccaauguaggcuuuuaaggaaucuaaauauuuuaucaaguuuacuuaagaaacauucagucccucuucaugggaauaacuuaaauugaggguacaauaagcaaauuacaagaugcagccaaaugcucuuuuugaaauuaagauguacagaaaagaaaggcucugcuuauguuacuggugugcauauucagcaguccuuauuucaugugguaagaggugagaucaguagaugacuugauuuucccuaaaagucucuauuaagagcagagagaucuucaaaccuagcacugcauuucaugaucuacuaagguacuuuugccuuuagaacccuaaggaauuuucaguaagucaaacauaguuuuggccuuucaaauauguguugccaaaagcauuggccaucaagagcugccuacgcuucaaaaacugauucacuucaacaaaaacuaggacauggucuuucaaaaguuagagauauuucaaaaguaaaugaauaauguuucagucaguuaacacuucaugauucacucuuugauuuacuugacaugguaccaaauuuacuccaccccugcacaucaaguccuauauuauacagacugaggaugccuguuagacugugacuuagguuaaaaacaagcgagguuccaaaacaacaaaaggggaaauuuuagaguauuacugacaaaaugucaaucuccaaauuccccggacuuaauguuuacucaucuguagcacaaaggguuccuuaucuucccucaguuuaaguuaauggcuguuagccaaaauucuugauuucuaagacaaaauuuagggaaauaauaaaaacuggccaaacuacuacuaaacauacuauuuuucauuucuuuacauugagguaugugaauuaaagacaagccuguucuuuccagcaauaagauccaccuuuuuuuuuuuuuuuuuuuuuuuuuugugagauggaaucuugcucuguugcccaggcuggaguccaguggcgcgaucucggcucacugcaaccucugccuccuggguuccugccauucuucugccucagccucaaaaguagcugagauuacaggugcccaccaccaugccuagcuaacuucuguauuuuuaguugagacgggguuucaccacguuggccgggcuggucucgaacuccugcccucaggugaucugcccaccucggccucccaaagugcugggauuacaggcuugagccaucgugcccggccagauccaccuuucuuauaccuccuagccauaaauacugaagucuuauuuugaauauggcaaaaauacauauccuuuuuaaagguuucuuucuaaaaagcagaaacauaaaaauaaacuguaaggaaauuauuucccuuuaaaacauuaacauuuguuuuaaacaauccucaucuccccaauuuuuuuuuuaauuagcuggagccagcugaguuaaagacaacuuaugauuacaagugacuaggauguacaucucuuaaaaauauagacaguccaucaucaagauuguaaggacaucauaucaauuccuuauaguuguuauauugucauuuuagagucaaauaaauuguaaauauggauaggacaauauacagacaccaagugauauuucaucuaagaaguuaaggagauuaaaugaaagcuggaggaaaucuuucaccagccccaaauaaaugugaagugggaaauguaaagggaaaaaaggggaggcaagaaaaccucuucucacauauuugggaaaagaaacuuguguggguaaggaauggguaaaauagaaccugguuaggaccagccauucacauuugauaguacagaaagcuuaccaauacuaccguuaaaacuauuuuuaggaguaaaauaaguuacauaggaacacuguugugagaugcacacaacuuucccuuugaaaaauuaucugcuguuaacuauauucauuuucuuucaagguacaugucaccugcaaaauuaggagaagauauagugauuacagcacauguucugaagcaaggaaaaacacuugcauuuaccucuguggaucugaccaacaaggccacaggaaaauuaauagcacaaggaagacacacaaaacaccugggaaacugagagaacagcagaaugaccuaaagaaacccaacaaugaauaucaaguauagauuugacucaaacaauuguaauuuuugaaauaaacuagcaaaaccagaagcagcuagaaauauucuuggaggaaaaggaccuggauaucaaguaggguaaaggugggggugucuuuuuucacuuuaagcaucuuguuuucuaaucaugugugauaauugggugaaaaauucuuagcucaaaguguuuuaaaaacagguaaagcaaagaaacuagcaggaccacucucaguuaagauuaaaacuaaaguccaguguuaagcuaaaggagaaauagaaauuaaugguucuaauucuguuugggcugcuaggaacaacagaaauuuuucaugguucuagaagcuggaaaguccugggucaaggcccagcagauccuguuaggugagggcccgcuuccuggcucauagauggugccuucucacugugugguggaaggggcaagugagcccucuggguucucguuuuugaaauggagucucgcucuguugcccaggcuggaguacagcagcacgaucucggcucacugcaaucucugcccccuggguucaagugauucuccugccucagccucccaaguagcugggacuauaggcaugugccaucacaccuagcuaauuuuuguaguuuuuuguagaaacaggguucaccauguuggccaggcuggucucgaacucgugaccucaggugauccgccugccuuggccccccaaagugcugggauuacaggugugagccaaugugcccagccuggguucucuuuuguaagggcacuuacuccaaucuugaggguucugcccucgugaucuaauaacuucccaaagacccccaccugcuaauaucaccuuggggguugggauuuuaacauacaaauuuaggggaaacacauggagaccacagcaauggccaauccuuagcgaaucuuagguccuucccagaucuaaaaugccaagcuacacuugcauuuccuuuuuuuaagauuaugaaacuucaaaauauaugaacuacagcccauauugaaaaauaaaauagauugagccauaugccuaaaaaagaccucaagaaaaguuugaggcuaagcauguuaguguuacaggaaaugguccaauagagggggaagaaaaaaagcaugcuacuagccccuuuucuuguaccgagaauaaaaccaugcagaucucaaaccuccaagucuauaguauugaaaagaccaaguucacuucucagaagucuccaaguucaguugacuguggcacucugagacagcuucugucacucaggcuggagugauacaaucacagcuucccauagccucaaaaucccaggcucaagacauucuuccaccucagucuccugaguagcuggaacuacaggcgugugccaccacgccuaauuuuauuuuuguagaaacaaggucucacuguugcccagccucgucucaaacuccuaggcucaagcaauccuccugccuuggccccccaaguacuggacuuacaggugugaaccacugcacccagcugacucuuacuugauuucugucagggaaucuuaaugaacauuucaugacuaaagacuaaaaaggaugcagcuuuaaguaaauuuaagucaaguuaacaguuaaagacaaauccuuucccuacauuagaucgccugcugaucuguccacugugaaagggcagaagacuccacaguagcaauagcagcagugagcauacaggagucccagauguuuacuucuaguauuucccacuaaaaggaagcugggcuccuuggagaaacagcugacuccagggcuugaggcugggacagaaagguuacaguaucuuaugcaugaaaggagaugcucaaaauaauaaaggcaugcaaauuaugauuuggagggaaaaaauaugaggccauaguguuuagguagauaauaaauggcagagauagaacacucucuuacaacaaaugcuguaaauggacaaagcauuagauuuggaaaaucacuauuuuguaaccaucauaguuaaagacugguuuggguuuuagucuggaaagaaucgccaagggagcuccugauaaaggaacaggguauuugcacauugcuucccagagauugcuaguaguaaguaccacacauagggcaaaaccaggacaccuugaccaggcgcucaaaaguaacaucaaugaagagcagauggagaguauacuugagaagggcguuaagcaugaauaaacaauucaaaugcaaaaugaguaacaauuuacaagaaaaauugcccuguacuccaaaaaacauagaggucauggaacacauaaaggcuaaggaacuguuccacauuaaagacaacugagaacaacuaaauucaaugauccuguacucuagagggggggaucuaaaacaagcuaccaaggauacugggacaacaaaacgaauauggaugauaaagaguaucaacauucccugaguuugguaauuuuacucuaguuauaugaaauauucuuguacuuggaacauaugccgaaguacuaaggaagggguaaggaagcacaaagugugcaacaaacucaaauagcucacagguauaaguguacagagaaaaugaaaaaaauguggcaaaauaauaaaaaugaggguaaagauuacacaacagcuuucauauuacucugguaacuuuucuaaauuauuccaaaauaaaaacguaaacaauggcugccaaaaugccuaacuuggugaacauaaguguaauucaauaugguaaauuaauucaacaugguaaauuaagagcauaggccuuaagagccagccagccugguuuuaaauccuccacuacuuaugaucugagcuugagcaaguuacuuaaccucugcaucuauuuccaccaaagguugagagguuaagacaagagcuuagaagaguaccugguuauaauaaacauucaaaauguuauuucaaauagauucuaauuuuuaaauaagaggacacaugaaagcauuuugaaauuuaagaauggcccuuucccaugaagcaaggcauaaggccagguugcuaacuguugaaagcugacaguauguucuugauuccuguucuuguugaaguuacacacucaauugccagguauuuuucuucugaauuuacuauuuagccacagacuaugaaauaauucucuaaggugaccaguaacaucagugaaauggaaagaaaaaguuaacacuucaaacuuuguguauucaccugaauagucagggaacuuucaccuauuuuauuuagguuuucuuuuucuuuuuuucuuuuuuuuucaaauuccaaccagaagcuaaauacaauuggaaacugguaagcacuaguuuuacuccaaaggaguaggaucauucagauuuacuccaauaaaaguaugcaacccuuaagcaaagcuuuucuucauuuaa

SEQ ID NO: 192415 - RNA, 510233 nt, Homo sapiens
uuucaagggugacuugauuucgccugauccuggucggcagggugggguuucuuggcauuccucaggccgggggaugcgacgucuggguguggaggugaugagcuagggguucuguggcacuccggcucugcucagggcgaccugcguaggggccucuggggcaggcccgcuuucugucaaaauggcagcgcccagcgugcgcggguaucucugaaguugggguuuaagauucuugcccgugagagcgaacgagccugccguacuucugauuuugaaacaccugggucugggcuucccgggcgagcggugggugagugccggccucauugcagccugggguacgacgugggcgguugguguuguaggggguuuacauuggccguggauuuuuuccucuuuccggauguguuuuugcuuuugagugaagaguucccgugguuuuguaaccuaauaaaugcauaaaaugcagcuuggguuguagacuuuggagaauaauuagagaccuuuagggcuuuaggcuuucuccaagaagcggagcaaguuuucaaccauggcuuucuucagaagacugcagcuuuuuugaaucaucuuauuaaagugguggauaaaguugcuuguucugaucuuugagcauggcacuggacgcaggaagcuucagccaguccuaguuacuguguuugcaaagcacuuuucuuguuuuuggaaucuugcuuuauguaaucaaccuuaggaagaaccacaccuuucugcacucaagcacagcgagaaguacguuaugcgugaaaacaaaacaacuuugcauuaaaauccaucuuucuccgaaccacuuggucacgguuguguucucaucugcuuuaguguauuugguuuugaaacgauauaccugcuguaugucuaaacaacuuuauauuuucaggaacuuuucuguuuccuuuucuuuuuuuugagauggagucucgcucugucgcccaggcuggagugcaguggcgggaucucgggcucacugcaaccuaugccucccagguucaagccauucuccugccucagccuccugaguggcugggauuacaggcgcgcgcuaccucgcccagcuaauuuuuguauuuuuaguagagacaggguuucaccauguuggucaggcuggucucgaacuccugaccucaggcaauccgcccgccucggccucccaaaaugcugggauuacaggugugagucaucacgcccagccucuauuuucaggaacuuuaaaggcagaaaaaacacuucucugaccuuaccauucuuuaguguacuugcaaccugguguccuugcauccagauauucuuacuaauccugaugcaaugacauuuuuuaaaaggcacugaagagaaaauacuuuuauuaagauaucuuuaagucuccucccugauuucuugaaaaucucaugucuguuauuguuuauuauuauuuuuuaaacaggauagcaaaacuucuauuacuuccugguuggucaggucauugagcaaaucuagccucugcuuuauugaaaggacuuuuuugaguuuucccuuugcuauuucuuaaaggauccaagaccaaggcaauugcacauuguuauagaguaagauucagagcugauuucucuugauacacuauugugugccagugauaugaaaugauaugcggcaccucaaagcuacaacauuaaugcaaguuacugauagagaaugcuaucagagugaaaaggaaaaacuugaagauuauuuuggcuuuuuuaaaaauagcaaagauuacauuauuuuauuauauuuugcuuuugagaguaaaguuggaauaauuacuauauacaauuguuucuaccuaauuaucaaggaauuuaaucauuaacguacauaauuaauguaucuaaauuacucaacuuuguuguaaucaaauaaaacuuuuccaaauaaauauguauaguuuaaauaguuuggguagcuuaguccucuguuaguacgagcaaugguugcaguuaggaaagugauaggcuucccaguuaauucugagccaagucuucauaaaaauaccuuauuauuuuauuuaaaaugguuuaccaauguguuggacaucauugccuggagaggcuaaaagaaaauaaucauuccguagcuacaucucacuuuugcacaucuucauugcggagaugacuuaaaaaaaauaacucgauuugagauuguaaguagauuugggccagaagcugaagaauggaccuuacacauacguccuuuaauagucauucuauucuggguugaaauuuuucuuagagaguaucuguaaaacaggagguaccauuuaggcaucaaaacguaaaaauuucuuuaguauucauuuaucaaaaguuaucgacuaccuguaguucuuuauggaagaucauguguuaccuucuauuaaaauuaggguuguuaaugaccacuuaaugcuuugugaagagaaauuucucuaaucauaauaaacaguguaacaacaauuuacuguccuuaagcuuaaauaucaaaaugauguauaaaguaaaauuuguauaguaguaguaacuuacgauauuauuuagaaauuguucagcugggcaugguggcucacaccuguaaucccagcacuuugggagguugaggcagguggauugcuugagcccaggaguuugagaccagccugggcaacauggcaaaaccccaucuauacaaaaaauacaucauagcgaaaccucaccucuacacaaaaaauacaaaaauuaacugggugugguggcaugugccuguagucccagcuacuugggaggcugaggugggaggauugcuugagcccuggagguugaggcugcauugagccaugaucacauuacugcucuguagccugggcaacagagugagacccugucuaccaaaaagaaaaaacaacaacaacaacaaaaagaaauuauucuauucuacaccacacaugaauccaaguauuauacauugauccuucauuuuaauagaacacgaaggggaagggggaagaccuuagauaucaacucauucauuuguacagaugaacaaacugaagacuuuuuccucauucguucauuccuucagcauuuauugaacacuuccuaaguacuauagguuaugguuuuucuuuucuuuuuucuuuuuuuuuuuuuuugagacagaguuucacucuuguuucucaggcuggagugcaauggugcaaucucguccggcuaauuuuuuguauuuuuaguagagauggaguuucaccauguuguccaggcuuuucuugaacuccugaccucaggugauccagcugccuuggccucccaaaguguggggauuacaggcgugagccaccgcgcccggcccauaaguaccauauauuauauaagaugauauagucacagugaugagagcuuccccaccccuaagaaacuuguaggugacuagauaagcgaaacaauaauuuauuuuauagagacagggucucuguuuacuaagcuggagugcaguagugcuaucauaucucguuguaacuucaaacucccgugcugaagugauuuuccugccucagccuccugaguagcuaggccuauaggcucaugccaccaugccuggcagauuuuuaaguguuuuuuuuuuuuuuuguagagaugagauuucacuaugauguccaggguggucucaaacuccucagugccucuccugucuuggcuucccaaagagcucagauuauagcugugagucguggcacuuggccaauaauuucuuuuugacaguugcugcgauaugaguaauauuaguaaacgcuaaaggaauagggaagaggaauauugaaccaggaguuucaccuaugggaaggcuuuccaucguagaagguguuuccagaaugagaaguaaaagccagaugaggaaugugguuaaagauugcaguguauauccaagcauggaggaagaagggugcuugaucuauuuagagaacucuuaaguguuuuagaaugguaggaggugggaagggagggaccacugaaguguuuagcccuguacuagcuuuauuuuagugauguuuucucucugucuggaauaaaucauuucuucccuuaugcauuggcugaguuauauaaguagaacuuaacagcugagcuguugaaauggagauuauuuauucagguacugauaaccuuuuguuucaaaucaugacuuugaauccuauauuccagaggcacugaaauguuauuuauuuaccugugcauucaagagauagcuggcagccuagcaauuuaaguuacuguuguugugguaacuugagggcgauauauaaaucaaacacugauccuguuuuccagaaguuuauacuuuaaaugcauuuguauaugauuaaaauaagguauuagguuggugaaaguagcugcaguuuugaccguuacuuuuaagggugaaaacagcaauaacuuuucuaccauccuguacaaagggcugcugaagcguuguggggucucagugcaaggagaggucacuucaucccugaugcuugggccacaccucagaccaacagcagugcuaaggcccaggcuucagauaauuuuguuuaauuuuuuuuuaaaauucucuccaugauuggguagagccagggcugagaaacauugaccugaaggaauuagggggcuucauggaggagguaguguuuguguugggcuugagaggauuuaaguuucuccugggccuugaaaggaauugaaggauuuaaauguuugaauguggugguaagauggcuacuguagguggaagaugacucacccuuuaccuugaaaggaugaaggagaaacccugauugaggucuaagaaaaaacaaucaugaccugcggaaggcuuuggccagagcuguagagugcaugagggugagaacggggagaucccgugaaaagguaauacaucggcuuucauauguuuuaggcaugagaugagcugaauccugauaugauuugaguuagucuucccaugaccugauggaagagcuguuaucuccauuuaagaaaagugaagcugcccaggugugguggcucacaucuguaaucccagcacugugggaggcugaggcaggaggaucacuugagcuugggaguuugaggccagccuggguaacauagcgagaccccaucucaauaaaauagaauaaaaaaaagaaaaaaaaaugaagcugagaguuuauuuagccagggucacacagcuggaaaguagcuaguguggaccuuggccugagaugugaucugucuagcuaugauacaacacugcuucacagauaaaguaccagcuucaggaauuggaagguuauugauuuuucuuggauaacauggguacauuucagucauauuugaauuuuaauuuaguuggauucucacuuauuuguaaagcuaaccgguuuguauuggaaauauuauaaauauucugggaaucucaaauguugauuuuauacuagcuuuuuaguuauuuaagauaaauuuacauuuuauucuauuaacaucucuuugaaaagacguagugcuuuuuuagguugucuauuuauguguguaugugagacauuuccucuugggggauucucugagacucacauuucuguagaagcuuuuuucagauauacuuaugaaaaucuguucucuguuuugagaaaucuugaaagcuaugauauguugcaacuagacacucuagcuucauugauuggaggcuaaggguucccguauuugugggcaguaacaacaaaauugacaauuuauuuuguguaaaguauuucaaaugucaguuauuucuagagguuuuuuuucuuaaaaaaaaaaaacucauuaauucuuuucauuguaaaggaaagaaaccaucuuuucaugcuacaaaccccgaccaccaugagaauucuuuuacagugugauuuguuguaaucuguuauagaucacuuucauucuuucuuucuugcugcauaugagggaccaguauuuuaggaauaauguuuucauauugucuggauauuuuaggaugauuuguuaaucaaacuagcuacagcuuauuguaaugauagcuauuauuuauuuagaguuuguuuucucucuucuaggagcuuugccaugaaaagaacaguccaggccaggcgugguggcucacaccuguaaucccagcacuuugggaggcccaggcaggugaaucacgaggucaggagauggagaccauccuggcuaacacagugaaaacccgucucuacuaaaaaaauacaaaaaaaauuagccggaugugguggugggugccuguagucccagcuacucgagaggcugaggcaggagaauggcaugaaguugggagguggagcuuguagugagcugagaucgcaccacugcacuccagcuugggagacacagcgagacugucucaaaaaaaaaaaaaaaaaaaucgccacacugucuuccacaaugguugaacuaguuuacacucccaccaacaguguaaaaguauuccuguuucuccacauccucuccagcaccuuuuguuuccugacuuuuuaaugaucgccauucuaacuggugugagaugguaucucauugugguuuugauuugcauuucucugauggccagugaugaugagcauuuuuucauguguuuuuuggcugcauaaaugucuucuuuugagaagugucuguucauauccuucgcccacuuuuugaugggguuguuugauuuuuuucuuguaaauuuguuuaaguucuuuguagauucuggauauuagcccuuugucagauggauagauugcaaaaauuuucucccauucuguagguugccuguucacucugaugguaguuucuuuugcugugcagaagcucuuuaguuuaauuagaucccauuugucaauuuuggcuuuuguugccauugcuuuugguguuuuagacacgaaguccuugcccaugccuauguccugaaugguauugccuagguuuucuucuaggguuuuuaugguuuuaggucuaacauuuaagucuuuaauccaucucacauuaauuuuuguauaagguguaaggaagggauccaguuucagcuucuacauauggcuagccaguuuucccagcaccauuuauuaaauagggaauccuuuccccauuucuuauuuuugucagguuuguuaaagaucagaugguuguagaugugugguauuauuucugagggcucuguucuguuccguugaucuauaucucuguuuugguaacaguaccaugcuguuuugguuauuguagccugguaguauaguuugaagucagguagcgugaugccucuagcuuuguucuuuuugcuuaggauugacuuggcaaugcgggcucuuuuuugggucauaugaacuuuaaaguaguuuuuuccaauucugugaagaaagucauugguagcuugauggggauggcacugaaucuauaaauuaccuugggcaguauggccauuuucacgauauugauucuuccuauccaugagcauggaauguucuuccauuuguuuguguccucuuuuauuucauugagcagugguuuguaguucuccuugaagagguccuucacaucccuuguagguuggauuccuagguauuagaacuagaaauaccauuucacccggcaaucucauuacuggguauauacccaaaggauuauaaauuaugcucuguaaagacacaugcacacauguguuuauugcagcacuguucacaauagcaaagacuuggaaccaacccaaauguccaucaaugauagacuggauuaagaaaauguggcacauauacaccauggaauacuaugcagccauaaaaacggaugaguucaugcccuuuguagggacauggaugaagcuggaaaccaucauucugagcaaacuaucgcaaggacagaaaaccaaacaccgcauguucucacucauaggugggaauugaacaacgagaacacuuggacacaggauggggaacaucgcacaccggggccuguggugggguugggggaggggggagggauagcauuaggagauauaccuaaugccagcauggcacauguguacauauguaacaaaccugcaccuugugcacauguacccuagaacuuaaaguauaauaaaaaaaaaaaugaaaauaaccaaaaaaaaaaaaagagaaaagaagaguccuuucauugcuguuuagcaguaucucauuuuaguaauuuuucuagugacauauuugaaguucugauugacuucuucgaaugaguguauuagccgccaucucuuguuuguucaggucaguagguuguuuacagaaaacauuuagaauuugcaguguugagucuguuuacaaaaaacagccuacauuuugcuaaucacuggaaaaauacuaggucagugucuuaagaugugcaauacugagaucugugauguuaacugaucucucagaggaugggucgauacauaucguugauaguauacuguagacuguuauuaacaauagaagauauacagagaauucaugauuucuuugguauuauagugaauuacaugauuuaauauuuuauaacguuuuaauguaaacauuuauuuucugagcacaauugaagcacuucagccuggcaaacuuguaaucuguauguguaauugugaguuugaguuaacuaacaauauuuaagaguuauaaaagccuggcuucugugaaauggauuacaguaauauuggcagagaguaaaacaguuaguuucaguuaaugaagaugaguuuuuugggagaauuaucuuuuuuuaaaucaauuccuggaauucugcagugcaaagggaaaguaaaaugaagcagucaugaaauagaaaaagcuuagcaggcagcauacuuucuuuccuguuucuugacguucugagauaagcacauuguuauuuauuucaagucuuggagcacuuugagacaagcacaugugccugggcauucauaacauuaagcccuguuaggaaucccacuuacacccuuggcuucugcguacugugagagcugggcuggaugauaauuacagucagcuuucauuuguagagcccaggucuucaaauaauuuccaaguaaacuaucccagauuaauacguuucaggacauaagugugguucgcuagagcugucaagcugucuggaugcccuucuguuaacuuuguagaagagauuccacgugugucaaguuacaguguuugcugaaauuuuucuguugucuugaaagcuauuugaaaaugaaauguucauuauaguacugguggucagguauguuccuuagauauauaugaauuaaugucaccacacuauagacaguaauuuuuauaucaccuucucuccaaaaaccugcagcacuuuuaggaugaagucuaauuccuuaacacagccuaugagacccugacgacuauggcgcuuacccacuucuccagucccaugucauaccuuuuuauuuuucgcuugcugcuuuucauucuuuaguacucaccucuuuccccucuacccuggggaccuuugcaaaugcugauccagcugccuggagugcccuuccuucccuugcuaauuauucuucugaucucaguuuaagagaugcuuacucaaagcuaccuucucuaacuugaguacaucuuccucuguuaagcucccuuaguauggugaauugcucuucagcuuagagugacugccauugcaaguaacugaagucaaauuguuuuaaacaaaccuaguggcuuuauugucuccugugucuugaggguucagaagccagaugggcuuuaggguugauugguuugagugauguugccaaagauucaauuuugugcuuuucucuacuuugucuucucuaacguaaauuuuaucgucuggccagaguccucucucucgguuaugggaaaccaucaacaguuugggggcgcuuguuuccaaaaccuuagaggagugagagagcuucuggaccaagagugcucagcaguccucuccguucaugucacuggcccuccuugugucauguccucauccauuucugaaccaauaacugugaccagggagaagauaggauucuuuuggucuugaaccaguugccuagcuccuagagauaaaggggaauuauuuuuuguaaaaggaacaaaguucacuagagcaaucuugccagaguuauauuuuuuuauuugauuaauuuuuuugugauauuaggcuguguauaagaacagagacuaugucuguuuuuuuuuuuuuuuuuuuugaggcggagucucgcucugucacccaggcuggagugcaguggcacgaucuuggcucacugcaaccuccgccuccgggguucaagcgauucuucuaccucagccucccgaguagcugggacuacagucgcccgccaccacgcccggcuaauuuuuauauuuuuaguagagaugggguuucacuauauuggccaggcuggucuugaacuccugaccuuguaaugugcccaccucggccucccaagucuguuuuugauuacuauuguuucuucaacauuuuacaucuagcuuugcauauaguaaaugaucgauaaauauuaauaguguaaugacucaaucacguaagcuccaaauacaguaaggacccccugccgccaccacccuuacccaugguuuugcuuucuuaguuacccagagucaacuauguucugaaaauauguaauggagaauuccagaaauaaugcauguuuuaaauggguguguucugaguuuuguguugaaaccugcccagggcaugaauccucccuuuguccagugucuccaugcugcauacacgcuaccugcccauuagucacuucguugccuucucaguuaccacaagaucacgauuuucguuauggauagaugacaagaagaaacagggugagugcagugggaugagguacuuugagagagagaagagaccauauucuuucucuuuuucauaacuuuuauuacgguagguauauuguuauaauuguucuacuuuuuauuaguuuuucuuguugaauuaaugauggguuuuucuuuuuucuuuccaaaaaauaauaauaaccacuaucuuaugcggaaaugauaucacgaacaguugcauuaucaaaucaaggaggaaaugcaaucagagaacaggcagaaaaacuaugauuauaaugguuuguauuuuucuugucucagauucuuuuauuuauuuauuuuuauugauacauaauagauguacauauuuuugggguacaugugauacuuuaauacauucauauaauuuauaaagaucaaauuaguguaauugugauaucuaucaccuuaaauauuugucuuuaugcuagaaacauucaaauuguuuucuucuagcuauuuugaaauaugcgauagauuauuauaaucuauagucucccggugauccaucagacacuaagucuuaucucuucuaucaagcuguauuuuuacuugcuagucaaugucucugcaucccuccugcccuguacccuucuuggccucuggucaccaccagucuauucucucuuuccaugagauucacuuuuuuagcuccgacauacgaguaagaacauaugguauuugucuuucugugcuuggcuuauuucacuuaacauaauguccaguuccauucauguugcugcaaauggcagaacuucauucuuuucuauagcugaauaaugcucuguugucuuuuuaugccacauuuucuuuguccuuucaucccuugauguacacuuaacauugauuccauauuuuggcuuuugugaauagugcugcaauaaacaugggagugcugauuacaaugcacauaucuuuuugauaauacugauuucuuuucuuuuggauauauucccagcaguggaauugcuggacauaugguaguucuauuuuuaguuuuuugaggaaccuccacacaguuuuccauauuggcuauacuaacuuauauuuccaccaacaguuuacagggguuccccuuucuccacaucugugccggcaucuuuuauucccuuuuugauaaaagccauuuuaacugggguuagaugacaucucauugugguuuugauuugcauuucucugaugauuagugauguugagcauuuuucauguaucuacuggccauuuguaugucuucauuucagaaaugucuauugagaucuuuggcccaauuuuuaaucagauuguguuuuuuuuuuauugaguuguuugugcucauuauauauucugguuauuaaucccuugccagguggaugguuugcaaauacuuuuuccuauucugugggagauucuggguuguguuuucacuuuguugauuguuuccuuugcuuacagaagcguuuuugcuugauguaaucuaauuuuucucuuuuugcuuugguggccuguacuuuugaggucuucacaaaaaaucuuugcccagaccaauauccuggguuguuuccccaauguauucuuguaguaguuucauaguuucaggucuuagauuuaaaucuuuaaucuacuuuuauuugauuuuuguauauggugagagauaggaacuuagcaucauuuauugaagaguguuuuuuuuccccauuguauguucucaacaccuuuguggaaaauaaauugacuguaaauguauugauuuauaucugguucucuauuuuauuauuaguuauuguuguuaaaucucuuacucuaccuaauuuauaaauuaaacuuuaucauagauauucacguacaggaaaaaacauaguaaacaguacuuaggguuucguacgcuccacaguuucaggcaucaacugcaggucuuggaaccuccguagacaaagaggagcuacuguaacuuaccuguaaaaauuauugagugacuuuggcagauaguauuaguuggcuacccaucagccauaucaaccguacuucuucccggccauuagaacccugauuuuguuuggguggccaugugccuaguuccuggaaaugaauuguaaugcggucuuaggcuucauagugauugcauucccucuuuaccagauacuuguuugucauagccaggcauagccacaagacacagaucugguuaaugagacaacaggaaguugucuggaagguuucuaggaaagauuuuguuuucuauuaaaagauaaguauuugcacaagagggcuuacuugugucaucuucuccccugcuuggaaugcaaguaauacuaaagcuugaagcucagcagacacacaugaaggaaaggccaagagaauaugagauuccagccuaaacauuggcuuuucugagccaugaaaugaacccuggaacuggaugcgucuagacuucguguuuuguuaacaacuaaugucuuucuguuuucagccacgauuauuuagucuuucuguuuuaugcagcucaccaugucuuuuuuuuuugagacagggucuugcucugucaccccagcuggagugcaguggcacagucauggcucacugcagccuccaacuuccgggcucaagcaauccuucugcaucagccucccaaguagcugggacuacaggugcaugccaccucacccagcuaauuaaaacaaauuuguuuuugguagaaaugggguuuugcucuguugcccaggcuaguuuuaaacuucuggcuucaagcaguccuccugccucggccucccaaaguguugggauuacaggugugagccuggcccuacauauuucaauauagugccaaaaauaaaauagaacuuccccgcuucagccuugccaaaagucuuuauuuggaauuuauuauauuugucaauuuaaguuauuuguuuuugcugguugcgaaucacugggauauuuucuuucuuuuucuucuuaaacagaugcauuuguuacauguacacaaggccaagcuuuuuugcacugaaggacauugguauaugaggguccuucucuugaauaaucaauauuuucuuauacucuucacuccagucaugacuacucagcuuaaauguuacuucuucagggaauguucccaaccucaguuuaaauuacacccuucugauuuuaucauuauuucuuaugacaucuuguucuuuaccuuaacuuuuuauaauuuaaaauuguacaaaguagaucuacauaauagaagguuccugguuuaauguugaguucucccaccagaaugugaauucugugagggcugggaccaugucuauuuuguucaucacuagaggcauagugccuacuaagugcucaguaaaucuuuguuaaaugaggaaaugaaggaauauaagccugaaauuuuuagauuucugcaucuuucauccuccugcccugucaccaccaagaauauuagguaacaugaaguguucagccacagcacagauucuguugcauuuguuuggauuauauugcucccuacuggccaggauuuagguuuagauuuuaggcuuuuagacuuuaauuuuguuugccucaauagaaaauauaaugggaguagcauagucacuuagcauaguaucugaguaaacauccugucaguuccuucagaagagugauacauauuuugcauacuuuaucucuugcguuacgauauauucucccagaauuuuauauuaucuuaagcuuugcuggcacuauuuuuauauauugaaguuaagagccccuaguagugaauguuuuuauuuucugcuuuuggauagcacuagaagcauggaaaugacuaucauuuuagcucuguuacuagucacaaucauuuaaaauugcauuuggaaacccuauuuucuuucugaaaaaguaggcucaaugggggaguuguaagaauuauugacacaaguuauugacuuagaauggagguacuuuaaaauaaauuuuuuaguuucagcaugcuguaauucuagauuguugguauuaguuuuaccgugucugggaagauuuauugugcauuuuugaaaugaguguaaaugcuguauauaugugauaguaagggagaaaacuugacuaagauuuugucgauuuggucucauuucacagcuguaucauagguuuuuucacaucauuuuagguaaauuacuuaacauuuagauaaucacauaauuuauuuccuacaucaggacacuugagaucagugaaagugggugcuauuaaauaauuauacuggcaugacaggcauaaacaugaacugucuuggggauacugagacauauggucacucuauuugauaacaauaaucugugaugacuauguuaaucugcauacccuugugaauugcaggaacuaagaauuggaggcucaucaaagagcuuuacuuucccuuuauucuuuacggaauggcugcauccucaacaccuucugcccagaggugugauucuucaauuguguggaucacucuggguccccaaacugaugugguucccugggcaguaggagacugggacuguggguuguucucugcuucagggaugaaucucuuugugcaggauuagcuggcuguacuaagccgggcauccaggaggagggcauguugggcuguccagacacucccaaggacuuggcugaccccaaagauuucucucugccugucucuucccaucucuauaaaucaggcagcacaggaggaacaaacacauguuauuguuuuaccuugaagugaaauccaccuauuccuccucagugcaggcucaguaucuccugagccagccucagugcauugugguguaaagagaaauaauuuuuucucccugugguguuuaagccuaauucaaauagaagcugcucugugauuaacuuaccuuucugucauucauugaucaaauggugacugaagaagaagcugaaugaaggcacagauagcgagugcagcgucaugucacacaaagcuuuugcauuugucagcaggggcugguucacaguuuuguuuuuuuuuuuucuuuucuuuucccagauuaauuguuacuugucacauguagauauuugacuucuugaaagacuuaaaccaaaacauuaaauaaaguagcagcuuagaauggcaaaaugguugguuuuuuaaacaaacuaaauugacccaagagauuuuagaaugacuauauuuuucaguuacauuuuugaggaaaagaaaauggauaucaauuacaaaugggugguugcagauacauuuuuuuaauaguuccaauaauacacauuuuuuuuauuuaccagaaaaguacaaguucagcugcaaagaaaaugcaguaaaacuugguaaaguuaaggaaugccaccuucugaauacucgauacauuuguuuguaaagagacgauauaucguaucaucucuguagggcauaaagggugcuggcaauuucaaaacuaaaaucuguuucuguguuauagcauauuaucagcaguaccagauuuacagugaauacauuuaagauuugaaagauauuuuggggacuuuugguucuuuauuaaaucuuuauauaucaugauugauaauaugcaagaacauuggcuuuuuuuccuugcucagcauuauucaaaaauguuuugcaauaaaauccuaacaccauguuguccauuuucacugcccccgaccccucauuuuaaggaauaucacuguacccaguccauuuuggguauccugacuucauaaaugagggaaguguuagcagaguggauacuuaggaguuugaugucuuauauccugcuccguuuggacuagaaccuuaaucuuuucaauauuuucuccuuaaaguauacuucaucugucauuaaucuaaauuaucaucucacauaaagcagcugacuguugacguuuucaguuaucacagugugauccugaaauggggaaggacugaacagagcccugaaagaugagaguucggcucuggcuguacccuagcuugugugaucugugaguaaaugaccuuuuccuccuuuacuuucuucagucuaaagcagaacugaaauaaccuauucucuccucaccccuagggacauugcaaagauucagaacauauucucauuagugcgcuuugguuuucugcaauaaggaggguguguagacagagcuugguauuguugccacgagugcuggggucuaauaggaacgcugguuuuugguugguuguuuuuuuaacuugcaugguguuuuaauagcagaagauuaugguuucuucaaaauaugguaaaacgaagggauuuuuacacaaaguuuuuuacuaaaaaugacgauguuaauggcguacuuuauuugaaagaagccuuauuuuuauuaguaaaauacuugauguauguuuuaauguguguagauuuaaaauacauucuuuaacauuauucuccauaacuauucaaccucacuagguuuuccuguuuaguuagcaauggucuuuucuuuauuaggcuaaaaaagaaacccaucaaacccugacaugagucacaugauuuccacauuugacucugaauuaauuggguaugagaugcagccuucccccucuccaccccgugugauacacuucagcucuucccagcaagagagguucuguuuucucucucugaaagaaaugcagagagaaaggaaaugccuagaugguuuggcuuccacuaaguagagaggaggauagagucuucaggcauccucaggaggccuugagugcacaacaagacagguggcuucagcgcuugcuuguggcccuacuguccauacuguucagaggucuuggugaugugucuugcagaugcuuuguguaggucuuugaaagagaacuugaacugaggauggugugcugugaugaacacagccagggaugugagauuagaaaaucuugaggccgggcacaguggcugaugccuguaaccccagcauuuugggaggccuaggcgggcggaucaugaggucaggaaaucgagaacacccuggcuaacacggugaaaccccgucucuacuaaaaauacaaaaaauuagccgggcaugguggcaugagcuuguagucucagcuacucgggaggcugaggcaggagaaucacuugaacccgggaggcggagguugcagugagccgauugcaccacugcacuccagccuaggugacagagcaagacucccucucaaaaaaaaaaaaagaaaaagaaaaagaaaaaaagaaagcaaucuugaguugaaaaugcagugagaagauugaaagauaacagaaugacaaguguauauaaauggaguugagugaguugcugaguguauucguuuggcuaguuucucucuauaaauaaauauagaaaaaauaaaaaauauaaauguguguguguguguguguauauauauauauuuuauauauauauaaaauaaggaagacgagaucuguaguuggcaaccuggagacccaggagagcacauggcauaaguuucaguucaguaccgaagaccugagaaccaggagaguggaugguguaaguucuaguccagguccaaguucaaaggcaggagaaggccagugucccagcuugaaagacaggcaaagagagaauucuuucuuacucagccauuuuucuauucaggaccucagugaauuggaugaggaccaccacauuggagagggcaauccguuauacuuaagucugcugauucaaguguuaaucucauccagaaacaugcucauagacacaccacauaauguuuaaccaaauaucugggcaccccaaggcccagucauguugacguaagacuaaccguuacacuaggcaaaggcauugaaaacaccuaguuuccccuuaguccugucuuuugaaggcuagggguguuuuugguccucuaucuaugagcugucuguggagcagugacagugcuguggcugcauggcagccagcuacauuuccuggauacugcugcuugaagucuaugugcauuuuuugcccuuggcauaaauaaugauagcaugcccuuaaauggaaacuguucaaccuaugaugaaaauaucuugauuacucauaugaauaguggcauggaagaacacagcuaguuaaaauucacaguaauucagaaacucauuuaagccuauucucuucuaagaaguaacaaaauuaauugcucuuucuguacaugcccacucagaaguuggugcuucaagagaugcgaaaugacaggcaggugauuuagagggagaaggagaacugccuuggauaauauauggacuguugucuaacuucgccauuggaauagauuugggugucaguuaaaugcuuugcuugguguuucaaguuuaaugagacagcuguagaauaaacuaaaaucauuuucuagaacauacuaagccuuucccaucugacuaccuugauacuucaguuucuuuaucuggaaacugucuuuuugaauggcuuaucuuuuuaaucuugauuuaaaguuuacuuccucagauaggccuuccccagccauucuuuuuuuuuuuaaucaaaaaauaacgucuccuguccuauuuuuagguuucuaaugauuccuacuugaguuguuaggccuucgcagccucagaaaguauguagguuuacaguaaauuauacacuguguauaauucauuuuucaauauauuguagguauauuuuaagguuuaguuaagaaguauguagggguagaagaucuuauguuuuuagugacauuuuaugauuuacuauuggcauuguauuuuccuuccauuuuuaauuuuugauuuauauuauuuuaauuguauucugucagauuggcuggagcuauccuggacuuuaguuugagggaugacacuuuggggaguaaagauuggguuuacuuuguacucgagucuuccacaauuuccuuuguagggcuaaccguugucagcaaguauuuaugcaacuguugucuuaugacuacauagcauguauuggucauagagucuaaaagcuucuuaaacaaagcaugggauuuaagaaagaagaauuagcagauuaagccuuaauaauauauaaauacuuuacaagugaagguaagacuuaaaaagauuuaauagcauaaacuuuaauaauucauguauuagaggcaucagguuuaaaauaaacugcuguucuuucacuuauuuugucuuauuuccgucuuuaaauuagaaaugaaaagaaccuguaguuguuuuguuuuuacugugucaaaaaaaugcuuaaaagucauguuucaugguggauuuuuaaaauugugguaaaauauauauaacaugaaauuuaccauuuuagccauuuuuaagugugcaguucaguggcauuaaguacauucacaugcuugaggaaaacaccaccaucauccauuuuucagaacuucaucaucccacacugaaacucuguacuccuuaaacagcagcuccccauucucccacccccccugcccccgguaaccacuauucugugaauuugaugauauuuuaaaauuguuguccacagugauuguccgaaccaauauauaguaaugauaucucucugugugucuacagggaucaccuccuuuaacgugacuguauccuaacuaaaugcauaauugccuuguauugggaaaugguagacacuucucgaggaccugaaaccauucaauuuagucagugcuccuagccaucacuaaccuuauguguucacccggagucagaucauuucucucauuuaagaaaacaauaauucuagaaaaugacuuuuaagugacaggugguaaaauggacugucuugaguaugugcuugauacuccaaacuuuaccagucugcacugagaaggcaaaaagaaucaguaacuguuauguaauauuuuuaauacuuccuagcuugucaguauaaugccauugugaaugcugugcaaccaugcaaaauaaguacauugaaauguagggauucagauggcuuuuuagucauuuaaugagcaauaggaauuuuuggaauuucaaggaaaguguuaccuugccagaggacuugcucuguauugcuagggagucucacugcucaggagacugaggaacagagcagggcaugcagccuaucauugccguggcugcuuagaaggaagcagcagcaagcaggcaugagaggcagccuauuucagggguugcaaaagaaacacaugguccauggcgcuuaggggagggagcauucacaucccaggcggacaccaggggaagcgccugagguugguggugguuucaguaggugcugaaggccacgagccauuuuagccggugcauauggggaagggagacaaucaugacaugggcauuccugauaaaggaggccaccggaguugaggguuagugguagggaaaaaaagagcagcuguucgaguuuugaucagcuggagugugcgauuuagucccuggaagagaaaggggcuugggcccguguggagcacuuugauaggcuaaguggaacccugauuuugugaaacuuaauaaacuggugcuuuagaaagguggguccaggaauggugccuagcgucaaucagagaagauaaguuauuuaaaagggaaagugguuaaaggcuguuuuaauucuccaggaggaagaugcugagggucucuacauuauguccauugugaugaggguggaaaggagggccaaauggcagagauauuguccagacagaggcuggcugaacagcagggauaaaggagagaguggccauaaagccuaguggcuugcaaugcauauaguauaacauucaagggccaggcacgguggcuuacaccuguaaucccagcaguuugggaggcugaggcagguggaucauuugaggucaggaguucaagaccagacuggcugacauggugaaacccugucucgacuaaaaauucaaaaaaaaugcaggauaugguggcccacaccuguaaucccagcauuuugggaggcugagacaggcagaucaccuaaggucagaaguuugagaccagccugaccaauaugaagaaaccccaucucuacuaaaaauacaaaaauuagcugggcauguuggcaugcgccuguaaucccagcuacucaggaggcugagauaggagaaucacuugaaccugggagguggauguugcagugagcugagauugugccauuucacuccagccugugcaacaaaagugaaacuccugucucaaaaaaaaaaaaaaaaaaaaacaaauuagccaggcgucuuggugggcaucuguaguccuggcuacucgggaggcugaggcaggagaauugcuugaacccaggagguggaagcugcaguaagcugagauugcgccacugcacuccagccugggcaacagagcgagacuuuguuucaaaaaaaaaaaaaaaaaaucagaaggcauaaauacauacaggaugaaaaaucagcuucucuccugucucuguccuucagcucuuaccuggucuuagacauuuucuuauauaugcauguauaugcauaaacuacauuuauaucgcauuucuaaaaggugucagguaccauucacacuauucuuguuuuuauccuuuaacaguauaucucacagauacccuguaucaaauguaucaauacauguagaggugccuuauucuuaauuuacuuagccaguccccaaucaauaaaaauuuguuuccugucuucagcuuuuacaaauuguuuagugaauauaauauccucauucaggcaucauuuugcacacauacaaacagguauauauguagguuuaaauuauugcuugccgaaauaaaggauauaugcauuuaaaauguugauagauauugucaaauuaucuucuacaaagguuuuuaccagcaaugccucuuucuuagacccuuacugauaguguuaucaaacaauuugaucuuucccaaacugcacauuaaaaauacuaucuaauugucauuucaauuugcauuucucucaugaaugcuauugagcaccuuguuacagcuuucagaggcauuuguaauucauuucgggggaucguucugucauuagcucauucucauuuugcuauucagagguuggacuuauauggagugcuggugaugguuucucauaaaucacuauucuggaguuuugguggauauauuaaggcaacagucuuccuauuuuauuaaaaguuuauuugucuuaagagggaauuuuaacuuugguccaaugucuggggagcugaugguaugcuguuucucuuucgaucguaggacaaguuagagaaauagauuuccuaucuugaauuauggggugugugccugcaauccaccaccugcucuggcugucgugcaguguucuuccauggcuucuggguucuguuuguuaacauuuuauuugagauuucugcauauagaucauaaauagugcuuauguuuuauauguuauuuaucacuggaacuacuuuucagagaucaccagucgccuucuggugauuacauuaacacucccucaccuuguuuacugucuuccauccccuucaacucaucuguggcauuucacacccugacuaguguucucauuucaccuucuugaaauguucucccuccucuucugugaugugaagagcugagcucugugguccuuggugggucuuccuccucucagcgcuucugucuucuccccagagccucccuccguggccuuucgacuccggugaucacuggcaugggccucucucaagcauugcuuaacauguucaucugcauggccugccaucaccuggaacucaaugugucugaaacaaacucagucgucacccccaccccaagucagcuucucacucaaccucuaacguuuuguuaaggauccuggcuccagcauguguggagugccuuccaugugccuggcucuaagaagccagguagcaaggagaaaaagugacagcaaagggggcaggcaacaaauacagauuucaagagacuugaagcgagaaagaaaaggccacagguuggagagggagaggcugacaggagccugaucugucugaggugcagaagcagucagggugagaagcaucggaugcagugacggaagaggccaaagggagcaguguccaggaggcgaccgaggggagcaauaagcuggaggaggaguccagagggagaaggggaggaaggcaggaucuagagagacugaugggggaacaccagcugccggaggaugaggccugugcugagaagagugggguuugguucuugaggagaauagacauuuuaaguccucugaacauuuuucuuaauguguauuauaccuuugugagcaaaaugcuguucucagcuacuuuugagagacucguaaagcguguaggaggacacggaggaccaugggggacucaucuuugcacauggugggugcucgcaguuauuccuugaauguaaggcugcaucagcaagugcauucucucuucaggcaagacugcuuuucaaaucucuccauuagcaguuccauaucagcagcuuuagggcagguagagaaggcguucauaucucuugaaaugucaaucaaaccauuuaggucaaguuucagugucugucucagugauguuaucucuguggguaguaaggggccaugaagcccagcuagcagucacccucagcacuccugagaggccucgcggcauucccuggaauuccucagucuugggugcugcuucuuugcacggggcuucuucucuccaguuguuugucccaauuguuaagaaaguucauaccuguggagaauaugguucuucacuuugcucuguccuucccacccacggucucauacaccugccuagaacacuuccucuguuugcaucauaacauuucacaugugauagcuguucccuucuuaugucucuuucuccaggauaaagguaaccuuuuucgcucaucuucuaaauacuugauuuccagacacuuuaauucauaggcuugcauuuaguacacucuaaauugaacauuggauugauuguugucaguggggucaacacugaccccuuguuccuagauagaauuauaaucugacuguccauguuuccuuauaguauccuguggugcuuaucauaagggcacuaaguuuuuacuuuuuuuuggagacagagucucacuuugucacccaggcuggagugcaggggugugaucuuggcucaccucagccuugaccuucugggcucaagugauccuccugccucagccucccaaguagcugggacuacaguugcaugucaccaugcccggcuaauuuuuguguuauuuguagagaggggguuucuacauguugcccagacuguuaacuccugggcugaagugauuugccugccucggucucccagacugcuaggaucauaggugugagccacugugccugaccaaucuguacuucuauucagaauauaaaguguguuuuacuacccaugcucuaucacucuguauguagaaauaaauuacguauauguguaugaguguguguguauuauauacauaauuauauucaaugcgauuuauaaaauacauguaugauauggguaccaaauacauuaauaccauauaauuauguauauagaacaugcauaauguauacuuuauuauuauguauguaacacauauguuggcauguguguaugugugugagagagaacaguuucuauauguuaaauaauuuccauguuaauuuuggugccacugcagaaucuuucugagagugagaaacuccucccggggcauguucgccucugaacccguagugcagaaagccugaccucaucagaccuaauacaggaagacucgcugcacuuguggccccaggccuggccgccuguggagcacagagcauggccauugccccguggcuuggcucuguugagggcugccuguuagcuccagcuuuacugguagccugguuagcucuuuagguaaagagccagacaaguucaauuugguuuugguguugauucuuuccaaagcaaagcaaauuucccgggugugauauaguguucagauuugauuuugcauguugagcccgaggcauuccuuugccugacuuggcuucucagcucuguuuguggggaacugggcuguagacauuugcuguggaccuugugucagagguggcaguggugcuaguggggaagagagaagagaaaugguggagugguccguguuaucauccuguucuagugcucagaacugcucacggagguguccucagcccaucccacagccuguuccuucccggccgcacuguuuccucuuuuuauccugauucucuuuuuggcacugagaguggccauuuuuccauugccuguuuccucuugcucucccgugucccugaaauuagccugccccuggccuggugcgagcccaaugaggggacauucgggcugcuguuccuucaugcuuucucccaccucauagcccuuccccgucccacagaaagaaucuuagagaguuggccuacuuucugucgaugcugcucccuuggaggaccucauagaaugccacaaauucuguaucagaaauagcucuguuuauuugaaugguuggaugucacccucuuccagaaaaacacuguuaguacacacggggaauuccuuaagaugcggagcucuucuucaaauuacuccagccccauguggcuccaguuguuuuuuucaagagaugacucaucuuuguggccacacuugggaaauuuaaagcuguucacucuacugaagacagaggcuggggaugaggaaaacagucacagaggccucugauuauuauuaagguagugcagguaucugucauguucuccuguaauauuuucucuuuuccucucccuucugucaucuuccuuccucccagcugccuuguucccagagcccuccucauauuuauccagggagugucacugcauccaacauguuuguucccauguugcucguuggcaacgucacagccaggacugggugacaaagaucuccucugggucuugcuuucccacugugcugaguccagugaucaucuuucauguuuuguccaaccaucugcccugagaucuugcugucuacuucuuuugauguuuguagucaauagcuugaagugacuucuucuucuucuucuuuuuuaaccucaguaaauuauuacaaagcaaauacccugaccauccuagucaaaaaagaacauuacauaagcauugagccucucccaaacaccaaucccuccugcuuuccaagagggaaucacuaucagaacacuugggaucaucacuucuuucuggagcaccucguuugauaccucauugugaaguccagguuguucuucucacuugugcacuguacgaaucaccaaauauacuuucuaaugcuacugaguuugaugagaacuguucuagaacacagccgugaucugugguuuugaauauaugugguuggauucucccauucauucaacaaguauauguacgugcugggcacuguuguaggugcuggcaguauauggaggugcggacuggggacaaaaucccugcucucaugcagcuuccauucuucucauggagcucaagaaaaugcucuuaaaagacagagaauuagaaaaaauaccucuccacuggcuuuuuaagacauaggugagaggaaacagcuauuguucagucuuugccaucacuucauugauucugauuuuaagcaacccaguuuuugagucugguuucuccaucaugaaaauguugcaaauuuuagggcuguuguaaacauauauagcuguagaucaagucauuuauucuagguugaauuucuaagauauucagcucucaacauuagaaucauuaagaauauuacuccuacauuuacuacacuuucuucacaaucagcaugcccuuagagugggagaauuuugaugauugauuuuagcauugauaacugaaauauuuuuuaaaauggaagaaaauguuaauaaaauauuuugaugacacacuuaacauguaacaugaaucaaauuccagauuuaagccaaaacucaagggauuacauuugaguuuuaaugcuuagaaguuugaguacucuaugcuuucuaccagugcuccaaagacuggaaauaauagaauugcuuguuuauuugccaaaucaggcacugguuuuguuacuggaggaagguguccagguucuuggcguuuugaacaaagaauuagacaaaacgcacaaacaaagcaaugaaagaaaaccacagauuuugaaaguacaugccacagaauggaaaggggcaugagcaaguggcucaagagcccaguuacagaauuuucugggguuuaaauacccucuagaggguucccacugguuacuugguguacacucuguguaaaugaaguagugguccacgaccagucugauugguugcggaaagggacuaaugagaggcugaagugaaguuacaaaguuacacuccuaugcaaaugaagacuuggccugugaccagucugauugguugcaggaggggacuaaucagaggcugaagugaaguuacaagguuauacuccagugcaaaugaagacuuggccugugaccagucugauuuguugcaggaggggaccaaucagagauacuuucaauuuuucaucugccacauggagaagagcagggaggaguagccucugguucuuuuguuacuugggcauggaaaguugggguuuuccuuuugauuuaguuguaggaagucagugugaauuggccuuagguucccugccuccaaacccuauucuccugccucaguuugaauucuugcaccagagaaaauccaaaacagaaggaauuccacucuuuuguguucaugguucuuuucaaaagcuaguuagagaguguaaaauuuucaauauuuauauuaaauaaugguguuuuaaaguguaaaauaguuuuggacagaaauaagaaauagcuugcuguguauuacauuuccugaaacuacaggaaaguugauuuuugguauauuuugauauccauacccuucaacaaaagucuuaagucaaugacauuuuacccccauuuaucuguuuuguaccgacuacuauggcaagugacugugugugugagggaaacaguaaugcuugacaacucaugcuuccugauacagagguuucucuagguagguaguucacuuuuuguacaaagcuggcagguucuguggacagaaaccaugguaucucacagacugcauuuaaguuaccucugagauugcaaacuccauggcagaaaagaucacagcaauuuggguaucuguuuuaaauugacaacuuaaaaugcacaauauguuuauuucuaaauuuucaaaguuagaaaacaagacagccuauauuaaauaauauaggaauuuuuaaagcagaaugugcuaaauguagaaaguagcucaguuuuucuacuugaaggacaaaaauucuagguugacauacuccuauuuugaugaccugugauugguugaugagcucaaccuuaguugguaguauuucccuuuuaucccccuggggguggcuuuaaauaauucuagaauggcagcacuguguuaaucuuugguuuguuuguuuugagacagguucucacucuguccccuaagcuggagugcaguggcacaaucaugggucacuguagccuccaccuccuuccagccuuccaccucccaccucagcuucuccaguaacugggaucacaggcacacaccaccaugcccagcuacuuuuuaacuuuuuuguagagacaggguuucacuauguugcccugucuggucuugaacuccuagacucaagugauccucccaccucagccucccagagugcugggauuacaggugugagccaccaugccuagccugugcuaaucuuagaaggaaaauuucuuuccaaaugucuucuugaagcauauaguguauauaagaaucuaccuguauuuuugucauuuucauacacuucagaaauaguuguagaaacuuuauggugcgaugugcauuuaccaugaagaacaggcuuuguuagcauuuaccuaauaaguuccuagucauuuugauuaauucagucuuguugacaugaucucauauaagaucuaaccacaagaagcuggugcuuaaccucgauccucucauuuaucauugggauuuuaguaggaugcugauuuugaauaaguugaacaccuucuaaacuuuuuuccaaaauccagugcugcuaaaaacaguucucugaaggugagguccuggagaguuaggcgggaggugggugaagaggcuuuagaggccgauggugaucccaacuuccuaaacuauccaauuugggggaaagaaucuucuuugauuuuuacaauuuuuaagaaaaugaagucugagaucuuucuuacaaaaaauaauuauuuagucuuucugguacugauaauuagugagagauuuaucaauccuuuuuacccuuagaauuaaauauugaauagcugaguguguuggcauaugccuauagucucagcuacuagagaggcuaagacgggaguccaggaguuugaggcuaaagugagcugugauugagccacugcaagccaguauggacaacagcaagacccaucucuuaaaaaaaaaaagaaaaagaauuaaauauugaauauauuuaaugaagaaucagguuucuuuaugaguauucauuuguuaauuuuacaaagaugugcaaacuguuguauauacaaagucuaauaagauauacuauuuuauuacuccaaagagugcauagucuguaggggagacuaauaagucaacaauuacaauaaaaauugauaauaugggugaucauuguuagauagguagacagauacaugcugugaggucagaaaggaggguugguuaccuaacccagacagaucgagucagagaagguuuucucggaguggggguugucagaaugaacaggagguaagcaggugaaggggcugggagaccuuuccuuggcugagggagcuauguuuguaugacacaugugucuguauggcugauguuuccagggagguaguugaugacaagacaugagauuggucagguauucaggaaauaaauuaugaaggcaaaagacuuuagauuuuucugaagaguuuuaagcagaaaagugaccuuuaagacuucuguuuuagaucauuuugacagcagccuggagagcaggccagaggcaugugugugaauugguggcagagaacuacguuuguguuguacuucugguaaucucagugagagaugaugaagucuugaacugucagcaauagacaaaauggagagauggacaaaugccagagugauaugggauuuggaaguaaucaggccuggccccugacuggauaugaggaauugaagagaaggaagacuaaaggauaccucccaguuuucuggauuggguacucagguggugguugauaccauucacccagguaguaaaugcagaaggugguauuagauuugguuguguugaguuugagguaccugagggacacccaaguggagaaguccugcauagacaggugcaccuguagccuggagcuuuuaagggagacugguguuggaaauacaaauauuuaagagaccuugguguauaauuggcaauucaagccuauuauauuuguagguagaugagaccaaaaaaggauauguaguagagggaggagagggccaaagauggaacucugggguuauucagugauagggaugauggaagauccuuaaagaagaugaguaggagcguucauggaggugggaaggccagaagagaggccacaaaaacugagggaaggcacaguucugaagagggugcaaccaaugugcaaccaauggcggccaaugccgcacagaauucaaguaagaaaagcacugacaaguggcuacuggauugaguaaauaggaggguauuggugacacuguuggaaauagcuccagugcagugguagagcagaauccagaauucacuggguugagaggugagaggugaauggaugaggaauugcgaacaagaaguguuuaguguuuauggcucagugccuucuugggaaagaaggauacaaggccgugaaagaggggguuguagcuaugaagggagguuugucaagagaggggaugcuuuuuguuuuaguaggagaaauuaugugcugaaaugagugagccaugaggcuuuggccuaggcaagaaagcuucugcuugcauccacauaggaugugagcaggaaagauggaugcugaugcaauuaagguugcaugcaugcuaggaggggaggagguggggauggagggauuauuacuugaccauucuguauaucuacauuauaaaagauggcauuuaaaaccacaacacugggccaugugauuuuuguggugaagagacuagcuucacuacaagaaauuuggaugauuuauaaaucucuaaaccccaaugggagaaaaguuauuauuuaauaauaucauagauauucacuuuuauuuaaagagucuuguuagaaaacaaauuagaaacuccauguacgauuuuuuuuguugucguuguucaucaaugagaagguuuguuuaaauuauaucccugucauuggcauuuuggaacuugaggacaacagaacuguuacaacaggaauuuuagagccaauuuugaccacagugaaguggcugugaaggcugaaggccaagagcaugauugauugggugauuagaauucuuuuuaaagcaaauuagagguggcaggucugccacaggugagaaguacugcaaagaaaugaaucucauuaucagauaaaacuucuuagaucaucaaaaaagaaguuuaauguuuaaacuuaaacacacacacacauacacacacagcacgaaugaccugcaugugaauuccuguuugugauuauuauacaaccuagcaucuagccugauguucuguauaguuauaaauaauaaagagguauguuuuauaguuaauucaggaacaggugcccuauuugugaaauacauuuaucaguucaguuuagccacuuauuguauuuggggucuucuugaugauuuaauuugugacuaggcauuugaguuucggauccuugguguaaaaggagguggaggggaaggaaggaagccaggaccaguguuuagaaagggaaaagaggaguagaggacaaagaauggagaaugauguguauguggugguguguaggggaaacucucuaacugcguuuuuccucuacucuucacacuacaacaaucaucaacacagaagaaggcuucuguggccaaauguguggguuuuuuccccauacaccaaguggcaggcaccgguuggauguccucuaauucaguucugacacucucuacccagagauagugucagaucccacagguugagggcccaguccccaugacugucccccucgcucccugacagucacaaguccuggccucuugaacuucugacugaugacuuccucuuugggugugguuaauuuucuggagaggcucacaggacucaggggaaaacuuaugauuacugguuuuuuauaaaggauauugcaaaggauacagacggagagacgugcagggcaagguauaggggaagggguguggagcuuccaugcccucccuggguguuccacccuccagggaccuucguguguucagcuaucaggaagcucccugaacccuuuccccuuggguuuuuacggaagcuucaugacaucagcauuccuucccccaaaguauagggugggacucucucauggaagggucuuaagacccacuaucagaaagcugagggaacauacagucaaaggagggcaggaggucagaggccugccccugaggccuaaaacacccaacauggccuaacacacccacaauaagggcugugggaguuaugagccaggaacugugggcaaaaaccaauauaccucuuaacaccacagaucgggggugugucucagucuuggagaguggcacgaggcagcagucuguggagagcuaggauuucucaggaacuaauacacgcuacacaccaagcuaugugccgucauauacguuauauccucacaauaaccuagcaaggugagcagugaaauuauuugaaguuucaaaggaagaaaugaaaggaggugaaaacauauuuuuaaaagaucuuuuaaaaguaaagaaaaauagugaugaugauuuguguuagaguuagaaauuauuucaauuguagcucaugguguuauucuaauuuuuuuuuugagucuuagguguuugagucaaaagggcuaaaauuggcuuugaagcugguaaucugaugcuagcugaacucuccuuuugugugugcuuggaaauuuaauaauaaaacguuuuaaaaaggaucaagcaaauaaauaaaauagucuugguaaugauaaaaaugagagaauauuuaugaauagcaaggggacuuucuucucucuucugucagauuuauaggauaaccauagucuuugaaacuauuuuugagccaaaauuauuaacaagccauuuuggaaauaaagacaguagaaucgguuguuuuuaauggguugucuuagcuuuauauaaggugaagacucaguucagaaauagguggcuucuucaucuucauccuguugcagugggaguuuucucuaaaugaaggcguguuuauuuaugcuggaaagaagcccagggcuagaaauguuuugucgcagaagguauauagcuccaagggggagaaucagagucuaggcagugagcaucuuuucacguaaaacacuguggcagggaccguggggagcuacaaaggugggaagguaagauagcagugauaccauggagggcuuacugugugccaggcgcaugcuaaacacuucccguauguuuaauccucacugcaacucuaggagguagguacuauucuuucucauuuuuuaauuuuuauuuuuaauugcggugaaauguacaaacauaaaaauuaucauuuuggccuuuuuuuuuuuuuuuuuuuuuuuuuuuuuugagacgaagucuagcucugucgccugggcuggagugcaguggugggaucucagcucacugcaagcuccgccucccggguucacaccauucuccugccucagccuccugaguagcugggacugcaggugcccaucaccacgcccagcuaauuuuuuguauuuuuaguagagaugggguuucacuguguuagccaggauggucucgaucuccugaccucgugauccgcccgccuuggccucccaaagugcugggauuacaggcgugcgccacugugccuggccuauuuuggccauuuuuaagcauacaguucgcuagcauuaaguacauuuauggucucauguaaccaucaccacuacccaucucuagaacuuuaucaucuucccagauugaaacuucguacccaguaaacacgaacuccccauccccucucccccaagccucuggcaaccaccauucuacuuucugucucugaauuuaaccacucuaggaacuucguaugaguggaaucauacaguauuuguccuuuucaucugauuuauuucagugagcauaacauuuucaugguucauccaugucguaucaugugccagaauuuccuuccuuuuuaaggccgaguaguauuacauugucuggauagagcacacuguguuucuccauucauucaucagaggacacuuggguugcuucuaccuuucggcuauuaugaauaagacugcugugaucaugaguguacagauaucuuuucaagauccugcuuuuaguucuucuggguacagacccaaacguggaauugcuugaucauaugauaauucuauguuuaauuuuucaggaaccuccauacuguuuuccacaguggcuguaccauuuuacauucccaccagcagagcacagggguuccaauuucuucacauaggagauagguaauuauuuguccuucacuguuacaacagcggaggaaggguagcacagagagguuaggugagcucacauagcuaacaugugcagaccugaaucugaauuugacuccagaagcuuaccuccugugacauacagguaaggugaggcacagagaguccaaggggcaugacugagggccccugccucauagcaucagugauucagagccugccuucagaguucauguuaugaaggauucguagaguucgcucuuuuuaaauaaaaauucucuuuaaaaaaacuaauuuuggccuggcgcaguggcucacgccuguaaucccagcacuuuggggggccaaggcggguggaucacuuaaggucaggaguucgaaaccagccuggccaacauggugaaaccucaucucuacuaaaaauaagaaaauuagccggcugugguggugggcacuuguaaucccagcuacucgggaggcugagguaggagaauugauugaacccaggaggcggagguugcagugagccaagaucgugccauugcacuccagcccgggcaacaagggugaaacucugucucacaagcaaaaaaauaaaaaaaaacccaaaagaacagcaacagcaacaacaacaacaacgaaacuaagcuuugcauauuuuaugacuuuuuccugccuuuccaaauuuaugcuuucaaauguucuuguuauuuaaaacaucgucuuuaaaaagucuguaguaucuuugauuucccuuuuauuuaagauuuuuggguaaaauuuugccuuuaaauaauuuaaagcaaauaugcguugguuccuguggaguuuuuaaaaacaucuccacucuacccauucccaucagaaguuuacuuuuaaauaaaaccaagcaacaguaucuaaagcuggauuuagguuaggggaagcccggagggcaucgaugguaaacacugaggacuuugaacauuuagauacagugaauguugcagcuuuaucaacagaggagcaacagcuaagaaacuuacacauuucucuguauuacuuuugugaagaggauaugcauuuucccucagagucacaguggggcugcauggccuugugaaaauagugcugccccuggaugaugcuggucugcugggccugugugucacuucaugucacucucugucuccacugcuucuuguauuguugucagggagaugccccuugaaaauacagacuuaguggcuuccuggacccugccucaucgggguugcauuuuauggcugggaagccugguuguacaugguccucagccccacuccugggguuggggguggguggcuuguacagugcaccaucuuagcuggugguuuuagacaaacacuugcuuuagacaaaugcuucuugucccagcauaucaagggcccaugaucuugcaaagaggaacucugauuuggaagguaucuuuagacuaaucucuaauucggugguucccagcuauggcaguacacugcaguccaccuggggagcuuagaaaaacaaugaugcuagagucucauguccagagauuccaguguaacacauuugaugugggccuuggucagugggauuuuuaaaaagcuucugaggugauucuaaugugccaucaagaugugggaccacuacuguaauuucuuuuuaauaccuuguucuuugggcuuuaaauaagauuuuuacugucaaaaaauacaaaaauaccaggagguggagguugcagugagccgagaucgugccaccgcacugcagccugggcaacagagcaaaacuccaucucaaaaaaaaaaaaaaaaaaaaagauacaaaaaugucuugucuuuucuuaggguguccuuauuagcugagauugcugaaauuuauuccucacauaugaagggaauuucuucuauuuuguuaauuugugguggaagaucauuuuuaugucuuuauagaguauguuuuuauauugaaaugauauaguguggguugcuaaaauauagaucuaguuuauucugcagagccuugcguuuuggaagauaaagagcaacuguuugcuugccuagauuucaguacaagcuuuagcucacuuuggguuuugauggcaguuucauuuuauaaacugaagacuauacuauguagacaucugugcugauauuucugauaguuccugaagguuucucauuuagacugucaucuccucuggcgaacauaguuauaaugcuuccuacacuccuguguauuuaaacacuuacccuuauuauuaaauuagaaaaucuagguguaucuuugaaccauacagucaaucugaggguuuuuugguuucaaggaaugcuuugucugagccccuucugggccccugggauuuguuuaaaauuacagagcuguaucgguauaaucuuuucuucuauaacagcaauggcugucuuggacuguggcuuuaagcuuauucgguugaaaguucaucaaaguuuggagaugacacuugggguucaggggaaacaaguauucucuuggccuugcuuuuguuuaaaagaugaguuuagaugugccauguugguuugcugcacucaucaacucgucauuuacauuguguaugucuccuaaugcuaucccucccccagccccccacccuccaagaagcccuguugugugauguuccccacccuguauccaagugaucucauuguucauuucccaccuaugagugagaacaugcgguguuugguuuucuguccuugugauaguuugcugagaaugaugguuuccagcuaaaggacaugaacucauccuuuuugcuaguuuuccaguuuacagauuauaggacuucucagucucgauagucacauaagccaauuuccauaauaaauuccuuuaucuauuaaaaaaagauuagauauaaaauuuuaaauauuugccuuuuuuauuuauauaugagagcucugucaguaguuggagcagaaaguuuagaugucaaauuuaaaaauguuuucauuuuuuguuuuuuauuuaccuaugauuuuauuuaucuaugaggacucugugaguaguuagagaaaggauguaggaucccugguagauuuccugcuguguaucucuuagagcccucacugagggcagaaaaugauuggauuacucuggugguugaggacaagaacuucuuaccugcuccaaaaccuuuuuugauauagguagaacagagacauaugugucucuguguguacauguaaguauauauaacauaagcauguccaaauguuaugucuguuuauagucauacacagcugcugauucagagugacauaguggaaauucuuccugaccuuugacuuggaagggacaucugauggugauccuuauuuuguuuuuuuucaaagagaagcacauuuggguuugauauggcauucacauuuagauaauuucaugacgguuguggggacugggaauguagcucucuucucacuuuuaugcagauuuuuccccuuaguuaauuacugaggugacaggugucuguguggagaugguggguggggcaggggacacuguuggaugagagagacagauugcuuagauaacagucaugggcaucuggucauuuccuuuuucuuucuuucuuucuuuuuuuuugagacagggucuugcucuguugccuaggcuggagugcagugaugccaucauagcuuagugcagccuucaucucccaggcucaagcuacccuucugccucagccucccaaguugcugggacuauagucaugugcuacuuauaccuggcuaauuuuuuuuauuuaaaaaauuuuuuuuuguagagauggggucuugccauguuguaaacauggggucuugcuguguuuuguagagauggggucuugccauguugcccaggcuggucucaaucugccugccuuggcuucccaaaguguugggauuacaggcgugagucaccaugcccagccacaucugguuauuucugaaguccuagaaaaugaaggcugugcuuacugggggugggagggaguguuuggggggcucuuggaucaauugguaugauuuuuuucuagucuguagucuuuuauuuuucuucucuauaauuauuauucucugguuguugaccuccagggucugguuaguuaccuaugucacuaagaaaaaggucaaggguuauagaaaugaggcacuuacuuuucugaugccuuaacuuaguuugcaacauccugggaguuugaaauaagaugguagcaaaguuugggcauaguggcaugcaccuguagucccagcugcuugggagccugaggcaggaggauccuuugagccuaggaguuugaggcugcagugagcugugaucgugccacuguacuguagccugggugauagaaugagacccugucucuaaaagaacaaagaagauggcagcaaaguaacggcaaguucucuuucaaagccuagcccacuguuuugcagaagguguucugccagccccauucuuaucuccaacccaccuaccccaucuccuggaucaaagccaaaaucauuucuaagggaagcaauugugaaaucauucccuucuaucaagagcaguuugcauugucuccaugcagaaagugugcaguuuaauauauuaggguggguugcggaguggcaacuaauaucaaacaauuuuuuuuuaaacuaacauucuaguuuuauugaaaaugaguccagccugcugggugacagaguaagaugcuaucucacacacacauacacacacacacacacacacacacacacacacacacacacacacaaagaaaauggggcuaaauugguggaccccacacaaguaaggguuaugucagaugauuuuggugaaccauccuucauguugggaauucacucaauaaaacagauuaagaagacuuggucccuacccucuuaagaacuuacaaggagcuccuuauguuguuggucauuuaucuucuuagccaugcacuuuuccaguuaccagucaugcccaccuacccucuuugucacuuacagacuccaggugacagucuucccacauauuggaacacuucuacuucagaacuuuccucuagagcucugcuccccuaaguuugguccuaggaacagcagaaucucaggcgccauccaaaccuguguuguuguguuguuuaacaagaccucuaggugacuucugucugcaaaacauguuaagauucagauuuuauuucaguagggcuugguggggacugagauucuaacaggcuuccaggcagugcccaugucggucugugcaccacgugguagauagcaaggcuuugcuguccagagagauuacaucucccuugugucagagagucgcaaagcugcuuggguuaucggaugacaugggaugacauaggcuaaucaaguaccucuggccuuggggaguugaaguuaaaaaaaaaugugccugguuauuaugugcuagcacaguucucagagcuuuacuugcacacugaauccucuccucaaucuuaggagguggacacuauuacuaucuuuuacagauggggagaugaggcacagagaaguuaaguagcuugagcaaagucacaugaacuaaugagugaaagagcagggcugugaaccaggcaguguggcuucgguaccaagguaugaaauuacugugcacuuccugacuguguggggggcuauaacuguuggcagggagagucggcucacggugcagaaaugagaguguuuugguuugggcaguggagugguuccagaaggcacgcugaguucaggacugagaucagcauaaggagggcugagcaacagagagcgggacugugugguucauguucgauggacaggguuaguggaggaagaagacacacagggugccagcugcugaggaacgagaguaaauauagcaaacuuuuauuaagcauucauaagugucagauacugggguuuacauuuguuguuucauuugacccuuauaaugauccuguggugcagguacaaaucuuuuagagaaggaaaccgaaguucaagagaguaauucucccaagaucauacagggagaagaguagcuuaacuugaauuuuaagucagugccgucugauuucacaaccuguaugugaagcuucuuugcccugcugcuucccuggcagggacucaguggggaagugaagguauagaggagagaaaagaacuugagcauugacacuaggguauaaagaggugccuggacauagagaugaagggcaagaaugcaagagcagcaccugggacugacugguugaagcuggacuggagaucucugagauuuuccugagugggacuggugccuggacuggcacagggcugaagcugcacguggggcuaaauggccccaaggugaagucgguugccaucugcugguugaggcuuguuagggcugagcgcacaccuuuaccuccugugucuucauccuugugucagcucgggagagccgcuccugcccucccucugagccugcccuccccacgacucuguuucuuagacaaauguguuugcggccacgcuggcugcuccccaagcccccugcuucucugaaagugaaaaguugcuucugcuugccuuccuccaucuuugugauuauugcauuucuugccacagacauuucucauugcucccaaugugaaaaucugggcuugugacuuuaaccaaaugauuguacagccccaugugaccucaaauaaauuuuuuaaauggauaacuaagcugacaguaugugaagugcgcccggggaauucucugccucgggaugcucguaaugaggggaauugacugggguuagcagauggacacugcucauuuuuuggcaaucauugaccaaguacgcaacaccuccagguggcucuccguggacugcucuguguggcucagcccaugaugccugugcguccguagaaugcuaauggucccucuuccucccugaguaacauagcaggcugcauggucugguguggcucuguauccuugagaucaaagcaugcauaucauuuuuaaauaaaagauuaucuuuuaauuauagaggcaucauagcaguauuacaaaaagcuuagaaauaaagaagggaaagcacccacauuuaccacccuaaaacaugguaaucaguuuuuaaacaauuguucaguggcuuuucauaguuguaucaguuguuuuguaugugcguuuccccuuaucacuguauaauccccauaguuaccauuugaauggcuguaucauauucuguugugaugccacaucauuaauuauuuaacucuguuguugacaugugcguuacuuccaacuuuuuacaguuacuaauaacaguuaaagguauacauuuguacauguagcuauuuucauauuuugaauuagucucuuaugauagagucucagacauggcauuacugggucaaagaguaugaacauuuuuauggcuucuaaaacguauuggcagauugcuuuccagaagaguggaggcaauucacaaugccaccacaaaggcauucguuucccagauggccaacuugguuagggaugcagccucucacaguacaugagaagcuguguuuauguuuguguuuguguuuguguguguaaaaaacuuguuggcgcguuuguguauugauuuaagcccagggacaccaugcauugccuuuguuaauaggaauguacuaggugucuaaggauaacauaauggucauccauuaguauuuaaaauagaugugugcuugauauggauuaaagcaaggguauagguguuuccucuuucccuagaauucggacuuuuaaaaagauuggcaaaggugaguugacaagaguguucagccagugugacuagguucuuaguggcucccuucuuuuugggaauaccuagugauuuggaggcgaagguggaagucaaaggagcuugguaggagcaguagugggagggcacuggaaguagcugggcaugcgcucagaagagugccuauuguggacugcacaaagcaccucaccucaccuggugaggacagucuuuugggugcugaauggagugcuuguguggagaaggauuuugaggucacaccuaggcucagugggaaagauacugugauuaauuagcaauuuguucuagaucuuugucauugcaguuuucuucaauuuguuauccaguuggauuauaaacauuacaugccuucauguaggaacuguaccuuuuaaaauuacaauuuucuacccauuuccuaaaaugucuagcacauuguauuguauaugauguacguguaugguaguuuugugucugcugauugaaugaaugagggaaaauacuacuuuauccucauagucccaggcauuuuaucaaagccuuguguugaaguagugggaucccacaguuugccugcccacaugugaaaccuccagcagaccucacagggauaaaggaaaggaaauuucaacugagaaacuuagggaaaguaaugccagcagagaccuuugacucauuuauauaaccacccaaaacauugaaugagaccuccuuguuuuauagaggaaucaauucagacaaagaagagcaaauagcuuccccacgaucacacagauggugggugacuggggaccccaaguuggguccugauuccugguccaguguccuuuccucuacaccuuguugggagaacuuggcguacuuguuuugcuugccccucucccacuauagccccuacaaguguguauuuggaguuuucuuugcugucugaccaugcuuguccucccauguaacuggauuaggaaugaguuuagagauuguggccuugaggcaguagucagauggggguaugaagauuuauacugagugccaagagacagugccggaucaaaauucaauucuauucaaacuuacagcuuugccuuaucuccaguuuggaauauaaccuuuuuuucauuuuaaagggagaacauauaaugguagaugugguacaugauuugaguguguauuugauacaauugugauccuaauaaaacugccauucugauccauaugccuaggguagagguuuaagguuguuaagggagcaugaacuuugagcuucuugauuuaucuugugugacugaaaucuaaacgucaguauugcaucaacuccgggguuguuuuuccuccuuucuuuccagaaccccucacccccaaucugaugagcacauuugguuguguaguugagauucugaagcuaaaugcauuaauagugagggaaguauucacagugaaugucgaaugaaaugacugaggagacaaagcaggaaagagaauuaacagucuacugguucuuuuaacagccaugugauggcugcccugggaauugaaugauuuguagaugacuggauccugcucauuccaugguggcuugaggccccuugaaauugaugugaaccucguaagcugucagcaguuacagcuacuggguaaucagguuuggaauuuaugaguauuuacauuucagagggccuuuacuauguuucuggaauuuuggauuagaaaugcuuguccuugauauaacaguauuuuaugcacgcugcuggaguguuuaagccccuucacauucccagugugucccaguauguaagccacuuucuuucugggagagcaaaaagaugauauacuuaauccuacuuuuggauuaguggacaggaugauuuuucucugcuucucuacuaaacuagcuccauacugucuucuguacaguaacaagucacaugguaaaaagaaguuagaagagucuuacugaccugcuguugauaaauauuuuccuacagcaugcugaggugggcacauuuugacuuugcuugguuuugaaaggauuaacauuuuuuaacugauaaauacgaauuuguucugaaaaacuaaaaaaaaaauggagaaauugagagaaaacuuaucuaagaccccuccaacagaaugcaaaccacuuaggacauuuaauuuuucuuucauucuuuuuuaaugcauaauuuuuauguaguuguaaucuguuuaugaaaaucugguauuuuaaaaauuauuacauauguuuuucuuuguuauuauauauuuuuccuacagaagcuucauuuuccauugaggggcauuuguuaaaaucuuuacuugcucuuuccacauguuguccaauggcucaguccuuuacuuaucaguggggugugaguggguaauggcacuguccaucaguaauuaugacugaugaguuggcugucucuucacucaguggaggccaggccucuucuuucauuugagagucauugaucugaauggcucauauauuuuuccaauuauaaauuauccucuagugggcuuuuugugcauuaguucuuugggauauuuuuucagaguagaauugcuguccauaaaagggacauuuucauaaggucuaugaggcauuuugauauuuuacacacacgcgugcacacacacaugcacaauuuccgucguaucauauuguauauacuguuuucugcaaguugccacuaguaaucucaaauguacaaaacuaaccauauacuacacguaacauuggguaguauugcuguuuuaaguucguuaacuugauaggcagaaaauagcaucaaguuuuaaauuucuugacuuaguagugagcgugagcacuucagcacacauugauuagcuacuugauuuccuguuuuaugaacuaauucaucuuggccuugaaguuguagugguuagaaaggaguggcaccugccagcaucucgguggggcacacggggcuaggacacaagcugccgugcagccucaggggucagccucaaggcucaugaccugaguuggcggaaaagcacuuacuuacacugcccacauugcuuuaggaggucaggaucucucaacacuaaaguaaaugcuuguuuuugaccuuacuacugcuucaauuugaauuggcaacuauuugcaauuuauauggggauuuuuuaaggacaguagggaaggugugagauuuuuauguuuaucaaauaaaaugggccacggaugugagaauuuuuucacuuuuuaaaaauggcuugcuacaaaauucuucuuccucucuuuuuuuuugagagaaugccacaugcaaaggccucaaggcaaaaaagggagugaugugucccgggaagaacaaugaagccagggugccuggauguuuacaaggaagaccuaggugaagucacagaagcaggaaggagcccagugaugcagacauuaguaggucggggcaaaugcuguggcaaaucaccaaaggguuugaguugcaggcaugugauucacagaagcaucacccuggaaaggcaagagaggaagcagcaacucccgauggaugccuccuggggaagccaaggcaagaggugaugguacccugcaugcuugugcuuccuaaaccaucucugguaaagggccauaaguuuuuauuucuaaucugcuguacacugauacuguuauagaauauaagaaacacggauuaccggaagaaugaccaugagcuugaaugugacagcaaugucaaauugcuacaaaaguuucuguguacuuacucucgcccuguguccuuaccuuaucaugcgcugguaucagguggaccccacuuugauagccuuggcugacaaugcagcuccaacgucuaacaauguguugcauauuuucuguggaucaagccgugguauauggcuaucaacuguauuaguucauuugggcugcucuaacaaaauaucauaaacugggugauuuauaaacaauggaaauuuauuucucauagaccucaaggcuggggaguccaagaucaaaggacauauuugaugucugguagggcuuucugguucauagauggcaccaucucccuguaucauuauagaagaggcaagggaucucucucaggccuuuguaauaagggcacuaauucuauucauaagggcuuugcccccgugaucuaaccaccucccacuggccccaucuccaaguacuaucaccuuggagguuagaauuucaauauaugaauuuugggggcccacaaacauugaguuuauagcaacuauuuauaccagacaaugugcuguguacaagauaaacagugggauaugaaauaaagguugucucugccuuucagauuuuauagucagguugaauugagagagaaguagaugaauaugaggcauauauugcagauagacucucuaggacuuaguaauggauuggaugugggagauucaaggagaaggaggacucaagguuaagaggcagggaugggguacucuuuacagaggggagagagacacuuucuuuagacuuggcaggauugugugagauucuuguuaguguugaacuuuuaucuuuuagagacaugauauucuaauuucauaaaagcaaaaugauuaacauccugaugcagauuugaaaugaauuucccugaugacauggugccuccaggaagaaaucuggguggcuaaggauaaaggugggggaguuuggaauuucguacugugccuauauaccuagucaauaaaauguguuuugaaauaggaucuuaugacagccaaaauaauaaaauaccuguggauaaaucugaaauaagaaauguggaagauauguaugaugaaaacuuuaaaacacaaagagauuugcuagaagaguuaaauggaaaaaggaacagguuagaaaggaagacaauauugaaagauaucaauucuuauaaauuaauccaauaaucaaugaaauccuaauucaaagggcaacagaguuuuguugcucuuguugugcagaggaauuugguacaguguuacaaaauucaucuggaaaaaucaaauugugagaauaacuuggaaaauacuccaaaagauaaguaaugaggggcaacuugacuuacuggauguuagauacauuaugaagcuauaauaauuuaaacauuagaacugaauaauuuaagaucuugcuacagaaaaagaaaaaggcacacagaugaauggaacaaaauaauuguucaaaaauaaaccugaaauggaccugaaauuagauuaugauaaugaugguuuucaaaucacuagggaaaguagguuuucaaaucacuagggaaaguagauuuuccaauaauuuuaaauguuuaaggaaacaagaguaaacaaaaugcaauaucuuuauuucauucuuuauacccaagaaaauuccagauagauaaaagauuuaaacauaaaagcauaaaguauaauuucuauaagaaaacaugaguagauuuauuaauaauuuuggaguggugaaggccuuucuaagcaaggcaaaaaccucaaaggucauaaacuaauaauuguuagauuuccuuauauaaaauuuagguuuaaggaaaaaaaaaaccuacaaaggcagucaaaagaucagccacaaacuggcaauuauuuguaauacauaugaccaagaaagaguugccaguaacaaucuuaauuaaaaaaaacucauagaaauaaguaaugaaaaagcuccaucagucuaauacauuuuuuugugugugugcgugugaauugguaguuuaagaaaaaaaauacaaaugcuaaaaacaaaugaaaaugugcagcuucacugauaauuaaugggaagguauguuagugagacaucauuuuugacccguuuggcaaacaaucaaacaaaaaguaaucuaagcacucaugaagguuugggcaaacagaaacucccuaccaaaacguaagguccauaggcagaggcccuuuuuaacaaaaaaucuauuucacugcuauauccugaaaauagagaaauguaaggggucagugaacauguggugagugaaugaaugcaugaaaauauuguccuugguagaguaaguugagcaaucucacuugaguggagugcaguuuagcaauaucaaaauaaaauuccugugccccuuucuccagcaaucccaccauuaaaaaguuacucuucuucugugcuuccaaagguuugcuaaaauacgugggcaaggaugcuuauuucagcacugguugucacagcagaaaccugggaacagucagaacacaucaaugaggcacugguuaaauaaaucauggugcauccaggugaugauaugguuuguaguuguugcgagugaagaggauuuguaugugcugucagagagggaauuccagugcauuuuguuauuaaguaaaaagcaagauguaguacaugacccuguuuguguuaagaaucaaaaggaguauguuuuacugauagauuaaauagaugcugcagggguucccucaaccccuucaaaagggaucacaggaaacuuuuaggaaaggucgcaaaagccacugaguuggagauacagaaggggguccuauuucagucacguguguguguguguacauuuggcauguuuuauuauucucauuauuuuuaacucaacaguuaucugaguaugauguuacagaacuuuucccucuuuuuacuucuguguauuaaaacaugcauacaccugcacgacccuaauaaauguuccuuagaaaaaaauuuccauaaaauguucuuuauuuguugacugugguauuggccucagaucaaauuauuuauccuguuuucuuuagauauaugaagccgucuuaagauugagaguuucucaguuuuugaccugggugucuuauuuagcuaagacuaggaccaugugcucuuuuuuuuggcauggaggguaagugagaacguaaugguuuguacuuguugggaagaagcagcucauguuuggaucuagcugucaaaaaugagagauaaaaagccacucacagauuccuuuguuccacaacuguaauguauuucugauucucauugauaauaauauauuaauuguggccucaagugaauuugcccauuguagguuugucugggggaguguaaguuaguuuaaauaacuuuccgugcaucguagaaucuucgguguguugaaggguuuuauguaauacaaacauucauccacaaaccauauuuagacacauaaagcuccuugauuucuaaugaacuuuuuacauguguagaaugucugaaacuuacaaauaaucuaggaacaagcaaauaacuugggaccaucuucugaaagugauucagauuaugaauuaagcugcaguccuuuugaaugugucuuuaacucaaaaggguggcaguuuaauucauagcauucauuuauccucagaaauugaaguauaaaaauuuuaauaagaauuuauuuuaggcuuugcuuacuauuaaucuauaagucucauagcuuaugucuguguaguauuuuuuguguuucagaaggccuuuuuuauacacuuucacuuaaacuucauaacaaccuugagaaguagacugaauuuucuuuauuaucugaggacuuauuguuugauauuugaggacaauauugccagcuuagagaauacguuaacagugguccugaagauuagacuaagauagcagaaaaaaggaaauaucaaaacuucaaagauuuaacucaucucuagccacugggaaugugcuuauggaggaggguuuugaaaaguagggguuauucccaguguguguuagaaagugcagggcucucucuucuugccuucuguucugggcucuuguucccuaaagaaaugccucucagauuuucaagaccacagugcuaaguaucaauuauaaggaguccaaccgggacucaaauaagaauuugagugcccaguaugugcaagcacuguagcaagugcuggaggcacaguguugaauagcaaagacacagcccuuuuuuuuaggcuuacaucuggggcuuccuguuggugacuuguggugacgguggacacguuccugcccccaaagaaucugggggauacugucaggucaaugggcagucccaauaccuuguguucagugauauaauaggggauguaugaauugcuggagagcacauagcuauggcaucaaauacaaauuugaggacucuggggugggagagggagaaggagagggagagagagaaaaaguguguggugguacugcagaacaaccuaaucagcaaaguacaaccaaccaacacccccuaacacagacuucaguguuguuuacacauauagugguucauugaaagauuaacagauaauggcuuauuaaaggaucaucugaauuuguuguuacaaaaucaccugccccuuuucaucaggcugggaugugcuaccacauucucuaugcagaucucagguugucugucugcugagggcuguccauacucagacuaccaucagcugguucuaguuucccagugacuucugauuuacugcuggcuuuauaguuuacucuuagcuccucugucguacuuaaugcauaaaggcucauugacgcagggccguuccuuaucauuuuagcugauucccggcuguauucccuaauuacauaucacagcuuucacaacacagaucugcauuuauugccaucuaauagaucuuuuccugauugguaacuucauauggauuucuccaguaggcaguuuuuauuagggaauuuuuuuagaacucuacuguaaauugaguugagcuauuuugggaaggagauuugcauaagacuuaacaggggagaaguguuuggagggagggaacagccuagguggagccuuagauguaagaaagcauaagaaaguauugaaaacagggaaaugauuuuuauaugugguggagaaguggucauaggugagccuagcuagagagguaagucauugguuuagugcuuccuaaacuuugcugcacaauggagucaccugggaauuuagagaaaauuaaauuuaaaauaaaauaaaauaaaauaaaauaaaauaaauaaccucccaaucccuggcuccucccuaccuucugugccccagacauugugaccuaauugguauguagugugcuggggcauugggaauuagaaaaguuucucagauuacaacguauagcaacauuugggcaccucugagccaguuuauuaagggucuuacgaauuauacuaaagcauuuggauuuuauucagagagggauuuauggcaucgaggaaccacugaaagucuuuaaccagcaguucuguaaauuagaaagaucauucagauugcuuuggugaaaauggaucgaggagucuaagacuggaggcagugaaaccaguugagggucccugaagguuaaggugggcugauggaggagggaguggcaguagaguuggaaagaggcagauggauaccugggauauugaagagguggguucagcagaaccguuuauggauggugugggugugauggaugggacagguguguggggguggaggagagggaugaguugagcuuaggugggugggagcagggagaaagggaugauccugggagauuguuuccuuguuucugcaggggucauucuaccagaccugcugaaccaaggugaccaaguuacacuaguuucuccuuucaggagguagcugagaaaauccgucaguuguuugcugagcacuuaccuuuuaggauaaacugccuauggucuguuuucuuccaggcagaggugaugucuuguuccuccucaguuugaguggguguuuuuuucucuaaugauuaaucaucuuauagcucauuugcaugagacaucugugaccuugauuaaggggaauucuccucacacuugugacccaugcagguccucgucgauaugggguuaccacuggcucaguggccuccagagaacuucagaucucuugugcaaagaaugagagauaguuggggaaauacagauuucauuacucuuucauguaauugaauuggaaauguaucucacuuuuaucugaaaaguuuuuggagaaaugugaggcaaauuuuauguagcaaucgauguucuuugagaaagaaguauaaccucuguaacaaaaguucaguuguguucucucuuuaggaaaauccaguauacaaaaaucugaauuuacaaagcacgcacauucuggguagagguaauuagugguugaugauuuugguaaugaauucuuggcuuugugaaaagauguccuuugagaaucuuuuguaaaguaaguuuucuauguucuuuaagugacuuggauuuuaggaauaaauuuuuggaauaaguaacagccuaucuggguauuauaauguauauaaucuacuauguacuguuaugcgaaucuuggccaaggauuaggaaggguuaagacccguuugccccacauaaugcuaaaaugucagagaaagggagucuucuuccuuuaugucuacacugucuagccuuuccccauuaacguggcuuugguauaaaguuuucccaucuccuuccuugcaugcagcgccuaaagaacuccacagugaaauccaaacccugugugugacauuuuggucuguugacauaaauguaauucuaaagucauaaacuguaaugaaauucaccacagauuuaccuagguaagcaaguaaguuuugaagccaaaaaucacaggaguaaaugggaaauucauuugauggugagaaaaaggagcaaggagaaaugaucaaaucacaaccuaaaaaccaaacaaaauccaucuacaaucugaaaaacagcaaguuuuucccaaaacaccaaaaucuacucuugccaacauauuauuuugaaaauaauguuuguuuuauuucuaaagcguauauugauuucucuuucuuucuuucuuucuuuuuuccuuucuuucuuucuuucuuuuuuuuggggagaagaaggaauagaggacagcagaauaccuaacgcauuugugaugcgcugcuuauaaaugcauguucagaggcaaaugaccaugauaaacuaccaucuaggaaacugcuuuauuuaaaugaagucauuucccuccugcugccuuacagggcaucaacaaaugaguugugcgugaggaagggagaagcacguagugcugaugcucacugugucaucuugcaggggcuucguuauggagagguaugccgaugcugauccagacagccuaacuggcagccugaacugacuaauggagccaucugcauguuggcugacaucugguuuuagaaguuauuuauaaagaaaggaucguuguaaucaaaacagccagagagguuuuaaaugucaaauguacugggaaagauucacuuagggugacuggcacuguaggaaggauuagcaguuucucuaaaugcuuguauguggggagugcauuucuccuguguguaaauaguacuuuaagacagcauguuauaacaagguauuugaaacaaacauauguuuuggaaguugugaacauuguaaauguggaggacuauaaaacuacccgaaugacacauuaauaagccaaaauauuaaugagacaacauguaaagagcuugaaugucuguacuccuguacaguaagggaaaaggcugagcaaagugaaaaucaaugacucuuccuagacccauggaagaacugaggugacaggguaaacugcugcccugagaaguggagagaggauaccuggaaugacaggugaccggaagcagaaguccaagagcagaaucccaccccaaucccuauacuagugggaacagauaagcuguaauugacgaauugcugggggcccagcaugcacuggcuuugagaguuaaagacuguggggcccagagccgccacacuuucaugaauuuuacuuccaggagucucaccagugucucacaaaaauccuacuuguuucuggcagagggagggggaaaguaaccauuuugaaauauauccacaacaggcuuuucucuuuaacaaaagccugcucucaaacuauuuaccaaagcccagcagacuuagcuuuuaucagaaucuaacugacccaagggaugggaaaugcccagcucuugccccuucuagccuuccugucuccauuaagggggaaaaguaaagcugagacccccuugugaagggcacagccgguacagcccaguaccuaaucacacucaccuccugucacacucaccuccucucacacucgccuccacaucaguuaggcucuugcaugguaacaggauuacagugaaaaguaaugcaaggguuaaaggagaccaaacaagaauacugcaggaaauuuuagccuccggcaucuacaguuacagcaaacaguaaaaacagcuaacuccuacccagauaaacauaaaaccucacaccaaaagccuguuuaccucaguucuuucacauaauagguucugucuaguauucgacaaaaaaucacaaggcaugcuaaaaggcagaaagcacagucugaagagacagggcagcccacaggcccagacucaggcagugguuuuugaauuaucagagcaguaauuuaaagucacuaauauuaauaugcuaggggugcuaauggaaaaaggggaagcacacaagugcuucugcagcucagacucugaguucuuggcuuuccuguaaacauaaauuaauaccaggccaggcugcguguggugguucaugccuguaaucccagcacuuugggaggccggggcaagaggauugucugagcccaggagcuugagaccagccugggcaacauggcaaaaccccaucucuacaaaaauacaaaaauuagcugggcauggugaugcgggccugaaguugcagcuacucggagggcggaggcgggagaaucucuugagcccaggagguugaggcaucggugagccaugauuauaccacuguacuccagacugugcaauaaagcaaagacccuaucucaaaaaaaaaaaaggaaaaauuaauaccagccaaacaaauuuuucucagacaagguuuaguaggcuuguggcuugaggagcagucacaagggagcagcauccaggaaacgggucccugugcucuuucucuggagggcuucacucuuguaauuuucaggaaguugaggcggggaaaggagcaacauauaggcagguagagguggggaacuuuucacaccggugcaguucaugagccacgugucucauuagccuguuaaaucuccaccuuugggucugauuuugaguauuauaacaagauagguugggcgcgguggcucacuccuguaaucccagcacuuugggaggccaaggcgggaggaucacgaggucaggaguuagagaccagccuggccaauauggugaaaccccaucucuacuaaaaauacaaaaauuagccuggugugguggccggcaccuguaguuccagcuacuugguuggcugaggcaagagaaucgcuugaacccgggagguggagcuugcagugagccaagauugcaccacugcacuccagccugggcgacagagugagacuccgucucaagaaaaagcaaacaagcaaaaaaaaaccaaaaaaaaaaaaaaaaaaaacccuacaagauaaugaggaaaaucuugguggaaggucagugcuggaguccaucuugucuuuagcuggcuggaucuggucagguuuuuaucaggagugccagagucucacuauguuaccagcugaggguaguuguccagauucuuggcaucuuaaaagaguuggacaaaaagcacaaacaaagcaaggcagcaaaagcagagauuuauuuuaaacgaaaguacgcugcacagagugggaguacuaagccaaguggcuuaggcucgguuacagaauuuucuuggguuuaaauacucucuagagcuuuccccuuggcucacucuaugcaaaugaaguagugccccaugaccagucugauugguugugggaggggaagaguagguccgcaaccagucugauugguugcaggaggggaccaaucagagguacuuucauuuccaacagccagucagcaacugccaugcagaaaagggcgugguugaaaaggaaguagccccugauauccagucagccugcaucggccuuagguucccugcuucccgacccuauucuccugucucagcuucagcaaccugggaagaaguaacucaaggagaugaauaguuagguucuuccuuaugguugggaauucugcuuggucagcuauguuaggagggguugugagaguagauagcuauccagacaugagcagguggagaggcccccugugcccucccaggaaugucaggugaccaucaggugauagucaggaaguuguuauacugucucucuaaaauaauaacuggucacuaccagugccagggaaaggcagucucccaauagauagaggacaccugagcuguugaggagcagcuuccugaugggaucucaggaguugggcaagugggcuccagcauccacgcuaagagguaaaaugauggaguuuaacugguauauagccuuccucuaggaacacucgacugguaagggaaaaaugccucaaaugagcacuugcacaacgucaguaaacacacuaugcauguggccccucccaagugccggcaggccacugcguuugcagacagcccacuccaaggaaaaauuaagggaggagaaaugccaacuuuggaccaugccaauguauaaaaccccaagucaagggugagacagugcugauggaucucucgaguugccuacuugacccucuuccaaguguccuuuacuuccuucuguuccugcucugaaacuuaauaaacucucacuccugcucuaaaaguugccuuggucucucacucugccuuaugccccuugguggaauucuuucuucugaggaggaaagaaucgaguugcuggagaucucuauggguuaguugcugguaacgggaagcuuucuguuaccugacuuggaucagcuuaaagggagacaagaagguaggggugggaaauuccuaagcaggaaagcauucaagauguggccagacugcuucuaacaaccuauacuuagaugugggaacaaagaaaugacugaaaguugggauuuauaauuagaagggaagcagaguguaaaaguuuggaagauuugcacucugcccucugcccaugugggaaagaaacaaaaagcaagugcuuuccagaagauguucuuuagaacacacaaugcuugggauaaugccacuugauaaauagaucccaaggucaaguuggugcaggaaaugcaaauguccaucgugacucuaaaaaggagaagaguccauggguuuccagaagguuugggcaacuuuucacuugagcgucuggagaaacugugcauaccuugggaaacaccuuugcaguguuccaguggcauggaugcucccuggcucgucuaacagauggaucucccuaacgaucugcugcucuccagagagaucaacacaagcuagaagcagcuggagggaggggcugcagaaguauuaaugaugggaggccaaaaacagaguaagaggagcuguccaguugacugagauucaccucugcugacugcccauucaguuguucugugcuggggaccaaacccuucagcucuccaagugccagcuuucugcuguggcugaaaagcaccugcuucuuucuuuccuccuuugcauucuuuggaccacuuaaggugguacugugacuggcaugaauuuuaacaucaacauuuauuuucauagcuggaauauuggugggagaaaguaggaauucuugauagggagagaaguuagaaaauaauugauguauuuugguaccucaagccuugagaaaaugaugcuuucuaagacuuuaguuuucagugucaaagggaguuuguuaguucauuuaagcugcuguaauggcagcagcauaacaugaguggcuuuugaacaacagaaauuuguuucucacaguuccagaggcugagaaguccaacaccaaagcaccaggagauuaggugucuggugagggcucauuucucauagauggcacuuucuaccugugcccucacguggugguugugggggccaagguaacucccuggguccucuguuauaagagcauuaaucucauucaugagggcucugccauuuagaccacagcaggaagcuggcugaauuuugcaagagaaaguuacauaagauucaucucucaacuauauuggaaaugucaggguuaccaaugagggcaggucauuuagaaaggaucugaccuucucuuagacaucgaagcaauaaaaaaaguuauagauuucuccaauuccauaaaggcuuuguucuugggucacuuguacaaagugaucauugccccaguuacucuccugaugucacuauguaccuuccagguguuaauuucaguaaguauuugacuuguguuuuucaugaugcuuagacuucuaaaauccuauggguaaaaagaucuuuacacaugauggcagauggugcauugggcuugauguguucuugcacuguuuguagacguagccuuuaagguagaucuagaaggauggguggggcuucugcaugaagaggggaggaaacagugugagcagaggauggagugucgccugugggauguguugggggaaaccugccuguguuuauuuaucuuucccucuugucauaauuugaguguggccucugugccuuguaggagacaagguuaggacugugcaggggugaagagguaagaguguucagacagggauauuugcacuaagcuuuguuguaucuacuucauccccauucgguaggugucuucuauguuuuaauucauauccuagcgucauuuuucauccauauagaaauguaccauauaaagugcuuaaaagauugucucuacaaucaaaucugguuaaaugugggaaccuccagaugcuaccuuuuccuucuucauccacuaaaucugccuuauauauugauugcuuuuaggaagucaaguagccguuucccggaaucuuuaguaaagauuaacuagauacuugaucaccugcuuucauauggguguuaugacacacacagaguagagcuauucacaauuuaugguguggugggacauaaguuaugucuuacauuauuuucaaccagcucuuggugcuaaaaccuuuuguagaugaggcugguuugaagcaagaauugaagggaagguucauuuauucaccacaugcuacugguaccuguuauauuuuagguaucgcuagagaaugaacaauaauggugaccaaaaacaaacacguguuuacaaugugaugaggcaggcaagcuuucaucaaauagucacauaaauauaaauuuaacaugggaagcaaccuaaauguccaauagggaaaugauaaaauaaacugucauuuuguuuugacuuaauauuagguagccacugaaauuguuuccaagaauuguaaaaugauuuuaauaacacuggauaguuaaaaaaguuagauuauaaaaguacagaguauaucucucuuuuauaaaaacaaauucauguuugccaacguauagaaaaguugguuaugaaccacaaugaagaguguuugucccuggugauaugaugaggaagcacugagcauguucucauugaguaguuuuuuuuuaaccagaaugaaggcagauuguuuccauuggcugaauuuacaauuaaaugcauuggaugcauuaagugagggacugaagcuuuagcauguauucuuuuucuuuuuuugguuuguuuccuuuugguuauaauagggugggaaguaaggugaggguccuggagggcucaucuucuugagugggacccuugguguucuggugacagccgucacacagagggacaguggggcuugcagagacgugaccuuugggcgcuaauucccuuuuauugccugccuaagcaggauucacuuuccucuguaugguguuuauuuugguuuugauuuugucugcuguuuugagacacaaaaacuuguguucagagggaaagcuucagaaaugcuucccgugauuauuagaguuugauaagugaguauuccuggacaucugauuacccucuuuguuauugaucaaugcguggauucuucugauuaguuucaucauuucacagcgauagcucccaucuucaguccuuaccaaaaacaauuguuuuauuugaaagcuuucuuuuggaagcaacuaaugcauuauuacuuuuaucaauuuaauaacaauuaaaucuguguuuucagguuuuaaucauuuuuuuauuaagcauccauacauuuugaggggaaaauuaauuauuuuggaaguacucaucauauacucauagaaauagauauuggauauuauagggcauauaauuuauuuuuuaaaagaugcaaagauucuagauuuuucucugaucuguaaaauuuucccucucaaaaaaguuuuucuuuguuuaugcuccauaauuuauuuauuuuaaagaccgacugggucauuuaaagugagagagcuuuguuggacggaggauaauagugcauaaaccugucuuuuaugacaccuuggacuuaaccuucuuuguacaauagagacacugaggguuggccuuaggaagccuggguuguuuuuguauuaugacucgagagaugcugaaaaaaccuccuacugcuuuccuuguaccucagauuauacaauuagagacuuaggcuuuuaagucuugacuuuugauuaugaguuucuguuaaaauaugacaauuaggauguaaaggagcugccauccagaaucuuaccaagauuucuaccaccaacugagaggacagaauagaaugacccaguggcggaaggacucauuccugcugggccugagggaagagcuggagggaagcuggcuuccucaaggacuuuccagagcugauccugguucuguaguugacagagcaggaguauuaccaucuuggacaagcacugucauuuuaaaauucaccuugaucagaaaccgccuaaauccaaaggguaucacccuaauggcuaaggucagcaugaccauaaaccacaaauaacaucuucaaccagaaacguuccaaacuccucccugaccagagacaauuauagccccaagauaaccucccuccagccgggaagaugccagcccccaagauaacuuccccuccucccagagacauuccaacccuguccuaaaacuucucccucacauggaaacaugccaagcuugugauaaagcccccucacccuaaaaccaguauguacucuuagucuguaagagaaagcgcuccugacugaaaucagccagaagccccucucagguuuuaucuaaaguaaaccggucuuuaacugucaagcugccauucguguuucuuuccucuuauuuuaacucuuacaguagugacaaacucuauuguguggggcuguaaaauuauuuagaagagagagaaucaugcauaugcauuucaccugcuugaaacugguugggaauuuacuucugggauuuuuuuguuuguuuugcuguaucaauuaauuuauaaucuauuucaccuuucucuuuccuuacuugccaauuacuggucuuuuuagggauugugguauuauugugggaaagagacuauuugcuuuuuuuuuuuuuuuuuuuuuuuaaccaagacguugguuacaauuccauccuacuauucugggaaaauguggauccccccaccuuucaaccaucaucccuuuauuuucucacuuauuggucugcuucuugcaaguuuuuggaaaaugucagugaagaaacaguugagcccuuuugugagguaaauuuccauuuaccaauguaugaacaguacacauacucuaagcauaaauauacaauaaacuguguuugaaaaaacucagcuguuuacuaccacaacuugaugaaaugaacaauggacugaagccuuuccgggcuuggcuggcagccccugagucucaguccccuucuaggaagaagugccccaaggucacuguguacuucacacugugcagggagagagagucacauggcuguccaccaagaacagaucccaucccuccucugucucaucccugccuccugagagcaucauguugagagacaugccaucccugccgcaggaaagaguuuuuagcaagcucuggcaaacacaucugguuccuuguacuucuauguaccucaugguggcagauuuugagaaauuucaccauuuaucaaaaaaggcuuucaguguuuaaaaccuuccuuuuugguuuuguucggucuuuuuaguuaggagggaauggcugaacauugcuuggcuacuccacagaugcacggcagagcagcuccuucuggaucccucacccccuuguaagcugggagcucuggugggugcuucucaaaucuacuuucuuuuccugagucaaaggauagaggaacugcugacauccugugagccagagcaccugaaggaaauccauuuccagcuugcauagcauagguaaggaaauugccaaagcaaugcaucacuaauuuugcucccuggugcuaagugcaccuagcgggcaugcuaaguacugcccccuccugccauccaguggcggcagggacuggcaugguucccagugcuuugcugccugggcugccugucugugcaggggcugguuucagcugugugcagccuccaagcuucaagcacaaagaaucacuuaguugcugaagagcagaagccacaaacacuucugguaguauaucguagggcccaguaaucuuccuacagcugaagcagcaggcuccuaaacaagucucagguagaauuacuugcauccauuaucaagcuagccaugaaaaaaugguguacuuguuuaugaacaugcuucaauuuauccuuuuugaugaaaauuuuaaaugauuuuuuucuauuauuaaguuucauaaggaagcaugaaagagaaauuaccaaauauuugcaauauauaugauggauaaauugauaagaaaacaacaugguaguaguaaaaugucaaggauaggcuguuaacaaaaaguaaguaccaaaguugaauaaaaaaauuuuaagcaucacuaauauuauaaauaaauaugaaagcauacauuuuuaagcaucagauuggcagagauggaaaaucucacaauauaccaugucaggaaggaacugggaaaaguaccuucucauauauuguuaaugggggcauuuauagggacaauguuuaugacaauguuuggcaaugugugaugacaguuuagaauaugcacacucaauuucugacguaagaauuucuucuuaacucauccuaagauaaauggacaaaccccaaaggagacuggcccaauauggcugaaugcagcguuauuuauuuccugugcugucaguggagagccugcuuugccuccuguucccucugaugugcaacucacuggauuuagggcuuauucauagccccagagcaagcucaagguaccuggcuagugacugaaaggacauuucuucuguucugaguagaacagucacagauucuagugcaggggcccugacacuuggugaggaacauccacuuugucuuucccugaagcaaaucauuaacguccagcacacagcaguugugucagcucugcagacagaggcuggcccauguggcugcuguccccagggcuuggugugccugcuccgagauccaccuacagguauuuagccagggcaggucuggucucccgcccugacuggcaccagccaggauuagagacugaguggccuggggcucccuccugugucaccuucguuaaagcuucgaguuccaggagcagcagccuucuccuuccacccccuucaggaacaccacuggagccugguggccaucugggugaccugaugcccucagagcagcaggguuugcuccgucaucaugaauggcaucuccaugugccagugucaucagauggucaucacaguggguuguggggagcaugagguaguugugcuguggauuuuuuuuucuagaggcaauauuuggaauuagaaaccuauuuacauacacuuagcauuaauuuacauauaauccucaaauaacuucaaauacucuucuauucaacuaauuagugcagcuaaccaguguuguagcccaccucagcauuaaggacauuaaacgugugaaucacugaauagauuucuaaaaccauaaucaugguaaugguaaaucagcuuaggucgcucaccaauggagcuggcaauagcugcuccuuaggcgugauuccuuaugcuggagugauagcucaauuuacaaauuccagggaaauuguaccuucauaacuuuuggcugaaucagccuucccccuaacaaaaaaggaaggaaaagaaauuaacauuuauuaucuuucauuuuauaggccugugcuaaugcuaacaguuauuauucuacuuuaauucugcuauucaauacaaaaucuacauuguuugucaaauugguuuaugaagaguugaaacaucuaggaaaggcuauacuauagauuuuggagauuaugugaagcuugccugauaugguugggcuguguccccacccaaaucucaucccuaauuguagcccauaauccccacgugucaugggagggaccuggugggagguaauugaauaaugagggcagguuuuuccgugccguucuugugauggugaauaugucucaugaaaucugaugguuuuauaaaaggaaaguuccccugcacacacucucuugccugccaccauguaagauauaccuuugcuccuccuuugccuucugccaugaucgugaggccuccccagacaugugaaacugugaugccauuaaaccucuuuuucuuuauaaauuacccaaucucggguaugucuuuauuagcacugugagaacagacuaauacauugccguuaggguuuacaguguaccacuggagcugaguuuaucuuuccuuccuuuucuccuugcuuacccuuuauccuggagugaguagucuaccaccugccucacuugagaauagauaguacaggaaaggggacagcuuaacccucucugccacugacccuguguugacuuccacuugauggguuccacuggacguugauauuguccugcacauuauugaaaugacaugcugacuacugguguguacagaugacuuucaauacccuuuggggaaauuuuaccccuucauagguuuuuuggagaguaggaagaccgguugucaaacaguaaaagaguaccugcaauucaugucauucuuugcauucaccuuaaaauacugaucuuaauagauuuuugauaacuaaauguauaccuuuuguuuuuguugcuuuuaagucauuuauucauuuagaaucuacauguuagcuuugguuuauuuuuaaggaauuaggaaaauauuuuaauuuuagcaagagaaugcucagucucccuccuuguuuacccuuacccccaaagcacuauugccccuguugguugagaauguuggucuagggaauaauuuuauauucuuuauaauuuuacgguuaugcucucccaugaguuuuaagcaugagugauacaaaguuaggggguuuuguuuguuuuuuuguuuuuaacacuaagaccuugaaauaggcuccucauuagcagugucaugucaugaaagaugaacagcuugagauucagaagacgcagguucuggcugagcucugugccccugagcucccauaugaugggggccaaucucugccucuguuuccuaagcugaucccucugguccaucaugucuccgacauccacuaaggcuacaucuuuucauugguguuacuguaugguuugaaggaggacugauggcagcguauuuaugguaucucggugacuccuaccuuaacccuguugacuuuuaagauuucaaggcaaauugaguuaggaaucucuuccuagcaagaaggccuuguaaguaagagguccuuaaaaauaaaagaaaaaaaccuaacauguagacuuuuucucugcagccccauguccuggaaccuucugcuuuuaaccuguuaauaauggaguuauuucguauugcaguuugcccaguuuugugccaaagagcucguuuuucauacuccuuccccagacaugaccuuguaaaucuuugccggagguaaaggauuagcguggcugagcaguucgagggagugaagugucuuaucucuauaacuuuccaaagugguccucuucugugugguggguagguucugugguauuagagugcuguguuucagugauaguguagccugcucgaucucuaaagucucugcuuaguguuguuucuauauuaaaaaaaaaaaagaaacuguggcuaccaaccaacuuauaaacaaguugauuggaggcaauccuuauuuacugugagguaagccauguaauaaaauauuuuaaagcuaauguagcauaucaauuuauaaaacaagccaugugcuuuaucuuauucaguuucucccaaugucagagugaugguucacaauugugaauggugauugagaucuggaaugaauucaccaguauuuuucaauugucuuuuuguugccguggcaugguugaugugcuuucaaccuguuuuuuuguuuuguuuuguuuuuaauaaaacuugugacaacaaauguaugaguuuuuaaauuuuuuuuaugucaaccaaucauccaagucucugggcaccaacugaguguucuacaauucaguucagacacugucugggguuagcccagaccccacaggcuaaaaacugucucaagauuacccgcaguagaaucuccaguuaaaucccauguuaucaccugcaguuuugaccaaccagcuauaaauuggggguccccuuggucacuugcuagaagguuucccagaacucaggaaagcaucguacuuacuauuaacaguuuauuauaaaggauacaacccaggaggagauacacagggugaagugcucugggugugaugccuccaugcugucuccuggcacacugcucucccagcacuuugauguguucaccagccaagauguuuucucaacucugugguucaggaguuuugaucgagcuuuaauuacaucgacaugauagauuacaucauuggcuauuggucauugccuuaauuaaucuccagcuccuuuccccuuucuguucaugaggcccucaguucuugcugugauauuucuggagacccuuguccauccugaagcugucucaugggucaccaagaguggccucaugagaacaaaauauacuccuagcuuccuagaaauucuacgggauuuaggaguucucaaucaggaacaggggacaaacaucaaauuuuagaacacaggcugcuccuauuaucccuaucaaucaagauaccacagaaauuuuaggagccccuugaugggaaccugggacagucagcaaauauauauauauagauauuauuauaucagaguguaguauaguguugucuucuaagucuuauccauccucacuuuuuucuuuugugauuucccuuucuuugaacaucucugagaccuacuucgccauguagguguagcguaugcugcuucugugcuggugacaucauuuggcucaguguuauguaucccaagaggaagcuguguuucuuaugcuggcuccacggguaccccaggaacauugaggauacugugugggguguugccuccuacaugguaugauauaggcuaggagaauaacuguagcgcaucuucauggaguuuuaaccucacucagcuuuggaggaaauuaaaaugaaugcaggaauauuauggaguagcaaaugauucacaaacagguggcaucagugaaauuuuauguucauuaacagauaccuuuggauuaugcauguuuccccagagauauauucguucacucuucucuaaugggguaguuaaaguugaggagucagaauauguauguauuugaguauguaguuuguaaauucuacaggaguaaauauuacuguaguagacauuaauucaauaauuuuuggcuggguggggugggucacgccuguaauccuagcacuuugggaggccaaggcaggacgauugcuugaacucaggaguucuagugcagccugggcaacaugguaaaaccccaucuccaaaaaaauccccaaaauuagccaggugcggugguauggucuguaguccgagcuacuugcggggcugaagccggagaauuguuugagcccaggaggucaagggugcagugagcugagauugcaccucugcauuccagccugggugacagagugaaacuccguuuaaaaaaaaaaaaaaaaaaagauugauggucuuauucuacauauuuuuuugagucuauuucuaugauauuuucaguauuuuacuuagaugggcuuuaacagauuuaauuuucucuuuuauuuugcuuggcugucuuaaucauggccuuuuucauuuuaauguuaccucauucaaagaguuuuugccugacuaaugaguuguaguuuuaaagugcuauguguuuagaucuucauaaugagagauuaaccggagccguggaucacaucucugggagcauucacaugucccauguccagccugccaaguuauaccccuugggauucccuggccacagggagggauuugaaucacaguguucugguggcugggauuuucuccuaucugaucacauaaguuaacuuaccuggugucuuguucacauuugucucuaguuccccuggugcuauuauugccaauagugcaauaacaaagguuugauaugaagauggacauguguaagggagagcuggggauuagccagcccaguuucaccucagcugguauuguuacugggucagagugggguugagucugaaaggcagagcgaggucaacacugacagaaugggacuaaaaacaaugugugggaaauaauucagcauuaucaaagugaauuucagagagcaucagcugcugcuuggggccuggggucacaccucuauagucgcuggucuuggagagaggguuuuaccccugaaccuacugcccuacucugaaccuauugcccgacauugcugagaucauuuaugauuuccaagagaacuugagugaggauaugugcaugguuuagugaauuggcucccauuuccugagcccuaauaugccauggcacagcugcucuaguagucacgguaaauauguuauuucauugaguuuucacagaaagucaaugaaauagauauuccugauccccuuuaguuucagacaggaaacuaaaucccugagaggucacaugauuugcccaagccucagguuaaauuugggaaguaccagcgcugagauucagacccaggacuguguaacuuuagagacaugcucucaucuugcuccagugauagacacugagcacccagugugcagcaagcaguggguuguaugcuggaaauauaaagaagaaugaagccacgcacuuugcaggggcauagcacaucaucuucagcggaaugcuaaggagguuccaaaaugacuuaauugaaagcacugcauaaaugcaugacauuaggcuggcaauaguuuccugccaauauaugaagugcuaagaaucaauagaaagaaguauaugguuauaaaaaagaaaugagcagagccauagaaaggcuaauggaaagcauggaauguuaagaagcuggcagauuuauuuaugugaguuuggaagauguuacucuagcaguuuuuggcugauuuuggugauugauauuauaccuaaaguagcugaguuacuccgauuaacaucacuuguuuuauuuaaaaucacgcuaacucagagaaccuuacuguuaauacaccugaagguauacaccuauuuauguuggauguaagauguuacagagucagaggaaacaaauaaaacaagggcaauguuaugugguuucaacaccagucaucuguauauugcacaugauauugugcccaggggguuagugaugauaugugcaggacacauagggcaaacgcuuucaugggagggucauuagaaucaagacaaggaugaaccgcauuaaaaggguaauggcucaguauuaaggaguagagaagaguggauacugaacauugguuuuuauugagcaaaaugaguuauucuuaguugacccagcucuuagguuuauagaccaaaucaagaauguuauacuaauauugauuuucuuauaugaucuuuugaauuuaauccauaauauuuugucuuggcauugguaaccucuaaaguguaccauucugcuuucugaaucgccuugacauuuuucaucaccaaauacuuuuuuacuguuuuaauggaguuauggcagugaaauuagaaaacuaaaagauuuugggaacagucaauaauuaagcaauacuguuuauuuuggucuuacuugaaauagauggacagggaggagaaagagacuugugucucuuauggcccucuagcuucauaccuaucccauuucaucugaguagccuugaugaccauuuugcagauaaggacaucgugauuuuuuaagagguugaaugaauuugcuagucaagaugcagucagaauuugagcccaggacuguuucuuucaaaacuccuuuauuuugcuggagugugcugcuucuuccaguuugaaaugacugaacuguaaugaccagcuagauuauaaaacaugaagugggaaaguugugguuauuuucugacuuacuuauuuugagcaaugcuaucauauuaaguagauauuuuagauaguauggacaugucugaggaaccuccuaccuugccggacacugaggauuuauucaccuugagcagaggcaggcaggugucuuucugaauuggugguggcugaguauaauugaguuuccuacacuuuaaaaacuguacuccggccacuguuuugauucucuuguuugacuggccuguuuguauuuugggcagucgcuagccagguguuagaccuauaauuuaccauguaauucucuauugacuugagcucugccguugugcacuuuguacaucaucuaccaucuacugcaucaucccuguuugcuucaggcucucccagugugacucaucauuaaauauccaguuggaaccucaaccucuuccaggaaugccuccucuggcauccucuacaugugcuguucuuccuccuaaaccuccaagggacuugaugccuguccucuuguuaaucauaugcucuuuuggaaauguauuuauguuucccuaugaauaugguggcccucuggcuucauacauuuaaaauguuuguggucagggaugaugaugauuuaaacaacaguauuuuggaaaguaggacuuuuuuuaaaaguccucucgcauuaucacuuaguguacagcaacuauuguaguaaaacuacuuggcaguguagcgguaaaauaguuuaaucacagugguacaaagggugcagggaguauggcacucguacauuguugaugggaguccuaacuggcgcacucccucuuaggagauccauuuggcccuaucuguuaaaauguaaaacgcacaaaccauuugacuagcaauucagcuuucagaaauuuauucuaaaaaugcuugcuucuguaugaaaagacauaaguauuuccuuuauagaguuacugauuuuagcaaaauauuggaaacaaauguucaucaguaaggaaacagcuaaguaaacaugggcuuuuguaugauggaauacuuggcaccauugaaaagaaugagguagaucgcuaugcacuacuguacugcuguggaaggucaugaguauuaauucuuaccagacaagaagaggugcacagcaguuugcuaauguuuguuugaaaaucaagugugguggaagaugggcauguauacuuauacauacaagaugaugauguaaauugugaaauauguaauaguuuuggggauuuaguuuaaaaauuaugauuuuauucuccucuguaauauuuccccauuugucuuuaacauaaaauaauuauaaaucacuuaauaucaggaaaacaauccaaaaauauuaucucuccaggaauaaaaauauuauucugucaaaauguguagucuuggcauaucagccauguuuaucuuggggcaguguagaacaacugcuucccagcuccauguguaggcaagcccuguuuugagaagcaaagcuuucuauccauaaauuaagguugggaucugauauuuugaugguuucuaugaugguuugaugguuucuuuuaaguugaugaaacugaauuuggcuucuaaggugugucaccaucucuugacauuugaccugugaaagcauuaguucccugacagcguaugacuguacucuagaaagguguugucugaauuuuuacuucccaaucaguauucucacuucaggauuuucauugcuuuaagugacucuuguauuuacaaagcccauauccguuucaauucugcucccaucugauucuuugugaucuguuuagcagcccaggccugaaagaggaacaaacagagagggaaaugagaauaagaaaugaauuaagugccagggagggacccagaguuaacuguacaggcgcuuuauauugauguuucuucuucaguauugaaagcuuacuauauugauggacucuuuuucaucuugguaucuugcacuuacauauugauguuauuuguuuuuuuaccaauauugaaauguagaauugauuaguuagacuuaucauucagauagaaacuguuucaagcucuuuuuuugggaacaaauauucuuaggugaauauuaacauguuauugagcaauuagcaauuaguuguaauguaaaucaguuuucuguaauacuuuaucacugcuguuuggugaaaucaaguuuuauuggaugauucaguguguaagagugucauaaaugaguuuuucacuauuacuggagauuuaaguuuuuggagaaauugugugaccaguaaucaaaagguauaaaacauuuagccaauuggaaagugaaaaauuauuaacauuugauauguaaacauaggccucauuuuaauuuagucauauugucaaguagcaggacgauauguguaguagauagugauaccugugcuuuuaauuccguucuuuuuguacgucugaguuggauauuuugcuuuguauagaggggaagagagaggaauagauuuuauuguuaagccugugcugaaucugaggugccuccccacuugcccacugucuuucuagugcagacucagaggagcaguggaccuguuucuucagcacagagcucucuuaagacuuaauaggaaaauuugcagagguauaaaucuaguggaaccauuaauucucagcuggauuuuuuccuauuguguuuuauuuuuauuuuucagauacuaaaaguaucugacaaauaaacugaaagguaagauuggcuuuugguaaaaacagaaaggagaaaaaaaaaaccuuaguucuaaauauaucacuucaggguuauaaaauaagacagccuuuuuuucuggaagaacagagacauggcagucugauggauuuuaaaagucucggugacuuuauuuuauacccauauaaacuagaagcuaugagucuuuucaaaguguuucuaaaaccaaagacuuuucuuuacauauguggaucucauaaaccuauggucagauaaccuauuuucaaaaguccagauuuuuuaaaauuuauuuuuaauuuuuaauuuuaaaaauuauggguacauaguagguguuuauauuuaugggguacaugagauguuuugauacaggcaugcaaugugaaauaagcacagcauggagaaugggguaugcauccccucaaucauuuauccuugaguuacaaacaauccaauuacacccuuuauuuuaaaauguacaauuguuacugacuauauucacccuauugugcuaucaaauaguaggucuuauucauucuuccuauuuuuucagauuaguuuuugaaagaaaauauaugcguguguuuccucaugcacugcagauauuucccacaauuucuuuuucacccuugcaaguuuuugauguuuguaaacaucagaaguuuuaaauuuucauguggucaaauguauguaucuuucauuugguuuuguuuacuucuuuuaaauuucuuuuguaaaacagucauuccucacacaaaaucaguuaaagaauuaccaguauuuuuuauuuguuuuucuuuuuaaacagguaacaaaacucuguauauucuauuuuggcacaugacaggaaguaaauaucacuucuuuuuuuuuuuuacccaaauaguuuuucaacacuauuuuguauguaauuuauuccuucuacauugguuuaugagauuauauauguauguguguguguauguguaaauauauauguaauauguauauauauauauauggagagugagaaagaauuaaaauaucagaguuuguuugcugugucaagucuuguguuaguuuucauuauuguggcucucauuguccuuuuuaagaaaaauuccuggcuccugucaauuguuuaaucuuucaaacgaacuugggaaucauuuucacaagucguuccccuuauuuuccucuuucuucugcagaccuuuucacugugaauuccaggaaaauaauuuggguagagcggcauuuuauacuauucaaucuucacauagaaggaauaucuccuuuuuaaauuccaauuuucuuuugugguuucuuauaaagucuugugacuuguuucacauaggccccuuuauguauuuguuauuguaaaggauguuuuucauuauucgcuauuuacuguugguaauugcugggauuuaagcuguugauuucucaaaauuguaaguuaauucccuucaccaagcuuuuauuuguucuaauaguucaugaguucauucacuugagcauucaggauauaccauuguguuguggccaaaaacaguauguugguuucuuccuucuaguggucacauuccauuacugccugucuaauguucuuacguuggcuaaaauccuauaaauuuuagaaaugauuggcuguaaagugccuauuugcuguuaggagugauuuuguaacucauccagagaccacaaauuacugugaagaaaggcuucugggaaagcaucaaguuuaggugguaaugccaucuuuucauauuuuugguagaacaauuagacuuuuagggaaaaucuauuaaaauaguagauuugaaaacuuaaagcagauuuuaaaauagauaauuguauauuuuuguccuuuuucuguuucuggauggaaacuugguuauauugagaaagagaaacauagaaugaaaaaauaaugaguucacugauucaaaaguaaaacccaacuuuuauggauguuguuuuaauagaccuauagauuauauagaauaaaauaguuuggauuuuuuccacuagauucagguagaguuaucuuuuuaaaaaauuauucaugugaauuuccuacuaacuaacuugcucucacgaugugcuguuuuucauuuccugaauuguguauugugcuuuuguuuuuacuaaagcugaaaacaucuaucuguuugcucucuggguguguuuucgucucccuuucuguacuguuucuuggaugcaggugugucgucuuucuuuucuccucagcagucuuuugcaaagccuuucaaaugccccacaguccugagcagaguucauauggaacguggccuuguccagguugccuugaccgcagugacuuuccucaugcucuuuccucugcucuaaaaugcucucccuuuuccccacccacccaacccaccugcacagaaguuuaccucuuugauagaacucucugauuaucucagguaugaguucuuggauuugcagggcacuucauggcauucucuauggcauuuaguagucuguagcuuucauucuguguaugugagacguguuuacaguuuggcacaguuuucauggcuauaucacauucuccgugaaucugcagugcuuagcaucacccuuguuuguugaacgagugagugcagggcugcuguacuuuggugcucagugccuuggaacaugcaguuuucuugcgauuuuccuguacaguccccagauuuacuagccuucccucaauauacuguuauuuucaagaauauauuaacgacugucaagauauguacagguauaugcuuuuuguuuuuaugggugucauauguggcuauuggugaaaacgaguugaaacuaaaguuuauauuuuuauauggcuuuuucauuucaaacauuaaaaaacauuaaaaauacaccaaaaggaucagaaaaaaugcaagaugauaaaaauacaacuguggccaaagccaggacuuuguguccaguggcauggcuauacuacucugucaguauuuuauguccucuaaugaaaaauauuguacccuagugccaauguguaauguuuuagacacugucauguaacugggaaaguguuaucucaguaacaaacaauuuuaccuaguaaauauuccuaauuggcucaaagauaacuauauuuaaaaucauguuuaauaauaucagugauaaugucaaaaaugaaaucagggcaaguuagcaaauuuuuuguuuaucgugcauaccaaaaauuaauucacaaaccaggagacuucuuuuuuuuuuuuugagacggagucucaccuugucagccagguuggagugcagugguagaaacacagcucacugcagccuugaccuccugggcucaagugauccucuuuccucagcuggcaguagcugggaccacaggugcaugcuaccuugccuggcuacuuuuuauauauuuauauuuuuuguagagauggugucucgcuauguugcccaagcuggucucaaacuccugagcucaagcaauccacccaccuugaccugccacaguggugggauuacaggcaugagccauagcaccuggccaaaccaggagucuucaaacagauagugguaagaagcuuggcucacagcaacuuauaaagcauaaaugaagaaguacauuaaucucuguugcuguuauuauaaucuuacauuccuuucagggcaagcagagcuguaaaagcuuauuugcuuguagaugguugguucacuuuuaucaugcugacaaggacagagagcuuaaguuucguuuauggccagagccagcauuuuagagaagucaggauagcugaaguuucucuuauguggcuaugggugguuggccuaaggauaugcccacacuguggccuccguuugauuuuucuuuaacaauaacgauauuaauagcaaccaaauacugacugaguucuuauuaggugccuuucacaucuacuuaucacagugacccagaauugauguugagucugcuuugcuaugcauuugcuaugcaaugaugaggccauacuuugugauaagguagcaacuagucaccugugagauguuuuuccacauggcuuugccucuguccaauaccccacauguccaggaagcaggcuuuguuacaugacuuggagcaucagcauguguucagaaggaugcgugcguauacccuagaaauagcucaaguuuauugauuauuuauuaggucaaguagaaaauucuaacuaaagucuacucuuggugaaagguuaauccuacuguguuuucauuccuaaggucucagaauacuuuuguaagaauaaucaccuuuuuucucugaucuucauguaaauacacgagcccguaaaguuugaagugauuuuccuuaaaaaucaaucagaauuuucugguuuuuuaaaaaaucauuuuuagccuacguuuuccuaauauuaggaauguuagagcaucaacagugccauaggugauacagaauaaaugcaaagauggaaguaggucucaggaaauggcuauauuaagguuuccgcuucuuucaguaggaacucugggagcucccuuuuguuuccagucaaggcuaagccaucuucugcccuucugccugggugcugcuaugguuguaaaugaauuggcuguugcggggaggaggaaccaucugccugggggcuugacagggaauagaagacacaaaauggaugaggaggccgggcgcgguggcucacgccuguaaucccagcacuuugggaggccgaggcgggcggaucacaaggucagaaguuugagaccagccugaccaacaugaugaaaccccgucucugcuaaaaauacaaaaaaauuagccaggcauggugacgugcgccuguaaucccagcuacucaggaggcugaggcaggagaaucgcuugaaccagggaggcggagguugcagugagccgagaucgugcugcugcauuccagccugggcgacagaguuucauaugcacacguuguuucacuuucauuugccugcucuguggccauggggagauauauauauauauauauauauauauauauauauauauauauauauauuuuuuuuuuuuuuuuuuuuuucccugugagagcaguuguuuugagaaaacugugagaaacuuuuccugggagacagugggugggguuugacagcuccccccucccucaucagugucccagcugcucuugaccugccuacacugcaaaacaucaacaggccccuaaucgucuauguauuugcgauacuguuguaugguucugauuuuccacucuuauuucuguuucccuacuugggacucuuuguuuuuauuuuuuaucaugacuuuauuuauuuauuauuuuauuuuaucuauuuuuuuugagacagagucucgcucuguugcccaggcuggagugcaguggcgugaucuuggcucacuacaaccuccaucucucagguucaagcgauucuccugccucagccuccggaguagcuaggaauaaagguucccaccaucacacccggcuaauuuuuguauuuuuaguagagaugggguuccaccauauuggccaggcuggucuugaacuccugaccucaggcgauccacccaucuuggccucccaaagugcuaggauuacaggugggagccacugcaucuggcuaauuuuuaucauaacuuuauauucugcugcaagcugcuuuuaauuauucaaguuaagaggaagguaaaaaaaauaauuuccaguucuuaccugagcugaaaaaaaugagauagguaauauaagccaguucaaauuacaguggaaguaagaaaacucaguuucuuuguaaggaucugaguagcccaaguagaaucacaugaucauauuggaaagcaucuuaaagaucauaaagauuauuuggucaucuuguagaagagggaacugagaccuagaaagcaaguuaaaguuuauaaugcuagcuauuuaugaguucuccacaacuugacagugugacuuucaugcaaucagcacuuucaaauauuaaaagauagauauccucaaacuaccuuuucuaggccuaauugggacuuccaugcaucagcugaugaacaaacauucuaauacuucauuacagucaagcacaauaaucaacaguugcacuuugcuaagcaguguuuauuugcacaacuauuugaagacuguggugcauuuauuuauauuaguuucuaaaaaugaacagaaaugguaaaauguucuaagugcugauacuaacagccagacaacugagacaaugauggacacaguuaagugacucauggucaacuagaccaguuauagaauauaaggugaucugccuguaaucccagcacuuugggaggcugagguggguggaucaccugaggucgggaguucgagaccagccugaccaacauggaaaaacccugucucuacuaaaaauacaaaauuagccaggcuugauggugcaugccuguaaucccagcuauucgggaggcugaggcgggagaauugcuugaaccugggaggcggagguugcagugagccgagaucacgccauugcccuccagccugggcaacaagagcgagacucugucuaagaaaaaaaaaaaaaagaaaaagaauauaagcugaucuacucagugcacaaaggggugaaaauuaaacauaucccaaauuccaagacuacauuguccaagugauaggagggagugagagagaauugagaaaagaucaguaaaauaugaaaugaaaauuauuaucagaauauccugggaacucaaauacugggaaagaguucauggguccauucgcuagguauacagcuuacuacaggcccgucaucgacagaaggcagcuagugccuuacaagaaaacagacaaaaccucauuaaaaucuacaucacucauuucugcccuaaucuguaugaaaugaccauugauaucuccuuacaguuaauaaugguaguaauaauuuauuuuaccgauuagagaugguacuacugcugacaaaacuguuguuuauuacuguagacaaaacuguacauuucauuuauuuaucuauuuauuuauuuagagauggaauuucgcucucguugcccaggcuggagugcaguggcgcgaucuuggcucacugcaaccuucaccgcccugguuccagugauucuccugucucagccuuccuaguagcugggauuacaggugcacgccaccacgcccagcuaauuuuuguauuuuuaguagagauaguguuucaucauauuggucaggcuggucuggaacuccugaccucaggugauccacccgccucggccucugaaagugcugggauuacaggcgugaaccaccgcgccuggccuacauuucaguuauucuugauguguuuuaaaagugugcauuccauaacaguuggauauaaaaauauacauuuuauaacuagaaauuguacacauuuuuaguucuuuggaacauguaaacccaguguugaacuucuguacauuaaguuuuuaucaccuuuaacaggaaugugucgugacugaaaguggaggaugagcugguaugacauggguucugucuagggauucuccugugggagggagaggaccuuugucuugguagcugucuacuguacuaauauucaugccucucugcccaagucuguagugucaguuuuaccacuugagaauuucagaaaugaaguuuaccuccccagucccuuuaaaagauaaaaacaaauuagcucaaauucuaaccacagccauaagugguccuugugcauggcaauggcuaagaaugggcacugccugcuucugagguguccucugucuuugcugugagcggcgugacagcugugccuuccgugcuucucuucggaggcuuguuucuggguauguguucaccgcaauggaugcuuagauuuugguucaccgaacgacacagaagucacugcauucgauguggugaccucagagcaaguggccuccagguccaguuuaucuaagucagaagcugugauucaggaaagccacugcagcuguuuccuguagagagguuggccgaggcaaggaccucaucaccugugggcguaucugcuugcuaauaccauugcugcagaggaauagguuccuggagacggaggcacacaggcccagagaggaagugacagggauuuguaacagaucacacugaccugaaggaaggcccugacguagauauguccccuuuucacauucagagucguugcugcugcuucucuuuaugucuuggauaauccaccuuggccucuugaguauacuguaccucccuaaccugcugggcugaaaggccaagugcaggcaacugagucuauacugaccuugagugguuuagggaggaggcaguguguuauggaagcaucuccuugaagccuuuguguguaugaaaggacacauugcaccaacugauaaaaucugcuccacuaaccagaggcagugaagugagagugagcuugcuuggcuuggauaacugacauuuauccgucagccaaauucaguggaaaaaaguauggcaauuggaguuagaucuggauuucugaugcuugccagucccgcuucuucacuauguaaccacagugccucguuuucucuuucuuucuuuucucuuuuuuuuuuuuuugaaauagaguuuuucucuguuacccagacuggagugcaguggugugguuucaagcucacugcagccuccaccuccuggguucaaacaauucuccugccucaaccucccggguagcugguaauacaggugcguaacaccacaccugacuaauuuuuuuauauuuuuaguagagaugggguuuuaccauguuggccaggguggucucgaacuccugaccucaggugaucugcccacauuggccucccaaagugcugggauuacaggcaugagccaccacgccuggccaauguguugccuuucuauaauguaauauugaucuuuaauuaugaugaugacuagaugagacaauguaugugaagugccugguuggcgacuaaagaaauaauaguauaauaaaaaaaaaacgccauuauaauuauuuuuauuaugcgucuguucuuccaccagauguuuugcuggagguguuaguaagaagguaaucagcuuuuagagauguuccucuuugaucugcuacagaggugaaaaaucuuaaaggcaagcugcuauuuuugauuuugaaaaaucucagaaagacccaggacugcagagauugugaaacugguaguuaagcagaauauguuuggcaggagugucacuucaccccgagguacaguaaauuaagagcagcaucuugauuacagcaaaaguucaguucuaggucuccuuuacggggcacuuuacccacagcuucucaggcgcauguguaaaacgaaguccacgugcugucuguucagaauagaacggagaugagugguaagagauuuagagagcagaguaauuucagguuaguguuugaauuugguguuugagaguagcccacaauuaaaugcuguaaaguggcacaggaaaguggcuugaacuuuaagaauguucccuuuccaccauucucccauuuuauccugagauuuuccauuuguauuaauuaucuccacagcuccuguuggguuauacaguagaauuugaauuucuaauaaaugucaaaaucagaaaauaggccuauaaucuuucacaggcaguuaugaagagaauggacuuuuuguuucugaagcauuuuguccuauaaagcacagaccuuauuuuucaaaugccuugucaccagaaaccacgagccauucucauuaaaagacucuggaggaguacuggggaugguggcagggcauggcggugugggagagcaggccuggagcagcagugcucacuggccggggcguccuguccaccucacccugacuaucagggacgugcagucaccuagaagucucuucccucgcaggacccaacuuucucauccguaaagucaagauauuaaaccagcugaucuuuaauguucuuuccugaguuccauuucuuugggcauaucauaugaaaaaccacucugcauauuauaaucaaccauucuugaagaagacaugaguacguuuuuauucacugaggcccauaguacuugggugaauaaaauucaucaucaccuccagcggugauuuucuguguauuuggguguaauugcaucauuggagucauuaaaauuauuuuauaugaagggccaguuuauacaauaaauaaaguagaauugcugugguuuccucagggacugagcccuaugugccuguuucacuuucagccccugagcauccccugagguauccauagagccccaugauuugaaaauuugacauucaggguuagauccaugcuccggaguguagcauuguauucuugauccaauccugugccuacuuuucccaccaacauuuuauuaugaaaaauuucgagcauacaggaaaaguugaaaaaauuuuacaguuaaccuucguauagccgccaccucgauucuacgauuuacauauuacuguacuugcuuuauauucacauauucaucugucuaucccucuauccuccaacaauucuuuuuuuuuugauagguuucaaauacgcuucagaauuccuccuaaauguagauaaugauaacuaauuagcuggaguucaacauuuauuuauaauucuuuuuuuagaguaaaauuuccauacagugaacuucacggaccuuaguuauaccauucauuagguuuuuuuuuuuuuuuuaauugagauggagccucguucugucacccaggcuggauugcaguguuacaaucuuggcacacugaaaccuccgccuuccagguucaagugauucuccugccucagccucccgaguagcugggauuacagucacccaccaccacaccuggcuaauuuuuguauuuuuaguagagaugagguuuugccauguuggccuggcuggucuugaacuccugaccucaggugacccucccaccuuggccccccgaaguguggggauuacaggcgugagccagugugccuggcccauucauuaaguucugacaaaaguauguaucuuugcaauuuaaacuuucugucaagaugcuaaucauccccuuuaccccaaaaaguccccucaugccccuuucuggucagucuucauucacaccaucuagaagucgguauuguucugauuuuuuuccaaccaaaaaaguuguuuuaucuguuauuacuuuccauaaagagagucauauauauucuuugugucugguuuccuucacuuaucaaauguuuuugagaccauuugagauucauccacguuguguguauaguaguuugugugugugcguguguguguguaauccauuuuaugaauauaccacuguuuacccuucuguugauggauaucuggacugcauccauuuuggggcugcuaugaauaaaguugcagugaauauacaacucuuuuucuugugaguauuuuuucuugguuaaauaccuaggauuagaauugaaucaugcgguagguguacguuuagcuuuguaaaacauugccggccauuuuucugaagagcuuguaccauuuuacaacgucaccaacaaaucagaguucugcguguuccacaucuucaccgacauuugguguuuucagucuuuuuaaauuuaguuuuucuacuggaacaacaacaagaacaauaauaauaaugauggugauaacuaauagugguauuccacuggcuuuuauuugcauuucucugcugacuaaugaugucaaccacuuuuucauguguuuaucagcuuuuuuguaucuucucuggugaaguguuuguucaaaucuuuuauugauuuguuuuuaacugagcuguuugucuuuugauuguugaguuguaggaauucuucauauauccagcugucaguuugugucauauucuuugccggucuuuggcuucccuguucauuuucccaaagaugucuuuugagaaauguaagauuuuaguuuucaaaaaaauccauucucucaauauuuucuuucacgauuacugcuuucuguauucuaagaaaccuuuguccacuccaagguaugaaagcauucucauauauuuuauuguacaagcugcacauuuggucacuagucuuuacauuuaggucuuugcuguaucuugaauggauguaugugugugcugugagauaggagcucugccugcuucuggccacuccuucaacacaaucucugcugcuguuacccuggcuuacuggccauuucccaaauguauauacacucaugucuguguacuuguauguuguguuacuuccuuacuuauuuauuuauuuauuuuauuuauuuuuuugagacagaguuucaaguauauaguacuaaauaaaacauaaguaaucugugccaccgugguucuuguuauguaguaaggauagacauuaaacaaauaaacacaaaugcucuucuaugaauaucuggugaaguucuuuuuauccuuuaaaacuugucuuuacgguauuuggagacaaauaaauauaaucuaccauuaucagcaggcuaaagaagaaaaaucauauuauaucaauugauacagaaaaagcacuuggaaaaauucaauacucauacaaauaaaaacucucaacaaacuagggauaagaggcaaacuuuuucaacuugauaacauuuauaaaaauccuaaguuaaccucauauuuaauggugaaagacugaaugcuuucccucuaagauugggaaaacaacaaagaugucugcuuuuaccagucuugacaucauacuagaaguucuagccacugcaauaaggcaaggaaaauaaaagacauucagauuagaaaggaagaaagaaaacuaugucuauuugcaaaugauauaauugucuacauagaaaauccaaaguaaucuaucaaaaauaaaacauaacacccuccuaaaacuaauaagugaguucugcaagguuucaggauauaagaucaacacaugaaaauccaugagauuucuuuacauuagcaaugaauauguggaaaccaaaauuccaaacagaauaucauuuguaaucacucucaaggaaaugaaauacuuagguauaaauuuaacaaaacauauuggaucuguauguugaagauuacaaaaaccugauuuuugcaaaagcaucuaaauaaauggagagacacguugugcucacagguuggaaaacucaacauacugaagaugauaguuuucccuaauugacuuguagguuuaauucaauucauaugaaaauaucagcaaaguuuuuuuuucuuacaaacauccucgaugauacaguuaaaaugauuaaacuuacuaacuuucaacccuugaguacuuuuuagaaauguauauaaauauuucaguaaucuuuguauuuuacacccuugcucuuuuacuaaugucuucaauuagccugguacauuugaugcaauuaaggaaccacuauuguuacauuauuaacgaaauccacacuucauucagauuuucucguuuuuuaccuaauacccuuuuuccauuccaggauacuacauuacauuuagucaguaaucuuuuccgggcugugacuguuucuuauacucuccuuguuucuggugacuuugacaauuuaaagaaguaccugucagguguuuaguagaaugucugucaguuggaucuuucugauguuuuucucauuuuuagacuggaguuauauguuuuuuuuuuuuuuggaaggaucacaauuguaaagggccauuauuuucaucacagcguaucauggguccauuacuaucaacaaaacuuauuacuguagauguugacuuugaucaccuggcaguguaguguuugucagauuucuccauuguacaguuauucuucccccaccccuuucuuuacuuuccccaccuuuucuuuacuauucccuuuggaaucagcaagguuuguucguucguucuuucuuucuugccugggacuacauggugugcaccaccaugccuggcaaauuuuuuuuuuuuuuuuuuuguagaguuggggucucacuauguugcccaggcugaucucaaacuccuggucucaagcauuccuccugccucagccucccaaagugcugggguuauaggcaugagcuacugugcccagccccagcaagauuuuuuuauacacaagcuguuuuucaguuuuguuuggaaagacauuguuucuagaauaacuaaaauuuuaaaagagguuagucaguaggaucacuuuaacugauguuccuaucugcuauagcgauaguaacgaaggcacuguggcauuugcgaaagguuagacacagagaucaguggaacagaauagggaauccagaaguagauccccauaaauaugcccaguuuauuuucgacaaaagccugaaagcaauucaguggaggaaggcuaccugcuucaggaaaugguccuggaacauuuggacaucccuaggaaaacacuguacuuugaccuaaaccucacacuuuguguaaaaauuagcccaaaaugaaucauguauauauaucaauaccauugauaauugugucaauguccugguugugauauuguacuuuaguguugccagauguuaucauggggagaaauuggguaaagaguccauggaauugcucuguauuauuuaauuacaacugcagguuaaucuauaguuauguucaaaugaaaaguuucauuaaaauaauccccuucaaagcuaauuccucuggagagcugggguuucuucuagcuuguuguauauuugcucauuuagucauuuacauacucaucauuuaguaaguuguuacuuucugccaaauucacugauagguucugaaaauucaaaaagugagcacaugucuagauauaaauauuugagauucagagccauaugggugguaggauauuaccucaguaagaauguauaauuucagagagcaucaaggcuauacuuguuucucuguauugcauuuauuccacagagcugucuccaccagccugugaacuggagcauagggccauuauuuguucaucuucagauaccagcuaccugcuuuuguagcugauauauauaagccauuuuaugcaaauauguugaaugauugauuuaaugcaugaauacuugcuuuuacuuuuuaugagagcagugagccauaugaccaaacaaagggacuggacagggagauauaaaacuaauuuuucuuuguuuauagauugcaggaacauaucuuuucacaguucuaugacaacuggaccugaaauuuagcaagcccaggaaaaucagucuccaaaacacguauuugugauauauuucuuguaauagcuuauggaagauuuucagcuguucuuugauagaauauugacagagauuaacugaucccccccacaacaaacuacauuucuuauuuuccucgauuacagaaguucagugcauaaaagcagggugggggaaaucagauggauugccauaaucucauaagccacuguuaauuccuuuaugagcucuucugguauuuuuuuauagcauaagacacaccuacguacauacaaaauaaagaugauaucaugagaugugaguaauuuuuagcuguuuuaucuguauugugaccauugcgcaaugugaaaauacaaucucaauucacacaucacugcaccauacuuuauugcagaagccccuuaguguuggacagucaaguuguuucuaauuaggaauaguaacuguuucuuguucugccguauuguguuaggggcaguacacuuuugcuaucucuauaaaaagaugccaccaugucuaccagaguaaaccucuggaaauagagauuugaaaacagcuuaucuccgcccuucauuuauaucaggcuuguucagcccguggccuguaggcagccuguggcccaggauggcuuucaauguggcucaacacaaauucauaaacuuccuuaaaacauugagguuuuuuuuuugugauuuuuuuuuuuuaauuuuuaguucaucugcuaucauuaguguuaguguauuuuauguguggccaaagacaauucuucugauguggcccaaggaagccaaaagauuggacacuccugauuuauaugauaggugaucgacugucauaauauucuuugaaguucacuuugauuucugggagggagccuuaaaaaaaaaaaagcuucccaaccagaagaugagcauugauuuuuuucugaaaucuuaaacucuaacuugaaguacgucaugcccacucugcucagguguguggcuugucacuaugucagugccucaugcuggugcuuucuuugugugaagggagaugcagugggugggucaguagagagcaguaggugagcaggaagggagaacggaaggccugaggcuuuguccucaguuaccuccagucagcacugccucugcagagaagaccagcucugggccuugguuuccucaucuaguaaaugcccucugguugaucuaacucaucucucaguuuccgcuaacuauaaauuuuacauuucuuuugagauguaaauacuugcucgacuagccuugagagcuuuccauccuucuguccucccuuccuccuucccuuccucccuucuuccuguauuaauuuuuauuuuuauuuuaacugacacauaaucguacauauguacgggguacagugagaugccuugauacauauacauuguguaaugaucaaaucaggguauuuagcauuucugucaucucacacauucauuuguucuuuguagugaaaaccuucaaaaucccuucuucuagauauuuugaaauuauaucauacaauauuguuaaugauaaucacccuucugcacaguagcacaccagaacuuauuuuuccugucuguggcccuguacauguuaaccagucucucccaaucacacuucccuucuacagccuaugcuauccacuauucuacucuuugcuucugugagaucaccuucuuuagcucccgcaugagugagaucaugugauuuuugucuuucugugucuuucauuucguuuaacauaaugugcuauagauucauccauguugcuguaaaugacaauuuaauucuuuuuauggcugaauaguauuucauuguguauauauuccacauuuuccuuauucacuuaucuguugauagauacuugagucgauuccauuuuuuggcuauugugaauagugcugcaauaaacaugggagugcagauauaucuuugacauacugauuucauuucuuuugggugcauacuccauagugggacugcuggaucauauagaaguccuauuuuuaguuuuuugaggaagcuccuuacuguuuuccauaguggcuguauuaauuugcauucccaccaacaguguauaaggauuccucuuucucugcauccuugccaggauuuauuuuuuguagccauucuaaccggggcaaggugaugucucauugugguuuugauuugcauuucccugaugauuuaugauguugaacaguuuuucauauaucuguuggccauuuguaugucucuucagauuuuuuuaccuguuuuuaaauuguaauauuugguguuuuuuuuuuuuuuuuuuuuuugcuauugaguuguuugagcuucuuagauauucugaauauuaaccccuugucagauguacaguuugcagacauuuuuuucucaugcuguagguauuccagagagcuguccuuucucaggugugauagugacuguggcagaaccaaagcccaaggcagaaggacaaaccaggcuuuucaucuccuguuugcugcuuuuuuuuuuuuuuaaaagugauuucuuguaacaguggucacagacauauauucuggucuaagugauaaaaucuuuuuuuuuuuccucccaaaucuuacuauguuaacaucuccaucucaucuagagauuaguuuucucuccaugucauccucuggagcacagcccaggacugagaauucaaagccucuaaagauaaaacauggccauuucaauccucuuacacuaaaaccagacaccauauucucuaggucuuuacccaauuucauugaaacuacuuagcauucaguucucaugagcuuaauuauuuugcuucccagauagcuuacaacagcaugaaagccugagacucagaggggauggaggagcugaguacuauuauuauaauaacaguagaggaucugcugaccaacggaaaucaaaggggcaaaaaugaaaacacuaaaaaucuaugauugcacagaaugcagauuuucuuaaaggauuacuauggucauugauaaaagcuuagaauauguuuauauccucuguuuaauaguacaguaacauuucaguggauuucuaugcuagugguuuccuuuuuuuuuuuuuuugagauggagucucacucuguugcccaggcuggagugcaguggcacgaucucugcucgcugcaagcuccgccucccagguucaugccauucuccugccucagccucccgaguagcugggacuacaggcgcccgccaccacgcccagcuaacuuuuuguauuuuuaguagagaugggguuucaccauguuagccaggauggucucgaucuccugaccucgugauccaccugccucggccucccaaagugcugggauuacaggugugagccaccgcgcccggccuaugcuagugguuuucaagccguagcuggcaugagaaucacccugaaggguuauuaagguacagacugaugugcccugccccagaguuccuauuuuuugggucuaggguagggcuugagaaucuaacaucuucucuggugaugucaaugucacuggucuugggacuguauuuugagaacuacuguuguauucaaaauuauuuuaaauguuauuuaaaauaaguuuaaauuuccugggaaacauaacuuguguguaaaacguaguccuuacuaaguaauuauuuuuaaaauauuuuaauuuuguauccuacuuccuguagcucccaccuccuuuggugugaauugagagucaugggauucuuugcuuuuaaauaauucucugugugauucuuccaccaugggagucugcccucgguuuccucaauuuagagacuguaaauauuugugauuuuuccauuuuugaauuuacuucuuucuauuuucauauuuuuaauuuuauuuugcuucccuuuuacuguuugaacccaaaggauaauuuuacuuuuuuuagguuuuccuuuuuguuuuuuuuuuuuuuuugagacagucucacucugucacccaggcgugaucucaacucacugcaaccucugccugcuggguucaagcaguucuccugccucagccuccugaguagcuaggacuacaggugcgugccaccaugcccggcuaauuuuuuuguaauuuuaguagagaugggguuucaccaugcuggccaggcuggucuugaacuccugaccuugugauccguacgccucggccucccaaagugcugggauuacaggugugagccaccaugcccagccuuuuuagauuuauaaugcuguuuucugagcaguggucauaauauucacauacacacacacacacagacacacaugcacacacacgguauaacaugcaaaagguuagaaagucgaaugguaaaacauaaauuucuuucccugcugucucccagccacaucauucucuuccuuggagacaccuacuaugaucaauuucuugauauacacucaacccaauauuauucacggauucuguacuugugaauuugccugcucucuaaaaucuguuuuuaaccucaaaauaagcacuugaggcgcuuucaugggcauuuacagagaugugcacaacagggggaauaaaucugacuugcccgaugcgcauguucccagcugagguugaacacggugauguucugccuuguucagcucucaaacuguaaacaaguguccuuuucauggucuauguagugucacauuucacgccuuucugugcuguuuguuggugauuuugcuguuuaaaaaugacgagacggcuaggcgcuguggcuuacgccuauaauuguagcacuuugggaggccgaggugggcggaucacuugaggccaggaguucgagaccagccuggccaacauggugagaccucaucucuacuaaggaugcaaaaaaucagcugggugugguggugcacgccuguaaucccagcuacucgggagacugaggcacaagaaucacuugaaucugggaggcagaggguugcagugagcugagauggcaccauugcacuccagcuugggugacagagcgagacucugucaaaugauagguagauagaugauagauagauagauuagauagauuagacagauagaccugaccaaagugcuguauagugucucuaagugcaagaaggcugugaugugccuuacagagaaaacauguauguuaagagcuucauuuagguaugagugauagugcuauuggcugugagugcaauguucaugagucaauaauauguauuaaauauuuuuaaacagaaacacacauaagacaauauuauauacugauuauuugacaaaaaugugaccagaggcucgcaggaaaccaacuguauauuuccccucggagcagcgcuucacuguuugcuaauuuagcggucauagcaacuuuauagacuauacugcagauaagaagaacggacggcauauguauuauuucuuauaugcuuugcaauuucaacuaaaugauuuuguguauugcuaauccuuacaacagaccuacaaagguuauagagaaguggagggcuauuuuuuuuuuuuuuuaaacgggaauuuuagcagagagcacaguaugauggggcuguuugggguuaauggaacuccgauauguaggccugaauuccacucuucuagcaaucuugccacuauguucaggauaugacuuaccaugcauagaacagccuacucugaauuauaaaauaaaaaguuguuugauguccaucuuuucgaaggacuuccuaaaugaacuucagugcugugcuuuaguuuuucaacuacuuugucacuagauccauuauggggagaaaauggagcuuuggaaauaucacugugaguuaaauaaaugguaucuuuucuuagcuaaacagugauuuggaaauguauaacauaaauguucauaauggguuuacuccauuugauuuggaaaaacauuccuuuuaaggauagacauauuguccaaaacauugucugaagcaacuugaggacauacugucccugaccucaaguugcuuaagaucugacagauggacuagcauccuaacuaguaaguuuagugaguguuuuaugugccaugagugaaguguguacagaagacaauugggaagagagaagagauggcucaguucuccccgaggagagcauauaggauaaguuaugguuugcauagagguaaaacaucucuggaauuauagaucaugucaaugggaagauguguuuugacuuaaaaagaaauuuuaucaagaacuuacuaggacuacaucuauugaaaaaugcaagguaggcuaauauucauuaggagagggcaggcaauggaaauagcagggguggacuggaaccagguaggagucaggugaaccugguuugaauccuggugcugccacuuaaguacuuuuggucauuuggcaugauuuucacagauuaauguuugucuuucauagugguguuaugaggauuaaaagaaaagaguaaugaagaaacggcuucauagagaagaugaugcuccuuuaccauuuguagguagagaaauauuucaggcuguuagacucuacuuacuaauugugaguguaaagacugacaaaaccuuuguguaauugcugcacuacagucaagagccaggaguuuauaugcagugacuucauuuagagaaucuuauaaauaaucaauuuauuuagaauauucaggagaacaggauuuuuaaccuggaggcuauuucuucuguagcacaguaauguuuuuaauugcuuaaaauaguuuuuaauaugugguuuagagaguugauuuaaaaaaauuuuuaauuuuacuugccauaacuauucugcuugcuaaauuguuugugggggaaaacuugauucuuuuucauuagcugaauauuuuuaguuuaaaaacuguuauauauauauguacauaguaagauuauuauaaaauucuuuuaaaugcugaauauuauggauaauuaauuaugccaacauuccccaaauauggaauauguagagcuauaguuuaguuaauaccauuuguuaaaaacaaaaauaaaugauuuuguugagaugcuuaaaaacaugaaggaugauuuugauauuuuuguguaagagagagagagaaagccagaguauguauugugcuuuuuccauuuauugagaggauuuuuuucccugauauguuuuggaaagcauugguacaaauggauauugguaaugugaacuuaauuuuaacugaauauauuuuugaaaguuaaaaaagcaaaagaaugauugggaaucacuacaauuccaaauacggugauaucuuuagacacuucagauuaauuuugcagugucuuuggucuguagucauucucuuauguauucauuuaauuacagauuuuaaccuuuugacuuaggacagcaaaacggauuucuuuuggaacuaaguacuaugauuugugucuaaaaaaaaacuucuaaaaguuauauuuuucuauuuguuuuuguguuugucacaagauauguuucucauggguauagaaguuuccagugugacagaacacuuucaaaucucucauucuugaauauauggcauuuauuagcaaagaauaguauugauagucauuucucaaucgaauuauagugaugaaaagauacccuuuuuuuuuuuuuuuuuuuuuuuuuuugauauggaggcuugcucugucacccaggcuggagugcaguggugcaaucucgguucacugcaaccuccgccucccggguucaagcuauucucccgccucagccuccccaguagcuggaauuacaggugugugcaacugugccuggcuaauuuuuguauuuuuaguaccggcgggguuucgccauguuggccaggccauucccaaacuccugaccucagggugauccgcccaccucggccucccaaagugcuggcauuacaggcaugaggcauugcucccggccaagauaucucuucuuaauggggaagauggcaugguauauugagauaauaauuguuuuagaauugcuucccucacuacuuuuccccccauuagacuuauuuuuuuaaaaagacauugucugcacaaaagguagcuauuacaaaagaagacugaagugucaaaggauuucuugggcucucugauccauaugcccuggcacugucucucauaaggcuugcccucuucaugcaguugccaagugcuuguauaauugucuugacaaauggcauacucauuaauauuguguugggccuuugccaaccuguggaagccaugugccccgggcagugaaauccagugccaaacucuuacugaugguuauaaaccaugccuuaaauacguuguugagaccaaugauagauaaguaaauagccauuugaccuaaaaauacuuacauuuauccauggaagccaagagcauuugugaaugguaaggggcugcugggguucugagcuguagacacucucaugugccggagcugcagcuuccugccuugagggcucgucuuuugucacuuacuugcuccagaaucaaucagaaaaacauacccugaugaaccaccacagaaaagagguuauucacuucuucaaggcuguuaaagugccuagucuagaagcaacgucauuguaucagggccugcaaucaguucuagaaauuagguacaccaaauucucuaaaaauuaauaauugagucuaaauggaugaaacucaggaaaagggugugagaugcucucgguacaacuguauauuaacauuuucucccaggcauuucauguuacuucaaauuaacgauuucaaaaugcacuguucauuuguccuuguauugguugaaugguacuaugcaacuuguuuuuucuugagcucacuagaaacaauuguagcagugugguaagggagccauucauucauuuuuuucauucauucauucauggaagaagcaguuucuuugggcacuuacuuccugugccugaccaucuuauagaaacaaucaaaugaauggcuccugcccucaaagucuuauuuucuagugggagagguauacaugucuacagguaauuacugccugggucauuuggcaugaaaaauguauuucuauuuuaaacauccagcuuauuuauauugauuucaacaaagcuaaugggagauagguuugcccggugcagaguuaguuccagaauuuguagacccagcauauucuguucuucugugcauccaagcuggcuuccuggugaucuuauuauuugcguauuacacaaagucccuguaagaauaacccccaaguauucuccaagguagauaucuagauaaugugugaccuugucccugauaauugauuucauuugcccaugaacuuuaaaaaauuuuauccucccucucagaaagaaggucuggauaggauaaccaggaucaggagcugagcuuguacaguuuaaaauuuaugauguuauguuaguagaaggagaauguucugaauuuagaaaaauugaugucaguauucaagacauuuuuagugaaacagagaagaucaggcuagagaaugcuuauauuaccugaaccaaagaagccacagaaacuaagcacaguugaaacuuggcgagauaggacaaugguuuuaaaguuuaauuuaaaauauaaugaaugucuauuuagaauauuuggaaauauaaauacauaaaauagaaaauaagcaccagggauaaauugcuaugaaaucuuuuggcuaguucuucucaugguuucuaaauaugauaugcauguguuuauagguagguguauauuuauagaguuaagaucauaucguacauacaauuuuauauccuguuuaucacuuuauguaguuguaucauucaaacucguugcaaccauuauauuuaaugacugcauaauauuuuauuguauggucucccauaauuugcuuaaucauucccuuguugugggacauuuaugugguguauaauuuuuuuucuguuauaaauaauacuguaaugaaacuucuuuguguuuaacuucugucuucauuuacauuauuuccuugugauagauucccagaaggguaauuacccugucaaaggguaugaacaguuuuaagucucuugauagugcugaauugcuuucuagaaagguugcgccaaugacacccucacgaguaaugcaggaaacugccugcuuauagcccuucucuuuuuguucauacuagucagcaggagcaaaagcauucucuugacuuggcuuuguaucaguagaaguuaauggaaguuggccauuuucccaccauuguuuaguagaauaaaauguauaacuguguugacugaaccaagcuucauuuuuucuugauagaaauugugugaguauugcaucuggugguuauggauugugcuugaacacuuuugucuaguggugaccauauauggguuaugccugcucaccauuggcuauuucccugaagcuaauuaugcuuuagggaaaugaucaguccaguacaguuuguguacuacuuaauguuuucuuuacacagaagaaugagggagguugaaaggacuguugaaaugauuauaaaacucauucauucuaacaacaaacauuuauucaguauuuuacuaguuguugucauugugccaaagaaugcuuacagcauucugaauguguccaaaaugaaaaacaagcaaaauaauccaaaugugauccaugaccauguaacagaugcuucagauaccuuucgaaauguuacuucuuagagcagucuuguagagaaguggacuugaccaccaugcccacuguuuggacauuccaggcagcuguauuccaauaguaaugauagaaauaauaauaauaaugauaauugcugccauuuauugaguaccuguuauauuccuucaagauacugugcuguuuuuuaccuucauuguuguuuaauacucuuauuaccaaugcaagguauauguuauuuucacguugagaaauauagggaaaguaagauucagagagagagcgagaguucuccuaguucauccuugucacaaaucacaggauuuacuucugucuaaaggcugaauaauauucuauuguauacauacaucacauuuucuuuauacacucaucuguugauggacauuuagguggaucccauaucuuggccauugugaauaaugcugcagugaacaagggggugcagaugucucuuugacaugcugauuucauuuccuguguuauauacacagaagugggauugcuggaucauauguuaauaguucuauuuuuaaauuuuuuugaaccuccauacuauuucccauaaugguuauacuccucuaaauucccaccaacaguguacagugguuccuuuuucuccacauccucaccaacacuuaccuuuucuuuuugguaauagcgguucuaacagguguaaaguguaucuaucucauugugcuuuugauuugcauuucucugaugacuagugauuuugaggauuuuuuuucacauaccuauugaccauuuauaugucuucuuuucagaaaucuuuauucagauccuuugcccauuuuucuuucuuucuuuuuuuuuuuuuuuuugacauggagucucacucugucgcccaggcuggagugcaguggcgcgaucucggcccacugcaagcucugccuccuggguucacaccauucuccugccucagccucccaaguagcugggacuacaggugcccgccaccaugcuuggcuaauuuuuuauauuuuuaguagagaugggguuucaccguguuagccaggauggucucguucuccugcccucaugcuccacccaccucggccucccaaagugcugggauuacaggcaugagccaccucgcccagccccuuugcccauuuuuaaguuauuugcuuucuugcuguugaguugcgugaguuccuuauguauuuuggacauuagcuuuuucccagauacauggcuuguaaauacuuuuucccauucugugaguugucucuucacucuauugaguuuuuaaauaguucuuuacugccccuuccaaagaggcagccuucuuuguuuuguuuuugcugaccaauuuccuuccauucuuuucuuuuucuuccuauuucucuucuucccgcgucuuccacccagcaucacauguagugcuagauuaugggcauacgaugauaaauauaagagagagaggagagaaagaguauguguauauauauguguuuguguguucuacucucaagaaccacacaggcuaguaggaauacagacaacagcagguaguaauaauacggcaugcuaaacauugcacauugagugguauuuggguccaggaaacaggcccguuuccuucuagaugucuuuuccccugacuucugugcuguggcacccuuuacguccccucugucuuacuccuuacauccccuucccuuaaauaugauaaguuccaaguauucuucuaucuuuugcccacuuauaucuugcucuuagccucccauggauucuuauauacgcuugugauauuaacucuuacgucuaugcaaauuaccuccaaggucuacauuuccaggauuaaugucuuaccucauuuccaaacuauaauauaacucgaauugccuuacagaaauuguaauguggcuaucucauucauacugaacuuccauuguccaaaucuguuucccucuacaaaagaugaucugaacaaacaacaaaaauccauucugaguucucugugucagugaaugacuuuauuaguucauccguuacccgaucucuagaaaucucugggucacuuuuaacccugaauucagcucaucuuacccguuacacacugggcaaugaguuaauuagcugaugaacaugaucuaguauaaucuuuucauuaugagauaaguauuauauuucucuguuuuacagaugagaaccuugaggccagaagggucaaauaacguuucuaaggaugauacauggcaccuaagagaucaaccuaggaucaaaccaacauuaguaucucugcgaagucuggccuauugcccauuauauuguauuuucucuucuuauaguuggucugauuguuucuuuuguaccagugcuaacauacuucacguccacauuuguauucuugcuccuuuuuugugacuuuauaaucuacauauauuugugacuaggaagauuuuauuaauaguguagaaaaauuuuucaguagguuaagcuaaaacagggcucagcaaacucuauaacagaccagagagugaguauuuaggcuuugugagcaacacaaucucuauagcagcuauucaaucuuaccuugauagcaagaaagccauggcaaaugauaaaucaagaaauggcuguugcuguguuccaacaaacuuuauuuguaaaaacagacuaugggcaaggcacgauggcuuaagccuguaaucccagcacuuugggaggcugaggugggcagcucacuugaggcaggaguuugagaccagccugggcaauguggcgaaaccucaucucuacaaaaaauacaaaagcuagccgggcauaguggcuugcaccuguaguccuagcuaucucuggggcagggagccacuggagccugagacaggaggaucacuugagucugggagguugaugcuccaguaagccaugaucaucccacugcacuccagccugggugacagaguaagacccugucucagaaacaaaaaaaagccaaagccaaaaaaaaaaaccccaaacagacuacugugggcagauuuggcccuugggucuguaaauacuuauuucauuuuuacuaucuaagcuaauguguuuuauuggauuuacuuauucaugcauuuauuuauguauuuaaaaacacauugauguauaaucucaauuagauaaaauagaaguuaagggagguccuugcagagauaccauuugaacuuaacaaucuuggaccuuugauugagaaguauacuuucuuuuuuuuuuuuuuuuuuuuuuuuuuuuuagugaggcagagucucacucugucacccaagcuggagugcaguggugcaauccuggcuuacugaagccugaacuccuggguucaugcaguccuccugccuuagcuccccaguagcugggacugcaggugugugccaccauacccggcuaauuuauuaaauaaaauuuuuuuuuuuuuuuuuuuuuuguagagauagggucuugucauguugcccaggcugcucucaaacuccugggcccaagugauccuuucgccuuggccuuccagaguguuaggaucauaggcgugagccaccacacccuacugagaaaugcacuugaccccuggacaacugauuacccucccucagucaguugaaaauuccuguauaccuuuugacuuccccuaacuuaacuauuaauuguuaacuggaggcuuuacugauaacauaaacaauugauuaacacauauuuuguauguuauaggcauuauauacuguauuacaauaaacuagagaaaagaaaauguuauuaagaaaaucaugaggaaagaaaauguauuuacuauuuauuaaguggaaguagaucauccuaaagaucuuuauucuuaucuucauguugaguaggcugaagaggaagaggagggguuggucuugccuucucagggguggcagagguagaagagauaggggaggcggaaggggaggcaggaagggcaggcacacucaguguaacuguuacugaaaagaaucugcauguaaguggaucugcacaguucaauccauguuguuugagggucagcuauauuugaauugccaagaauucugaacugucucauggcuagcuaggcauaugaauuuaugcuaguuacgugaucuuuuugagcuuuauauucuuuguugguaaagugguacgaacaauacuuacaucacagaacuguugaagggaugaaauggaagaacaauguauuaauagaaguaugaaugucguuggucuuauccuccugggucucuuauguauuuccagaugauauauuucuuauagagaaauucgauagagguagaaggaaaggaagucacuucucagauagaagugggaaggcucuccuagucauccaucucucucuguuagagauaguaacagaaaggacagauacuuuucuguguggggugaaugacaguggagaauguaagcagggcugagcagauagauagaaggccugaaaaccagggcaagaaccucaaacuuucaucggcaagcuggggguugcgugaggagagcaaggaagggacacgaggcuggggcacaucccugggaauggaacccaaguguggguuuggaugugugaagagcuggaaacugggaaggaaaagcaucgacagcagcccacaaauaacuggaucagaagcaccuuuccgagaacaauucugaacuuugucuaacacauaugccuuugggaggaagaaagcuuuucuuguguuuuggcaagggugcugagcuagguagcuaauaaccuaacaguuugauuuugugccaagauguguaaggcugcauaugcauguuuaaaauucauauccacugcagugacaagucacugaacacuagaugggaagacauuucaguugaagcucagccaaaagcccuuuugaaacaacucugacaaaauaacgccauaagugaauaaaaccagagaguuccuggguaucuuugaaaaugucucccaugaugacagucucagacaaaggugcugugcacagcuucuaagaagcaaucacacacaagcacagccauucaacuugcagcuagauuuccucaguuccaauuuggagucagguggauuguguuguccagggacagacugugcuuuugauagugacuuggaacaauauaauucuuugcuaaugcagcuucauaucaugaaguuacauauuuucuugguaugauugcacggcccuugaaguaaaacagccacauaguuguaugcuuuaaaauagcccgguagggaagaauuccacauuuuagaagauggauuuuuauaauuuaaguuugugaauguaaauuauuugugaacaaugggaugugacaucucaagacucuccuuauugggaucccugagugaguuuaaaacuggcuucuguggcagugggaagaagacacugugugagugguucacagcccuuugcgguugucuuauugaacucuuucaauaccuuagaguuuugccaguuauacuuagguccuucucaccucauccgugacuugaaccgccuauacuagaugacagcugaggugacuuucagcuguaaaguuuggcauuuuauuuacuuaaaaaucuaggucagugcucugccuucuggcugcucugucacucuuccccaacaaguuuaguccuguuucugguuaauuguggguguguaguagaaauuugcccuuuugccaaagguguaauugagaggaugccacaaagguauuaaguuuaagugacaugaccagaugugagaagauuugcauuuacagcuguccauugauauagucuaucacuuuguacaauauuuccugagauuuucuauuuuaucuuuaaaauauuaaaguuaaccacaaucuaaagugguguauuuuguuuaaaacuuuuuaaaaaaauuaguaaugucacuuugugaucuagugaaguaauacagaaguuaugcuaugucaaagauaaagagaacucuguaguuaugaggauggucggcagaaaugugaaggauggcucuuaaaucucuucucuuccacucuccuucggaagccucugucuaaucauuugcuuccuuuauuagugggacccuuaauaggguccaauuaaguucuguauuuuaggggaucucucugaaguuuuuugguucuauaauguaaagguugucguguuuacaguuuuuuuccacaucacgaguucaggacaugauaacauaauaaacgagguuuucuacaaagccaaggaucugaaugacaaaggaaggacaacuagagauuagggauauaaaagugacuuccaggaaucuuuucauuuaguguauuaaguaucacaugucugucagauuucuuuaauuggcucuuucagcuguguggaggucguagugggggaaacaugccaguaggacaagagggagcuggugggagaugcaaagaacacacuugcuuuccacagagugacaccugacuugugcuuugccugugugcucuuuccagaaccugugagaaguuucuacaauggugggcucagcucucaggagaggugcccaugcauaugucuaccuggugaguaaggccagucacaucuccagaggccaucagcaccaggccuggggaucgaggccuccugcagcagagugugccacccaaagagcuccaggcagugugguggagcugcugggcaaauccuacccucaggacgaccacagcaaccucacccggaagguccucaccagaguuggcaggaaccugcacaaccagcagcaucacccucuguggcugaucaaggagagggugaaggagcacuucuacaagcaguaugugggccgcuuugggaccccguuguucucggucuacgacaaccuuucuccaguggucacgaccuggcagaacuuugacagccugcucaucccagcugaucaccccagcaggaagaagggggacaacuauuaccugaaucggacucacaugcugagagcgcacacgucugcacaccagugggacuugcugcacgcgggacuggaugccuuccugguggugggugaugucuacaggcgugaccagaucgacucccagcacuacccuauuuuccaccagcuggaggccgugcggcucuucuccaagcaugaggugagucuugagauguuucucaucgcugaaggaugucauagacauuuuauguugaggucacuaacauuuagcucgaugagaccagcauagucauccuugcuugccuuauuuugccuuagugaaucauccauacuuaaugacaucuuguguauaggugugccccaguacuuuuugaccgcuuuguuguguuaguaacuacagaaauugguaagccuuaguuuccaguugucuguccuuauccuuucucucaauacugacccgccauucucuggguuacuucuuaugaauggagaauagucuguggcucaaauucaccuuuaauccaggauggcugaaggugcaacauggaaaccuguggucaggucauucuuaauucuguuaggagaaguaaauuauauuuucuugcuguuagagagaaaugaauuucuuagguaccuuaggggccugaugauuuauuggcuugggcuguaaacugugucuuguccccaggcacuuuccucacccucccuggcuuugcauguugcugugagaugucuuaauugcugugggaugucuuaauugcugcuauucuugaagcauguguuaggaugaugcauggagccuuuucccaacuccuugcgucuguuagauguuauccuaauauguugugugcaucuguuagauguuauccuaauacguugugugcaucuuuuuuuguuguuuuuuuuuuugcaaauucugaaaucccuaaaagcuugauuccauuuccuaaaaacuugccauaccacuugucccucacucauguuuuaaaaaccaucucuguuuuuauauaagaaacaaaugcguuaaacuaagcacaggguguauuucauuuuacuuccuuagcaaugucccuuccagacauguucacuggaacaggaggaauuauuaucgucacaaaacucucuccugccaacguaagcuaaaugaguuauuaauaugaaaacaaauaguauagcauccuuaggccaauagguaaccauuguucuguuguauucuauaaguccuauagcaggagauaacugaacaggacugcccuccccuucucuccuuuuucuuucuguuuaccucuggaugugcuguucuuuugcgacucugugauaauacaguaauagcuuagccuuacacaaaaaggccauccgugcuggaucucgggggaucucaaaugagcauucucacuacuuggaauagcugacuauuuuccaaguuaggaaaaauaaugauuaauaaggauauagauuuauuagggaacuaauaugagaugaauaaagacaggucaaaaucugggaaauaugaccaagugauagaaugucauuuaaaauuaauguacaagaggagcugugaugccaguaauaugacguccaggucacaguagcagacaggugcucagcccagcuuaccucauuaaagaaauaagaaaggacugugugcucugauuuguaagccugcaugccaugaaagaggcaaugaaggcugccaggcacuucuagcauuuuaauggagggaaaaucaaggcugccacagaagaugggaaauaggaaguggauaggaaauuagccuucaccuuguuucauauuuguuuuggguccaguccaauuugguaguuaguacaaauuacuaaucuaaacugaugaugcuacuauauauucugcguauaguuaaaaaauuaugcucauguguauguauguaucuaaucuucuuauauaaggugcaucuguguucauugcuucguuuacuccucuuaauaaaaaccucgcaagguagaucauuuugacuucagccaugaggaaugaggucccgaaagguuuagugacuuacccaaaguugcugaagcaguuaguaacaugccuagaacuggaacucagcucuucugaauucauugccuguuuuucuguauucugcuuuuuuucaugacacuccuuucuacgugggaccugcuuaugacccaaaggggaguuuugguuccaagaaugcuauggagaguggagucagaagauugugguguuuucugaauuccuaaccucaacuaaaguguugguacuaacucugaccuaaucuuaacucuaaacaaaauguuuuuucgucuuucaguuuauuccccuaugaauaggauuuuuagaguuguaauaauguuacagagacaauuuuaaacauuuuauuauuaucuuuuaagguauuuuuguuguuuaaucuuuguaauuauuacuuucaucacuauaacguguauuucagcaagaagaaaaguaaauacagaggugcaggguaaaaaaacaaugauaaguauagaaauggaugagucacaguaaucuauacacuuagcuauuaauuguggaaaaaaaucuuuuguauuuugaaaaauaguaaaaugaaaacucuagugaacaguaauaaauuggggggaguaaucaauagauauugaaagucugcuaaggcucuugucauauuuggggauaggauaaaauuacugaguaacuucagacuuuguuggaaaaaaauuagauugcaguacaauguauacauugcaaacaguuggaguagaaaaggaggaauguagagcaugaucucaauuuaacagacaggaaaaaggaaugaaaaaaauaugguaaauagaaaccccaaauuaaggauguagauauaaguccaaauacaucaguauucaugaauuuaaauggguuaaacuuacuaaagacacacauuaucagauuggauauuuuucaguuagagaaaccugaaacaaaaccacaccaaagggugaaaauaaggggcaggaaaaagagauaucaagcaaauaauuaucaaaagaaaguugguacagcaauauuaauauuauguaaaauagaauuuaugaaaaaagugacaagcaguaacaaagagggguaguuccucaaucaggaaacuuuaugaauuaagaauuuuuauguauucaacaucauaggcuuaguacauaaagcaaaacugaagaauuaaaaguuaaguuugacaaauuuauaaccauguuagaagauuuuaagugaccuuggucagaaaccaauggguuacgaaguuaaaauguguaaagauacagacagucugaaaaggugguugacaaguuugauuuauauuuauuuuuaaaauuugguagccauaaacauauauauacacacauacacaauuauauauguauauguguauaaacacacaugcagaaccaugcacauacauggaguuuuauaugcaaaugucagaaguguauagucauauggauuucuaaaaauuacuuaugcauuacuaauugacagucaaagucuaaacaaaugucaaagaaucaacaacauaaauagaacuuugccugccugacuucaguguaguuuauguagaaagcaauaagaaaguauaauaaaaauguuccauauucucagaaauuuaaaaauauacaaguauagcuucauggguuaaagagaaauauuagcaauaaauuacaaauuacuuaucacugaccagcaaugaaaauacuuugaacugcucaaauguggggaaccauagucacuucauuauggagaaacuugguauuccccaccuaagccguaggaucacuguuaacauuagaaaaacaaaacugaugauguuagcuaaaaggguauuugucauaucuuucgcuuuagauauguuuauuuuaaaaauugaaaauggaaaucaucaaauuaaguguucaauuuaugaugcuaaaaaugacuuuauuacaaaaaaaguggaagggagguggguguauagucuuugaauauccccaaaucuuaccaaauugagagagcaacuagaauagcaaaaccaaauaccgcagacaacaucuacaacacaauuaggugacaaguucucccuaaauccucacaaaugcaugggaagucacaaugaacagcuagaaguucugcacuguaucagaaacagguaguauagggacacagcaguacuugagagaaaaggagagcuuccuuaggggucucucagagaacaaacuuccacaaucaaauuuacgggagagacuuuggcucaaaguaccaguaucacuguucaucagugacuacugacgucaucugucuaggaaaacaguggaucucuaccucacacuaaaucuucaacauaaugugggaagguggauuagacauuaauauaaagggacaaccacaguuaacgugucuccugaaggaaggauacaauaccaacuauagagucucccccaaaauguuggacuugagucugauuaauucucuagacccaacuaccauauguguaggacauauucaggcugugggaaauuguguagcaggucuacuggaggugugaucugcagaaugaaauaaauagaggacucaagaguaaguacuaggaaauguuuaaccaaugcuaaggguuuagaaauguuuaugccauuguauucaagcacguuauuaguggacuucuuuuguugaacaguguguguggauggguucaaguguccuuaaauacucuugguguguugagugugcccagucuaugcaguagcaguaggcccauguaucaguuugugauccuugggaaaucuaaaacuauuccuuugcuauggcuugagaagcgcugcucuaugggauaaaggacccaauuucuucaaaugauugcaagaaaaauaaaaggggaugaaaacgauacccguagauuaaaagaaagaucuaucagucacaauguguagauccuauuuuuaaagaaaaaaaaaccaugacauuugagaccacuggaaauuugagcacugacuaacugaauauuugaaauucaguucuuuuuuguuuuuauuuuuuagaugugauaaaugguauuguauuuuuaugaagucauuuuguuuuagagauacauauugaaauaccuaagggcaaaacgaucugaugucugugauguucuucaaaacaaugugggaagguggauuaggcauuuggagauggauguaagaggauuaauaauuguuaauuauugaaacuggguguuggaugcagagaaaucaucauccuuucuauucgugcauacguuugaaaauuuccaaauaaaaggcuaagggaaaagacugaaggaaaacacugggauccgucagucagucaaaaacauuggcugaauauguacugggauucaagacuguaagaagauaucagacagucaugagauggucccugcuuucauggggaagacaacuauuaauauaaaaaaagagugcaggauaaauuaaagauaaaagcauucauuacauguaauagaaaacugaaagcaauuaacucuaaaauuaauagccuuuccuccaucagccucagaugauuuuacacaaguuuuuaccaaaucaugaauuacuuguacaaucuguuucagaacauagaaaagagaguccuaccaagcucauuuuaugagguuagacauguuaauaucccaacuagauaagaaagaaaacuuuugaaguuucaucauuaugaacauagauuauuccuuuuuaaugaacagauauagaauuauuaaaugaaauauuugaaaauucaauucauugauuuauuguguccuaccacauuauuauugcauauacauuacauuguacuguauuaacugauauaaggagaaaaagcaugugaucaucucaauagauauagaaaaaugauugcauuuaaugucucaugacauuaaaaaagcauuugaugacauuaaugacucaugauaaaaacuuuuagcaaauuagaaauagagggaaacuuccuugacuuuacaaaugaaauccaugaagcucuuacagcaaacauaauuaauggugcaucauucuaaauauuucuauccaaauuagccacaauucaggauuccuuccuaucacuguucaucauuaugugguaaauucuagcuuaugcaguaagccagaaagagaaauagaaggcauaagcauuggaaaacauagauaaaacugcuuuauuuguagaggauuugaugcuuuaccuagaaaaagaauauacagaucaacuauuagaacuuacaagacaauucaacaaaguuguuggauucagggacaauauagaaaaauuaauguuuuuauccauaaguaagaaccaauuaccaaauauaauaacacauuuuauuuguaguaucaacuaaaauauuucaguaccuagguauaaaucuugcaucagauauuugagauauuuauggauaaaauuauuaaauauuauuaaaagacauagaagaacauaaggagagauuuaccauauuuguagauucauagauaggaaaacaauaucaugaagaugacaauucauccaaaauuaaucuacaaauccagcgcaaauccaaccaaaauuuucacuggauauuuuggaaaaauugagggacuaaucuuaaaauuuauagaaagagccccagguauuaagacuuauacuuguguaguuguaaagauaguuuaguaauggcacaagguuaauuggguagagaacauugcaacagcucuacuucauauuugagaacuuaugaaauauaagugauauuucauaucacauaagugggaggugauggauucuacauuaauuguucugagacaguuaucucuauaggaaaacaguggaucucuaccucacucuaaauccaucaaauggauggauuaauaagucauuugugaaaaagaaaucuuuaaaacuuuuggaagaaaauauaggagauugucauuuuuacucugauagaauauaauaucauaaacaugagaauucuugaacaagaaaaauccauaagggaaaaaagugcuaaaguuggcuacauuguguuaaaacaucugccuaauaaaagucuccauaaucaaaguuaugagacauuucuacgugcuggguggagauauuugcuguguugucagacauauuccuacuggauucuuuuuuucauccugagacuuucuuuuacaugaucacuaccaaucuucugucaaucuuucgacacuguucuccuuucugaaaaugcauauagguggugagcacacgugugugcuuuuacuauucuuuaaacaugucauacucauauacuuuuauguguaugauuuauuguguaagaagaaggcacaugacuggcugauaaacaaggaccagcuuuaucaauaaacaagaaaaugcaaauuaaaacaaccaaauaugauuccaaacucagcagauuagcaaaauuugauaauccucacaauaccaaaggccuagaggaacuguccaucuuauagccuucuauugggaguguauauaguuacugccacuuuggaggguaauuugguaguuuccaaugaaaacaaaaauuguaugcuaugugauuuggcauuuuuuucuuuaaguguuaaaaagucucaaaaacccaucaagaggagcaaggauagauaaaaugggcucuguuuuuauauugaauacuuuauagcaauuaacauaaacgaucuagagguacuuguaucaacauggauggguuuuaaugcaaucuugagggaaacaaguacaccgcgagugguacuaaacuaucauaucuuuuuaaauggauauucagaaugcacccaauaacaaaaacaugcccgacaauguguguucuuauggacuugcuuauauucuuucucaucugucuuugucuauuucucuuuuuaugcacacaaacacaauuuuucuuuaauccagcuagauaaacauaaaaguagaugugaaaaaauauauggaaauaauaaacacaaaaaucaaggucgugauuauuuaugauguggaaggagggugaaugagaucaggcaucauaucauucuuugcaaacaaugcaauauuuuauacuuuuuaggagcauagaaggauuuugagacuuacauguuugagaaccacuguucuauagcuuccaaacgaaauuuuuagaaaacauuugagacauuuaguuugcaaagaauggugaauuucaaguauuuggcaggcccaccagaggaaacucuuacaaauccugugucuauuuaaucugauuaaaaaugucaguugaaacaugcauguguggaccagugcucagacaaguucuguuuucccacucucccugguggcaccuugucguguuucaccagaugcacacuugugugugggcccugaggauggacagaggaguugcgugagagacaggcauuccgcagguuguucuccagucuuggcugcagacuguuugccuccuuauuuugucuucauuccccuuugauaacauccucugggucuguuucuuccaggauuuuucugucguguacacacaugugcaggcaauacuuccuccugaauuuaagacgauucauaaugagccuucuuuucuuccagauucugucuccauuauuauuauuauuauuuaaaauucuaaaugccucuuguuuucuuaaauuuuauacaagaaugugcauaucuguuucuuguccuucuugcuaguaguucucaaacuugaguguauuaaccagucuugguccaugaccgaguuuuuguugauuuuacaggaaaauaaaaaauauaagagcaauauaccaauuuuuauaaagguauauuuauuuauuuuaaagagcucuccucuguucuaggaugauuuccuugccacuuuccugaguguuaaaaugcaauuucucuuaugaagugauggugauaguauuuuaagcauaugccuguacuuggcaaaauaaagcauugccuaccuuaucuuagucccuauaauguuuugaaauuuuuaccaaucuaugaaauauauaaccuuacaccuuaacaaaugaaggcauaauuguggagaaguuauaaauauuacauaauuaauauauaauuuacaaauauucacacagaaauaaagggaaaucuuuucggaaaagaggaugagugaagguguacagagaaguaagcuuuuuguauaauuuugaccacaacccauuacuggaauggcccuucaucaagagguguguguucaguucauauaccacccaccccuuuaaacauaaucaugcucauucgccauuuccucauggagggauuuuaggagcguagaaggauguugagacuuacacguuugagaaccacuguccucaaaccacuguccucaaccacugugggugaggggcuccuuccacggaggcugcuccugcccucacgauuccuucccgcuggagugaggcgcuucuuuuugaacaccccuuuggcauccuuugugguucauccuugucagaaaaaaccgcugucauuuaucauuagaaaaucucacuuuugcugccuuugauauucucucccacuuuccagaugguucacuggaacccuccuguucuugggcuucucuuuccaagcuuccccgcuguuacucuuguagugagcccaugguugucucuuuauuccugcuuucugcucugaaucacuuuucugucuuucagugagugacaggguuuuauucuccaccgugugguuauuggguuuccuuaauagccucauguggaggggcuuuguugaaggcauuuuuauucggcuuugacagauuauaguccccauguuucccuaaucucuucuuuaaaauauuuuaggaagcauugucccugucaaagacacacuuaaauucaaacagcuuuuccuuuuuaaaauuauuuuucucuguucacauguuuacguaguccucugucuugacaguuaagugagaggcaacuggucauagugaggaguccauggauuugggaaauaccccauuauuggagggcaaagcaugauuuggaggaccguuuggagagagaccccuuuuucuguggcacagggcuuuugcagauaauuagucuuuggcuacgacaagauggaaacuauuaggcucuuagucugagacucaucacugccuuguagcaguuuugcccaugacccuuacugggcuuucagcaacucacugccuugaaauguuaguuugugugugccuggugucuccagcugguuagucaacuccuuaagggugccacucuaucucuuuuugugccugaucuuucuaacccaggauucugcacagaacagcaaugucucccucuuucugggcugucaacuuucacugaaaaaaaugacagcuagcacuguuaacugcauggcagcucaccuaucugcuugucuaguuggguauucucagcuauaagagcacaugugucuguuaggguccaauucugauauggaaaccgcacaguaacuugaucaaggaaagcauaauguaaagaauuacaaacuccaacacagaacuuggguaaucagggauuggccaguaagagguaaugaaagaguccagaaguauuaucuauaaggaggagcugcuacccuuaggacuaagacggggacccagagaagagccccuuccuccuucccgcagcugugguucacugaguggcucagaagugcuaguaguggugccaugcuggugaaauugcuugauauccacgcucuggaauguaccgaaaucugcuuucuuggguguggggaaaguuaauuugggagacuugucuugugggaagcacuaugcuaugaaaaugaucaaaugggguaccgaggagagcagcuggccauuggaggagcuguguugccaccugcacugcagaucugggcaaaagaagugcagggugcccaguaagaauaccuuccuuugccaugucccuccagcgaccucuacugacaaaguuuagcauuuugccagcuggcaaaggaaaauauuucaaggacucaacucaguuuucacagagcaggcaaugaaggauugauuguuuuguguaggugauaagugacagagucagcuugcucccuuuccugaaugucuagaagccuuuagggagauaggcuaucauuuaugcaauuacaugaguugcuagggaaagucauauuuauggaggcaaaauauuuguucuuaauucaaauuuaauauuucugaaaacaauuagguaaugggaaagcucucuaguuauucgaucuuaguagauggaauacacagagaauagaggauguucucaaggguaaaagcuugugcuccugaaccaauaauagcauccaaagaaaaacagauuaauauucuuuacaucucauuucucuaagaucucaggaaaauuauugccauuuacauucuacauuuguuguugaaggcuaagagggccucauuagguuuaccaaauccaaauaauuacaguuagagacgguguuuuuuucuacuagcugaagugaugugugaaaauagcaaaaauauuuucacagagaaauuaugcucuuuaacaguaaacuucacgccuugcuaggaacugcauuucucugccugguguguaucaucgaaugcuacuuguagggauggaguggucuaauuucacauuucgagcuugguaggugcaggugggcuguaggugaaagggaguuuucuuuaccagccagccucaaaaauggcuagcagccggugccacucgcauaguguugaauuauauguccagauaccccagucuacucacaaauguaaaagacuacacucuugcuauuugaccaagaaugcacccuguacuggguacuuucauugucuucgcuccgaggcuucguccuaaaaucugcuuucugugucaucucccugacucauccugggauaggucucugcaaaauuguaaacuuuuguuaguuuaaaugaauuugaaagguaagauaguuuucuuaaacuagauacaucaucuaaauacaauguuagucuuuagcuguauauuuuaguuuuuauagaaacuuuauauaaucuuauauaagaucaauaguaguucauuauagcaauuauuuauuuauuuauuuauuuauuuauuuauuuauuuauuuauuaugagacagagucucgcucugucgcccaggcuggagugcaguggcgcgaucuuggcucacugcaagcuccaccuccuggguucacgccauucuccugccucagccuccugaguagcuggaccuauagguucccgccaccacacccggcuaauuuuuuguauuuuuaguagagacuaaaaauccuguuagccaggauggucucaaucuccugaccucguuauccgcccgccucggccucccuaagugcugggauuacaggcgugagccaccgcgcccggccuauagcaaugauuucuaauuuucuuuucuuuuccuauuugagagucugaugagaaauuugcauacuccccagaaacacacacacacacacacacacacacacacacacauacacacacacacacagaugcagaauuuuuuauauaguuuaaaggguuuuauaggcuuauuaguuaaaggguuuuaugggcuacuggauuagauuaugaaauuugaagucagggucaaggagauaguuuuugcuuuuaauagguaauucccaaucucagucuguaguaaauuggaaaaucuguucuggauucuuucagcaauccucucucuuuccacaucugccacuuuucugugacacuucuuuugggucacauugccaugcugggguuauguuugguggucgauuauguaaguagcaacggaaguuaggguuaaguuagcuauaggaaggcagagaaugcugccuaacuuggguaugaccagaugucaguuauuagaaugauuggagauugagaaccaagucaggaguucagagucagaggcaguguaggaacaggaggcuggguuggauguguugggggaaaccaagggaaaaguggaaagucucucuccgagggcugggagcauuccuaaguuguggucauuucuggaccaggaaauacaaagagcugguuucuguuuagaaagcuggugaggcggacagauagccaaagagcagacucugggacagugggcagcauggguccugcggggagcagaucuugccauccaucugguaaacacuggcccuuggaaucuuguuauguguuggacuuuagauagcguguguguauucuuuaagguuuaugagcuaugcuuaaaucaagcagagaaagauuuacguuugacaaaugacaaggaacgauuucucaccauaaagauuuugagugagagaaugaguuucaagggaacuuggguuaaccuucuccagggugaugcuucuuaauauuuuuaugcuguggauuuccagauaagguaaaagacccuucaguucaguuaucccaacucuuucaucucuuuaaugcaaaaggaacucagugauagcaaugaggugucauuugggaauuuggugguaggacuauguagaauauguaucccucuccuuugguaauaguaguacaaaugauuuuuauuuaaacuuuagugucucaaauauaaucuuaaaaucuaguuguuagauauugauucuaucaugucaauuuacacacaguaaagucauccauaaugauguagcuagaguaacagugauuuauuauuaaaaggccuaauaguaugugaagucuacaaccaacucaggcuaccacugaagauccacugauaguuuacuucuuggaaucguggagauuccaccuuuugaagagugcugcagggaguagaagcuucuuuguuauugucuguuuauauuagucaggguucuccagagcaaccgaaccaauaggauauagcacagauauauaauaaaaagauggcucaggaggacaaacauuauaguuugucacaaucugaagguuggagaagcagaagagccaauggaguccaagucugaagacaggagaagacugaugucccaguacagggacagugaaguagagagaauucuuucuuccucagcauuuuauucuauucaggugcuugauggauuggcugaggcccaccacacuggggauggccacaugcuuuacucgcuuugccuguucaaguauuaaucuaguccagaaacacccucacagacacauccaguaaugauguuuaaugaaauaucugggcacccugugaccccgucaaguuggcacauaaaauuaaccaucauaccauucuuggggaucuucauggugaaacacugagaguccucagucaguucuaauuuauauguucuaucgaugccacauuuuuauuaauaacuccuaguguaccacuuagucaaugaccaauaaauagccucuauuuguacauaaaaguauaagaauaaggaauuaugccuuuuuuacccuuuaggacugaauaaaggacuggaacuuuuggccgcuggccuuuggagccccuccauggccuggacauuauaucuugaaaauguuuguuuuuauagcagugcuuguuauucuccagaauaacaccagcuuuugagcuagcgaaacgagaggcaaauccuggcugugcaacucagccucuggugaccuuagauaaguucuuuaacguuaacacucugaacuucagcguccauaacuaaaaugaggacaacucuugagugguggugaaugagccugccacgcuccugacauuaggagguguucagcuaauggucgcugcccugcccauccccuucuguguaucuuacaaauaguugucuccuccuuuuguguuaaguguugauccaucugagcauugucaaugucaauuauguaucuuguggguuguccuuuuuaguucugaucuacuuuuuuuuuuuuuuaaagccuuugcugucuuuucuguucuuucccgugguugacugauuaguaaugugucuucugucaccuuccuauagaacaggugauggaauuuagauggggccuuuguccuguuauauuuugcccacuggcaucaugaaugagcuguuuagccaccuggagaagaaaaugcaaucucuuucucucuguuugaucugucaucauggcccaggaagaagauguugagagaucauaauuuuaaaguugacagcagaaugggugaaguuuucuccuacuuuacauggugguugucaugagaaccaguucacaccagaaugggguguuuuuuguuguugucauugugcuuuuugccuugacacauggagauauuuaauuuccauguaauuugugugcagcuuccuugcuuugacggauugaaauuucugauucucuguagaggccagagcuuggcaguaauauuaaucuacuuccuuuucuccuaggagagccccugagagaagaaaagugcuggaaaguauagucauugcgauaugucaggauuaauaaaagcaggcaaagcaaauggccagauuuccaaaauacccagcagcauuuggcaguauuuuuggggaggccgaguucaggcagcugccgaugccaccccacugagagcacugcggagggcagccucgccuucugccggccacauggcuguguggaaucccaugggauggaaucugcugcccuuaggauuucuauugucccuggccucuggagagcacauguuuuggucacuaagcaaggaacugaguagccucugugauguguucaacuugaguuuucugucauggaggcuuaaguagggggagauauggacaggccauguuggccagcgaggacuuguuugaguuggaaaauaaaggucugacauaggguuucccugagaaagcucagacugaaauaggaggaaccugucuguuugaagcuugagcuucuaaucuaguauagcacccugacagccaguauuuuguucagcugccuggcagaaguuguuucucagccaccaauguauuuuuguagcaucuuucaccacagaauacugacuguuucacaucucuucccauuaauccacuggcacaaagucucauugcaaggagaggaaaugagacaagcagcagggagaaaauaaagucugcuuuuugcaguauagggcuuuagugcauuucuuccccugugcucaucucuguaacuugauuaauuggcauguggugcauuacagaaaauccaggcaauggcaaagcugguucaauaucaauuaguuaaaacagggagggacuucccauagagaccuuaggacagaguuguauuuaacugggcccuugaaacacaagucuucccgaaugaugagcaguagaagauccuacuuagggcccaguugguuaaagaaauugaaaacuguagaaauuagcagcugaaauccacuuggaugaguuugcuaucccuuuaauauaucugucuauucaucuuacuaaggcaucccaauccuuccuccaaagugauuugaauacuuaauauuugcugaaaugcuuuaguuggauuugaauaauguaauugaauuugcuugcugcauuugggggagaugaaggcuugggaguuucuuuucuuuuuuucuuuucuuuuuuuuuuuuugagacggggucuugcucugucaccaggcuggaaugcaguggcaugaccucggcucacugcaaccuccaccucccagguucaagcgauucuucugccucagccucccaaggagcugggacuacaggcaugcacuaccaugcccagcuaauuuuuuuuuguauuuuuaguagagacgggguuucaccauguuggccaggauggucuuggucucuugaccucguggucuguccgccuuggccuccuaaagugcugggauuacaggugugagccaccacgcccagcuggguguuucuaugguaagaaaugugagugugcuuauguuuagcagugauucuuauuucucuguaugugaaccaaggauuaauaagcaguagaccugccaaguaugugaggcuguauucaucacaguuacggccugugucugucacucugcagaugacuggcuuaucccuggggcucaggggucgccugcuuagugacagguuuugguugaaccgaguuggauauagauugccuuuguguuuggaugccacacauucuugggaagcucguccuaaaccagauugcuguaaaauaagauauugacuaaguguuguuccuauauauauagagagagaugaaguauaaacucugcuccccacagucagcauaauggaagauacagucaaggcacggaagagggagagcucuauuccuggggguaauaauagaaggugucccaaagaaucucagacaaaacauuauaguuguacaggcagagaagaaggggcacuguguuucagguggugugaguagcagauugaaggaaugaagauguaugaaggugacgaguccccggaauguguaguguggagcguggcacauuggaaagugacaggugauggaguuagagaaggaagcacgaacugcuucaugaagggccugcuauguaacuuuuauaauuugaacuucaguuuaaaaagaaugaggagucuuuacuaaauuuuaaggggccagagugaggcaaucguucagguuggcauuuuagaaaaauaauucugcaauguggccaguggaauggagcagggucaggcaagacuggugauggaaagaguuguuaggagauuauuacaaucguccgagagaaccagugcaggcuaagccaaggaaauggcagggaugaucgauaagaaaggauguaaaagagguggaauuaauuggauuuuaucccucuacauggggaagugagggaaagggaaaagcaauuaaaacuaacuccuggguugcuuuuuuggugccauucacagaguuaggggucucaggaagagaaauguguuuugggguagggacaggagagagacuugagucugagacauguuuagguuugggauuugcaaguagaaaugcccccuuggcaggugcaucuguguaucugggccuggcacagucgccugggguggagguggagauaugugaucuaugggcauaugaugauaguuggagcuaucaguuuagcugcauucaucuaggggaagguacgcaggguaaagacuguagagggcugaaaacgagucccuuggcguacaaauauuuagugacaguggaaggaagggaagcgugaagaagaccaaaaaagagcuaucaaccuaacuguauuugugagaggggauaguugcagcauggucuggggcuggagggaguuuuguugguuuguuggaccguuuguuuaaaggaaagaauggaauauauucauagaggagaaagagccuuuggagagauuacugguacaagagagauggcaugauuucuaagugacaucuuugaggagacagagugacgggauaggguauauccaagacgcgaggagauggauuaguaacaccugccgccugaccaggggaaggcacccuuuuccuguuguuacaaagguaggaaugaaggauugaagcauggcugcagaaaaggcacagauguuuaugaaugggaauacagggcuuagacauuagggagcuucuucucuguuggcuucucuguucucaguaaagaagaggacaaagccaguuuuuuccccaguugaaaguagcgugggagggauagacauuuuaacaagugagauacaugauuagcauagucucugaaguuaauuggagagaacagcuaauacuuucuucuccaaaauuugguucuugacucggcaugugcuuauagaggcagucuacauugaucaaguaauuaggaagaauagcgugaagcaucugcuauguucaggacacugugaugggggucucugcuccagaggucgugauguuauccuucuagagcucuuuccucauucuuucauguugguuacaaaucaugguugcuugucuucucucacgauaagagacugaaguguuguuccuggagcugcaaucugucuauagcaugcugaacucauucagaggaguauauugucucuauauuaaauuuugcaauaaauguuuaauuucagaauaguucuagguuuacagaaaaauugcaaagaaaguacagaaaguuccuguauaauccauauucaguuuauccuauuauuaucaucuuauauuagcaugguacauuugucacaauuggugaaccaauuuuuuuuuuacauuauuaccuguauucauuuuuguucuuuuguuucuaaacucucuugcuaugaccuuuucaguuaucuuugacagugggagaagcacuuaucuacuaaugcuucagaaaccugagaugaaccaauaauuugaagcauccccuuucuugugucuuugggauuaucuuaucuuaaacccuaugucuucuuauuucaaaaaucauacacuuggcaggggggaaaugguugcagagaaaaaguaaauaucaacugggauuuuaucaaguucauaugacccuacugugaguuauauguguguuuaauuuaaaaaguauuauuauuuauuaaaugcaauuugacacaaaucuuuuuuaaaaugggguucaucggggauuaauaaugaagaauguuuuuuggugacaagaucguguaccaucgccaguaauaaaauaguucucuaugucuuugccucuagauggcacugauuuuauauuugcccaugauuuuuaagcuauugaguuuggaauaaaaaagccuguucuuuucuggcuaacacugugucugugcucauuugugcacucuguuuuuacuucacucucagcaaaacacagaauuaagacccuguuuuaguuccuguaagaguccagccauuacaaaaucauucaugagugaucuaguauuugcugaugaauucauaaggaagagagcauuuguaucauguaaccuauauggaaucauucugaaaaauauuuaauggaucuguauuuucuccaagugccuuuuucuguugucggugggcaguuguccugagcuauuccuccagguggaacuuugcucucugguaucugcuucucaaagccaggauauuucaaaauccuuuuaaaaaaucccuuuugucauacuuguccuacagaauuauuuagcagguaucuuguauuccaugggccccuuuggguuuucaguucuccgucauaucuguuuauuguugcccuccccucacauccacagaugucaaagaaucucuuuacuuuuuacucagagaguaagauuuuuccuuccuaauuaagcugcuaaacuuuucugucagauccuuucuaauagaaucauacagcuaaaugaaacaguuaaaaaauaucggcuugcagaaauauuuuauggcuuuggacauagcgucauucuuggacaaugcaaaaaugccuuguaguuugaaaauguuacaucaguugaccacuguguuaggcgaguacuauuguugaguucuccaagcugcuacuguuccuccuccccucccuugccaucuucucucuuguguccugucucucucucucuccucuuuauuaagaugcugguuggcacagccuggacucuuaguuaugaccuccuuucuuucauguacucaaucugucuacugaaacgauuuuguuuggcugcauuaccuagcaagauuuuucuauuagcauucucuugggucaucucuucacugcucaagucacuuguacuugcguuugguauugugcagagcaagaauguccugugguguaucccaucagacuuuaccuuuuuggucuauuaccucaggcaaagauugacuuaugaagcuagaauuagugaaauuggugauacgguaguggcuaacugacuuaccaccugcuugaaaauuucaaaugcaguugaagugacauuauuauauuugucuuaauguuacaauggaaaaaugccuguaguuugaaaauguuacaucuguuucugauuuuccucucugaaacaaagcuuucugaauucugcuccuacuacaguuuuuuuguuuuugucguuguuguuguuauuguuguuuuuguuuguuuguuuuuuuccugagagagggugucucucugucacccaagcuggaaugcaguagcaugaucucagcucaccgcaaccucugccuccuggguucaagcaauccucuugccucagcccuccgaguagcuaggauuacaggcacgcgccaccacgccaggcuaauuuuauauuuuuaguggagaugggguuucaccauguuggccaggcuggucuugaacuccuggccucaagugauccacccaugucggccucccaaagugcugggauuacaggcaugagccacugcacccagccucuacuacaguuuuuuuguuccaguacuuaccuugcuuguuuagguuauucagaaagugaguacuauugcuuucuuucccugugagguaaggccaguuuccaagcccaugcuuggccccagacaccucaggcaggaacaguagguauaauuauuucaucagcguuaggauuaaguuagaaagcaaugaguauguauucuuuugcaucgcacaugcuaaaaauauccuuacucagcacccuugauggauccugccuuuuaugaguccccagguaaccacagggacugcucaaguucuacuguuacuucaaggauuauuuugauuguuuucuaugacacaucaucuuucagaauuuuauaaaccgaacaacaguaucacaaaccagugucuuuucugugugaaggcuuucuugugaacagcuccuggguuugagcaauauuucuuucccuuacaguguauauaaggaacauuuauuuggucaguucucaaacauauuaugccuacauuucuucugcuguuuuucuuugguucucuucuauucccuuaguuuaagaggaaaggggcugagauaaccagugucaagcccggguguccuaauagcugccccagguauggccccuuucccguacuccauguugccuuugggaguucacauggccucuaaccacacagugccuucuuaugaauaauguggaacaugaucauagcuuacauguuuuucaaagcaguccuccuggaauaacccaagaaacuguucacauugaugcaauugcacauaugcuaagugcauuuuaaaggcagaccugaauuuaucacuuuuugagaaauguauuaguccuuguucaauaggaaugauauaacuaggguaaaccgucauuauuuuauucagggugccuaaagcaguagaaguguguggagcuauugcagcucagcucuguucaugaguguuuuauguccaguucuaaauccuauucaucugacccuauugccccuuuuaauacugaagcugaagagagugauaguauauauuccaucacggaaauaaccacagagccuggaagauggggucaugacuuggagauuuuggguugaauucaggcuccaccauuuacuaugucaugguacauguuauugaaccucacuaagccucaggguucuuaguugagaaauggggaaauaauaaggauugugaagauuaaagaaaaccauauaguauguaagauaagcacucagcaagguagcaaagguacuaaacgguguguaacuauuaaccguuaguacugcaaguggcagugaaguguguuauaggaucauguuaucagucacaggaacucagagucaggauagauaaguguuuagcauuaauuuguaaggcagauuguauagaugaaacugguggucaauaguuauuuuuuuuuuaauggcugguauaaaaaugacuacuuugggagccacagaccaguccucaauaucuccuugaaaaucuacuaucauccaagccucauuuucacuuugccacuuguaggauuuugcaaagaagcaaauucuucuucuguccguuuucuuuuuucugugcccuuuaaauguguguuuaaaaucuagaccuuuugggaaaaucuuguuggcuuucuaaauuuuaaauuuaauuggcuuuugcaaucuacuuuuauucuuaaaucugauuagaaguaauuccuugcucaguaauuccucaguaguucugaacuacuuucuguggcuuuuguaagcaguuguaguugggguugaauuuguauucugggucauuuggauuugcacaaggacaguuaggaaaaugucagagaaauagaagcaguccuaguggaaaauaaauuauacaaacuguugggugcgauuaauggaaauuaauuuaauuucaauacugugguaucucccaaacauaaagguaagugagaggcagauacuuagaggucccuggaaucaagggugagauugguccuggacugaugucuaauuggcugagugaucuuacccucucugggucuuuaccuuucugaguuuccuauccuuauauggcauugguuaauggacuacagucucuuccagcuccaguguuauauuuccauuagaaauaaucucugccuuugauuagucuuguucuucuguguuguguugugcacauggccuuaugaacugcugcuuuuccuuauuucaggguuuugaaaacuuuacuguguuuuacaguuauauuuuggucauacccauauagugcauguaugauuagaucuuaauaauuuucuaaaaauagccuuaaagugacugaccucuuuugcuuagcgcuauucuaagcuauaguaccugugaaaucauggguuugauaggagaguuauauauuuuucuauacacauugaaaguauuauguaguuauuaaaaugaaguacuuagcccaccugcucucucagcuacucaggaggcuuaagugggaggauugcuugagccuaggaugaccagaaugaccacauuggacugaagcuuaagcuuuaagaccagcuugagcaacauagcaaaacacuugcucuaaaauauauauauauacacacacacacacacacacacacacacacacacauguauauauauguguguauauauacauauauguauguguauauauuauauauguauauauacauauauguguguauauauuauauguguguguauauauuauauauauguauauauacauauauguguguauauauuauauauauguauauauacauauauguguguguguauauauauauacacauaaaauauauugauuuuaaauaucugaaaauauuuuuaaaauuuauuaaaauauauguaaaauaaguuuucacaauggaaugugugcugcauuuugggaauuaucaguggguuuuugauuuauugcuucaaccauucccuaauaugucccuaauauuuuucauauguaccuacauggauauacuaguauuucugauugaucuauugaaacuagcuuggucgcaauaaauaauugaauccuguaaugcacagguagacucucaggauuauuauaggcuaaccauggaauccuggaaaagauacucccacagauuuggauuccauguguguaaaggaguggugguuauggugucaguggcagcaguggagggucugggagugacgaugcaguggcucauguagaagaugacaagugcuuuggccgggcaugguggcuaacgccuguaaucccagcucuuugggaggcugaggugggcggaucgcgaggucaagagaucgagaccauccuggccaacauggugaaaccccgucucuacuaaaaauacaaaaaaaauuagcugggcaugguggugcgugccuguagucccagcuacuugggaggcugaggcaggagaaucacuugaacccggaggcggagguugcagugagcugagaucuugccauugcacuccagccuggugacagaccgagacuccaccuaaaaaaaaggcaagaagaugacaaguacuuuuaaaauuauaauacaguuuaccagugugagguauaauuaguauuaucacgcaaacguguuguuuggagaaaggcacccuuuuccucuuugaccguggguauuagagcuguccuccuugcgugaggauggagaacugcugagaugcucauuggucaucuccucugugauguuuguuuaguauguggauggaaggggcagagugagugagacaucucgagcauccugcuaugcauuuagacugaaaauguguuggcuuugguuuuuauugccaggaauggucauggccacauuggaccgaagcuuaaggcucugacuuccuaaaugaucaaguauuucuccuuggcuugaguagaaauuugaaagaagaguuuauuuuccucugguaacuacauaaugacauuacugucaaagaggggacuauuuaagcuucagaaugaggaggagcauaaagcugaaauaaauguauguguguauauguacauacacgcacacaguccugcaccgcaaaacauuucaguuuuaguauauaugcugcugaggugagcacgagcagaaaacauuucaguuaauggcagaccucauauaugacaauggucccacaagauuauaaugcagcugaaaaauuccuaucaccuagugauuuguguuacaguugccuacaguauucaguaugguaacaugcuguuauagauuuguagacuaggcacaauaggcuauacuucauagccuaggugugcauagugggcuauaccaucuagguuugcgugacuacacuccaugguguucgcacaaugacaaaauugcguaaugaagcauuuuucagaguguauccucuuccuuaagugacacaugcuuguguguguacauauauguacauauaaaaauuacaguaaaacuaugaagguuuuauuacucagguuuuauaaucuaaguaccuaauuagaaaaugucgaacugggugauaucuuauggaaacucugcuguuuuucuuguaccuucuguaagugacauggaguaggggcuguuuguuuucucuuucaagugucacuuugaaacaucuguguuguuaguaagggacaguguuuuuuuuuaaaaaaaaagcauuugguguccuuaaauaacugcaauauaaaaagauuuuuuuucuugaugcucguuaacuuuugacgucacacucauuuugccauucgaagugguacagaaaccauauuccauugucuaaaaaaggaugaucugcgucuuuuguaggagaguaggacugucaccuuguaggccucucucuuuuuuuugccguuucuuaguuuagccaggcuuauucugcaaggcccugcucuaguucucuuuucuagcugaaugaccgucaacauugugcugauugguuuugagacagagucucgcucugucacccaggcuggagugcaauggugugaucuuggcucgcuucaaccucugccucauagguucaagcgauucuccugccucagccuucugaguagcugggauuacaggcaugcaccaccacacugggcuaauuuuuguauuuuuaguagagacagagucucaccauguuggccaggcuggucuugagcuccugaccucaaggaauccaccugccucggccucugaaagugcugggacuacaggugugagccacugugccuggccacugauugguuuuuaauauauaauugcaaguaaauacuuccuuuuauuaccaaacuagaucagguaacagaauuuucacuuuuccuggacuauaaaagauauucuuuggaaccuggggucuuucuggcccugaucaguuauuuauauuuuuguuuaguagggaugacacucucuaccuggagccacauuuugaccaagaacaccucauuuuucucuguaccauuacuagugaaauauuccccuccauuucaucuuauuaguucuccucuccuuauucuccacuaauuaacguguucugggaguaguuuccaucuuuggaaaaaacagcuuuaucuucauuuguaggaauaucaaaacacugugugcuuauaauaauuuugggguuggccacuguauuucuagcauuaggagagacugauguuugaauccuuuccuauuccucuuuuuauccuuguaguaacauuuguuguuuucucugcaacuucaaauguaaccuugcuuauugaggaaauguauaaaauaucuaaaagcacugagaagaaaaaaauuaugggcaaucugaccaccuaguggugauaaauguuuuuaauguuaugguuuuguuuuaaaucuugaauuuuaauguuaaugucauagcccacugacauucuaguauucuauuaggauaacucuauuucauauauaacuauucuuuaaagaaaauuguuauugcuugcuaauuuaaucuguuguauuuacuaaauucauuguucuuaaagaauaauguucaugaaaccuggaauucauauaaacugcuucccaagagcuccauguugcauguauauuauguuuaaaagguacugagagauuuuuaaaaauagauucuaguaauuaaaggcuauuuuuaucuuucaguuaauuuccucaggggaaauaaauuccagugaugcuaaaguugcucaaauauuguuagaguuguguuuaauuucaccguuauauauugucauugguccucagccuucaucccuucagagauuuguuuuuugcauaaucauuuguaaaaaaucauuuggcuacaaggcuggaauuugggguugucaagcggaguaauaauacuguuuugauuaagaacaagguauaaaaguaugaggauuuuucacccccugggagauuuauaauuugauucugaaagcaguuuaugaaaucaaguuccggaaacuuccacuucuuucacagacuagauaugcuggcuaaaaaaaccccaacuagacuccacauaaaauaauuuuguuacaauuuuuaggcucaccgaaagugacagaacuucccaagggagaggggagaaaauggaaggaacugagcgccaggagcagugagcugacaugaagcguguggaggugcuacagcugcugucagcagcagggcagcugagcgaucaggccucuugguaguaguggcaagauggggaagucaaaccugggccccucaccuucaccucuucaagagcgguaaauugguuccagggcuguugcugcccugguuacacacagucuuugaaggcaaguguccccuaccuaggcccucacguuucccccugauuugauaucauccagccuaagaucaccacacacaaaccauccugugugaaaaucagcagaaaucacacccaguugcuucagcuauuugaauuccuuggcgcaaaguauaaaauaacuguaugaaaucuuuaaagaaguagaaaauacaaucucaaauacguauaaguaauaaaaaugguuuuuaacaaaagaucauacaugaguuauuaaucaaugagaagacaugggggaaauguacaugcauauuacucaugaaggaagacaagcugaaaaggcuccauacucuauguuucccucuauaugauauucuggaaaacacaaagcuagggaaacagugaaaagagcagugaugaucaggggccagugcggagacagugaugaauuggcugagcguagaagauuuuuagggcacugaaaacacugugugauacuauaaugguggauguauguucgacauuuguuuaaacccauagaauguacaacuccaagagugagcccuaagguaaacuaaggacuuugggugauuauaaugugucaguguaaguccaucuaguguaacaaguguaccacucugguggaggaugcugauaguggaggaggcugugcauguguggaggaggaauuauaugggauaucucuguaucuuccucucaguuuugcugugaaccuaaaacgaugcuuaaaaaagucuuuauuuaaaaaaagagacuaugccgaauugagaaagaacuaaauagaacauguaaaauugaaaaauguguuugcuugaauuuaaaaacauguccuuuuucuggacuagaauucaaucuaggauuacauguuauauuuuucacguguccaucuccuuuauuaaauugggauaguuacucagucuuccuuuguuuauuaugacuuugauguauuugaaagguacuggccauauauuguuacucagucuuucuuuaucaugacuuugauauguuugaaagguacuggccauauauuuugugucauguuucucaacuugacaugauuuuguauuuucucauggugaaauucauauucuacauuuuugacaaaaaugccauggagauuuuguugugcccuuagugaguucuaucaugaagaacgugguggugauauguuaacucugaucacucgguaaauguggcauccauuaggauucuccgccauuauuauuuuccccuuuguaguuaauaguguuugcaggaagauacuuugagacuguguaaauaguucucauaauauuuugcccuauuaacuuuggauucccuugauaauuuuugccagaaauuauugugguguuugucaaaugguuauuuucuuucuaauuuauucuaaagguauuaauuagaauuuuacuguaaggaagaccuuuaccuucucucccauauauuuauuuaauuauuuauaucaguauggcuucaugaauauuugguuauuguauggguuauaaccuauuacuaaaaugauuuauuuuauugcugaaauuuacccagguuuggucuuugggagccccuuaaguaguuuucuguguccucugacauguuaucauuuuuuguccccaugagauaucccagauucaucuuuuacuuucuccaccccagcccuggaaucagucauuucuuuaagaaacucuguuccuuuuuuauuaaagaaugguauuuagaagccuagaccugaguauacuuauugcccuagggauaucauuacuuguaggcccccucuagugacagagcuaggaaauacauauaccuacuucuauuuccguauugauguaucugcauauauguuacaaaauaugaauucauaugaguaccuccaaucuaagccaacaccacauggcucauucuagcccuccccauugccuuugauagugacagugagaaaccugguucuucuuacucaugacauauuuauuuucuuguucaguccuggaaugaacauaaagguaguuucauaauuguuaacacauaccucuguggaaaaaauuugcuaacuaguguacaauauuugcuauguuuauuuuguuuuucaucuuauuuaguuaaaauacuguuuuugaaaguuauuuugguuaauucuuuucuucuccacucucuuuaaguggcugucauuuauuuagaauaaacuucuguccaucauuacuguuuguauuccauuuguguucuucccaccucuggguagauuuuauauuauuuuauuauuauuauuauuauuauuauuauuauuauuauuauuauuauuaucaucaucaucaucaucgagacggagucuccuuuuguugcccaggcuagaguacaguggcaugauguaggcgcacugcaauuccugccucccggguucaagugauucucuugucucagccucccaaguagcugggaucacagacgugugccaccacgccuggcuaauuuuuguauuuuuugguagagaugguguuucaccauguuggccaggcuggucuugaacuccugaccucaagugauccuccugccuuggccucccaaagugcugggauugcaggugucaggauuuuauuuuuaauguuuugcguagauaaaguauuaacguccuucuaaaacucagaacuauacaacaagguuuacuuagaggucaugacccccacucugccauucauuauacucuauucccauucaaccauuuuuuccauccuguuuccaccaccucuguguaggugauuuauuuuuguuauuucuagccuauccuuccuuuuuuucacaaaugagaugauucauguguauuuuauuauuucuuacaugaaagguagcaaguaauauaugcccucuugcacuuugccuuuuuuauuuaucaggaugucuugaaaaucauuccauaucaguccagagagaucuuccucguucuuuauuacaccugcaaaaguacucuauuguauagguagaccauaguuuauuuaacaucuuuccaaugugagacuuuuuaaaaaaauauggugcaguuacaaacaauacuacaaugaaaauuuugugcauguguauuaauguuggaaguauauuuucaggguaaguaguuagaaauggaaggacugggucaagagaucaacaaauauguaguuuuguuggguguugucaaauucaucuccaaaaggguucuaccaguuuccauuuucaccagcaaaguaugacuguacuuauuuuccaaagccucagcguauucaaaagaauauguugucugacuuuuaacuuuuugccauugugauagaaguauuaugucaguguuauuuuaauuugcuuaauuugcucuuuaaguuugaauuccuuuucauguguucaggggucauuuucauaucuuuuuuuugaugaauugucuguucuuuuucuauggaguuuuuggcccuuugucaacuuuuaaaaguuucuuuacguuagugguauuaccucuuugugguguauguuuccugacuuuuguuccccuucuuuuuuugucaguuuucagguggaaagaccuuuauguguguguguguuuguauguuguuaaugggaaugauuuuuaguuuuauuguauuuuaaucagagaguauaguuuauuauuucuucuuuauggaauauacuuauuucuuugugacuuacuaugugaucaauuuuuguuaauauucucugggcccuugaaaauaaaauguauuuuucauuaugaagggaguaaguuuaauauguguguauguguguguguguguguaaaauauacguauacauauuuauguauacacacaugauuucauuuccuaauuauguuuuuaggucuuuuaucuuauuaauuuugcacauuugaucuuauacuaagaaugauguauuaaaguuuccuauuaucauuaauauuaauguguuucuaugugugucuuuugcguccccuaugguucuuucuacacagagguaauaauugucuuauugauauauagauauucauaaguguuauaccuucacugugauuugaaacuuuuagcauuaauacaagaucuucuuugucuugcucgguguuuuuuugcuugaauucuacuuuuucugauuuuaagaaugcuaugcuugcuuuuuuauuguauccauuugccuguuauauucuguccauccauuuguuuuuaacauuguuuuagguguaucuuuuguauaguugagucaugcuuuguggccagauuuauuuuuuuaagaggugaauuaagccuguucauauuuauugauauuacuuucacauuuauugaguuauugauauauucgaucugaacuuuaucauaauauauugugguguuauauaugucauaacauguuacauuuuauuucucuacaauauauguuuuauuaugcuuuugaauugaaauuuugguugcucuuuagaaagguuauauuuuuguuuuaaugguugcuuuuauacuuaaaacuuuuaaagucccuuaucccucauuuuuaacuuuguucuuaguaaaaguauucuuuaacuauugccuaugcaauaaucaguauauucuacuuuccucuuugcugcuuucuuccauuguuuaguuacguuauuucuacuuugucagaacauauaacaauuggauauuagucuuucaauguaauccccagcuuuuagucugaaaucuguaauuuuuauguauuaacauguucuccauuuguuuugugcugaaauuuuccuaguuauuuauuacuugaacaaggcucaugcuuugguaaauucuucagaaagagcucauuaaugugacauuccuaugcucuuguguguuucacguuuuuucuguagacuuggugcuuuaaggacagcauugauggauauaaacuucuugacccacauuuuuaaaaacugaguuguuugaaaauguggcuucauuguugucuuguuuccguguuguuuuugaagaaucugaugccacucugauugcuuuacuccucuacauuaguugaucuuuuugccuagaggccuugacgauuuuccccauuauuuaugaaaucuguuuuauaagaauauguccuauauuugauuuuuccagguucuuuuucacagguacccauuuuaucugguauuaguucugcuccauuguuuuuuuuucccucuuuaacggacuccaauuauauaaauguaauuccuucuuugccuguguuccauuucuaccacuuucuuucugauucuucuuucuuuauuuuaccauccuccuucugguuguuuuucuccuuuucuucaaugcccccucauuaaaucuugauugauuccauugucccuugcaugcuuuggaauuuagauuuuguuucugagaugauuuuauuucuuuuuuuuuucugaguuaaaucaauucucuuuucauuuuuucucuauuuuuguucuuaauuuuugaguuucugacuaaagcaauuuauauccuuaaaugcuugauugagcauauguaacuuaguuuuuaaguauuaguuuguguuucuuuuuagugcuccuuaguuuuggggggugggugggagaaaaguuggauuuucauuaguugagcucuuuugaauugacuuucugauuuuugaguaauaauuuucuauauuuuuauugaauuuauuugucguuccuuuuugguuguguaaaagacuuccuuagucucuggugcccucuucuguuaguguagcaaugcacacuuuagugguuuauuuauuuauuuuugguguggguuagagaaugguuuuguaaauccucuaauuuuuuagcugugcuuuaucuuucacaaccuugaauuuucucauuugcaucuuuuuucucuuccuacucaauugaaaagguugucuuucgcuuuguauuaacuccuuuuucuuuuauuguaacuaugguuuugggauccucucacuucaaauugggcaugcuuuuacaccacuuuucuguggucccugcucaggccuacuaggacacuuuuuaaaggcuuuucacacuuaguguaacuuacacuuucuggguuucuaaggucaaccuuagcaccucacucauucuccucucuuucucuuauuuuuuccagcuugcucuugcuuacuucaaagccuuaucagugggguaggaguauaacaguucugucccuagguuuugacuggcauuccuuccugccugccugccugccugccaaaggcauuguguucaauaguuuuauuuguucuuguugcucuaaauuauuuuuagaggaagcauugacagccgucauugucuuuaguccucauaagaauaauuugaggccuaggauauuagaauauuucucugaaaacgguuuugucucauuuugcuggccaguuagaggaaguaugucugggauugccuuagaucaucuucguagccugaagcucucucuauuguucagaaaaugugauaccugacugcaagucuacacaaggacugguuuacuuuugugcucauccucaucagggggaugagucuuuuagggacucaaacaccccagcuugguuccacagcaaagcuuucccuuuugucucacuuccaugguaagcuguuacaacccauguucagguuuucaguugauagguuagauaggcagauacucucaaugcuucucucuggcuuugugcuuacuuuauuuuuuauuuuuauuuuuuaauuuuuuaccccuggcuucaugcuuccuguagaguucagucacuccucucuaucucgguuuuacuucuucaaugcuguuaagaauuucuguauuuuuuucaguagcauuuaucaggaaguuugguucuaauuaucaaaaccaacauuacuagaaauggcagcugacucauucuuuuauuaaaacauuuuuuauguuugauuaugggacuuugggugggaagaaugauacauucauuugcucaguuaucccuuuugagccaaucuucuaccaaguaaagaccugcugugucacugaccagaaaguuacuuuauuucagugguaaagcagcuuaugacuaaugauagcugugguuaauaaucaugaagacaauaaugaggaaaacuuauuuagccauuggaaugugccagauacucuguauuuuuuauauauuauuuuguuuguaauaaaaucuacuaauuuacuauuauuauucccacuuuauagaugauucccugaggcuuagcuacuguaucacuugccuaaguuuacacagauaguaagcggcagaaacauguuugaggcucugccuugagccuuggagauacaggacuagcaaauuccagcuugcuuccuaccuucauggaccuuacaggauuuaauuccucgacacugugggauggucagggauguaauuuuagaauaugaaagcgauucacuaguauuuccacuagaauugaggauaaugucucuuguugggaacugacuauaaguucaugcaaaucaaaaacagauuagcaaagaucagaagagugucuuaauucucuaaaaaccccccauaccauguagcguaguguuuucuucagaguuguacuaagugaauguuaauuucauuacguuuauugacaggacauaaugagucuuauucccacauuauaacuuuuuagagucaaaagauucuuagcagaauuuuaaaguuaucugauauagaugggccaggauauuuucuuuauuuauacuuuccuguugguuuacaguuauuugcugguauaaaggauggagaaagccugcagcucuuugaacaaaguucucgcucugcgcauaaacaagagacacacaccauggaggccgugaagcuuguagaguuugaucuuaagcaaacgcuuaccaggcucauggcacaucuuuuuggagaugguaagugcucaaacacagguugacgaucucuuaucugaaauacuugggacagaaguguuuuggauuuggguuuuuuuuuuuuuuuucauauuuugaaauucuuuuuuuuuuuccccgagacggagucuugcucugucacccaggcuggaguauaguggugcgaucucggcucacugcaaccuccaccucccggguucaaggaauucuccugccucagccucugaguagcugggauuauaggcgcccaucaccacacuuggcuaauuuuuauauuuuuaguagagacaggguuuuaccauguuggccaagcuauucucaaaccccuggccucgugauccgcccaccucggccucccaaaguguugggauuacaggcaugagccaccgcgccaggccugaaauucuugcauauacauaaugagaugucuuggggaugggagccaagucuaaacacgaaauucauuuguauuucauauacacuuuacgcacauagucugaagguaauuugauauaauauuuuaaauaauuucgugcgugaaacaaaguuuugacugcgauuugacugaaaaucuuaaugaguucagguacgaaauguuucacuuguggcugcagauuggcacucagaaacuuuuagcuagagaaagaaaaaugauuauaacguuugcuaagaaugauaauggauuaggucagucucaucaauggagugaaaauauacaggcugauuuggaguauauuauuauguuaucauuacaugaggacgugaucaguggagcaagguucuuuuuuuuuuuuuuuuuuuuuuuuugagacggagucucgcucugucucccaggcuggggugcagugcaguggggugaucucagcucacugcaagcucugccuccuggguucacgccauucuccugccucagccuccugaguagcugggaugacaggcgcccaccaccacgccugguuaauuuuuuguauuuuuaguagagacaggguuucaccguguuugccaagauggucucgaucuccugaccuugugauucacccgccucggccucccaaagugcugggauuacaggcgugauccacggcgcccggcccaguggagcaagguucuuaaccaugugaaugaaccaguggaaaacuuuacguauugccauacugauuaccacuaucaacaggaguauauuaacaguauauuauaucaacagcaaaaacauuaacaguauauuucgugcaggaggaacaauaguguugcaaucuagaccucacuuagucacuugccuuuauuuuucaaaaaauauuuguuuucaguaaugccaccuucccccuccagcuauuuuuaacuuaauugagauauauuuuguuuuuuuaaaucacgauauaaagagaagguuaguggauuuuccuaauugugacuaucuuuaagaaauacuuacauuucuuaucugagaagacagaugaccuacugugguuaggauucuccuuuacucucuuauucuugugagcuuuuguaaaagucaguguuguugagguguaauuaacauaaaguaagcuacacauaucuaaaguguacauuuugaucaguugacauacaaugaacugcacacgaacauacucgcacagucuuacaaguuuugacgucuugcaaguucaugccaugaagcuaccagcagaaucaauacaugaacaucuucauuguccccaggaguuuccuccugcucacuggcaauccuucccuucugcccuuaccacaucucaccccgggcaacaugugaucugcuuucuggugccauuaaucaguuugcauuuuuuagguuuauauaaauggaaucuuagaauaugugcucuuuuuugucuggcuuguuuuacuuaaaauaauuauuuugaaauucauccauaucauaguguauaugaguaguugauuccuuuuguuaaucaguaucccauuccacgauuuguuuauccauacauucauugauagguaucuggguaguuuccaguuuuuugcuauuaucaguaaagcgucuaugaacauucauggaucagucuuucugggucguacguuuucacuccucauaaacauagguauauguuuaacuuaaaaaaaaaaacugcuaagcuauuaucugaaggguugcaccaucucgauucccaacaguagucugaaaaugccaguugcuguacaucuucagcaacacuugauaggguuagucauuuuaauuguagccauucuaacaggaguccagugguaugucaaauacacauuuggcauuuauaaaggacuucuccauauaaacaaacagaaauugcaacuuaagagaaaaaugggugaacaugaagguggcaaauuauauauauauauauauauauauaaugaccaauaaauauaugaaaagaugcuugucuuuauuaguaaucagggaaaaacaaaaccacaaagagcuuuuucaaaugggaaauaauuuuuuaaaucuaacauuuuaaaucguugacaaagguguagagaaauagaguauagcacaaaguucuggccuuacgcaggauucauggucaccguucuuccagcugggacuucaguacucacuguucuugauucaccucuauuuuuucauacuccagauuuccccuacuuaugccugaacucaaauauguauuuaaagagaaucuuguuguaauuuauuaagccucuccugcucuguuuuagcaagguuuuuuagaauaucuugacugccauauugccaaacgcauaguucauguaauauauaagaaaccacuagcuaaucuucuguauuuuuaauauaaauacauuuucaaaaagugcacaucaacuucaggauaauguuuuucuaggaagugggaaaugguauuagggagggguggaaaccauguuucaaauggauuuauaauguuuuuuuuuuuaaacuaaaguuaaauaugacaaaauguuaugguuugauaaaacugaauaaugaguauaugggugguugcuauuuucucuuccugucucuagguuugauauauuucauuaaaauggcguaauauaauagugaaauagguuucaaauagaaauugcugaugugaaaaaccuaugauagccagcaucucuuugcuuucaugauaaaagaaaggaauugugauauuuuaaacauuuauaucaucuguuuaacacaaaugcagggagauggauugagcuguucaggccauuuuagaggcagggugagguagaagggauucuaguauuuuaaggagguagcauugugucuuaacagaaagauucaggcucaucugaauuuuuccauugccaaacuauggagagaauuuuuuuuagcauccuccuuauuuaugucauccuacauauuucuauaaucaaaugauuugcuguuuggugagguuuagaagcuggauuugcacccuguugcaggcaucacaauauugaauaagcuagccauacucccugucuucaaagagccauggagccuuggaucuugagcucucuccuugggaaacauaggauguucuccgagcacacaggcaaggcgccuccuccugagcccagccugugcuccuggaaggcuccugcugaggcacaugcacgcugacaccugguaagugggaauuagccuugggaaaggauaagcaaggugggggggcagaagaauggggugaaaaaugacaaagcaggugacacaaguacuuguggagagcaagcaugaugcagcacaguccacggaaagaaggaaagaagaggcaaggggaagaaaaaugauugacaguagacucuuaugaccauggagaaacgguaguguagaaucagaaaacuuaaaaugaagcuccuguucauccccuuacucugaaguccugaacaggucacguagcauuucaggucucaguuuucuaacuuuuaaaaguugugaugauacuugcuucacucaagaauaaaacaagauaacgugaaagaugccuuguaaguaaaaaauaucagauaaauauguaaauaugaacaaacggaagaaggaaggaaggaaaggaaaguuaagacaagacaauaaaagcagggagcacaugacgaaagaguaauacgaucaaagagcaacggucauggcugauucgccuuuaucaugucugagggaacaagaaggagcuguguaccagacuguggcaccguagccuuauuggugcugaugguggcuuucauaucugcaccaggagauauuuuaaaaaguaagccaugugcuggccucuguauagauuauauaagcuguccaagguguuucaggauauauaucucucugaaaauaugguccuagacuuuccuuuguguuauuuuuuauauuuguauuugcguagcuuucaaaugcagaugucagguuuccuuacaaaaaacaauuuaugcaauauaugacuuuucugacugugaugccuguccugacauggugggcaugauccuggccaagaauuaagaaucuuaaauuugggccaggcgcgguggcucacaccuguaauaccagcacuuggggaggccgaguuggguagaucaugaggucaggagaucaagaccuccugucuaacauggugaaacccccaucucuacuaaaaauacaaaaaaauuagcugggcgugguggcacacgccuguagucccggcuacucaggaggcugaggcaggagaaucgcuugaaccugagaggcggagguugcagugagccaagauugcaccaccguacuccagccugggcaacagagcgagacugacucaaaaaaaaaaagaaacuuaaauuuuagaauagcagugaacuuguagcuucuuucauuucggcauauguugcuuuauuguuuuaaaaauauugucagccuagacuuuugguagucagcuuuuauuacagaucgauguugcuauuuuauaaauguucaaauucacuuuuugucuguaagacugagcuggcagaauuauggaauggaauuaaaguuuaaaaauccaccugcuuggauaauacauguugguucacacgcaucagaaucuaucugggaagaaagccuuuucuuuuucuucuuuccuuugagccauggucauuuuuaaccccauccacacaguggccaggcauccugaaacugcugaaaggugccucauucacacacccuugccaugcccugguguguuucugccgguuguguugccacgagcuguuguuguagaggugugugagcuuguccccgaccguguuugccguguuugugacguccgcuguauugccucucaggggagaugugaagugaagugggaaggugacuggaaccugggcccaucugaugaacuagaagagugagagggucuguaucacagaacacagacagugcugugugcuuccuucaugcucacacugaauguuaacaaugcuuucaggauucucagcuguuucuucugaacucugaagaaaagugcuuuguucguuuuuguguuuuuuuguuuuuuuuuuuuuugagauggagucucacucugucauccaagcuaaagugcaguggugugaucucaguucacugcaaacucugccuccuggguucccgcgauucucaugccucagccucccacguagcugggauuacaggcgugcgccaccacaccuggcuacuuuuuuguauuuuguauuuuuaguagagacgggguuucaccauguuguccacacuggucucgaacuccugaccucaggugauucacccacuuuggacacccaaagugcugggauuacaggcgugagccacugcaccuggccgcguuguucuauuucaggcauuucagaagcacuaauuaguuauggguuuuggguucuugcuguugguugguuuauuaauuaaguaauuuugcuagcuucugaaaaaugucuugguaaaccuaucuaggugccaucaaccuggauuaaauuuacauuaauaauagcaauaauaaugguaauaauggugacgauagagauaauaguuaacagugugaaacccugugcuaagcacguugacaaggaguuuuuucuuuugacgugcaucuaugauauggguguuacaaucucuguuuuucagauguuguauugagaguaaaaauuagguuuauaauuaauuguuagugcuacauucuucuuaaauggaaucacaucaaaaauuuuaaguguguaucacuuuaaaaauuuuuaaaccaucucuaugauauggguguuacaaucuccguuuuucagaugcaggaaccuagacacagagaaaaagugccauguaaaaaucacagggcugguaaguauuugaggcaguucgagcccacaggcugacuucuaaggccauaccagaaguuagcuuuuggauaggauacaaagaaaucuuauuaguaauauuucagagacugugaggccuauaaaagccaugaugucccccuggccaaacaacaacaacaacaaaaaucagggccaggcccaauggcucacgccuguagucccagcuacuuaggaggcugaggcaggaggauugcuuaagcccaggaguccaaggcugcagugagauaugaucaugccccugcacuccagccuggccaacagacugagauccugucucuuuaaaacaaaacaaaacaaaacaaaacaaaaaaucgucuucucucuaggugcugccucugauucugccucugauucuuuccuuuaccuucucuucccauucagugccuccugguagcuagcuugugguaaagccuccauuuacuacaucauauccaauuacauucuggguagcaaagaccauuuaaaaacuuaagguucacucuuucuauaauuagugaugaaugggaacugccucuacaggccucagaaauauugagcaacucuuuuuauauuuguuuuuaugguccaggcuuuucaccuuuuauuauuauuauuggauuccuuuguucuugaaaagcaaaauuaaaaauuagaacacacuauuuccuuguggcaguauguuauuacagcugcuuuaguuucagguuuuuuuccuguccaaaugugguuuauuauuuucugcuaacauuucaauuguaccagcauccuaaggcuauuauaagaaagguuaucauuuuagaauuagaaagaaauaaaauaacucuuuagacuauuuuuaugcuuguggauuuuguugucauuuuuaauauuucucgaguguuuucuguauauuuuguacugugcuuaguagaucauuucuuucagaguaaccaagguggggauuuaggauuucuaacuuuuaaauuucucuuucuguccuugaguuuccagccuuucuuuggcacaguuucuuugcuaaacauuggcauuucccuuucuaaaggauuggccuuguagcacaguuuagauuaauuagugugaaggagagauggauugggacccuugggggagucaugucuugucuuugcuuguuaaaagaccugugguggucauugaaaugcaccucccagcaugcccuccgaggguccaggcugaugggauugccgaucgccugcagcugucagcuucuuggggaauugccucagcugcagggagccuccuugcccaaagacaugcccuuccuggggcagcccacauccgaagacugaauguggcaagaauacaaaggcccuccaugggccauucugaugggcugucugcuccagaccucuggcaagguaaaggcuucauuggccugacuguaguucguugacuucucccucugcccaguuugcugccacugucuucauccacacguguugauucccuucagauaacgugcuugccagcccaaccugcauagggaccuauacauggucccauccagcagaaacauucuagggcccuguguugugagugauguccuggucaggagugaaaucacuugaucauguguaauaaggaaucacgucuuccauaccuuuucauauuuuuuuauccaugaggcucuauuaguauaaaugaagugaaagggaucaagaguaagaauuagauuuauaauuaauuguuagugcuacauucuuccuaaauggaaucacaucaaaaauuguaaguguguaucacuuuauuaauuuuuaaaucagcucuuuugggcuggcugcuguugccuggcuuggggaguguuauccuucucagaguacuccuagacagcgaaguagccaaggcaguuguugcauucaagcaauuuugacuugucuguacucgccucgccguagcuuagauguagucuagagcagguugcucuuuccgauaaaaacgggccaacaccuucaaccucugagacuugggaucauuaacugugaaaagugaagugccucgcuuuaagccaguggagggacucaguggaaauaagacaccacccuaggaaucagguggagagaggccuaagacacacuuuuccuuagaugucuagugaagugggaaaauauauacuaggguugaucuguuggggcuaaggaauugguacaagggaaccucuuuagagaaagguugagauagcaauaguugagcugaacuauaauacuuuuaaggagcccagaaaccuuccugauucuauggcaguugggcagaggauaacagagagguucacuaaucuagggaaauaauaaauugaaauuguuugggguuuuauguuaauuaaaauaaaauuauuggaucuuaagguacagagaaaaaggcacugaaaauuuuagggcugcuguaaugaaaaccaucagugugccuggaacuacacccauugcaaacuauuuuuacugguacuaauaacucucaggugguugguauacaggugaccuagaaaccauuaagauuuagggagagagggaagauucuccuucuacucuuuagguucauagaaagcucaauuuccugauugauuucagccacuucucuucuggccugucuucuagcucuacuaaggaauugaucaucagcauaaaguuaguuaucagaacucuguuaucaaccacuuuaacuccuucacuccuuugacuugcacuggacacuugaugaaaaccuagccuugaauaugugcccaaaucucuuuaugcuucccccuccuguagcagcucagauuugccaccuuagccaggucaagguugguggcucucuucuuucuuauuuuggucagcucacuguacaaaucccuuuuuuucuguuauuccacaccauuuuuucagucuccauuuuucuauucuuugucagaggauaagcuguauuuuacugagaaaaucuaggugacuggcuguggauuuugugcuuaguuggacugcugauuaccagcccaucgguuucucuagaauuuuguuucaucagcuuuaaauauacccuaaaugaugucaucucacaauaaaacaaacaacuaccauuauuugaugauccaucuuucucuggaaacuuacuguccuuuucagcuacaguuuaugaaauauaccuuccaauugcugcccgacagaggcagcagugguuaguucauucuaaugguuucuguugaggucacgauugauuuccaaauuauaaaauucaacagauuggggaaaacacuuauuaugcugaaucuuucugcuuacucuuuuguuuauugaauuauaaugggcuuccaauaaacuaaaguguacaauuugauaacuuuugacauaauuauacacacacuaaaccaucaccacaaucaagauauacucaucaccccaaaacguuuccuugugcuccuucaccgucccucuaccaccucuucugcccacucucccuacccaccaggccuagguaacuagugaucugcuuucuguuacuauagguugguuaccauuuucuagauuuauguucaaggaaauccuauuguauguauucucuggcuucuuucacucagcauaauuauuuugagauucaugcauuuuguagcguguuaucaauacuucauuccuuuuuguuacuaaguaggguauuacauuguauugauauuccacaauauguguauucauccaccuauuguuggcuauuuggguuguuuccagguuuuggcuauugcaaaugaagcuucuauaaauauuuguggacaagucuuuauauggacaucgcuuuuuuuuuucuugaguaaauagcuacaaauggaauggcugcaugguagguauaugacuguuuuuuuuuuuuuuuuuuuuuugagacagagucucacucugucacccaggcuugagugcagcaucgcgaucucggcucacugcaaccuccgucuccuggguucaagcaauucucugccucagccccgcgaguagcugagauuacaggcacccgccaccaugccuggguaauuuuuuuuuguauuuuuaguagagaccggguuucaccaacuuggccaggcuggucuugaacuccugaccucaugaugcaccugccuuggccucccaaaaugcugggauuacaggcgugagccaccgcacccggccaugacuaacuuuuaaagaaacugucgaacuguucaacugcuuguaccauguuacauuuccacuagcagugccuaggaguggaaguugcuccucauuuuugcuagcacuuguuauagucauuguaauuuuagccauucugauaggaguguagugguaucugauuaugauuuuaauuuguauuuucuuuucuuuucuuuuuuuuuuuuuuuuuuuuuugagacagagucuugcucugucgccaaggcuggagugcaguggugugaucucagcucacugcaaccuccaccuccuggguucaagcaguucucucccaccucagccucccaaguagcugggauuacaggugcacgccaccacgccuagguaauuuuuguauuuuuaguagagacagaguuucgcuauguuagcuaggcuggccuggaacuccugaccucaggugauucacccaccucggccucccaaaguguugggauuacaggcgugagccaccgcucccugccuaauuuguguuuucuuaguugauaaugaugcugaauauuauguacuuauuugcauucauauaacuauuuggcaaaguauucaaauauuuugcccauuuguuuucuuucuuuuuuuuggucuugcucuuuugcccaggcuggagugaaguggcaugaucucagcucacugcauccuugaccucccaggucaagcgaugcgcccacuucagccucccaaguaauggggauuacaggugcucaucacaaugccaguuaauuuuguuuauauuuuguagagauggggucucacuauauuguccaggcuggucuugaacuccugggcucaagcagucugcccacauuggccucccaaagugcugggauuacaggugugagcuauugcgccuggcccuauuaucuuuuuauugauuuuugaaacugugaauuuuggauaugauucuuuugugggaugugggauuugcaauauuuucacucagucuuuucauuaguguuguuccucaaaaggcagaaguucuuuaacuuugaugaaacccaguuaaccaauuuuuuucuuuuauggauuaugcuuuugauauuguuucucggacaucuuuccuaacccaaggucacaaagauuuuucuacuauguuuucuuguagaaguuuuauaguuuucaguuuuauauuuagauuugugauuccuuugaagaauuuuauggaugaucugagguacggauugaaauuuuguuuuccauauugauauccaguuguuccagcaucguuuguugaaaugaccuuuccuucugcacugcaaagucuucguaccauugucuggaaucaauuaaccauguaugucuggggcuauuucuggacucucuauucuguuccaugcaucuguuauuugucuaucuugacacaauacuucacugucuuuaucacaguagcuuuauaaugccuuaaaaucgguuaaauucuuguaacuuuguucuuuuuucaaaguuauuuuaauuagauuguuuacauuugauguuauuauugauguuguuggauugaaaugaucauuuugcuauuugcuuucuaugaguaacauuuuuuuucuuuguucucuuacuuuguuuggauuaauuguauuuuuuauuauuccauuuuauuuccuuugucuuaugagggguaacuuuuuguuuuguuauuguagcaguugcuuuaggauuuacaguuaucacagucucacuucacuuugagugcuguuaccccacuucuguauagcguaagaacagcagacuucccuguuucccaucuuggccuuugugccgucacauauuuuaauucuuauguauacuaucaacuccuaaauacguuaugauuguuuuugcuuugaauaguugaucagcuuuuaaagauauuuaaauaguaagaaaagucuuuauaucuccuagguccuuaccaucuucagugcucuucaucuggguucccaacugauauuuuccuucugcacagcagaaggucugcuucugcuagugaugaauucuuuugcauuuguauguccauaaagcuuuuauuuugccuuuauuuuugagauauuuucacugggaaaagaauucuagauuaauaguuuuuuuuaccucuguguauuuauuuuugagauagggucuugcucugucacuuaggcuggagugcaauggcgugaucauggcccacugcagccuccaaguccugggcucaaaggauccuuuuacuucagccuccugaggagcugggacuacaggugugcaccaccacaccccgcuaacuuuuaaaauaaaaaaaaaauuguagagagauggggugucaccauguugcccaggcuggucuugaacuccuggccucaagugauucuccuuccucggccucccagacugcugggauuacagguaugagccacugugcccuggcccuuuuaguuuuuuagaggugauauuccuagaucucuucucacuugcccuguuuccugugagaaaucugcucuuaacuuugcuuuugucuuuguuuuucuguacauaaugugucucuucucucugagucguuuugcaauguuuucuuugucacugguuuuaagcaguuugauuaugauguacauagauacaguuuucuucagauuucuuauguuuggaauugguugagcuucuuggauuuauauuuuucgugaaaucuggaaaauuguggucaauuauuucuucagauacuuucuguuacucuccuccuuuagguacuccacuugcauguguauguggccacuuaaaacuuuuccacuacuggugcucuguucauuuuucuuucagugauuuuuuuuuccuucuauauugcauuuuggauaauuucuauugcuuuaucuucaaguuuaccaauauuucuucuacagugucuaauuuucuguuaacuccuuccuguguauuuuucaucucauucauuugcuucaguuuggaucuuuuuaauaucaucccuguuucuacuuaacguguuuagucuuucuucuagcuuuuugaacauaacgaauauauaauacauauuuuaacacauuuuuuccuacuaauucugacaucugucauuccuuggugaauugcuuuugauucuucuguacuuuguauuauguauuuuguuucuauuuugcaugccugguaauuuacuauaggauauugccaaacauuguuaauuuuaccuucugaugcauuggauauuuuuuaccuuccuaauauccgcgagcuuuauucugggauuacuuagaaacacuuugauccauuuaggucuucuuuuuaagccuuacuaggcaggaccaguauagaguuucgucuggggauaguuuugcccacuaccuaugcgagaccugucuuagcucuguaaccgauaacccgugaauuaugagguuuuccccuuggcuguugagaacuggcacuauuccugguccugugugagcuccaacuuuauucccucuaauccuuuugugugguuuguucccugaccucagguagauuuuucaacacacaugaucaguguucaguugaaugcugaagggguucuucugcagaucuccagaguucuucgcgcagcucucuucucuccuuuacucugcccugagaauucuagcuauccugacuuguccagacucccggcucugucuccucaaaucaaggagacuuuugggcucucccauguucuccuuaggucucaccccucuggggggucuguguccuuggucaccugguguccucuguuuugaguggugugauuuuauauauuugucuuuuuauuauuauuauuauuauuauuaguuuuucauauggaaggguaaaacugguuuauuauuccauccuguccagauguggaaguuucucuuuuucauuugaaucguuuggcuacuccuucuggaccuuccuuccugcaauuuucuauuacaucucauuccccucuucgccuucauuauauucuuacaucucucucaucacuuacucucugugucuuuuuuggucuucuuuucugaugcagcuuaauguuugugacaggaacucuuugaaaggguggcugguguuuuccuucucagagaagaauuugacugggagauggauacaauccuaaagaugcauuuuuagaucuguuuuacaaaaccagaauuuuuaugaauuuuauuuucuagaacacaucagugaauugugcuuucauguaucucuuaagauaucuaaaacacacuuauuuuaaagucucagauuguuucauaaaaauaaucucaacugagguaaguuaauguuugauuauuuguucugcuggcuguauuacuuagcauuagauuuguccauauguuuuagaauuuuggguugcagggucauauucagaggaagguuuuuuuguucuuuaccguuucucuguuuucuucguuccuguccuucucccccaucccccgucucuuacuauucacccuauaaguggauuugcaggugauuccacccaauucucuaggcuugaaauccagagugagauuucccagggauccaucagaugucuagcacccauacaaugaggggauggagcugauccuaggccuauggcuuggaucccuaaucuuaaagcuccuuagaucuacagccccaugcugcauuugggugacaguauuugacuuccuucuggcaccgucauggagcuuaucccaucccagccucugacuugaagcuuuuugccucccuccugccccaagcccacagugugccauccugcaggaggcaggcuccugguucuucuugguuguggaccccaagcccagcaggcucacuuuauccucucuuccuguuuugcuucuggccuguggagguuuacauuuuguauuaguccauuuucacauugcugauaaagacauacccgagacuggaaagaaaaacagguuuaauggaguuacaguuccaccuggcuggggaggccuuacaaucguggcagaaggcgaaagacacgucucacaaggcagcaggcaagaaaagagagcuugugcagggaaacucccauuuuuaaaaccaucaacucuugugagacuuauucacugcaacaagaacagcaugagaaagaccuacccccaugauucaauuacuucccacugugccccucccacaacacaugggaauucaagaugagauuuggguggggacacagccaaaccauaucauuccaucccuggccccucccaaaucucauguccucacauuucaaaaccaaucaugccuucucaacagugccccaaagucuuaacucauuucaguguuaacucaaaaguucacagucucaaaucucaucugagacagggcaagucauuuuugucuaugacccuguaaaauccaaagcaaguuaguuacuuccuagauacaauggggguacuggcauuggguaaauacagccuuuccaaaugggagaaauuggccaaaacaaaggagcuaccaggccccaugcaagugugaaauccaguggggcaguaaaaucuuaaagcuccagaaugaucuccuucaacgccaugucucacauacagguccugcugaugcaagagguauguucccaugguuuugggcagcucugccccuguggcuuugcaggguacagccuccuuccaagcugcuuccauaggcugguguugagugucugcggcuuuucuaggugccuggugcaagcuguugacuuccuucuggcaccgucauggagcuuaucccaucccagacucugacuugaagcuuuuugccucccuccugccgcaagcccacagugugccauccugcaggaggcaggcuccugguucuucuugguuguggaccccagacccauucuggggucuggaggggucuggaggacggcguccuucucacagcuccacuaaguggugccccagcagggauucugugugggggcuccuacccaaaauuucccuucugcacugcccuagcagagguucuccaugagaacuccaccccuacagcaaacuucugccugggcauccaggcauuuccaugcaucuugugaaaucuagguggagguucccaaaccucaauucuugacuucuguguacucacaggcuccacaccacauggaagcugcuaagguuugaggccugcacccuccgaagccacagcccgagcucuacauugaccccuuucagccacauaacaacugggacacagggcaccaagucccuaggcugcacacagcauggggacccugggccuggcucaugaaaccacuuuuuccuuguaggccuccaggccugugaugagaagggcugccacaaagaccucugacaugucccagagacauuuuccccauugucuuggggauuaacuuucaccuucuuguuacuuaugccaauuucugcagccaguuugaauuucuccucagaaaaugggauuuucuuuucuaucgcauugucagccuacagauuuuccaaacuuuuaugcucugcuuuccuuauaaagccaaaugccuuuaacagcacccaagucaccucuugaaugcuuugcugcuuagauauuucuucugccagauacucuaaaucaugucucucaaguucaaaguuccacaaaucucuaaaacagaggcaaaaugcugccagucucuuugcuaaaacauaacaaaaguuacuuugcuccauuuccgaacaaguuccucaucuccaucugagaccaucucagccuggacuucauuguccauaucacuaucagcuuuuggucaaagccauucaacaagucucuagggaauuucaaacuuucccacauuuuucuguuuucuucugagcucuucaaacuauucuaaccucuuccuguuacccaguuucaaagucacuuccacauuuuuggaugucuuuucagcagcgccccacucugcuggcaccaauuuacuguauuaguuuguuuucacacuggugauaaaaacauaccugagacugggaggaaaaauaggcuuaauggacucacaguuucauauggcuggggaggccucacaaucauggcagaaggugaaaggcccaucugacaugguggcagacaagagaagagagcuugugcagggaaacuccuguuuuuaaacccgucagaucucaugagacuuauucacuaucacgagaacagcaugggaaaaccugcccccaugauucaguuaccucccacugggccccuuccacaaugcgugggaauucaagaugagauuuggguggggacacagccaaaccauaucaccuuuuaucuuucaacuuagacuaugccuguuugguucucucucucucucucucuuuuuuuuuuaaaucauaaaugucacuguuguguguuaggagaacaaggacacagaccgugccuucuuggucucaugagugugcuuuguguuggaagcugaguuaaugugguguugcacugucugcuccaguggagggcagcauggggcugugcugucccacacaccugguucugauccuggcauuuacucucuacuguaaacugagauuagauacgugagcuguugcagucacauuucccucaucugcaaagugggaaugagaguaacgauuguucaguguauaugccagccucacaucagcguaagcaugaagugagagcaggcaugggacguguuuagcacagugcccagcauauaguaaaugaacaguaaaugucaguuacccaggaacacaauuuagacaugcuuauuuuuucauauuuuauuaaaaagugagauguuucagauuaugagcugaauuucaugacauucaaugaaaaaaaauacccacugaguguuaaugagcugcuagguacuguguuaggcuuuuuacacacuuccccaugcugaauugucacagaaacucugugagauauucuuauuuuugacaaaauugaagcagugcgagguuaaguaacuggccugaggucacucagcugcaagugauaaagcugggauuugcuucuagaucugugcuggcucuuagauccaggcugucccccacccgaccagcuuuguggaggcuggugugugagccuucuguuuacaaugccucucuguguagccugcagggaucugaagauaguuuccuucgagaacagguugacgaggaggaucgaggaccaaagggcugugcuguggcucugccugaggccgggaugcuauuggacuguccccucugcugcuugauagagagcacgggagugaucacuuacccuggugccucugaacccauacccagauuucagaaugaggggcccauuaaauugugccauacuccauuucucauuucauugugagguagagaaacgaucauaucaucuuacgauccaagcacuagucaaaaggaucccuguguagaggagucccaggggaacagugugaaacugcacuugcacacauuggucuuucugccaagcagaagaauaauagcugugggaccaguuauaccauugccaaugguggaggaaaucgccugccuuuuauuuuuccccuauugcuuuguguuugucuuagcaggagucauuguggcugaaauaguguuaauaucuucuguaugcuugggaggucccacacuggaggauuuuauuacccucugugagagggaagaggugguauuuaccauuaacuuuguaguaggaaugguuuuauuccacuuggcacucugcagcgcuggacuccaggguacaugguuguguggacgcauaggauauauauggcgcucuuaaagagucacagugguggcauugccagguuuguaaggcccuagauagggaugaaguguaggucaugaaugacuucaugcugcgugugaggugggcuuuggaaacagaaucaguauuuguauucccacauggaugcuucaggccuuaaaagugccuccucuuccuuaugacugccagccacauuuacugaguccagaagacacucuuuucuucucuuaggggagagacgagauguaaacagcaagggcaaggaaggcagcccugggaaucgugucuguggguacucaacuguugcuuuaucuaagugggagcugcguaagagggucgagcugguguucuuuuaucagcaaagcccuggaucuuugucugggaccuacacucucauuguauucuuccaccaguuaguucuauggccuuggcgccuguggaaaguauugagcuaauguuagugcaaaauauuauacaacaccuaucgagggcguuuuggcaauauuuauuaaaaucauaaaagcauuuacucuucaacucaacaggguauuuagucacagcauugcuuucaguagcacaacacugaauauucuccaaguguguaucaguaagacuucuuauaugaaugugggccacaugcaggaaucuuugguaggaguaagaaaaggacugagggcgugcucuaugcauucauguggagaggccuccagacacaucauucagugaaaaaagcguggugccgaauaaaguacacacuaugcugcuuguuauauaacaaaggaaggaaaauagaaacagauauuuguauuggcuuaacaucuggcaguaaaaaggaaacccugagaguuuaccguaaggguccaggagauugggguaagaugggaaagggagguaagugagacuucuuugucaugcccuauuacauaaugagauggauccuguuauaguauuuugauuuugaaccuugugaacauauuuccuauucaaaacaaaacaauuuauaaaagaaugcuguuagagcacuauugaaacaucaugaaaaaaugggcucuaucaaaagguugcgggucuucaacagaagcagaauagauggaaucaucagaugucuuugacaguggcggcugcacgauuucccgugguuagauugugguuaucgaggaugaucccagcucuuuaagaauuuguuuccagccagagaguccccuccuuccuuuuucuuuccacguuccuuuccuuccuuggauacuagcuguucagaaagugugaguggcaacccugauauuagaccacuauauucuacuauuuuucuggugucaacugagggaaaaucuauuuugaaaauaaugccaaacaccagugguuaauggcauauuuguucaguuaauuuuaaaaaauuauucauggaggguaccccugguuugguguagaaaaucacugguauaugcucuaguuugggccacugaucuuucaaaauuuagauucuaccaucuguggaaggcaguucugauaggaaagucccaucuuuaaauacaaacgguaugggaaacagcagaagaaucucuuuaaugagucaauaaaucagggaaauggaacgugauguuuauucagaaugagauccuuaacgaaggugggauggaauggaaugacgucuacuuaaauguuuauaguaugucagacagagugcucaggcccuucagggauuggugggaagagaccaaacacacacacacacacacccgcccugcaagugucccuggcuggucuugccaaaggugcagaagucgggaggcugguacacagagcaggcgagguacagugcugccuuccccaucccuguggcagguaauguccugcuggaguugagacaggcuuagaauucuugcuauaccucuuccauuugggcucaugucacuguccuggagguauuucuacuuauuucugaagucccacuugagugauugcuucuggacuuugggcucuccucauucuugaacaaacucaacauccuuauucagaggagaaauuugagucaguguccagaucuccaaagaggauugcugccucuugagaaaaccugggcucccacagggucuuuucuugaaaccacugggugagggcaaucauuauccacgguguagagaagaggcagguggggcucaaagaggauaaguaagcuucccgcgguuucacaggaaaaaugguagaaggcugaggcuugaacccaggugugguuuuuuuuccuaaaguauacuuucuuuuauguggcucuaggcugaaaauugagguguauaauuuuugacaguugcuguaaucucagaguucugaagccguuaaaaaagcucugagcuucaucugugugguuuaggaaauuaaaagacacaaggaaauaggaaaaaaaaccuuggcauuauuuuccacuagauauauaguucauauaugcacuuaauuuuccucuauagccccaauaagaaguuagucuuaugcauaaugaauccauaugauuuggauaugcuuacugaaaauucuccucuauuaauauauaacacaaaauacguaauuuuuaguaaauauucugacuucuaauacuugacaugugaaauaagucacacucaacauaguuuugagcuaguuauuuggcauuguaucuuuuaauacaagaagcaugucaagaugcuuuuucaacuagauauaauaauaccuacaguaauuuugagaucauagauugaaaaacaagaagaaaguguauuuuggggguaauaucaaaguauucaagaaauaauuucacuaccaaugauuuuuuuaaaaaucucuguuaaugugucaauguaacaauuaauuaauuuauuuauuugagacugaaccuuacucucucacccaggcuggagugcaguggcgcaaucuuggcucaccgcaaccuccaccucccagguucaagcaauuuucgugacucagccucccaaguagcugguacuacaggcaugugccaucacacccgacuaauuuuuguauuuuuaguagagaugggguuucaccauguuggcaaggcuggucucgaacuccugaucuuaacuaaucuguccgccucagccuccugaaguacugggauuacaggcaugagccacuguguccagcccucaaugucacaaauuuaaauuguuaaaauguguaagaaaauaugguauauugggaaaaaguucacauuaauauaauuuacuuucaaauaauuacuauuuauguuugaaguagagacacaguguacucaaaaauagugcuuugcaaauuuuggccuuuuuuauuuuuaguugacacaucauuguacacauuuaugggguacagagugacauuuuaauacauguauacaaugugugaugaucgaaucagggaaauuagcauauccaucaugauauucucuucaauaaaugauucugggcaagugcugucuuucucaccguauacaaacccaacucaaaaugguuugaagacuuaaauguaagacccgaaaccauaaaacuacuagaagaaaacagaugaauuacuucaggacauugguguaggcaaagguuuuauggauaagacuucaaaagcacagauuuugacuuuugucuauuuaugugaaagaggcaaaucuuaaaaacugaagaaguccuuaaaguagcagaacaaaggaaaugaaugguguauagauuuggcauucuuuguggggucauguagauuuuaaaacgaaacugagcagaggaucucaggggguaaaaaggauuaaaaacuuccuggucucauuagacacaacuuuuaccagucuguguuuucuguuuuaguuacuaugguaguaucaauagauucugcuccauuaaaucguucguguuuaucaucuugguggauucugaaaaacaucggcuaacgucccugcuuuucuugcuuugcuaucuguaguuuucacuguggagcaguuacccacguuguuaccaaaaaagacaccugcaggaugauugaggaagaagaaacugagggcuugugguggcugagaucuuaaaccaaaaaaagagcaaggguugauaaaacauauuuuaucuuaagaauuuguucaacauuacagaaauuuucaauccaaagcuauaauuguuuuuucucauuauagaagugguaaaccaaaagcccuucagugaaggaagguuccuggagaagggagagccaucacaucacuucucaguucuauccuuguguugugcugacgccaucagcaccagcagcucuaguggguguguguaaacagggaccugucucugcggagacgcggcuuccuaugagaccauaugcaguagacauuuaguuaggguuuaauaaacauugauuauggaaugacuuuaaucaacacuuguaauuguuuucagugcuuauuaaugucuugaaaugucuuccucuuggacuagggagaaccuaagauauuacaguugugagagauggaguuguauaacugaacucuuccauauuuauuuaaccuauccaaaaugauuuuuuuaacagaaccuaagagcaaacugagaaaguaaacuuguguagcacuuacuuuaccacuguguuccaagcauuuagguaauguuuaauuacauaaaauuaauuauauuuaauuauaugaaaucaugauguuaacccugaguccuguuccugcuuuugguaaaauucaggccaaauauccaaagccauguacacaaaauauauuguuccaaacuguugucauaaaauguuuuccgcuuacgugccaagaguuauaaaaaaagaaagauagaaauuauuuugucugucaguccuucugcacucacuuccaugucccaagaccucacauauuucuguuuguuagcaggauugucucuggugcuuuuuacaaaaauauugauagggaauuguuggucccaaagaugggcagggauacagguguauaaaucccuucuucucagaauacagucccaaauaagcaguggcucugcgugucugagcuuccacacagaaaagucgacuacucaggggacguggggacaguucuccaacggccugcaacaagaccagcuuuuuuuucccaguuagaaaaaguguugaugcgaucucggcaauaaaaaggaaugaacuauugauaggugcaacaacacaggugaaucuuaaaauaacccugaugaaagaagcaagaaaaaaaggaguacauucuguauguuuucauuuuuauaaaauucuaggaaaugcaaacucaucuauaguggcagaacaaaucagugguugccuacagauguggggggucaggagaagaguggggcagugggcagguggguaggauuacaaaggggcaugagaaagcugggaggugauguuuauguucauugucuugauuguggugacaguaucaugggugcauaucugugucaacauuugucacauuauacacuuuauaucugugcacuuuaauguuugucuauuuaacacagagaaaauaagagggggaaauauuguauuacuguuguaaacagaaaucaguugacacuugucauagacagcagcuaagaaggaaaauaaaugcaauuaaaacaaaucaauuaaagaaaaaucugccuucuccuguggaaucugggccauaggaaagccucccuguguuugauaauuacacucuugucuaauguuugacucucaaaauaucuuuuuugaugggcaggcaauuauguuuuaacugucaagagcuggguuuuggggccgagugccguggcuccugccuauaaucccagcacuuugggaguuugagucaggaggauugcuugaggccagaaguucaacaccagccuggucaacacagcgagaccucaucucuaaaguaaaaaaaguagagaaauuagccaggcaugaugacgcgugcuuguagucccagcuacucagaggcugagccaggaggauugcuugagcccaggaguuugcaguuacaaugaacuaugauuggggagccacugcaguccagccugggugacagugugagauccuaucaaacaacacaaaacaaaaaaacaacaagagcaagagcagggguuuuggaguugggcagaccuggguuuggcacaguggcccagucaccugcuagcugugggacuuugggcaagacaauugccuuuuuuuuuuuucccgaaucuaugaaauggguugguagaagcauaguaaguccucaauagauagaagccauuuuugucauuauuuuuauuugcuucacauuuugauucccacaagauuuaacaugcagguaguuuggggugagaacauaugguauuuuaaauucacaagagggcauguucauauuaccauggagaaucgaguccuuuagcaaaguguugccuaaaaaaagaagaggucggcacaggaagggaaagggacacagggacaggaacacaggauuugucaaaaugcccacuuuuuucuguguucuucucagugggcaucaagcuccuaggugacccucugauaugguuucucugcuuuuagugaccucugcucuuugcaggcuuuaauuguuuugaauucauuagucuuuucccuuguuaaauaguaaggccauugcuuaaauuacagcacuuuuucucaaaagugcuguauuuauguuugcuuauuuagaaauucauucuggcauuuagcaugugcuuuuuaaucauucaucuguaggaaaaauguuggacuuuaaaaauguuuuacuuaagauugacugauagauuugguuuaaucugacuuuuuauuagcuuuauaaacuuaaaaauaauauauauauuuauauauacuuauggaaguaaaaguugaucaguuuaucuugaauuggucauauuguugauauguaaguuuggaggaaaauauaguaaaaauauacucucuuuaacucugaaauaaugucauuuucauguauagaaacuaacagaauuacuugcuuucccaugaucuuggccuaguguuuucuucugccagcugguggcagggauuugacaagugauugauuugguugcagaggguccuggaauuacgcaaaguguuuuuuauauuggagaagacaugcccaguuuuucacaaguuuuaagauuuauugccucacccuaacauguugcaaauuaguuuauuugcuauuuauuuuacucagaauguaguaauuggugucauuaguagaagggaaaauuugaucacaagaaagggcagacagcuauuuaacacuacuuauuuguuucuuuggcaacuuugcagagcuggagauaagauggguagacugcuacuucccuuuuacacauccuuccuuugagauggagaucaacuuucauggagaauggcuggaaguucuuggcugcggggugauggaacaacaacuggucaauucagguaaaaaagaaucccacauuuuauuuacacgugcucuaaaggaacccucccuucucaggcagccccguugcacacuuguagauauuuacauacuucuaugcgggcagcggcaucacuggucucucuucagauuccccucuagauuugucuuugauacuaagcccuggaaaaacuuauuucucacauccguauuugcaaaggcucuuugucuuuggagauccaccuugucagcacuuggcugcuggauuuguacuuugugauuucguauuuguugauacguugcuuuguaauugccccaaagacauuugcugcaugucacaggaguguaguuugucuuucagacuauuuaagaacaaagacaaugcauaauccauuuuuguucuuacugcacuuaguauagugucccaaauucagcaaguauuuuauaaauacacuaaaacgcaguguaaaaacacuuaggccccuaaugcuuaauccaucaccucccucugcauaggcggcgccaccugacugagagaaaauggaaacacgagguugcugauugaauucuacgcauaucuauaggcauuucagaaagaucugucuggcucuuuucuguaagaccauugcuuaauaaaaaugauggcuucuaaauguaauuucagagcugugagguuucuuuuuaagucacuaucugaauugaguaauuuuuaagucacuaucugaauugaguaauuuuuaagucacuaucugaauuggguauuuuuuuuaagucacuaucugaauuugauuuuuuaagucacugucugaauguaauacuuuuuugaaaguuacuaucugaauuuaauuaaaaaauuuaauauaauuuaauuaauuaaaaaauauuacaggcucgugcacuuuaggaggccgucccagcacuuugggaggcugagguggguggaucaccuggggucagaaguuugagaccagccuggccaacauggugaaacccugucucuacugaaaauacaaaaauuagcugggugugguggugcgccuauaaucccagcuacucgggaggcugaggcaggagaaucacuugaacccaggaggcggagguugcagugagccgagaucgcuauacugcagccagccugggcgaaagagcaacacucagucuuaaaaaaaaaaaaaauauauauauauauauauauauauuauauauauauaauauauuauauauuuauauauuauacauuauauauauuauguauuauauauaauauauaauauauuauaaauauaauauauaaaauauauauuauauauuauauauauuuuuuauauauaauauauauuauauauauuuuuuauaucccaaucauauauauauauuuuuuuuuuucagaguauaaauccuccaaaaaaaaaagggaaaguugguuuggauugggcauuugagcucacuacauaagcagugagcaccaaauuggauaggaacugauguggauuguucaggaaaccuuuccggcucugcucccuuagaaggacauuugcugcuuggccuuggagggcagcucugagucaggguucaccgcccagccuccuguagcagaaugaagagagguccuucuugguaacuaagaaaugugaauagaccauggguaaggauaugauaucuggucaugggcuuggaaaaugaggaugagcagagagugacgagacagggugcaugaagugcaggagcuuguguuaccucggcugggagacuggaggccuggccuucccuucuuacuuuuagguacucuccaucugcaggggccuggacuccacaagcucccagauucuucuucauccugcugaggaagccucaggagaaagcccagcacagggcuggaagcuucgugggcaguuuuaaaauaggugaagagcuguccuagaggagagggagcacagagguugacaucaggaccugggaggagaaguugugaggccugggcuugggugucuggaaacccaggguuucuguuaauuaacagcugugucucuuuaggcaggguucaucaccccacgagccuuggcuuucucaugcuuaagaugggugcaaggauacacccucagaguuccauuauggggauagauugaggggauuccucucaagugcuuagcaaagggucuggcacacagcaagcauucaguaaaaauuaacugcugauguuguuguacuuaaaauuuuucuaauggcuagagccaugugucaacagaggguccccuuaguaggaaauauuuaaacagaaguuguuccugccugugauagaaacaauuucuaaccaaguguaauuuguuaccucuuugaccuguagucaugucugugucugccauuuuaugcugagugagugauuuuacagggaaaaagaaaaguaagaguaauaaacaggaagaaaaggaaaaucagccuaacaguuguaugugcaucucaacagaaaacauaaaauacugggcgugaauaugaaagauuuaaucucuccuugaguaggagcugacuucaaauaccucugugaugauuugauaguuuuguuuuuuagaaaaagacuucaaugacuacuaggcuuccucccaggagugccuggugucagggggcugaagcucagaaagcaaaucagggaugaucagcuuacacaucaguuguugcuuggaauugcgcuuccuugcacgguuuccaauauccuugauggguuuuuaugagguuuauucacacaguaauuggcugaauauuguuaucugaaacagauuuccaagucauuauugcacguuaaugaggcugcuguucugcaauuagaucagccacguuagauauucuugaauggaauggcaaagugaaaaagacaccuaagucguaaauauguuucagagauucgcagugaugguaggaugugcuuugaguuuuggggaaacuguacacauaaaaaugaauuaauuaauuaauuaauuuuugagacagagucucgcucuguugcccaggcuggagugaaguggcgugaucucagcccacugcaaccucugcccccgcuggguucaagcgauucuugugccucagccuccugaguagcugggauuacaugcacccuccaccacaccuggcuaauuuuuguauuuuuaguagggauuggaguucaccauguuggccaggcuggucucgaacucuugaccucaggugauccacccaccuuggccucccaaaauucuaggauuacaggcaugagccacugcgcccagccauaauauuuaaauuaaauauuucacaagagaaggaaacuaaggaaauggaagaagagacaauuuuauagaacggauucuguguagacuuugcuauuugaauuugaaguuauuaugacaaaguucugcucuguguucucaaauucgaagguguuuggaugucuguaguuaaaaucuguaaacugccuggcagucacuaaccacagacauuuguaagugcagcuaaauuuucuguuuuuugaguucuuauggcguggagaaagaccgaauagguauacuuuaucccacucgugcaguuccgcuauucuuuccaucucuucuucuauauuugcuccccugcucucccuuccuucuuccucccugcacccugcucuuccccucucuuuacuuuucuucauucccuucucuuuuaaaagagaacuuccaagaaacaauauaauugaugacuccccuuuaagguucuuauagagaaucaggugagugcuaaaauaaccagaaaacaaagaaacugauggagcaaugauaguggcagacaucaguugagcccuuccuguaugccagcaucccauaaagcaugcuguauaugcuuucuuucauuuaaccaugauaacaagguucccagguagaugcuguuauaacccguguuuuacagagccggagaaagguaauucagaucaaauagcuagacagugcuagugaaacuugccaagucuuucugacaacaguuaacuaauaagcuaugcuccccaaauaguaaauugcaugauuuugaaguugcuaaaaauucauuucaaauaaaucauucugccuaacguagaaugaaagaacugaaacaaaaugaaacaaauacauagcaaacaaaacuuuauuuguucuguaguuaccucuaaggaagggcuaugccaccauguguguucucucccugugauagaguguauuuaauuaaagcaugaaauuagauugcuaauuugaaaagucagugaagacauuuuauuacacauuuaagcaacuguggcauauauguguuuuuauguguggaacacagcucuuuuaaauggcuuguagcauuuuacuuuauuucuucuuccuuaagucguagugucuucaccguugauuucuggauccuuagacugagugauugugaugugaguggugaccguuuucaggcugacuugguuguuuuuuccuuagggagguauuuugaggacaguacugagucacguccccaaauacuacacacuugccucccacuggguugacucaggcugcugugucuuuucacauaguaaauggagcaccgcguccaaaaccaucacugggacaacuaugagccgugaucaugccaggaaggaauuuaccauuccuugccccugugaaguuuagaagauuuuacaugggccaagagggagaagaagcuugauaguugaaaauaucuuuuuaaaagugaaauuaccuuccuuaccuuuuugucaaaauuuaaaaaucggcucuuuggggaaaaccuuauaaauagguacaugaacagcuuccgguuuugaaggaucauuauuggcuugcuuaucaaauauuucuucaaaguccuucuaaggcuauagcgaagugaaucagcauugcuccugcuuuugaaaauaucacagcauacaauacacagacauacaaacaaaugauuacaguaccaugugguaaguauucauaacagggguaccgugggcacaauguguggggaagagaaggauuagagaagguggugccaggccuuucccugguuacaaucaggauggaauauugaugcgauagauauuugaaaugugcaucccagaguuaguuagguucuuguuugcaaggagggauauacuuucucuuugcuuuuccuauaucagcaugaaucuauuuccagucugucccugucucugguaguugaucucuauagccucuacacauacuuaacaugguucacuguuguugaucucaguuggugaaucuguaauagcauggaccaaggcuguacugguaauaaacaugccuuuuauauaauuagugucuuuugugugcaaggcacugugcuggacagaggaaauuaggaaaauggaugaaacacaccuucucccugugaaaacuuguaguucuguguaguagggcagauaagauuauaucguuagaacauagucaugcauauaaaugcauuuugugagaacgagcuuugugagaugagaaaagggaacuaugucugucaguuggaucaguagagacuucauaaaggagauggucuuugaauugggccuuaaguggucauucucagaugugugacuaguaauuacuuggagagguuauuuaaaaugucuguucauagagcaucagagucuggaggucugggauggagaucaagauaugcauauuaaacaaauacccuagauaauucuuacgaaugacucacauucagaccauacuuugaaaacccuaucuauagcauagguugaauauuuuucccaauuuuuuugggauauaauugaaguguaaugaacugcagauauuuaaaguguccaguuugaucaguuauugacauacguauacaccagugaaaccaucaccacaaucaagaugauaaauguuuucauucccaacuguuucucaugcccuuuuuguaaucuguuccuccacccaucccugucuucaggcaaccacugaucuaccugcugucauuauagauuaguuuggauuuucuacuauuuuauauaaauggaauuguacaguguguauucauuauaccuggcuucuuucacucagcauauaaugauuuugagauuuauccauguuguguguacuguguaucaauuuauuccuuuuuauuuggaguaguguuuuauuguaaaauucuuuguguggacauauauuuccauucucuagaagcaaaaagccuaugaguggaguguucuauaaaugucaguuacaucaagguaauugaauaguguuuagcucuucuuucuauguuuacugauuuuuuggucuuaguacucuaucaguugcucagaaaagaguaagauuuucuacuaugauuauggacuuggcuauuuuacccuuuuaucugucaauuuuucuuuauguuuuuuugaagccauauuauuaggugcauauauuuucauaguaguuauguuuucacgaggaauuguuccuuuuaucauugugaaaugucuuucuuuaucucugguaauuuuccuuggacucuguuucauuuauauuacaauauccauuccugucuugucuuccuuccuccccaguuaccuuuauauuguuauaguuacauauauuacaucuacauacauugaaaaccucgugauucaauguuacacuuuuccuuuaaggagucauaugcauuuuuuaaaaaauuaagaggaaaguaguuuucuuuuauauuuacuuagcuguuucccauuucucuugcuguuccuuuauuccugaaaauacauguuuccuucugguuauucuuuuuuccuucaauaagaaaaacuuuccuuagcauuuuuuauagaccacgucaaguggugauaauuucuuagcguuauuuuaugugagaauguuuuuauuuccccuuuaguuugaaggauguuuuuauugaauauagaauuccggauugauggauuuuuauuuuuuuucucagcaacuuaaagauguugauccauugucuucugccucuauaguucuaaagagacauccauaaucuuuucagucauucuucacuuguaaauacuaguaucuuuccuuuuuuuuuaaaaaaauuauuaacuauaauuuuuuacugugcugucuuuaguuacuuucaaggcuucuacccaccccccgcccccccccccauuuuuguuuuucagccaugugauuuugauaugucuagguaugguuuucuuuuaucucacacuuaugauagaucuuuugauuuugucccaggagacccugagacucugcuuacuuuuuuuuuuuuaaucuuugucuuucuguuuuucagauuggauaauuuccacagauccaucuucauguuaauugauuuuguucucugucaucuccauucugcugccuugaucaccaaauauauuuuuauuucagugcuuuuuuuuuguuuuaaaauuugcauuugguuuuguuuuauaguuccuauuuuucuucugagaauuccuguauuuucauuucuaucaaguuuguuuuucuuuaccucauagagcaaagugacagugguugcuuuaaauacauguugaauauccauuauccaaaaugcuuggaaugagaaguguuucagauuuuuggauuuuggaauauuugcauuauacuuacuguuucagcaucccuaacucaaaaaucccaaauucaaaaugcuccaaugugcaucucuuaaugggcaucauguccaugcucaaaaaguuucauauuuuggagcauuuuggauuuuggauuuuuggauuagggauacugaaccugcaucugauaguuccaaugucuggaucguccugugauugacuuuuguuaagaauuggugauauuuuccugguuguuuguaaacaaauuuuggauuguauauugcacuuucugaauggcauccugucaucuguggugacuguugcuguuuuaguagggugaucaaccuggugagcucuaggcuuugagugggaccugcuuccuaggggcagcgauucaguucucaguguaagucuuuguugugcuuauuuuuguccauccuguacuuaagggguuagucugcaacuugugugagugguucagaucucaguucaguuuucucagccuuuucugugcugguuggagucugugcugugcgugugucacuccagugucaggcugauaucugugcagguuuccacauagaauucgggcauccuuuccugggcuuucucuaccccaagaucauacccucagacuccucaacucgcagaaucccuuuaucugcagacacacagacaggcuucucuuugaguuuaguugccuguguuguuuugcagcuaugcaacuggggcucaccuuuggggcaaaaucaugugagaagaaaacaaagcaggaacuucacccuguguggguugccuuuccaaguguugacucuccuguauaauuuuucuguuuuuuuacuuuucagaguccucuguuaguuguuuagagauuuuggucguaaucagagagagggauagacuggugggcucaugcccccauaguggaccugaacuguaguuuggguugugaaugcacuccaggugaaaggauaauugcgugacacacauaugugguacuggaaacguggugguauuggcuccacuugucuauuuacucugucaacuuuauuaaucagaauuaagccugguacauuuuugaggccaguuaguugagauugucuaagaucugugaaacucuggcucgcuuccuuccuccugcccucccuuccuucuccguuccuuucuuucaccuucuuaacuuuccucucuuccuuuaagucagucuugccccuuuuagugcccauucagaaaagcaaacaaauacacgucagccuuauguguagguuuugccucaaguuccuccuagugacauauuuucaagcugccagaauggagaugucuguucaaauauuuacuuagccuuuuucccuuuucaaaacagcuaagauggugagacuuuuuuucugauauaaaagcaaucuguaaucauugaaaaauuaagaaaauaaaauauaaaaaugaaaaugaaaguaauuccaugauccuacauaaaauagauucuuuauaaaauuuaauuccuauauaaaacuguaaaucuuuaugcauauuuauaauugucagauauaccuacauauagaaguuauauauauauuuuauaaaaaguagaaucauacuuugaauauuuuuuguauuaauuuuuucugcaagaaaugugacacaaguguccuuugauguuaccaaauauuuaucuacaucaucauugucaguggcugcacagccacuguggauggaucuuucuggccacccccauguugauggguuguugacaauaacauuuuuauccauguguccugugcacuugucuuaauauuuuccugggauaaguuuauaaaaguggaauuacugguuuuuuccucccuagguuuaugaugcauauucauaggcacacuggaaaaaaaguaccugcaguauuugaaagaguugauuuuuccacacccuuaccaauauugaacauuaucaaucucuuuacucuuuacauuuaacaggaaaaaaauguauacugguguuuuguuguuauuguuuuuuagaaguggagggggggugucucacuguguugcccaggcuggacuugagcuccuggccucgagugauccucccaccucaaccucccaaguagcugggaguacaggcaugugccacaguauccaguuuauacuggugguguuuuaauucccuuucuuuuuuucuggucacuagugucacugaacauguucccagaagcuguuggcucaguccauuuucuuucuuuuuuuuuuuuucuuuuuugagacagagucucucucuguugcccaggcuggagugcaguggcacaaucuuggcuccuugcaaccugcaucucccggcuucaggugauucuccugccucagccuucugaguagcugggacuacaggugugcgccaccacaaccggcuaauuuuuguauuuuuaguagagaccggauuucaccauuuuggccaggcuggucucgaacuccugaccucaagugaucugccugccuuggccucccaaaguguugggauuacaggcaugagccacugcgcccagccacucaguccauuuucuaaugagacuagaaaggaugcuagaauauauucugcaaguuuuucuuuuuauucuuucacuccaaaugauaaccuuauucucaucuuuguugaaguccucuguguaucccucccugucaguuucuucacuccuucccucucucccucccuucuauaagcaaucacauucugaauuuuguauuauuaccuugauuuucauuagaguuuuacuauuuauauuguaaaacaaguugacuuucaugugcuuuuauguuuuaacaaaugaaaucacaguauagcuccuuucaugacuuuagguuuucaugcauuagugugaaguucaucuguguugucauaaguagaguuuuaguucuuuuguuuuuugcagcuuauauucuacuggaugaauguuccauaguucauucauccauucuuuaaugaauauuugcuugguuacgauuuucuuuuugcuauuacaaaugcuacugcugaacauucuugcaccucugaauguauagguguaagagucucacugagcuauguuuuaccuagcgguagaauugcuaaaagucagcacuuacgagcaucuuuggguaucaucaaauuguuucccaaagugguuggcccaauuuauauugucuugagccuuucuaaaguucccugguguuuuacauccucuuuaacacuugacguuguucaacuuauuuuggcagucugauacguuuaaaauaguaucucuagcugagcuugguggugcaccuguaguccuagccuagaggcugaagugggaggaucacuugagcccaggagaucagggcugcacugagccauagaguagccgccacuccacuccagccugggugguagagugagacccucucucaaaaauuaaauaaauaaauaauaaauuaaaucaaaugguauauugugguuuuuauuugaauuuaccugguuauuacuguuaaguuugaacacaauuuuauauauuuauuuaacauuuauuguuuuucuuuuguucauuuuugggugaggcucauuucugucuucuaaaacuggcaggaauucuacauuuauaucgguuacuaaucauuugucauuucuauguauugcaauuauauucuucagguuuguggcuuuucuuuuucuguucuuuuuuuaaguugcucuuucauaaauggaauguguauauauauauauauacacacacacacacauuucuuuuuuuugaguagcuuuagguuucuuuauauaacaucauucuccaaaaaagucacuucaccggggauuguguguggguguaaguuggcaaguuucaugaagauaacccuuuugcuugucaugcuugauucuguaguuuaagucucucauguuacugccuuaucauucauauuuucagcauugggauucuaaauauuuaaugacuuucaagcauuuacccucucuuuccuaguguucugucagauuuagucccacccucggugacaguuucccuuggcugggaagucguacucuaggaugugcuucuuugacuaggaaauguagcucagagcuugccugggagccccagugaugcccuuuucacugaauuggauuuauguccuccuauguuuuuuaguuuucccuaauccugcuucucauccacaccaggccucugguauuuccauuacuguaauaaaaauaaaggcuuuggcaacuucucucaagcugugguaucugucuacauuucugauguuuuugcaacuguuguguuagguguuguguacugucuguggcaugauuucuagauauaagaaacaucuggaaagccgagauucuguccuguauguucauuucaaugucuaaggucuuguaugcuugccagauauauaaagcacuuuccauuuaacuuuccaguuuccccccaucaauguggacuuaauuuuccauuuuaaacuguuauccuuuuuccuguugucuucucccauucaugaaacaguaacgccaaaaacacagucuaaccauuagcuuuuuacauguagaagcuguuggcacaguuugugagugagcaaauaaaagguguggauggaaaagaaauggaauuuggcaaaguugguauugaugcaagugguuccuucuuuuaucagacuguaguauuguuccaaguucuucaccccucccuguaucugugcacuugguucccugacuuugaagcacugucugcuaugagaagaauauacuucucugcccuguugauuuggagcuugccccuguaacugcuuuggcuaaagggaaauuagcagaugugacaggaaaagaggcuugaaauguacuuggcaguuguuuuuuugcccuuuuuagcuucugccauuaugaggugaacaugcccuguguagcuugcugguuccagaacaguaagaagcauguggaguggacccgaaccaaccucagggccuggagcccagccagucuggaccagcugagccccagccccgcagacagguggugguuguugcaugccacugagauuuuguagugauuuguugaucagcuguagcuggcugauaaaacauacauuguaguugucauauucuuuuucagcuuaccgagggcucauagaaugcuuaagagucucucuuccaaaaucauuucacagaaaauucagcucauuuauuucucucaaguauuuccucuucaccucccuuucuaacuuagcaggaaggauauuuggaaagaacuugacuuuuuuacuucccucccucugcagagaagccacugaaauaguuucucaguauuuuagugggcugugguggugguucugaaaaccagacagggauugguggugggaauguccucuacaugggagguuuuugaaaagccacugauauauggaagauccucguguguguguguguguguguguguguguguguguaugugugcaugcacgcacgugcauauguucgcaauauaaucuuuuuaaaauuuuagcgcaggcugggugcaauggcucaagccuguaauccgagcacuuugggaggccaaugugggcggaucacaaggucaggaguucgcgaccagccugaccaacauggugaagccccgucucuacuaaaaauacaaaaauuagcugggcauggugucaggugccuguaaucccagcuacuugggaggcugaggcaggagaaucgcuugaauccgggaggcagagguugcagugagccgagauugcgccauugcacuccagccugggugacaaggcgugacucugucucaaaaaaaaaaaaaaaaaaaaaaaaaaagagagagagagagagagagaggaaaaaaucuuagugccaggugucugaauuuaauuagucucaggucgaagacucuggaaucaguggaauguaagcuucauuagggcagggaauuuuuuugguuuugaucacuaugguauucccaguuccuagaacaaugccuagcacauagaagacacucaauauccauauauaaauuagauggauggcuguguggguggguggaccccccacuccucaucccaauguucguuauucuuucuucaggcucauggaaacaguaaaauggggcgggggggaacugaccuaauuuuugaagcuugcucguggcucuuucugcccucagcugcucaguacaauucccaguuuccaaggaugggcagugggaagcacauuggccucagagugaagaccuggcuccagucaggccuggccaccagcugggcuggagaucuugggcaaguccugugggucucaguuucuucaucuguaagaugaggggccuaaauuauauaauuuucagauuucauuuuaacucucaaaucuucaacagccuagaguuucuuaauaaaacccauagaggauuguguuuuguuguauagcaccacauagaaaauugccuagcagcaggacuuggguguauaugguugguuaaucaggguuuuucuuccucuuaaagaaauucuuagagaccuuuaaaaaaaaagagagaaaaagaggaugcucauauaauuggauuuuauuuaaacuauuuaugaaacucuugcuucaugggaucacugcagcuuugcaggcagguagugaugugcucucaguggcucaguuuuauuuucuccccugcaaaaaggcaauuuagaaguuuaggaauuauuuaugguacuguggggauaaacacaaucugcuaaguuauuuuucuuauaucauuuuuuuucaagguucauuccuguauuuuaggcuggaagcaaugucuucaugaaauggccauguuguuauguccgugaacaaaaugaggcaaugucaucacuaggcaaaauuuaugccagguuuuaaaauugugauucuuaauugguauaauucaagaauuggauauuacugggugauucucagaaauaaagacuugauagucaccuaaguauggcaaaugauggucugaaaaaguuugaguuuucuuuacuggagagugucuccaagcucggaagaaguagcucuguuugagggagggagugugccguauuuuccagacuucuuugaccagagaaucccuucaugaaaagauuucuucuauggauccugucccaagaaggacacauggggacaugcccauccauuggcugcugggauugacaguaaccuaggaggcugaaggaaguguuuucuggggaagcagggacaaacuacaguaagauacucuuuaaaaauuuuguggccaggugcgguggcucacgccuguaaucccagcacuuggggaggccgaggcaggcagaucacgaggucaggagaucaagaccauccuggcuaacauggugaaaccccgucucuacuaaaagaaauacaaaaaaauuagccgggcgugggggcgggcaccuguagucccagcuacucaggaggcugaggcaggagaaugccgugaaucugggagauggagcuugcagugagcugagaucgugccacugcacuccagccugggcgacagagugagacuccaucuuaaaaaaaaaaaaaaagaaaauuuuuuuuaccucgaggcaugccuucaauacaaagggaaguagcugauacuaacauaaguaauucagaacauccauuuaucauuuuagauuauuugucuguggagcccuggaaaccaaggguuugugggcuucaaaggcauuaggaagaaaaaaagcucucaaaauccauuauauguauuugauacuccauuuaguagaaucagccuucccucuuuucuuccaucccugaagcaaacuuuuaaguaucugugugguaggaaccauacccacaucauauggauguagagaggugguuucugccuuugggggacuuccaguccagugguagaggcugauggguaaacugcucuguccaaggugcuaugguaacaguugaaggaggaaauaguucccugagagcuugugcaaagcuucauacuuggaugugaugcuugagcugacagaugaagucugaguaguuuagacgacaggggcugagggaagaggagguuuuuaaaguacauuuuauuguguauauuuaagguauacaacaugauguuauaagauauauauauauaguaauaugguuacucuaggggaaugaauuaacacagccaucaucucacuuagucacccauuucccccgcugugucaugaccagcuguuggcuacucaucugcuggugcagagacacagggagggagaggcggcacuguguguuugggaagacugacgcauggaugucuggauuacaccaugaaacauguuacuuagguggaggagguuggaaccuagauagggucaguuccggaagggcuacgaaugcaaaaucgaagaccuuacaucucauccuucugguaguagugaggcauugaaauauuuaaaguaggaaaauaaugugaccagauugauauuuggguaucuggcauuacuguggagugugaguggaagaaaugcaaguucaaagacaaggagaacaggcgaauugucuaggcgcuaaaugaugagggcaggagcugaagcagcaguagcagugggcagagagggggccagauugugugccuuuuaagaguuaucaccaggcuuugugugcaaggggaccaccuucuuggcaugaggaaaaggucauggauugaaggagcagauuaguucugauugcagcuuuccuaagcauaauugacacacagaaccuuugagcaauacucugccacugauacccuccaaagaauuguaggugaauuccacagcaugcuuuuuacccccauucucuaccuuaagcugccuaaaucauaaucacuaguauaaccucuuccucaugguggagacauuuuuaaagaacauuauccagggaaguggaaacuguuaggugaaggcuuuuguuaccuaagaaggcaaaauguacaaaugcuacucaucaucccuaccuuauccucaauaaauguuuauuguguuuuugacccacauuugguugaaaacaguccauguagaagugaaccuguguaguuuauugaggauaaaacaauaaauguuuacugaggauaagguagggaggcugaguagcauuuguaagaaagguagaugcuuggcaagugaagaugaacaaggcacaacugcccuuaaggauugaaugguuugaugagggaugcagucucacaaauagccccauaagcagauaugguaucaggcuuggaggcaaguggccugcagaaucagggagguuaucccagaagaauuaccuugaagaguguucuuuuaccuucgucuugaagaaugcauaggccuuugccagcacaauaggaaggcagggccuucuaggcagaugggauagcacauucaaagauacagaguuucgaaagauccagaauguuuauuugaggacaaagaaucgcagugugguugggguagccuaggggacagugagagugcuggugggagguagauccagagaauccuggcaugugaggcuuuauacacaaagcuaaaggaguguggacucugugcuguuguuauugcagccaguagagacguauuugggaagggaaggcgaugagaaaguggaagaagggaguccgccucuucauguauuguauacaauuauuuuauaggucaugcauuuauuuggggugugagugugccugugaguguguacacucucccucccacugcuuucaugucuguuuuucuguauccuuuaaguuuuuuaaugcaaauacaaauauguauucuuuuucuuucuucuuaaaaaccaaagcagcacacauuuuuucuguuuuuuuuuuuucacuuacaguguauuuuagagauguuugcacguuagaaagcauucccauuucuauucacagcugcaugguauugcauuguguguaugaaccauaauguauuuaaucagugcucccuugaugggcauuuuguguguuucccucuuuugcuauuaaaaacaauguuucagugaauaacuauguacaugugucacauuuugcgugcaaguacauuuauaggauuuauuucuugaaguggaauugcuaaaucacacaguauaugcauuuauaauucuuauagacaucaugccuauuaaguagaccuggggugaagcagucauaucugauauguggauugaaugaggguaagcagugagcaaaauggaggauggugcuaaguuagccuuggugacucaugaugccauuucacaagauggagacagagaagcuauguagguugcacccaagcuuuugaacucuuaagucugaagugucuauaagacaucuagguaggaacaucuaggagauaguugcacgugaaagaucggagagcguaagagagcucuguaagagauuuugaauucaucagugaaguuaaaagucacuggccgggugccguggcucacgccuguaauccuagcauuuugggaggccgaggcgggcagaucacuugaggucaggaguuccagaccaaccuggccaacauggugaaaccccaucuuuacuacaaaugcaaaaauuagcuggguguguuggugggcaccuguaauaccagcuacucgggaggcugaggcaggagaaucgcuugaaccugggaggcagagguugcagugagccaagacuuugccacugcacuccagccuggcugacagagugaguaagacuccaucucaaaaaaaaaaaaaagaaaaaaaagaaaaagaaaacucauagacuuaagauuuuuuauauauguguauauaugaaaauuauuauaaagaaagaagagaaaggccaaaaaguauaagguuucagaaaaauaaauauucuccuggguuccuuuaucuauuaaauuuacuagaauucauuggcauaaggcaaaaguucucaugugguucaggucuuuauuugacuuauucauucauuguucaugcauucauucauuucaauauuugcugaauaccugguaguacagauugcauaucucuuauguuaaaugcuugggacaagaaauguuuuagguuuuggauuuuguguguguguguuuuggaauauuugcauuauacuuacugauuuagcauucguaauccgaaaacucgaaaucagaaauguuccaaugagcauuuccuuugagcaucaugugggcccucaaaaaguuuuggauuuuggagcauuuaagauuucagguuuuucagauuugagauacucaagcuguaccaauuaaugacgaaaauauggucaucccuugguauacaugugggauugauuccaggacuccugaguauaccaaaaucugcacauacucaaguccugcacuucccugaggaaccuguguguaugaaaaguuggcccucuguauacauggguuuugcauccugcaaauacuguauuuuugacccacaguugguuaaaaacaauccguguagaagugaaccuguguaguuccaaucuuuguuguucaagggucaacuguaugaggcuacagauggccccugcccuccugcagcucacagucaggugggaaauauggugagguaaauguguaaugucagugugugcugacaccugcugugaggagagcaguacauugcacugugggaagaguaggagguggcaucuagugugacuuggggaagcuuucagaaaggccuccuacucugagaugugaggaaugaguaaggguuggugguaacagggagugggggaggggaagcgugaugugggcugcaggggcaaacuaguuugguaaggggccaagugguaggcauuuggguuuggggcggccuuggucuccugcuccagcucccccaugccguuguagugugaaggucgcgguggccaucggugaaguguggccggguuccaauaacuccuuauuuacggauacagaaaauuuccccugauuuccaugcaucaugaauaguauucuucuuuugauguuuuucaaccauuuaaaaagguaaaauucauuccuagcuuguaggccuuacaaaaaccagaggguuagggauccagacuuggcgugugggagguagugugccgccuguuaguccaggcacaagggacagccuguucaaagguugaggcgggagaagcacacaggggcuucucugagaaccucuucuuaggggucuccuugccuccaggguuucccuccuccagucugcccugcuuggaaucccuggauacaugccuugggcugucucuuucauuauugccgugccucucuggaaaaucuuccgugauucuccaugaagguauucaggguccuccccucaucuucugcuuuguuugccucagccuccuuucaugaagauuugggaaaaauccugcuccacugacaggaaucuaguauuuuagauacgauuggaggugcuguaaacacuucaggguuuucuaggccacugcucauuccuauguaugcacacauaguuugcuuucauucugaacuuuuuguauauuuccuggaaaaguuacuuugggauuaauuuacauauaaaaguccuauauuuucaucuuauuuuuauccugccacuucagguauagggaaauaaaugaaaaagucuucaaauguugacuucuaaggcuuuauuaccucagacagcuucauuagguuuguggaaaucuagugugcuuugaaggaauuaaucuagccuuacuugcaaucuguauguguuuacauagaaugaacaaacauugcauuacguuucaugaaaauucaauuauucuugucuccaggaaacauguucugcuuaguauuuaauucucaaguaugucaaggugaugguucuugaacugucguaagaauuggggagcuggggcucacugcucauuuccauaaucaauggagaaauagccaguggagacuuuuuaaucacuaagguccucauguaacccaugucugagguuacaggggacauuggggacaucagucucaguggcauaaggcuaauauaaaauccucucuagauuuuuguuagaaugaagagaaguaacauuaaggaugauacucuacauaauuaauacuuucuuuuggaguuuauuaugcauauguaugguuuauucagcaggcauuuuuugagauucuauuguuaacgagguacagcaagagauggaaagguaacaaucagcugguauuagugucuguugugauugguuggacccuauuuaacuggcaaggaucaguuuaaaugcuuuuauucuugaaacauuccuugcaaaguccgacaacucauuucccacuguauuguuacuacagugaagugauuuuuuggaaacaccuaucacauaucaucaccaugucuuuuauaguuacacgauaguuaacuaaacuuauccuuuucuuccacaagagucuaaccuccuugaagguaggaccaugcuuaauuccuacugguuaguggcugcaguauuauacugaagaaacgguaaguccgguuucagcaggccgagauguggaggagacgguuugggguccagaguggccuaagggaauuauuugaaucaggccaagagcaugaguuuacuucgagucuuugaggagugagguguagauggguguagcacaguacuaggaguugagaauggaucagaaauguagcuugggggcuacaccaggacgcacagaggccauacuuaaggguuuggaauggggcaccauugaaaguuucuaaacagaaaucacguggugagguccacauggccuuuuggggccuuccugcccuggccuuugccugccuccucgcuuucucucccacucuugcccguggguacuccaugcuccaaggaacuguugaaugugccaugcacacucuguucagcauuucccaaagggacccugggcaguccucaugcucauuuuucaaaccaugccaugguuugcacuguucacuagcuguuugagggaagaggucgggucuguuuauuucuuugccaccagggcuucacgcacaccuaaccuuuaguggguacuuaguagauauuuauugaauguuuggaugggugaaugcauuuuggcacaaaaccuucacuucuggacuggaagauagauuggauggagcagagacgggaggcagugagaccaaguggagcaucauaccuggaagagaaacauugagccugugaauuacagcuauagcaguagaaauucaaggggggaaauagauucuggagaccugggcaaguagaacugacgggacccagagaucagcggauaaaauggaugcugugaagggcuaagggaaguggaaagguugaagacaggcaccugaagcccaccuaaucauaucacuagauguuuugcagggugugcggugggcaaaaguagggguacgggaugggaguggaaaccguucuguguagguccguuugagaaucagcuuaacugaggauuaauugccuugguuuggaaaacuccacuacugaaguuugcacaacauaguaaauuguggaggacuaaagcauccuucgcuuaacuauucaauuuauuuacaaauuuaacugcaacaucguucuguaaaggauaugagauagugacaucuguagauacagauauaucuggagaaaacaaaaaccaaggggcaaaagguaaagggaaaauaagaauaugaaaauaacaaagcuaggguaaguuugcacgaagaaauauacauuucucucaguugccacaaaaaagcauagauuuggauuucagcugccuagugguaaaaggaaggagggaaacauaauuaauuaauacuaucuacagugucugcaagauaaaaacgugcucauccuuuuucagagaaagcacaauauucuugaccgagaaaacugagaaaaaauuuccccucaucuaugaggcggaauguguuccaaacaguugaauuucaaaaugagcuuucugacauuccuuagucucuucuuacuaguauaauaggauuugauuugcucuguuuaacauaugaugaaguuaauugugaaagaucucuagaauccaaaucugcaaauuauuuccaaaacccuguuuuuuaucuuuuacaccagucguucuacuggugagucaauacuugcagcuccuguguguguggcagguugccaggugccccagaugguaccaagguauguaggaauuuuugaaggagcucacagugccaguggguagucuaggcauaaacacauggaaaguauguuaaaugcaggaguugaauaaugaggaaccguacgggagagcccacgaagccgugccugauuuacugcugugcaccugcuuagacaucagguggggucugugaauucaaaagaugacaagaccagugugggcuggaggagccgagggagguuuaacaaggagggaugcuuuuacuuuuaauaauagcaucaauauuauuauuauuauuguuuagcuuauacacuaaauuaaaaaauugauuauuuugacaaaucuugaauuuuaguacaaucuuuagaaacaucaugucccugguuuguuuguuuuuuucaaagcaguaugccuaguacuuuuaucagugccauuugggguuacuaaguucucccuccauuuuuuuuuuuuuagacccauggacaugccuuucugcugucacuugugaaugcugucaaauaauccuuacauccuaauuuacauuugcuuauuucaaacuguuuguacuguucugaaaauaucaacacuuguuuuuuuaaaauuuauuuauuuauuuauuuagagauggagucucacucugucgcccaggcuggagugcaguggcgugaucucggcucacugcaaccuccaccucccagguucaagcgauucuccugccucagccuccccccgaguagcugggauuacaggugcaugcuaccaugcccggcuaauuuuuuguauuuuuaguagauaugggguuucaccguguuagccaggauggucucaaucuccugaccuugugacccacccaccucagccucucaaagugcugggauugcaggcgugagccacugagccuggccuuguuuuuuaaggaauaaucuuuuaacaguuaacucucggucccgauaaucuccguauaaucuuuggauucucauugcucugaggguaaagguccaaaucuguagugaauguguccuccaaggcaaugccuacucugcuuugcucugaccagcucucuggccaugcggacccgccuucaccgucauuccagcugagcaagccuuucgguucucccuuccuuugcugggacugccugggcacaucugaugacccugugacccacuccaguagcaccugcaugucuuguucacagcaggcaucaccacuguaguaaaccaauugugauuaugucuuuauuuaaugucauugauucuagcuuccccuucccaagacugcaagugcccugaggacaaggaccuuguuggucauagacugcugacccaccagcaucuagcacgauaccuggcacagagcggguggucacguguacuuguuuuugaugucauugugaggagauuuccuuuuccgguuuucauucaaaaccgucuugguuauugcuuauuuguuucuuacccugcagaugguuaccaagcagcuuuuugauuuuuaaaucuuugcagaagauuccaaaaagccccuccaaagaugacacaagccucuauuuuauugccuuucaaaauauauacacuuuuauugccaagggaaaauuuuugaagcuuggguauguguuagucuccagggaagcagcagggacggccagauugugagaguguuaguggaguaaugucugauguaguuuacugagcaauuucaaagcagaguaauggagguaaucucagaaauucuaagcagcagcguuguaaaugcacagagagagaguguugcuuucauuucauugaccugaaaucagcuuguuucccccauccuacuucuaauuuguuuuuauuaccuuaauauccugugucauggagguucuaaacaucuuuagaauaaaauucuuuggagaucuauaaacugcugcuuucuaauuucauugcucuuaauuauaggucauugaaaaugcaaaaaacagaaguaauguaggauaguagaaagagcuuuauacucagcaucggaggccuggacaauaguuuuuuaacuaacugauuacugucuggcugacuguuugcccuagaggaauccuuugacaucucugagccucaguuucucaucuauaaaaggaagcuauuagaaaugguauuuaagauuauuuauuaucucaguuuauacucccuccaugcaucaagcuucauuuguucacuuaacaaacaaggcugggcgcgguagcuuaugccuguaaucccagcacuuugagaggccaagucaagcaaauugcuugagcccaggaguacaagaccagccagggaaacguggugaaacccugucucuccaaaauuacaaaaauuagccaggcacauuagcgugcaucuguaguccagcuacuuggagggcugaggcaggaggauugcuugagccuggaggucgaggcugcagugagcugugauugugccacugcauuccagccugggugacagagcaagacccugucucaaaaaaaaacaaaaagcaaaaaauaaacaaauauuuauuguaugccuacuaugugccagguacucucccaggugcuugagauacagcagaguacaaacaaagccguguucuuguccuccuacagcuugcauucacgcagcauuugaagggcuuacuauuuagucccaauuuaugaaagguucugugugauuaaaggcuguggcuggagaauauguugaauaaagagaugggcaggguuggccaggcacgguggcucacgccuguaaucccaacacuuugggaggccgaggcaggcggaucacgaggucaggaguucgaggccagccuggccaacauggugaaaccccaccucuacuaaaagcacaaaaaauuaaccaggcuugguggugcgugccuguaagcucagccucaugaggcugaggcaggagaauugcuugaaccugggaggcggagguugcagugagccgagauggcauuauugcacuccagccugggcaacacagcgagacuccaucucaaaaaaaaaaaaaaaaaagagaugggcagggucauuagcaggcaggauugaaaagauuggaaagugaggcuccaucuuaccuuggcuggugaaaauggcucccucagggcauugcucaugacccccaaaccguccacagaaggaaaggauauuccugucccuagcccuguccagcuaccaaaacaacagcagggaaagggaggccgaggguagcccacuuaccucgccuugguaagggucuccccugcuguuggauuuagcuuccaguugugucauuucaaaugcccgugauccucuacugugugcaagacaaaaguacgaauacuugcuuguccagccaggccccgagccacccuccucccuuuccccuacauauguccacgucagugggcaagcuggcagcccggugucuccagcacauggggugcacccugucucaucugcaggccauuguguguguguucacaguucagaagcugacucacuaucucugccugccaacauccuccaccacacccaccucccaccccuauggucagggggcauggguauugaauggcagugccaucagagcuugccagcacccugucacccaauucucggccacugggaucagagauuauuucuuccucccugaaucucucagucccugcugcaccauccacagcugcgggggaagggcuggccgacguuuuugaucuuguuuuccgugccuaucacaaugccugucacauaccagauccccugaaauuguuuguugagcagacuguuaucauaaucuccugugauauuuaccacauuuuaccuuuugacaugguuauuugagaauauuuuuaaacuuucuaggucugagcucuuugauagcagggccuguguuuuauuuauuuuuuaaucuccuaaagcaccugguucuuggacuccaugaauauuuaauagccugaaauaaacagaauuuaauuccuggauaguugaauuugagagguggaaauaaacauaggguuuuuauuucuguuucucucaggggaaacugagucaaagaaaaauaaguaacucacaagcugaugugucaaccaaggcuauaaauccagggagaaauucagcaauagaagagcauuguaauauuagaaagcuuccagaucuccccacucaggaguauuuccuaccuguaacacacagauccgucguacaaauuaugcuuuguuugcugaaaagccuccugaagcugaauggguuuacuuuggcaucagcggaggccaugauugagggcggagaugagacauuggaucgcucuuguguggcuuccgcauggccgucgugguuccucugcccagcccucuccugcgagggacucgaucagcuccagggcgcagcuugugugucugcucccauggccaaguccccuuggcucccuuccccuuggcucugguuuggcuugacucugccuucugcuccucaggucugucuagguuuaguccuguguaaucauuugcagcaaagccugcccaugacuggaaaugcaguccuggcuuggcaggaaagggguuugugcaagagcuggcuguaccugugucugaaacaccugaggcccuuccagggcuagggaugcaagaagccuaggcuggcaaagcuggccuuccugccagggcugaggagcacuggagcccuagaaggggacugcuguccagccccuuggccagccagagcaagggccacuguagucaaacaugaauucacaaaugggaagagcaggaggugacucagauccaccucccccauaacugcuaaucauagugaauuauuaagagcauaaaaucaggaucuuguuucccacauagagaucaggcccaucagcccugagcaguuauauaauccaccucauacacguggauaauauugagacuggcacuuccaagcagaagccugcuaaauaaggacauguuuguuguuucuucuaccucaucaaaaugucuguuucuuauuccuaagaauggcagggaguaaaggauuauuuauuucccuugauauuuuucauuucaagaaucaacaugggcagguuuacaguguucacaaacaugcugguagcaauuugauugcaggaagaaugaaauuuugccaggcaagugcagauuugucuguuguggugagaagggccauccaugacuguacaaauggugccauucuacccugaagauacauuuuaacaaggauggugguaguaguuuuuauucuuuuguucucucagaugcauuccauuaaaauuaaagcaugaaauauauuaauuugaugaaauggauuuguuuccacuugauguguugcuuugugaaacguuaacauugucucuuaauguucaacagaacugaugacacugguccauguggccagcauggagggaaacaugauuccucugagagcagucuaauaauccgugucuuggaccugcauuacuucuaagaaaaacaaauuaguuuaacauauuucuagaaauggaaacucuuggauacaucagaaacaaauuugaauuuaggcaaucuaauuaaccuuuagcuaaaaauguugguauuuucacaacucuuuuggacagaguucguuguuagugguugcuucaaacuuuuuuuccagaucuuuuaucucuaaaaagcaauuuaugauuuuuuuuuugacccuaguauacugggaugucuuuucgauuugauuuucuuauauuauucuggcuccacuuuugugggaacuucuuuccuuuccucuuuugugcuguuggcucagugacccagccaccuuugugggcggugguggaaugugcuccgguugccugcugcccaugucggugugcccagagcgggagggacaucauuuugaccacagcacuuuggccuuagaaugaugcagagacuccaugucacugccuguuccucuugcuuuacucuuuuuaaaaaaagacuucuauucuuuccauuaaaguuuacucccuuucuagcuuaaggagucaaaucauucugcaaaguuuagugccaagccccagcagucuccuguaugccuuucccuuuuccccaccucccuccaccuuccuauuucuuccuccuuagaggcugccaguuucaacuguuugacaucugagucuuuggaaucauucucuguaucucuaaguaacauguucguauugcugcuccuugauuucuuuccgcuuuaaauauucuccuuugaccaugcaacgugaaauaugaggacuuagccaugucuucccuacccuaacaccaaaccaaccaaaaggcagccuuuucauucaucuaacuucucugcaguuagagcguguuuugggauagaucggugcucugcauuagguuauuuugacugaugcuauccacagguaaaauauuuaguaaacuguaauuaccuuuucucuuucacauaacuuuuucuucagucuuuuuuugucugcuuaguuuucuguaugcuuuucaauaaugcaaacacauacucucugcaaauugccugaacugacucucaauacauucacauacaucgcucuuuuuguuugaucuuuuggagaugucugucccagagccucugaccugccccugccuaggcaggcuguucuuuuaucguauagguauacugcuuccugugucuuccuguguauuauguuuuucaggcguucaguuggagggccagaaaccacacuagcuauuuuaaacagaaagagacuuaaaacagauauuaggugcuuucuaaauuauuggaagggcuggaggagugggcuugagacuagguuuccagcaaugcuccagaaccacacagcugcccuggccugccagggguguugcuuuaucugccacuuugggaugggagggagucaggaggccgccucugugacuauucacuucaagaacauucugcuguagcugcaguccaaggaucagaaccuuacauugcagcuacugccucuugauacccaugaagcuggugacugacugcuggaguacuuauagaacaauccaguagcccucuacaugccgaccaggagaacgagccaagcugcagaaugauggccuccaccuucacuucucaagucuuacuugaguacaucuaauuggagaaaccuaauuuacucaaggaacucaguugucaggaaggccaggaaaugugguguuuagcuuuguggauucuguaguacagaaaggcagaugggaguggaaaugaaugcugagugccauuccaccauacacaccacaccagggcuguguguguguguguguguuuguguauguguguguguuuaugggcuuguuuugauggacugcagacauuuuaaagucuuuuuuuuuuuuugagucacgguaucacucugucauuuaaguuggagugcaguggcaugaucucagcucacuggaaccuuugccucccaggcucaagcaguccucccaccucagccucccgaguagcugguacuaccggcaugcaccaucacgccuggcuaauuuuuuguauuuuuaauagagacaaaguuucacuacauugccuaggcuggucuugaacaccggagcucaggugauccacccaccuuggccucccaaagugcggagauuacaggcaugagccaccacgccuggcccagauauuuuaauuucugaucauuuauuuguagccaguuuuucucccugggacuuaacauuuuuuuaauagcuuauugaggaaaacuuuagguaauuauucaaggauuauuuaguaaauuuauagaguuuuccagccaccaucacaaucaaccccaaaaaguuuccucaugcccaugugcagccaguccugacucucugccagccccaggcagccaccuguucuacuuccuuuuuuugagaggggggucucacugcuguugcccagacaggagugcaguggugcgauccacuauucuacuuucuauagauuugucuuuucuugacauuuuugguaaauggaaucauacaauauguagucuuuggcauguggcuuuuuucacuuagcacaguguuuugcgguucauccuauuagcaugucucaguaguuuguucuuuacuauuguugaauaguauuguacacauuuuauuuaucuauuuaccagucagugggcguuuagauccuuuacaguuuuugucuguaaugaauaaagaugcuauaaacagucacauacaggucuuuauguggccauaugauuucauuucuuugggguaggcacccaggaguagaauugcuggguuguaugguaagcuuaugauugacuuuuaaagaaacugcugaacuuuuucuaaagugaccguacaugagcaauacaugaggguucuaguuucucuacaucuucaccaacacuuuguauuaucugacuuuuugaaaauaggcaucccagugaguuuguaucucguuaguuuuacuuuacauuuuccucuugaauaaucauguuaagcaucuuuucauaugcuuaguagccauuuguauauauuuucugauuaaauaccuauucaaauauugcgcccauuuuuaauuggauuauuugucuuauuauucaguuguaagaguucuuuauauauucuagauauaagaucuuuauuauauguaugauugcuuauauuuucuucuagucuguggcuugucuuuuuauuuucuuagugguaucuuuugaaauuuuaaauuuuaaugaaaucuaauucauccauuuuuuuaauggauuaugauuuuuguguuguaccuaagaacuauuugacuaacccaagucacauagauucucccauauauuuucuucuagaaguuuauuauuuuaucuccugcauugugcuauauuuuccauuuugauuuaaauuuugugugugacauaaggaaauguucuaaauucaucuuuuugaauguguauauccauuuguuuagaaccauuuguugagaaaauuaguccuuccccauugaauugccuugguaucuuuguugaaaaucuguauauagaacugugcagucuugacuauugaagcuuuagaaucuauuuaaaauugguuaguguuaaguucucaaacuguucuucuuucaaaauucuuuuggcuauucuacugccuuuguauuagaauaccaauuuugucaaucucacaaaaaugucuguuggaauuuugauaggaauuucaucgaaucuuuagaucauuuagagaaaaucgccaucucaauaguauugaguuaggauggaauuuauauuuauaucagagcuuggcaaacuuuuuucugaaagggcuagguagugaagaauuauuuuuguaagcccugcagucucugccacagcuauucaacucggcuauuguggugagaaaguaguguggacaaugggcuguguuccaguaacuauuuacgaaagcuggaggccggacccugggccucugacuugaucaucuuuaauuccuuucagcaguguuuuauaguuuuuagaguacaagucuugcacuucuuuaaugaaauuuauuucuaaguauuuuauucuucuuaacgauauugugaaugggauugcuuuuuaaauuucauuuucagauuguuuauuccuaguacauauaaauaugauugauuuucauaugacgaucuuguaucuuguggccuugcuaaaguuguuuauuaguucuagaaggcuuucaggaaccuuuccuuuguccuugugcguucugaaaccucacauuguguaccuugguguggaucuacuuucauccauugcaugggcugacuuucuugucaucuguaaaaaaacuaacaguaaaauuccuuucuugaguuuagggcauuuguuuuguggccucgucuuuguaaggaaggagaaagagcauuguuauguuauuauaccuguauugaaacuaucauaggaaaaauuuucaacaauaauagguguguuaaaacuuuaauaauacaaauuaucuguggauuucauuucuuaugccuguggcauaaauauaucaacagcauuaugagcagauuuguuuucuuaaaaaaaaaaaagugggauuaaagcacauagcacaugucauuuuucuguugcccugugcaugaaaauugcuugguggauucugcauagugagucccuuaacagcauguuucaacccugcauuucuuucauuuuccuucugguuuacauuacugauuuccucucuccccuucucccaguaauagccagcugggaaaggccuuguuaaagugaaggaauggaagagucuuuaguaagguaauguagucgugcuaauaacuucaggcacagcagguuucauaagggguuguucuagugucgggauucauggcaggugcuguggaguaaaccacgauucaaccucuggacuuaaguauguacauuugguugcacuucuccaucuuauuuuuuuauuaaccaguuuauucauuucuaagcagcauuuauugaacaccugcugugugcuguuuccuagaaaugcaaaggaaaguuagucccuguuaaggggccagcauuacauuuuggauagacagaaauaguuucuuauguugccacccagcugagcuugaggaacaggcugcgacucggcagagcagcugguuugaucagcagcugguuccaccauaugugcaggcuucacacucccacaauggacaguccugaccuggacuggcccucaggccaguguccuccaaguccaucagagcauucuggguggagucauugggaaucuugggcugucuucuagcuuauuccaggucuuccucacuauuggggauauguuaggggagaaagagcugcugcccgagucaggccuugcugaaccuauaagauugcuuugucacuuuuucccuucucuguuucgaaugcucuccuuaccuuuacucaauugccaggaaugagaacauuccuuaguaguguuuagguuuuccucaaccuauuagauaccuauuuuccucuuucauuuauaagcucguauaguacugggaccacauacaguauuuuccuauaacugugaaaucagcagcagaccagcauuccguacauuuuuauaauacaugaaaauuuuucaaaccacaaaccagagaaaaguaucucuuacaggguuaaagaaagaaagaaagaaagaaauuggccuccuuggagaggucaacaauuuauuaaugaaaucacaucuuaacaugaaaauaacaaaaugaacaucuuucuacaaagaggaugaauuaucuuuuucaguguccuugaagagaacaacuagaggagucgugcgggcugcagcaugggggccuuagauaagauauaaggaagacccucuagcugguggagagugcggaagcuugaacugaguuaugaagaguauguuagaguuuugaaauuuacugaguagauuuucauuucuuggaggcauuuuaaauacaguccucuugaaaggaauagauauguggaacauccuuggaaaaguccauuuuaaucucaaguacuagucaaaucuauuuaaaagcaaaaagaggagaaaaaaaucugcuuuuaauaguuaauuuuuguguaguuguauuaggaugcaaacugaacuugugcucuucaucuucagcaacugucuguuaagccuacaucauuugaaaaaguaaaaacagaauucugagagcacgguuagcaaggugguugguuggugaugugcauacuuuuuauuuguuucuucauuuuauguuaauacuaguuuaaaguuaacuuaguccgggcacuauacuagucuuacuugcguauuauaauuuacuugcuauuuugcucauuggcuucuaacuaaaacuagaccagcucagcaccuugcuucagacuauaucuccaaucgauuuucuguucugacuuuuuaaagacccccuggucuuuccauuuaucuguuucauccccauuaacacugauggacacaccucuaauucucaacccaguguuaccuucuauagccaugucucucuaaguacuccugugaaaaccaguccuauaaccuuugguauuugucagaaauuauuugauaagcacuaggagauaucuuuuuuucuuucaauaaauggaggcauuaaaaguccauucauuggaaguuuuuuuuuuaauguaagcaucauuagcuuuuuuuauuuauuuaauuugaacuuauauaacauaaagaccucuucauagccauacuuuuuuugaaaaaaagaauuuuuuuucaaaaauaguuuaucaaccucugucuggauucuucccaugucuauaaugcuuccacuguaggagaaucaauuuuauccuuauuuuuaacauaccucaauaacucugugguguguggcccuuagcaggacagaccugccucuuuuuucugaucuuugcagacuucugaagcucauuucuuacacacaacaccuguguaguucuuucuuuucaacggcgauggguaaugcguagcucucugaaugcuccuucucucuuugccuugguaacuuuacacaugccacuccuggcuguagugccuuccccauucccuuaauuucuacucauccuugaagauuuaauuugcuucucaucugcaaagucuucacagauccugccucugccccuccuuuuccauuccuauccccaacuccaggccaacaugaaaccuuuauuuguauuucugaaaugcucuguguaccucucuccggugccauugucaugccugugucauuucuuggucuccuuccuguugcccccacuagaugcugagcuccuuaaaggcaagagccaugucuuagucagcucuauauucccaggcuuagcucugaaaacauaauaaauguuuaguggaagaagauaaggaaauauguuguauaccucauuggaaguuuuguuuguuuguuauucccuaggcuuguuucaguuucacaucaacccagaggauaugagacuucauaaugguccugauggcacccagccauccacugagagcucauucucaggcaugcuggcaaagugacucagugauuuucaaaccuggggagcuggauaaaaaugccuguuuccuuccagagagucgaaugcaaggcuguguguggugccugggaucuguagacugaagcagcaccccuggugauucuggugcaggaaguuguuacccaccucugagaagcacugaguugggaauggagcccauuuggagucagcagcccaugcuggcucuucuauggauuccuugaacccaugagcacaugggcaccucggccuuaugcugcagugacuucucucuuuacuagcacagccugugcaggaaugauaagaggcacauauucuucaguucgugcaacagauguccuccugagacauugaauacaaauuaaaguuuuauagauggaccaugggauaccagcagugaauuauucuguaaguugaauagucacuucccgauuuauugguuguugagcccuccauuuuuaagaauuaguuuguuuaaauuagauuaaauguuucuaucugugguuuacauuuuuugacuguaugaauuuaauaauuuauuuuuuauuuuuauuuauuuauuuauugccacaggugguuacccauucuuaaccaauccuuaaaugggcauuuuaagguuucaguaacaacauuuuacugcaguuggagaaugacuuucaaagcuucagaagcccuaaucuaggggccauuucauuucuaaggagguucaugaucauugcccaaguaauuucucauuguaauaucuagaguccuacaagcuuaugagcuaacaacauuugcccaugagguuuuagaugcugaaauaagauacaauaggucugaaauguuaauaaaauauucuucagugaucuccuuucuuagucaacguugcuauauccucuuccugugucaacuccucagaaugugggcuuuccauacugacaguacccccaccaugcuacauguuauaggugaacaaucuaauuuuuuccaguagcuuccacucucuucuguggauaaauguuaguuugaugaugauaaugauagucauaaguuuuauuaucaucauuacuguucuuauucuucuucucuggaccucuguguuuccuaucaguaaaauaaauguggucagaccaaaagaugauuucuaagaugacuuaugccuuaccauuuuaugguucuaugauucuagauauacauuuugaugauuauagaugcucauuaccuuaagaaaguuaucagaagggaaugaugaacuauguuucaaaacauuuauuuucuuaauaacauggcuaacuucagaaugucauuaaauagaauauauauuggugcaacguuuauuauucauuuuccugacugagaggcugaggccaguaguaaaaacuuauagccaccaaauaucagaguuggaagggaccugagagagcaucuugucugucccugcuuucagaaaguggugauauucucaacccaagaguuauggugacauguuauauacaucaagauaaacucuuuuaagagcuucagugucauggaaacucuuugugucagcaacaucaaagcccaugauuuucuaaguggcauuucucauucuacgaugcacugcaaaauaauauugccaaaccgugaaagauuacacaucuguaguaccaggguuagcucaagauuucagagcaugccaauuagauauuuuuucccuuggcugguaaaaguaaaaaaaaaaaaaagaaagaaaaaaaguuagccauauaaugaaagaaaaggagaauuugugugacggugauguuguaucuuauuacaauaauugaauucccuuuaauauuuucaucaagugcuucauauuuagggaaagaauuauuuaaggauaauccauaauauuauagaaagaauacuuauguuuuaaaauauaauucgaccagaaaucuuugaaucuguuucaaagagggccauuucauucauaaaagguaaugacacuauucuaaugccaguguuugauuguucauuuuuuuccugugucugcagaauggauuacagauuccuugcauaaucagcaauccauuuuguuuucuaacaauuagccgguuauucauacuuucacaagaaugcgaugcuagcaugcuguggucuguuucugaucuuacacaggaaaaugacagugagauaagaguagaaagaugauuucauuugucuuuacaggguaauguaugggagauguuccuggauagucauauccuuuuggaaugaugaaguuuaaggauuuccguaucuggaauuuguauccauauaacacagauguguauaugacuuggcauaccauaacucccuuuuccagcuguuaugugacggguaaauuuugaaaauguaucuuccugccaaucucaguuuaccggauucuggucauuucaagccugaugagauuuggguucuugaaaagggcucgagacugacaugaaucccuuacacagaugucuucacagaaaccaguguuuagccauugccacuuccagcgacuguuucuugggaccacuugguggcaggcccacagucagccucccagcucgcacuuccugcuguuuucccucaugcagcuaucaucacucaccacuugcuugguccaccgagguuccuguccugugcguugcugcacugccuugaccccacucgguucucacuaccucacagcagaaccggccugucucccauugugcggagccccgccccacacuucauaucccugcuguguguccuucagcgggugacaguagcuaaucccuccgcuggauaccuucuugauuuucucucuaaacagcugcagagagcugagaaaacuccuucucccacugcagcaugucaugauccaguacuuagcuguuaguugccaccccagcaagucucagacccucugccaggcucuggaauuuaguuguguagaauguucuguacacugcccucggcaucucuuaaaggaacuggguuucugucagucaggaugacucgcuucaagugucaauggauaaugucucaugaaaaaauuaaaggcgauggaaaaauaugcggucauugcuucuaaaaagauaagguuuggauuuggaguaggaaauauauaagaaugaacagagcuuuuacaacuuuucuuuuuccuuuaagggagcuagauuucuaaucaguguuuuucaauauaguuuaauggcuuacuuuguggguuuaggauuuugagguucugcaucugaauucuaguuuugucauuugucauuugugugcccuuacacaagauacuuaccucucugagucucauucuucucaucucaaaaauaggaauaauacugguacugaccuugaagaguuguaaaaauuaaaaagugauggaugcagagcacuuagaauaguuucugacacaauaaaacuucaaugaguaguagacuucauuauuaucuauuuuauuauuaauauuauuguucacaacaccauuccaaaaggaguuaauuuuugauaaagaagcagaauuucuuuaauacaguuggcccuccauaccugcagguucugcauccgcagacucaaccaaguguggaucaaaaauauucaggaaaaaaaaugcaaguaaaaaacaauacaguauagcaacuauuuacauagcauuuacaugguauuauguuuuauaaguagacguagagaugauuuaaaguguacaagagaaugcgcauagauuauaugcaaauacuaugccauuuuauaugagggacuugagcaucuucagguuuugguauuugcaggguguccuggaaccaguccccugcagauauugagggaugacuauacacuacccaauuucagcucuacaccaaacucguauuuccagauguauacauguuaaguaucaucauuacauaauggaaaaaagaauaagaguaauauucagaucauuuuauuuucuccucuguaauuuuuuauuagaauaacuaguaacuauauguaaggcucaaaguggauuuguuccguauaguuuguguaguucuguauagcgcaugggacuggguuuguugcuacuaaacugaaaaacaaaguuggaaucuaaguccuguguuuauuaaaaauuccaagaaaaacaaggcuuucuuuuucaucuaacuuuucuagaaaauagacaaaucaaugagauccuauaaguaucauuguccuggaagaaggugaguggaaaguaaagagacucaauuuuuuuaucuuuuuaauauguguucaugauacaaaauugagcacucugaauuuucgcagaccuuucucccuuugcuguauuaaccucaaguaccuuugaauagucuugguacagguauauucuauuuauaacagccagucuauuaucugguucucuuccucuuccuguguuccuuucuuccugcucuuacugaucagaaaaggcuuucuaagcuagagugugagaguuacauguuaacaauaagugaaccccacugagggguuucagccacugagagacugacccagaagcagcaguagagggcgcucggccccucauuucauaauaguggagccugcaccaaacgucuuucauuugaggagcuaaaaaugaauugcacguauuaauuaagucuugccgaggccuuguuagugauccggugcuaagcgccuaaaauaaguagaucuuauuuuaaucuuggggaaacuggguauaagagggaauuuccugagacuccauagcaagagucagaauuucagcaaaaacccaggaauccuucucuuaccuuuucuugcucuggcuaauaucccaacuagcccuucauuuacgaagaaccaaagggaaacuccaggacuuuuaauuuccucuugaauaauuccuuuaaugaaggacauaugagauuuuugcuugaaguaaauguuaccagcaacacuguaccaccuauuuuaaaauuaaucccuuuuguuagauagcuauucuaguggcucuuugcuuuuaaccaacaaaggcccuuaagaaaaggaaaaugaaaaauaaauagcaguccuggaauccuauugccuaguguaggcagaucauauucuguaugaucuuguuggcucauauuauguggugauuagagcugggcuucaaucagcuggaugauuccccaaggcagggucuugucccaccagugcacauggugcgccccgucugacaccagggcgacuugagaauugagcccagggaagcugcaguguggugcagcagaugcguacuggugguugccauggagaucgcuaauacugcugaaacccaaagaaagggcauuugccacagcucaggagccugccugaaaaugaaugagaaacaaguggaauucagaauagucccccagcuccuuaucccacauggaguuuuaauuuccuuuucuccuccucuuccucuuccuuuuucaaagaauagauugaaaacaaggcuguguuauaaagcaugcucagcccccuccgaccucauugcugccugacauaucccuggaauagauguauauuaaugacgacgcaugacuaauaggauuggggcugggggcugguguaguggugcuucuggagccugugggccgcaugucacugggguuuagcaggcacgcugggauuugucugcagcauaugcgcugcuguuaaugauugaaaaauuaccacaacaauuagucauggaucgcugaaggcagggcccccaaaugugauggacaaugugauuaaauccauguaugugacaauuaacucuccugcagguuuauccaccaaggagggugcccuaggggugagagcaaaggggaaugagaaggaggaaaaaugggaaaacaaaaaggagcaggagagaauaaugcugcagaauggaucagauacagcuggcacuauugguuuuaaucugauccugaauuaaucacgguuugauuaauccugguuuuauugcaccuuucuguugcccauuuauuuauaucuuccuuaauuuuauagaagcaugacugauuaaauucugcccauucuguguuuuuuaaauuuuaaaaucaggucucuccauuuaaugugauguccuaggugguccaaggugcaauuaucucguaagagcuuagcaggcaccagacauagcaugucaugaauccccuuauguaucacagcugaguaacccagaauaaauauuuguuugcucaauauucugccuaaguaaaaagaagccuugugaugucagucugcuuguuuauuuggguggaagaaauaagaauacacacccccgcaacuuuguuaaauacagagagcacacauucaguauaugucacacacaaaauuuugugcauaaagaaaaaguguguuaauauuuggaugaaguaucugcaaauauauauucauggccuaaaaggguaauguuugcaguccauagauauguucauacguggaauuauuuuuaaccaguuuguauuguucuuguuuuguucucguuuagauguuacuuuugguguuaucuauauuugcauaccaaacacuacauuuaaauaaugccaaggagguugugacacgaaucagcacaagcaaaaccucaugcuuuguaacucacgcauguuggauacacugugugcauuaagaauacccugcuccuggccaggcgcgguggcucaugccuguaaucccagcacuuugggaggccgagguggguggaucacgaggucaggagauugagaccauccuggcuaacacagcgaaaccccgucucuacuaaaaauacaaaaaaauuagccgggaaugguggcgugugccuguaguccccgcuacuugggaggcugaggcaggagaauggugugaacccgggagauggagcuugcagugagcugagauugugccacugcacuccagccugggcgacagagcgagacucugucucaaaaaacaaaaaaaaaaacaaaaaaaaaaaacaaaagaauacccugcuccugauucaggagagggcaucuaaagcuuuagaaaacauugaauuauauuuacauacauuguuuuucuucuuacagcauuccugaggguuauuccauuguucuuguuuagggugaauuugguagaagacucaguuuuuuauuugcaggcuaaauuggauuaucuuuguuacuugcauuuuuaccugaucuacccaggcauauaaggauagauuuguuugugauguaggcagcggugucuuucaauauaguagaaaaagaaaauaaucagcauaagcaaagaucucagugcacaggccacacagaauggacgccgcccugcuggauaccuuuacacccuugcaucccuagcugcugauaucacuguguuuuuagaacaccacuccagaaacccagucuauccaugaaugauuuaggaaccucaggaucccuccuguuaccaaauuugugcucuccauguagccucccaauaaccagcccuucaguucugugaaggcaggaaaacacaucauucaugaauguccuucauacccaucaaacuaaaggacugcauacuucucgagccaucaucacauuuccguuaucuccaauggcacaugccgcugucuacauguauuaauuucugcuggggcuucaguaaccagggccagccagcacgguuuguucauuuguuuguucauuaaugcauuauuucauuuauuuauuauugacauauguugggcaguguaccggguacuugaaguggagaugaaggugggacacagggagacucacagucccaaauuuuaugcugaagguguguuguagagauaagauauacagucaugcaucacuuaacaacagggaugcauucugagaaacauguuguuaggcaauuuugucguugugugaacaucauagaguguauuuacacaaaccuagauuguguagccuacuacacaccuaggcuguaugguauggucuguugcuccuaggcuacaaacauguacagcacuuuacugaauaccguaggcaauuguaaugugacgguacauuuuuguauaucugagcauaucuaaacauagaaaagguacaauaaaaauacaguacuguuuuuuuuuuuuuuuuugagacagucucacucugucgccccggcuggagugcaguggcaugaucucuguucacugcaaccucuuccuccuggauuaaagcaguucucuaccucagccuccuggguagcugggauuacaggcacccgccaccacgcccagcuaauuuuuguauuuuuaguagagaugggauuucaccaugcuggccaggcuggucuugaacuccugaccucgugauccacccaccucggccucccaaaguacugggauuacaggcaugagccaccacgccggugcccagcccaguacugucaucuuacaggaccacugucauauauaaguagucugccauuuaccaaaacauuguuacuuggugaacgacaguguacaggaagaaccauauacaagguggaaauugacaaguaccacaagaggaaaacuaaaugaaaggauaugauuguuugcagauaggagaaaugacuucuccguggguacuggggaagguuuuguggcaucugacuuagucuuugaagagguucccaauucacucauagccaaugguugaaagacuagauuucuuggacaguucucaaaaagaguuggauaugcaggcuugaagagaaguauauuuuaggcacgugcaagaaugugggcguaguacuacuuuggacauaacaaagaaacaacuugauuugaauguaugauguagaaagagccuuuuggagccagauuacggaggaccuuaaaugcucagccaaggaguuuagacuuccuuuuauagucagugaguugagggauaauaaaagaggacagaugagaagacguugcaugaagcaugugcguuucagacuaggacucuccccugaccacaguccuccaaaaacuucccaugcagcuucagguagaaucucggcucuagcucauggccuucaaggcucugcaucaugggcaccugccuccuauuuggacaucauagaccccucuuuacuucccucacuccuguagucacacuguuuacuguuuccagcugagucucugcucuuacuggucucuguagcugaaauacuccuaccccagggcuuugcauggaugccgccuucucauuacucaggugcagcucagagagucccucuuccacucuuugccugucucccaaccuccaauuccccucucugugucccagucucaaguggcuugcugucauggaugccggucguugcuccccugauguuguuuucucccaugauuuugcuccauuagccauucuguaacucagggaaggugugccuauccguuggccaggggcuaaccugaucauaguaauucucuuauuaucagugauugguucauucauggcaugugacccagugagggaccaaugagacaugaugggggaaaagugucuucccuucugagaaaaugucacuaaagagauguugccucuuccuucccuccaaguugaagaucaggaggugaggucugggucugcugaguaaggacaguugacacucagaagaaggcagcccccggcgaacgggagagaaccaggauauggauggaacaugcccacaccuagacuucuuguuuugugagauguuaucuccuucucaagucccuuugagucguguuuucuauuaccugagugggaagcauacuaauugauguuuucuuuuauaucacucugcuuuauuuucuucauggcauuugucaguuggugaauuauccuguuuauuuauucucauguuuauugccugucuuccuuacuaucagugaagcuucauuuggacaggaacuuaccugucuuguuaacugaauucacaacuccuagaacugugugaagaguaucgguaggugaccaauaaauaguuauuggaugaaugaaugaaugaaugaauggagugagggagggaugaacaaaugaaagaaugaagugagggagggagauuaauguugcccuuguauauuuuauaaaauaucauggggagggguuggagagggcuuauggaaggccguugccaugccgaggaguucacagcuagguauugagagccugccccuugguuguugcagugcaguggggaagggccagacaaaagggaugugacaaaccuaacaggacuuggaacugcggccagaguggaaauggggagaggugggcuuaacuccugaggcugcaccaggggguuauugggaggaauaggauguaggaggaauagcaguugcaauacuggaaaacaaggaaguguauuuuggaaguguaggauauuaagugccaguuaggcaucaguguggagcucuagcugguaguugagaauguagaaaugaagacagacuacuuuuauaaucagaagaaaauaucccucuuucuuuauaaagauaaucaggccuggcaauugguacuucucuuuccuaguuauuaugccugacucaaaagcagacuccauguccaauucaauuuauguggccagagccccuguuuuaugugccuaucauaauaauuuguguauaauuccuuuauuagaacaaaaccaaaaccaaguaaagaccuugacuguccuugggucuaacagggcuaaacagagcuaguucuaagaauacuuagauggucagagauuagccaggaacuaguuucugagcagugucucagcucacaacagaccuccuucagguauucccuaucucauuacccuagcuuauugucuuccugccgacacuuccugcuuuccugaaauaccacuuuuauuuguuugacccaugagaacaggguugauuaaugccaauugugacuauuauaaggccuaguugacuugaguuagagaaugcuacaauguuuucacuugucuugucucacugcggcaucuccaggacauauaacauagugauuaggaacacuggcucugaagucagacugccuguguuuguauccagucuuacuagcugggugaccuugggcaaauuacuuaaugucucugggccucaguuuacaaauuauuguaaauuaauuaauuuuguguguguaauuaacugauaucuuuugaggaguaagcaaauaaauccauaucaaauacuuaggcaaggcugggugugguggcucaugccuguagccccagcaguuugggaggccaagaugggaggauggcuugagaccaggaggugaagaccagccugggcaagauagugagaccucaucucuacaaaaaauaaaaaaaaugagcugggcguggugguguguaccuguagucccagcuacuugugaggcugaggugggaggaucacuugagcccaggaggucgaggcugcagugagccaugauugcaccacugaacuccagccugggugaaagagcgagacccugucucagaaaacaaacaaacaaacaaaaaacaaaccaguaacaaugacccgcccccaccaacacacauacaauaaaacacuuagugcuuggcacauauuaaacgugaugucaguauuaaccuggcacacgaagacacucagucaauauguguggaauccaacugaaagagcgcagauugauguggcuguaacaggggcuccagauaauuucauuagccuaaccugugaccaguuacuauuuaaccuggcugucuauugguagcuuuuuccaauucuagauaaaauccuaguaugguacagacagauagguggugaucauauaucuuucacuuguaugaugcuuuuacagauuauuuucuuacuaucugaucucauccugacagcuaaucuugggaauagacaggaauaucauuuccguuuuaugaaacaggaagcuuaggcacagagagguuaaguguccuuaauaacucauggcagaagcaugaguagagcaugagccuccuguuucccagacccuggcuggagcuccccaucuguucaucccagucuaugcuaccaaugaacauagaauacauguccagaugcccaggcaagauaagcguucaaaccaccaugauucucucacaucgacugagugccccugucuugcaagugcggaacaaccagcaccaccauuaaaauggugguucguccagggugcuucccuggcuucccccaaauuagugcucuucgggcuguguauaccuagucugagcugccaugaguggccagaugguugugguuuguucauucccucuugguggccacaaagcagggcuucccaggauugcguuauucucccucugagccaaggagagagugcucaggccugcaggggagugagacagagccccaaauacuugcugaaagugccaauauuuuuagaagcucccuaucuuuucuugacuauaaaauauacaaauuauaaacaccaucauauauucacauuuauuuuaguauguaaaagcaauuaguuuguuuguuauguaguaaaauuauggcuucugggaauuccaucggggugaacccgugaaucuguauccuggacauacuugcaaugcguaucagccuguagucacuuuugcuuagguuaagggucuggccaucugagcacaguugguucucuguguacggucuuuucacuugucaucccuuuuuuagggaaacccuccuugggguuacaacauuuaacaugcugccuacaaaauguguugggugugugcccucuuucuuguuggcauuguuagauucuacucauuguauucaaaaugucauauuccauuccaggagauaccacagugggagaggcaacaugacauagagugcauuuuaggaggcugaagcaggaauugaguucuacuuugcuuuaguguucaugcguuugaccaggggacagucuuuucuugaaaacccaggacagcaaagucuccagauagucaucuaguuuuaacucccagcaggauaaaagcauuucuaauacacaguuguuuaucuuuuaaauuuugucaucuuucugauccauaacuucuacuuuuacauuauauauccacagaaguuauaacuucuuauaacaaaugcuguuacagcucaaaucucugcauaauaaagcaauugcuaaagcccugugcagugacccaguucaggcgguaucguguauauaaaauuccacagcgauuuaaaaaaaucauucugguuugaauuauuuuauuaacuccacauuacaacuuaauuguaugguuagguaacaacuuuaaagcaguuaagccaaaacccacacagccacaccugaauauaccagucucagggagauaccagcuagcuauauugaugcacccuguucuagcacaacccucugcuccucaggagaaggagaagggcaggaccauuggaagaguuagggaccuacggcccccuucugucaugucugugucugcacagaucuuuccaaagaguagauuauuggcuuaguguuaaccuggaggaauauuucuaguuggggugaugcagagcccuguccucagaacugucugguucacgauuuuuaucaacgacuuugaugaagacauguuuaucaaacuggcaguugacgcaaggcugggaggauagcuaaugugauuagugacuugaucuugagucaagaaaaucaugaucgucuaaacggaugcgccagaaauaacagggugaaaaauaguaaaguuaaauaugaagccuucaaauuagguuuaaaaaauuaauugcacaacuccagaguggaaagaaguggaggauguaauuugucacagauucaauaugaguuaacuuauaauaaggcuguugaaaaaugcaggcaauauuauagaaguacauauacagcucaaaaaaaguaagaacauggcgcagaacgcaucugguuuauuguauccgguguuucuuuucucuuccugaccugagauauacuaaaauucaaagauuaccuaauggcauaccuguuuuaguaaguuaagugcaaauauucuaacugcaaguugagauagguugagacaugugacuuuuggauaaacucuuugagguaagaaugacgguuucaagcacauuuugggaaauugucaaagaucuggaguaaguccugcccuuugcuaucuccuucuugccucucugccacucuguccccuucccucaaauaaaaacuucugcuaccacugucacuuaaagcaaagcuaccaaauagguggcuucuuuucugacugaguugccugcaaucuuuuauccuuccuccuuccuccuagguuuaacugcauggugaauuuauagugucauaauggaugucucuuuaaagcaggauucugcaggaucuauagaagacuaaaaaugaaaacaacaucgaguguguaugaguguguguaugugcacacgcauacgugcauuugugcaugugcuagucuguuggucgaagccauuuugcaaaauuaaaaaugaaagcacucuuuaaaacagucuuugcaguuagccugcagcacaguguucacuggcagcaggaaaaggcagugaguccuuuaugcacgucuuacaccucccuuucaacucccugucucuccccgcuggaaagagaaauauucuggcacaagcaucuucucgucucgguucagaacggguaccaccugccuccagagcccaggggagcccuccguguguuccugcccaggcacaccacauggaaauguggacacagugccaggcggacguguuaauaggcagggaagggggaggggauguguaaagcacugcaaagcuuuuagccacagccaccuacuuauuagcuaguuaaggcugcccaugguguugugaagggagagugaagacauggggcacauugcaagcuguccauuggacacagggcaaguuguaauuacuaccacaguuucuuuucuuuugucguuuuucuggaucugccucaguucauuguucuuagacuugggaaggggagaagcugucuccagccauuuguuacaaguagucuagaaucugugcccauuaaguugacucuuugaaagaaaacaacaauuugaugccauuuucuaucccgaggcccuuguccuuuagagucacaguccuauuuauuuauugcuugcauuuggcaugcacagcuucaagagaauuuccuuuuaaauuucucacuggucguuugagcuuauccagccuuucccugggaauuuggggugucagcaugcauucugacagggauacuuaggcggauuggaauggcaggcuguuaaaaagaccccccuugcuuccagauccacucucguggucugcucugugaugcuguauuuucacacguggagacgcagcucuuaggauggcuucuugcuccucccuaaguaucuguggauaugcuugaggacuguccucguaaguuccuucucagcaugaaucgguucaucagaggcuuucuugaaggaaggucguaccagaguggggacugggucucaugaaacggagaggaaagaagccgaggaaacaugcuuccucuuucuuagaaaccucagguuuuuauuggauaaguaaaugguaauaucuaucucauaggauugccagcuuacaucuuuuuuuuuuugaaucagauggaaaauaaauaaaugccacauuucaaaaagucuaggaagcacaaucccuccucacauuuuuauauuucugguaucaguauuugauaucaguacaauccauauuaucuuucaauuauuuuggcagaauuauuuuuuucuagugguaaauuacacagcaucuuauuaucucugauuugaugcaauaugguuuaacugaccaggacuguugcuggauuaaaugaaguaaggugaggcaugcggaacucuacaaaugcccacuuaauguuuuugagagugggcccuuuuuccugagguucauuaauggagagcauaaacauggagagagacuuggaauccugaccucuuaguggauuucuagggaugcucuuguccuucuuugcuuccuccagguauugaacacucgaaugccagguggugugcuagguacaagcuuccuggaagugaaggacacccuuauccccagggaggugagagucuaguggagacagacagagcagcacccauuugaaaaucacugugaugagcacugcaaggugcuggggaagcacagagaaaaaaaccucagcucaguugacguggggcuggguaggaaaagcuucaaggagggggccacugggcugaguccuaaaggacaaugauggauuagcuaggaaaguucagagucagcacuuuccagaaauuacaguugggaaaaucgugcauguucucauuuguaaagaagccugccuuggguguaccuguguuuccuccucaugacccagcucugguuucugccacagcugcauuggaaggaauugcuggagcucugacugaccacugcugccagggcccacaaggagccauacgcacaucuauccaccucugccugggacuucuccagcucuguaggcacuccuuggguccauguacaagagcauuauggaauggcagcccucaaauaaggagggaugggagcugguggauagauaccccaaacugcuggguucuccuucaagcugacaauuucuaaaaguauucagugcaguggauacuauugcucacaguagcaaucucaaaacacaccuuuaucguagcuuuucuccuuuuaucacucccccugcuccugcacucuaucuuuaugugaucaauucccaaaagacccaccuacaacaaaguccuugucuuuggcucugcuuuuggagcaacccaaaguaauucaguauugacuuuuuuucacaguacuaacuuaaagcuuauauuaggccaggccugguggcucauggcuauaaucccaggccaaggcaggcgggucaccugaggucacgaggucaagaucagccuggccaacaugacaaaacccugucuuacuaaaaauacaaaaauuaaccaagcuugauuguacauaccuguagucccagcuacucaggaagcugaggcaagagcauugccugaacccaggaggcagagguugcagugagccaaaauugagucauuguacuccagccugggugacagagugagacucugucucaaaaaauaaauaaauaaauaaauaauaaaaaugaauaaauaaagcuuguguuaaggagacuuagaauaugguauaaaacuggcucaacaaagguagcccaagagauggagaugaagaagaggaugagcaggugagggggggcauuaagacaaagacaaccagagcuuguggauagaagguauagcuguacaugcauuucuaagccugaagugguucauggaguaauuugaacggauucagggccugccaccaacaccagaauacuccaggggaaaaaggagacuuggaaguuugaaaugcccaguaaaacuuacaggcaauagcuacugaggaggcugaggcuagaggauugcuugaacccaggaguuugaggcugcagugagcuagaaucaugccacugcacuccacccugggcaacagaaugagugagacccugucucuaaaaguaaacaaaaacaaaagugaaaaacguucaggcaaacacauaaauaagugauuccauuauuucuggaugggccaagggggacauacagaaggcaguguuccaaaaguaaucauaaugguugaguugaauucauuaugcugugaaggaauuaucugguaaugguuauguggcauuggugcauuaccaaucagaaguuagaaggaaaucaugaucuuccucaucauguauuugcgucuaaucagaaucgugugaauauuagguuuuagguggcaacacaguccauuagagcuugcagugaugaugggaauguuccauaucugugcuguccaguaugguagccacuaaccacaugugacuggugaacuugaguuccaauugaguguaacugaggaacugcguuuuaagauuacuuaguuuuaauuaguauaaacugaaauagccacugacugcuuuauuggacagugaaguuuagagcauaaggaaaagauacaaaauacugaagucucacguguaaccucugggaaaccuggggacagucaguggucccagggugaaaaagaaaaggauaguuugcuuuacucugcaagccccagaagguccucacaucccaggaaucacaggaguggccuggagggugugucagagagaaaccuccuagcuggauugaagggcacagugaguuuccaaagggacucuguuguugcugagagaaugguauccuuagugcgugcagcugaaggccaggcagacgggggcacagcuguucaccucucugagggggccuggacuccuggggcuguguuugugcuaguuuucaggaaccccugugaaaaagccagauuagacacuguggguguucuggagaccugaagaggccccggaggagcccucccugggcacucaguugguggagaggagagaggcucuuccucccaaagagggagaaagcccauggccuuagcuauucugcuugaauuaguugaacuuauuggcuacuccugugacccugguacaugcaccauuuuuuucagcuucuacagaaauuuuguuucauggccaagucaguggacucggagcugccucuccuuugauguagcauugaguguggugucucacuuuucuccuuuguaaaaugggcauacuuugcucaugagauuguuuuaaauaagacaugagauaaugaaugcaaaugcaguuuguaaauguuaaguguuguuuuggaggcugacuguacaaaacuuaaugagggcauaccuuggucagcauuuuuugccuucucuuaggcuugcuugaucccuuaaauacucuaaugggaaauaggaaacuucucacaugaugcaguucuuaacguugucuucauacuguuaagauuuaaagugggggggacugggcuugaaauccuuuuuccuggggggcagugacuguggggcuaagaguauagcucucaggccgggggccgcagacuuucucuguaaagagccugauaguaaauacuuuaggcuucguaggcuuuauacugucucuguuguaucuuugucuuuuuuuagaucuuuuaacaaauguaaaaaacauuuuuuugcucaagaccauccaaaacaagcuacuggacacauuugaccugcagcuucgguuugucaacuccugcucuagagugcccuguccugcaggguggccaugagccgcacauggcuguguacauccaaaugaauuagaauucgguaccacugagauuucaguuccuuggcuggccacauuccaagugcccacuagccacauguggcuggugccuacugaacugggcugcacagacacagaacauuucccgcacucaggaaguuccgucgggcagcccugcuccagaauuagguggaauccaacuuugccacugcuaaccuuggggacuuagacuaguuauucauuauuucugaacuucuuuucccugcaacuauaacguggaaauuauagcauuaccucucucaaggauauggcaaggauuuaaugaauauaaagugcuuagcacagggccauucacacucaguaaauguuagcuauuaauagagaaacagaugcauuucuguuacuacucauuuuaguaaagcuuaacuuuuuauauauuauauauuuuuauauuuggaaaagggauuaucauccucacuacaggacaccugggaagucagagaugagguuuugguuuuagucucaguaguugaccagagaaagggaaguguuucccugagccccaaacccuguuuccacgcagaacaggucuguucuuguuaugacuuguuuuuauuuuagccuucuauucaggugaguucucacucugugguaauuucaugaaaaauuugugguaaaucuuuguucagcuuaguggugggguuagagauaaaaguuaucucacaggggagaagucuccaccgucagaacuucugaguaaaugauugcuuucccuuugcuugugaggagggauagccagugcuguauugauaagcuucucuuucaauacuaguauauuuuguugcugaacaacaggacuuuuaaaauauauuguuaaugagccaaaugugaugccaggaggucagcauguugagguguggacuuaagcuuugcauugcuuuccuucaucccccguggucagcugucagccacguuuccaucaugggaaugcaugcacaggccacaaggaguuaauccuucuguccuuccaagcaaaaugaucuaccucugucuucugugaagagagaucaugguuuuuaaaagcuaauaugauaauggcaguauuauuagcaaucucaaaugaaucuuugaucaguugaauuguuugauuuaccuacucauucaucagauuuuuugugccgugaacaucacacagaauccuagaagggcaccgucacugacagaaaugaagcugguuggauauuggcugcucauguccagggguauugaugauucuuucaaauaaaucucaaaguaagguaugcauaaaaagauaacacucagcugauauaacauugcuuauacagagaagguuuuucauuuguuugucuuucaguuuccacauccagguguugugcuguuucccuggaccuccggguucaucacacagccucuggugcaccuaccugggugccaacguuguaggaagaagcugucugcacugacaggcuuguggaggcgagcuaaacuccauaaccccaugacuguacauccugaagcagaguuagggagaaccagucuccaaugaccacugacaaaaacagaaucaaagugauaauagaaccaaccagcacuacaauuccuaacauauagugugcacucagcaaccauguggcagguaccaaggucaaaaacauaccucaaugauauguuuuuauguuuaauaccuacaacagccguguguauuuggcacuaucguugcuauucccauguuacccauuacagaguggaggccuagagaagauaauuugccugaagucgcacguuucagucaguggcagagccagauucaacccuagcuggucugagggcagauucuguggucuccccaacacgcauggguucucuuuuugucucugcacucacugacaucugauguagguacguggcuuuaauacucagggccuccucuggaaaaugaaugguuugaccagacugcuccaaagaccuuuggucauugacauaccgugguuuuuuuagauccugcagucaucagaccccucaguggcuuuacuugcuuacgucaccuggucuccaugaggacacaugcuccauguguguggcauguggaaaggcucaguaagcauugaugagcagacugacuuccauauuauccuguguuguaggggcauggaagcuggacucuggggcuuauucuggagaauauucucuccuugaagcaguguucuuugcuugaagauuauuucuuuuggauuuuacucuucaucagaaaguagauguuaugaucagcuguguccuuggauaaauguguuuucuccugugcccuggaguucaucuuuugcuuucguguuaagccuagacccuuuuuuaccucugucucucugaaucuucccuaacuugaucccaacuuuccccuaacaguagugauuggaaugcucaaacuucaaggaaaaaaguacagacauacauuagugauaauguucaaaaggcuaucguuagucagauuguaauucuguuccuuguggagaacuuuuucacugguucuauauauaugaaguacucaggcuuccaccaguucuaucagagcugaaggauuuaguagggucaauaucuacuauugcacugccuaaauauuucuaaucuaauguacuuauauuugauuccauggacagaauuauuugcucuguacuaauauuuggccauauaugaagucaucauuacaauguguucauauucaccuguucaugcucaaaugaauaauuuuacaguacagugcugaagaaaauauuguagauuuuuguuuauuugcuguagaucucuuuugugaaagagaauggguuuaauggagcauaagaguuuaguugggacuuguugaauuugaggugccucuuagaaaucucgugucuuugcagaacuucagccauuaucuuugguaaaaucacccaccuaacuucucuuucagucucuggcuuuuauuuggcuuuuaaauacuucauacuccgcauaucuaaaucugaauccaucauuucuuccugcuuuccucagacacacacauguacaugccuguuucuuuuucagguguucggauuucuuuuaauguuuucagucaauucauguaguaaauauuuauugugcucuuacugugucccagguacauuucuaggcacugggucuauagcagugaauaaaacaggccaaaauucuaccuuucuggagcuuacaguaugguggggguaggcaauccacaaggaaaaugaguaaauuauauaucuagugucaucaggucauaaaugauagagugaaaaugaaucagggaaggagaauaggaaauucugagugugggagugggggcagggguauuucaguuuaaaauaggacagucaggcugggugcgguggcucacaccuauaaucugagcacuuugggaggcugagguggacggaucacuugagaucaggaguuugagacuagcauggccaacauagugaaacgccgucucugcuaaaaguacaaaaaauagccaggcgugauggugcacgccuguaggcccagcuacuugggaggcugaggaacuggaaucacuugaaccugggaggcagagguugcagugagcugagauggcaccacugcacuccagccugggugacagaaugaaacuccaucucaaaaaauaaaauaaaauaagacaaucaucagaugccucacugggaaggugacauuugauguuucaauguuaucaugacauuugaauuucuccuuugauucucuuucaucuccagucaguugacaaauucagucaguucaacccuuguaauaugcuuccaucucuuuccuucucucuacgcacgacgccauuacuucaguucugggcuuuaucacucuuuccuguacaggcauauuagucuucagauaggccuaccagucacuagucucuuuugaauuugauuuuugauuauuaauugcugguuauuauuauagaaaguuuuugcauuuuauguauagugaacuuacguuggaauaaauagguuaugaaaauuuuauaaaauuguaauaaauugccauaguuuucuuugaaguugaaaagcauauaaugccaugcacauaauaauauuuuuuauuacgguauuauuuacguaaaauaaaagucuuucauuucaugugcaauuugaugaacuucaguaaguauauagagucgcguaggcacaauaucaagauacagagaguucucucacccuaaaaagccuccuuguggcccuuucgguugaccuuucucuucauccccaaacccaagcaaucacugauuuucuuuugucauuaugguuugccuuuucuagaaugucauauauauggacuuggauaauacuuagauguuuguguuugcuuucuuuaacuuuacaaaguauuucugagguucauccauguugcauguauuaauauuuuguucuuuguaauugcuaaguagcauucuauuguguagauauaucacaguuuguuuauccauuaaucagcugauggacguuuggauugcuuccaguuuggggcuguuguguauuaaugcugcugugagcauucauggacacaucuuugucugcauaauguguucauuucucuuguuucaauacuuagaacugggagugaagggucauauagggcuguauauuuacuuuucuaaaauauuguuaauaguauuuuuuaaagcaacuguaccauuuuguauucccaccagccugcaagauggcccccagugaucgcugcuuccuugggcuugugccaguaauacagucucuucccauauuuugucagcauggguuugugugaucaguagaguauagcaaaagaggugguacaucacuucugagcuuagguuguaaaauacacuuuagcuuucaucuugguugguuauuuaugcucucuugaaucauuugcuuuguuggggaagccaggugcuguauugugagcagccuuaugcagagacccacauagugaggaacugagaccucuggccaacagccagugagaaacugguacugccuacucacagcuaugugagugagcuuggaagcagauauccaaccaguuauaccuccagaugccugcagccucaggggaccucuuaauugcaaccucaagagagaccuggaaagcuacucaaguaaacugcucuuggauuccugagcaucagaaacugugugagauaauuaauguuuguuguuuuaagcuucaaaguuuggggauaauuuguuuacacaucaauagauaaggaauacaaggagaguuccaucuucuccauacccucagcaacauuuuauauuguugguucucuuuagcgauucuaguaguuaugugauggcacuuacuguguuuuuguuuugcauuucucuguugacucaugauguugagccuauauucauguuuuugauggcuauuuguguaucuucucuugugaaggguuuguccaaaucuuuugcccauuuaaaaaauugagucauuuuuauguuuucauuuuguguuuucuucccugaaaauuuguugcccccaucucuauaagagaugagaauccuuaccagaugcagcuaccauaauuguugcugugcagaauuaaguaagucuugcgguaacuuucuagcagcauuucgaucauacuuagcuuuaaguucuccauccccugcauuuuccuaaagugacgucgaguuaagaaucaugcgccauugaugguaauccuccagccugcacucaaaacguuuuccguaucauuaaucacuucccugucucuugccaguuacugaggguuccauaaacacagugcuuccccaugcugcaggaguccuuccccgaaagauaugagcguuucuucuucugcauaugccauagcacauucgucauuuucuuacauguucauauuuuauagucauugcuaauuuuuguuuccauuguaaucuuacccucuuucucgcuagucccuuuaacacccacugcuucuguacucaccagauaucacaggcuacugccacucuugugacaccucacauguaaguauaaagcacaaugaauuccaugaaaaucauauccagucaaauuagcagaauuuucauaacaccuaccucacggugcuauuguaaagauuuuuuuuuuuuccugguauguacauucuuuuugagguuagagaucuccuuuuacaggacuuaguaucuaacaaauucaguaaccaaacuucuugaccuccccaauauuagaucacuaaaugugcaaaagaacuaccguuaucuaggucaauaaaaacuacucauuuucuaugaaacgguaugugcauagauuuuaaagcugugaaaaugcaauaaagagcacaacacauuuuggucacuuaauuaaaugacuuuuaauaaaguaguaguaguuuaaguuucaacuaccaaacaacacuuugaauggugaaaacacagauaguauauugucauauuugaacgcuuuucuuuaaaaacauaauucuaauuuguguauauauuacaaaacagccuuacagaaagaagugagaucuuucuacagcacuuaagauaacucaauacaggacugauuuauuaagauaguguauauucgacuuuucuagcucaagagaugaguuaaaggauaaacucugaaaaaguaaaauguauuauguaaacauugauaaaauauuacuauuuauugcugguuuuauuuaaaugggcauuucuucacagcuuuaucuuaaguacagauuuaaaauucuaccagcaauauaaucaugucagcaaauauuuauugaguaucugcuauguauuaagcauuguacuaggucuguaaaugccaauguuggcaguuggcauauuuucuaugaacuuuauuuuguauucaacaaguauuuaucgagccccuaccauguucugggccuaguauuggcagugaauauaugaaaaugaguaagcugagaaucucauauuccagggagucccaguugcagaggcugauguggagaugcaccacugugcccggcuuucccugcaaucuuuuguuuauggaauuugcagaguggcuagaguguauauagccuuacacucugcagaccuugcuccugcccugccacccaccacuuuaggguuuccaauguuauaagcaugcccuugcgggcuggagcugauguuugccucugcuuuuccuguaauauggucuccauggcucacagaggcaucuacacauuuuuuuccuuuggauugauuuuuucugcuauggcccuguauucuguguacuuauuuaggaaugagccgcuuauuggccggugccuguaaucccagcuacuugggaggcugaggcaggagaauugcuugaaccuggaagguggagguuguagugagccgagaucaugccauugcacuccagccugggugacaagagggagacugugucucaaaaaaaaaaaaaaaaaaagaaaaagaaagaaaugagccacauauugcacuauguugcucucucauuacuuaacuguuggacaguugcuuuucauucucauuuauuccucuuuucuccacuuagaauuuaacauucuagaagguagggaucacaugucucuuaguacagugcucagugcagagcaacacuuaagaaauacugcuuuaaaugaaagaagggucugacaaaacauugauagaacaaaugucuuuugauguguggcuagaugaagacugcaguguaucgaccuccaagaggaauggaaagucaaagucgcagucucuauaggggaccuuaugucuaccccggaccaccaagcugggacuggagaucuaacuucuagcuguauugccaacuagcucugcgacauuggacaggugacuugauggcucuuagacuguuuccucauuuauaaaaugggagcaguaguauuagcuauucacggaguuguuuugaggauugaaagacaugaugcacagaaagcacccggaaugaaugaaggucucuuacauaguaggugcucacaaacguuuaacaaauuauuuauguuuuucucauaaagcacuacagauguaaugacaguucaaugacuuuauaaaguacaacaugcugcacaaauauuuuacugucauuugcuuuuauuuugucucuuguguuaauggcauaccccucuauauuaugaaaauaccaguuugguuuaaagacacaguggacagugucaugugauacaaugacagugagugccagcgcuauuucagcagcaagaauuauuggaguuccugucagaaguucaucuugggccacuauuggggccuuucaauacuccuuacguuguuuuucucuagcucuuguuuucuguuuccuccuuuuuuuuuucuuuuuuuuuuuuuguggugucaaguaggcuuugugaggaugguuuaaaauguaggguauauacucagaguuuaaauagucagugacuacuuguuugagucagguuugguuuuaaaaaguaaaauucuauguuuuagaaccauaauaccuucaaagaaagcagcagcccuggugaucauaccauccacccauccuuuaguucacaaagaaggcggagaacgcucaggaggccugccaagcuccuguagccgcaggacuggaauccgggucuguacuggcugcggcuucacacugccucgcuucucagcgggcuuugaaacucugcguguuuagguguccuugauagguucuuauucuuuuuguaucuuucuauugcuaguaagagcaaauuuucuguuugcacuguagagacuuauuuccuacauuuugggaaggugguccuccuguggaagggcaaacuccauuauuagguucaugcccacuaauucucuucucucucuuccuacuacccauccuuuccacuuggaguauucucuucuguuguuuccuucacaucucauccuucuuuaucauucccaugucucccuugcuguauugccugcacaaguucacauguuugaggaacgaaacuucaaacauagucuguaccaagaggcuuuauuauuuucuuuuuccucucucccccuuuuccccuagagcuaguucaagguguccuaauggucuaaaaugucaaaagaaaacuagaugaggaaaaagcaaucgaaaauaacucuauuacaagcuuccuuauaguucagauucaucccuuucuuuuugaccccuuuaaacaaaugaacauguuggccuauuucagggguaauugcucuucucuucagaauacaccuccuaaaaugacugcugugugagguugaacauugugggugacgaaugucugccagagcagagaacuuuguuguuuucccuccuucccucucauugccuucauuuucuucccuuuuagauaauaaaauccuuuuccaauuauagaaacuguagaggucaaaaugugacucagguuaaacccugugaaaacuguagccgccugaaauuauaaugcacauuuuugcuuuugagccaagguagugugccagcuggaagauguaaauuugucaucauuuucugccuuuguuucaucuuuucuuuccuuuucuacaucgucguaauucucaaacuuuauuguuuuucucuguuauucucuccccuugguaaaccccugugcucccaguggagccagaagaaauuguacauggggcuuugauauuuugccaacuguuuucuauaauuaaaagugaauuggaaaugggaacacuuccucuguuccaccgaugcuucuggggucuagucuaauagaaacauggaaaggugcaaaaaaagaaucuggagcuaggaagggaaaauggaagcuugcaacucaggcuaaggaguuccuaauggaacaucagcccuuuaagccuucggguuuucuguucuaaauuugcucuuuucuuugugucagaucauuagaaaguuuuauccaaaauuaaaccaguaauacugaggugguagcucauagagcuugugauuggcuugauccaugcuaauuaucuucucaguugaaguaaucaaaggcagagaccauaacagaacaauguggacucugagagacugguauuuaaauucucaugauuuaagcagaaauaguaaauagauuacaauuuguguaucaggccuaauuagucccuagugcagggcugauggaccaugauccuauaaaauauucaguaucacgaugcccugccugagcagcuaaccagcccuucacugucugaauauggaagaaagcuugucuuguuaaaaucaucucaaauuacuaugaccugcuuuuccccuaggaucccugcacaacucucccugacuccccacccccagcuaauucuucuacuuucuucccgauuacuacggccauauaaaacaauauaugcccuuuucuucuuaucuuuuuuuugguuggggguggaaggaggguaauacuccauugaguacucugcuuuugaauccguugaaugucucucuaguugcucugcacagagcacauugcuuaagugcgccauuugucacuucuguguuuuuaguugaugacucuaguguugauacuauaggaaucaguauaagauuacuuaaaaugaagccuuacaagguguucagcauucagaauauuuugucaucgagagggaggagcuuugggaaauuagugaauuugcucuaccuaaaagcuugacaucuguguagagcauacaagagaugagggugugcgugcauuaacuugcuacgggugccauaacaaauacugcagaguggaguguuuaaguggcagaaauuuauuuucucauaguucuggaggcuacaaaucugacaucaaaguguuaguagggcugguuucuccugaggccucuuuccuuggcuuguagaugguuacuuucucccuguguccucacauggucuuucccucuguguguaucuguguccuaaucucuucuucuuguaaggacauccaagucaaauuggauuagggcccaucuuaugaccucauuuuaacuaauuaccucuuaauuaccucuuuaaaggcuguaucacguucugagguccuggggguuaggacuuucauauaugaaguuuuuguuguuguuguuguuucuuucuuuuuauuuaauuuuauuuuuuuagagguagaggucucacuauauugccuaggcuggauucaaacuccugaccucaagcaguccucccaccucagccuccugaguagcugggccugugugcaugcaccucugcacccagcugugaauauauguuuugagggggcaugauucagccccaaauggggugaagaagcucuaauccuguuacugugaacagcauucaauauaaaaguaaggcuaacucccuuauaggaugguacugagacuuaaaugaaaucucguguaugaugauuuugaaaacuccaaaucccuacuuauaagaaugguagcaucguuaucauuauuauauaaaauacaacaauacauauaaugaucauuauaauauaaaaaugauccuguuugaaaugacugaguccacaugaggaaagagugaguuugaauugauaacuguucccagagaaacuaguccauguagagaaggaaaccaagauguuaggagcaggccaggggccagcaucguugcaacucuguugaguuuggagcuguucuaaaauagugaaucuuuuugccaggccugaugagaaugaaaaucuuaaugugggauaaaggacaaacugaacagcaccuacaaugauuggcugucauggauuaaaugucagaaaaaugaguaaaaggaacauuggguguugauuucauuaauaauagaaauaaaaauguuucaacaaacaucauuucacaccuucaguuaaaagccuguauuaacuguuaucaugguaaauaagauauuuaacauggaaaaugaaugccaaugguaucauucaaacuucuuauaguucucuaaauauauguaaaauauuuuccucaauauuguucugacugagagcaauaaauguggguaauuuuauuauucuuuuauuuuaaauagaauuuuaggaaauguuuauuuuuaaaauguaauccuuucauuuauucuccucuacccuaaauaaguaauucauuaaccuuucauuguaauaggagcgugagcaucugaaggcaauuaacuguuuuacauuaucauucauugugaauaaacaaauaguuucacccucuuuccccagagagcuauaauuuagggauuguguagcuaauuauacaacucuagagccaguuuugagagggauagcuaucuucucugaucacaucugcuuucaccuacugugcugggggcccuggggaauggaagggacucucuagggguguuuaggacuuacauauuuguugaguuaggcgauuugauguuacuugugguuucauugaauggaaucuaggacagaucuuaaaggauaagaaaugauuaaaauuuuuuuucaucuuuugguguucuaaauuggaaacacauccuccucugaugguaaaauagucaguucuggauuaucucaaaagagaagauuauuugagugguagaguuuucaggcuccuuauuuuuuccuuuuauucgugucacuaggcuuuugcuuguuucguuuuuaagaguuaucguucaagagcaucagcggggaaaggaaaugccagggugaaucagaucggccaaguuaaccaucugacugucugauggagcuuauuuuacuuaucauaaaacguaaguguuucuccucuagaguuuaaguugcuugagggaggaaucuguucaucaccgugucucuaacaccagcggagugacugcacgcaccagguacucaguagauguuggcuaaguucaauuguugaauuagauuuaugauccauguauuuuuuuuuuguuuuuaguuuacacaaaaaguagaguuggcuuuaugucaccuaugacuaacuccucuauaccuccucaaagcagcugucacuuaccaccagcauuuagucacuuuucagauugaauuccuguuucuuuacagcaggauaggagcaugaagagaagguuaagauaucugaguuaagacgagggagcuccuuaauugaauugggaaaaccuacaacauaaauuaagcaggaugcuagaaauugaaacaaggcaguugcauuuccauugaagccaguagugccuuuuuuuuucuugagauggagucucacucugucacccaggcuggagugcaguggugccaucuuggcucacugcaaccuccgccuccuggguucaagcgauucuccugccucagccuccugaguagcugggauuacaggcaugcaccaccacgcccagcaaauuuuuguaucuuuagcagagaugggguuucaccauguuggccaggcuggucacgaagcggugcccuuuucuuguuaaaagaaucuugggcgaggcguguaucgaugaaggcugcaucugaccuuucacuggcaguucacuaacuugguucuggccaacgugugccuaccccaaggaaccugggagaguggacauuuuuuucuggaugaagucuuuugggaguagaaagaagggaagcaagucagauaguguggugcuucccuagugguuuuauuagggagguccagacacauguuuccuucaugagacgcagacugcacuuuaguucccuucagugcaggacaugagugaauuagggcaaugcaaugaaaaggaaagaaugguuagaauaaggucagaagguuugauuucuguuuucagauuuagcacugcuugggucugugagcuuggagcaagucauuuaaucucucugggcccuaacaugcucauccaugagugaguuaaauggauugacagcuaaugauugcugcuccuaauucuaugcauuuagaaaauucaaacuucccucaaguuccccguagaguucuuaccguuugcuguaguuugaacuucaggaucauugucucccaauuugcuuccuuuggcuuggugauaucauugccugcagaaauagaaaacugguacaaagccauuuaucuaguucugugugccagaauaucuuugaugagaucauaagucguucuuuuacuuuuuaaaacuaagugacucaaauaguagucacuaacuacuuaaacuuuggguacagcaauggccuacauuuccuguuucuuuuguguugguuuucaacugucccuguaugguugcugccuuuucaaugccuucuuucuucucucugcauacauuaauacaaggggcaucugaaauuucagcagaagcaaaugucaacuguaccaagcugagguagcaauucuaggggugguguccuuuccaaauguguuguuuuaugaagauauaaguuuuacaugauucuucgugucagcaguuuugccacuugccaucguuuaagaagucuauuggguaucugauccuguucucuauuauuucauugugcugccucccucucgcccucccucccucucucccuagaaaacuuuauuuucucuagcuugggaaaaugugugugguacagugagaaauucugguaacuuggguacugcguuuucuucagcuucuugagaaaaggcugcuguggaggcugggaaaguacucauagaaaugcagcuuuucucccaggcugcaaagagcugcccauaugguucugucgaagcagaauggagaccaaauaagacuugaggaggaagacaccacauuaguaagcaucucuccuggaugacugaagggaaaucaaggccagccacaccagcggaggguggggcaaggccaggcgccucagaugcagcuugcagaggagaggccugugcaguuaccuucaguguuuuucaucagagcagguaaacugcaggccugucugguaccaggugcuggcuaaggaacauaccaggguaccaugguuaaggcacggacucuggaguuagacaaaccuagguuuaauugcuaagggagucagagugcuuugguuguaagcuguagcaccaauuuuugcuaccuuacauuuuuuuuuuuuaaaggagaggauguauuaaaaugacacuggauaauucacagaaccgguagaagaguugaaaggauaaaggauaagaagaggguaguucugguauuuaggacagccacuugaagguggugccacuggaaugacuuggaacaaaacauuuucuguccuugugacauuccagucaagcuucaaauccccgagagagagagagagagagagagagagagagagagagaugccaggucuggucuuguucuuguuuugggagauggggcuagaagagggaaugcagugauuaacaaacacaagauucauucacccagagaaaacuggacugugcuuaucaaaagaagggguuagaguugcuagacagaccaagccagcagauguaaacaugauaugaaugaacauugccacucgccaucuaguaucuaaaccucaaagaguuuaaguaguaucgguauaccucagccuuguacuaagguaaacaaaggacauaaaucuaaugaagaaauaacaccuauuucagagauaugcucacugugggcguauugaaaaagauauugccuguaaagcucuuggcauaugcuucaugguaaguucucaacucuuagcuguguuaauuacauuuucuuaacagagccauuaacugauaggugacuacacagcucaguuugcccaggacagucccaguuagugccuuuaaccuuccuaauuagcauugucuugggguucucauuuuuuuauuuuauuuuauuuuuauuuauuuauuuauuuuugagauggauucuugcucuguugcccaggcuggagugcaguggcgugaucucagcucacugcaaccuccaccucccggucuagcaauccucauggcucagccuccugaguagcugggacuacaggcgugagccaccacacccaucuaauuuuuguauuuuuaguagagaugggguuuugccacguuggccaggcugaucuugaacuucugaccucaagugguccgcccgccucagccucccaaagugcugggauuacaggugugagccaccacgcccagcugguuucucauuuuuuaaaauaaaguaucauuacggguugcauuaaaauaugccagaaugggcuugauagaccuuugcuuuguccuuugagcuugccugccccuccagucacaugugagaugcgugugcagugagcagaguucucagugaaaucuaaaucuguccagcaaugacguucuucucuucucccaggccuuucacagugcagcugagccaauaccuccuugaaugaagcaugcaggugcucuugauaaaacagugugcugacacaccaguggcuggggcaguuaacuccucccaguccagcauggugugggaguaguauuugagacugcuaccccagccagccuuguggucucucagccagcugugccguggaucacuccauagcuugcaaagugcaggagccacuggccuuuagucagaugaaacagugagaauuauagcaauuuauucguuaaaauauguguuggagagaggcuuagccauuauguguuagaaccuauagaugcagagaauaguuuggcaugcccuuucugcaaggguuugucacauuuuauaggguauacaucugaaguuauucauuuauuuuacuuuuugguaauuuuuaaaauuauuuuucaauaaacccuuuuggucgcaauuacucucuccccaaaagcaccuuuuaaggaaaaauggauuacuggauuugucaagaaaguugauauugaacguguaaccugucaauauuuaccauucacauaaaagucagaacaguaucacugaccagauuucuaaaagaaagaaaucuauugaagaaggcuucacaauuuuuaaaauuuuaaacauuucaaagaugagcauguaagaaacacaaugcagcauuuuugcauauuguuuucaaagaaugacuuuucauuuaggugagacaaguaacucucaagauaauuucauucuuucuggaguucagguuuucucgcacacauguaaaaauguagguauagcuuuuaauaucuuggcucaguuagcaaaagagcuuuacaaacaguuaagugauccugccaauuuuauaucacagccaucucaucagauacuucaaauagaaaaucaguuaauucgaauuuuuuuuuguuuuuuuccaugugauucaugggauaagaggaaugcuuuuggaaguucauuuugucaaagguaacacaccugauugugcgugugauuguaaauccauucaaaaagcucaauguuuaugaucaaauuauuuauuuuuguagugaugauauaugaaaacuuuuauggagaacaauguuuuaauaaaaacaacauccucacuaaauuaagaaaaguguagcagaaauauaccuggauugaugguaagauacauguguauauaauucauaauuuaaaaauuaauaaaauauauaaaaauauuuuaagaaaauaguaaauaaaagauuuuauuaaaaaugggaagauguaggucaaaagacaugaaguugcaguuaugaaguacaagucuagaaauuacagcacaaggacuguggucaauaauauuauaucauauacuagaaauugcuaagaguagauuuuagguauucuuaacacacacacacacacacacacacacacacacagagagagagagagagagagagagagagauaacugugugagaugauggcuauauuaauuugccuggcuguaguaaucacuucacuauacauuuguauauuaaaacaucuuauugcauaccgcaaguacauaugauuuuaaaagaaaauaaauuaauuaaaauauuuaaauaaaauauacaaguauauaauaugaaauguauuuuguaaaaucauugaguauagaauguacauauaauugauaauuguauccaaacgaguugugauauuguacucuuagaauuagaagcugccauuguaaaaauguacagauauuuauaucuuuacacagaaugauugaacuacagauuuuuuucaauacugaaguuaaauacaaaaacacaccucacugugggaagaacacacuugcucucuuugcccccgucauugaucagauuuuagaaauaugucagccuuugaaaaacuucuuuguaucucacuguaacuaugcuacacugguaaugaguguaugaauccuuuaaaucuugucugcauuuuugccccaaaucaaguggaaaucuuaaaaguauucaauuacuggaguaucaggaaauucagcauaggcagguuuuagagacuugccauuauuaaaaccacagccugccagcuagaagauauugccguauuuccucacaaaagcagaguagggagugacaaauuauaggaugagggcccaaugguagguacacaaaauuuaauuucaaaauuguauaauuuuuccuuagaacaacuacguuauggaaauaauuuuuucaugagacuucuguauuuuacuggauaaauuuuuauucuauaucacaauggaaugaaguugaaaaggcuuauaauauugcaucauccacauuuggucagauauucaaaagaaucauaaagagagacaauuaauaugagagcuugaucuugcuaaaguuuucauuaaagaccuauacacugaguggaagcagaaagauaguuccuuuaaaaauauugggaaugaaauauuuaugcuuuccaguaaaaaaaaaaaaaaaaaaaaagaauugagaacauuuuccuuugguaggauuugcucugagcuuaucacuuacccuuagguguuuucaaaaauuaaaauaguguggacuuaacagaaacauccauugaagacgucaacaacuucaagucgcacaaaaugcaacauuaaggaagagacaaaaauuacugacaccaagcucguaucaaacacaaauacuuuuagagaaauaccaggacagaauucaaaacauacaguuacaaaacugcucaagguauguaaauguaugccaagaccaauuacuauuuauauuacuuuuaaauguuuauaauuaacauaaagaauguaaagaauauaaaguuuuuauauuuugccuuaauguauguggacuuuuauuuuuucuuuuuugacauagggucuuucucucuguuaccccggcuggagggcaguggcacaaucucggcucacugcagucuuugccaccucagucucccaaguagcugggaccacagaugcaagccaucacaccuggcuuggacguuuuuuaaagaaagauuuuaguuuugaaaauaguuucugaauaagagugauuauauagauccaugauuaugagaaaaccaguuugucagucaauaaauagacauuucaaaauaauauaauuuuaauuauuugugguaccuacuuucacucucagaagugucuuggugugaaugauaaauuauauggcuauuuuauuaauagcuuuugugaaucuuuagguuuaaaacaugguagaauucaaaacgcugagauuagauggaaaaggcuuggaggcccagcagcucagucccugggagcuuccuucgcucuuccagauugauacuuuaguuccuguugugccuuagugguuuugcuccaccaugacccccuuucuuaauugaguagcuccacuccaacuuggacaguugucugucuggcaaugguccccucacuguggaggcaaucacacuuuuagccagagaauuuuggauuuaagagaagaaagaguacuguccacaugguccugaagcgacauacauccuccucagcugacaggauuaagagauuaaaguaaagacaggcauaggaaauuauaaaaguauuaauuuggggaacuaauaaauguccauaaaaucuucacaauccacguucuucugccauggcuucagcugaucccuccguuuggggucccugacuucccgcaacauacugucccucuucaauggcugaagcuauaggaugcgaugccugagagcauugaacaaucauguuucucaacuuugcacuugaggagcagagguagccagucugcaaacagaaaaggaagacagcagaugcagaaugaaaacaguauguuugauauccagggugugguuuuuccugagacuccccuucaguuccaccagcuauuauaauauuacaaacauuuuuauaauaaauuaaccuuuugcuauuguaaauuuaaguuuacuugcuguuggcagccagaagagucuuuucuuuuccaccugaguuuuaagcaaauuaagacauugaaacaggugaaggaaagagaaugucagcuuuauuucuccucagcugauggaaucacauggcuuugcaucugcaucaagaggaccugcucucccucccuccccuccagcccaaccuggagaaugguggggucugcauaacaagcauagucucucagcugucccaguggagagcagggcaagaaagccuauucccaacuucaaggucuuuuaguagaucagcuccgccucauccagaaauauggaccagcaaguaacuugcuccuccuagggaguacugagcuccuagcgggacucaguaaagggcaggguguggggucaggagagucacucuaacggaaguuuuuuagcagagagaaaacaaggccagcagaauagaggaaccccacugugaguugaaacuaaaaccugaaccuugacucucaagauuugugaaugccccacuguugguccaacauucaaaugggcagcuagagagaguggggcugggcacagccucuuaaccaccgaauugucuucuguuuacaauucugcaggcuccuuccccauguuuugguugggaucagugcagaagcuucccugguuugucucuagcaccucccaccacugccuaagauuccagacggguaucacucuguggacacccagcauauacaaaccuucauaacauuacacgaagaugcuuggagccugggaaggaucugcuuugaggggaaagagcagauuuagcuaauagacauggcaacuggugagaaaggucaucugcuucagugguugaucacugaggcauucaugaaaacagcuagauggagaaucgcucugaaaguucgugaacaauaagauagcaggggaaaucugacuauaacaguaaaucuucaguguugcucuuggcaauccagaguuuuucacagagagaggcuaagaggcuaaccauauauuuaaagacugcccccuuuccuggauacaugucuacuguaaauggcuuugauuuuucaacauaggaugacuuuuuccaguuuugcacauuugagugcaugcacacugcuguuuggaguuuuagaucuuucuaaaauccgauucacacagacaccuaaccucuuuaaccccuuucugccaccuaccuucucugugaauacagugcuugcagccuuucagagacagagguuucagaauuuggcagcaaaaaaagugauggcuucuaacacauuuacagugugguuaacaauagcaguugcugaacucugccauggcugacuagcuuuccacuguuaaguguggucacacugguaacauuuacuuaggaacugggcacacgaguuaaaauguuacaugcacaacccauuugggguuugagguauucucuucuacauacguuuuacuuguucauaaaaaggaagcucuuuaaaaaaaaaaaaucugauguuuagcuccuguugauucguaauggcugagaaggaguuugaagcauguuucuuuucaucuccuuucagcuuuuaauuuuuaguacuuucacuuaugucuguaaaaagcaguuaaaagugaaaguccccugacaggaguguguaauuggcaggcugggguggaaggcaggggcucaugauggcuuuaagagaacgugaagaggaagcagagcuguucauugucaaugguaauagcuuuuaagagaggcagaacuuaugauuugagcuuaauuucuaaaugaagcucauuuuccagugucccagcccaccucucaguggccucccggcuagugggucagacugcggacacgccaugauggcacacagagagaagaccggagggagcagagggacaagggagaagcagagagcaggggagaagaacuuagagguguauaagaauuuguuuauaaguguguagccuguuaaaaccugacgauccaaaugggauggguggccagagcuuaugccccgagguaggagaagguuucuuuugcuucucaauuucagaaugucugguaagcaagugauugagaguucuggguuuuuauaggcaaauagagaaagggaacaaggcaugaaguuuuauuaaagcaagguaugcuucuauguuucacaauaaguuauuaaguuccucuacuuauuuucuagcacugcaauauauaugcauauucuaauggggaguuauuaacucuuugaagagaugaaaggcaaagaugugaaaugucugggaaaacaaucaagucagugauauaaaccauuaagugcagugugcaccaagagaggaauuuucaccaggaauguaggugauccccauguugagaccuaguauaguuuuggaugccacaucuccgaggggaucaucccccacguggauuccucucaucagaaucuuucuuguagucuuuguccuaauuuauuuuuuguuaccauuggaaucuauaagaugagcagauaauucagcaagaaacaagcucaagugagugaacacaugacagcagggacugaaccagagggcagaaugcagagaggccaggagggaaucugugaauuagcaggagaucuucuuggggaaaggggagcagagugcuggcagguggggcgggggaggggcugaagcccucccagcaguggaggaaagcauggguguacccacagggagggcacaggcccaaaggguacaggacagaagugagaccgaagucugaauugaaggcccugaaagguaaaauuaggagauugccucugguggcaacuaagagcauguauguucuugggcauggguuugagaggauucagcaagugacaggaugacagccaggcagccguacgcagggcggacuggaaugggaagcuaucccgcacggagagguggacagaauuugaaucauaguacuaucauuggaaaugagggggcacugagaaauggagaagacuuucggaggaagaaacgacaguauuuagugacaaauauaaaggaaggagucagcaaacauuuucuguaaaggaccaaauaguaaacauuuugaguuuugcgggcuggucuccaguugauuuuugucacuauucggcucugccaugguagugugaaagcaaccagagaaauacauccaugcaugcguguggcuguguuugccccaagggccacaccauaguuugccaaucccugauagaagggaugaaaaaacauuuucaaccuuagagaauagacguagacauuagguaaaagcuguuaaccuuguagccaagauuucauuucacccaaucagaauugcugagaacacugucuuccugagauacuaaacuuccagcuuugcccagguucuccugcccagcauuccuuggcguggagcucgagggugacacuggguuugcguaugcagauaagagaaagggaacaaguuacaagguuugauuaaagcagcggccccuccgucuggugaauggcuccuaguuuacaccacguagcugaugaaaaugucacaaagaaaucucgugagcacacuggggaagugaguuguuccugguaggacacaguugguccugguuuuuacaauuccagugcagcucggcagacaaggggcagacucgaugggcauagugcaggaaaauggguucuuaaggguaaggcgagaggucccagcuacuugugaguggcuuacuuuuccaaggagucgauaaugauggagaaaaggauguccagagggugguccaucuagcuuggcgccagagcgggagagcuguggaagcucagcaggaaagacugagcguggggacuguggucucugcagaaagugggugguuucuuuauggggauaccugcuggagugugcugguuuuuaaaaaacagguuacugggaagagcauuauccacaacacaacaucuauauauaccaacacauagcauaugcacacuccucuacauguuuauauauacacaucguuucugguuuauuuuccucuuacucaaaauacauuaugucgcccaauuuuguuuucucauuuaauguggagcucuuuauggugguguuaacuguaauuuuagcucuacauuuugugaggcccgccaguguugggcuggggauuaaggagagugucaucuggauagauggcaagaaggcagcaccgcuagauuuuuauaggacaaccaaaggcugggguuuggagggguuuuuuguuuguuuguuugguugguugguugguuuuugcucccuuuucuauuuaaacaaagauuuugccucauuucaaauuuuuuuuuaguucagugauucuguggauaucugcagagugaaacguuacauuauuuuuccucagggguggcagaugaguuagucgaccccuuagggaagacucugccugggucgaccccuuaggggagaugcugccuggucccuucgcccucucccugcagggugccauccuggccugccuccuuccaggcaaccccaacagaacugcggagcugaagcagccucuccccuucagaccucagagagcauuugucugaccgugaguuccgccgcagccuggccugucuuucgcccuaguuagucuuuaagcuccugaaugcccgccgcacgcccagggcuuugcacacggugggcacacggugccuuuugagcgcgggagaggguugugagcuguuugugugcggagccugugucucacucaucuuugcagccccuggaccugcuagagagcuagcacacucaccagcgcuggccgcgugagaagcgaguacgugagugcugacacagugaugagcuugaccccauauguaguagaacggguucccagccuugugucugagccccacccaccccccucuuguccucuuguccuuuuggggauucacugucagaggagaugaccucaggaaguuaaugagccaaugagagaugagcugguauuuauuaauggcaggccgaugccuaggagugccugucugugcugggcuuuaccgguaugcagagaugcagccccccagugggcuugaugugagaucuccuccucucccucccucagcagggcuugcggggauccugaggaucagagccugaguugucucccaugcuugagcucagaggggacugagcuucccuucucucucaagacacaggagggagaaggagaggccagauggcacaagugucccacacuuucaccccagauugguccaacguuuagucaaaccagcacaugaaugguagagggacagaaguaagaacaagaaagaaugauagaugccaagaugaagauuuuguacaugagaagguauuuaagggaucuugcaauuuuccugcaggagaaaaagagaaaaugaggagaaggaaagcauuugugcuguaagaacuaaccuauaaauuauacuuaaauaacuuccucaauaagcauaaaucaugcaguuacauaaaaucauauugauuucauuauguucguauuaauacauuuuaauuuuuaggugcacaugccugaaggcacaaggcucuuaaacacauaauaaucaaaaagcuaauuaaucacaaaugggcaaguuucccaaauaauuccaggaauagguacaauuaagaaauaauacccugcgcacaaaguagaauaaaaacacacaagcagacaagaaacuucauuacaagccauaaaaaccaaagagaaaaacagaagagucucauuuccuaagccagguaaugccuaagccagguaauguauuaggagggcuauuggaggaaaagggucauuucguagaccuguggcccuaaccaugccuuuucucuguuuuccucauuaaacuggugaaucuugacucaugccucuguuauauuaaugauuucuucuagcuuugagggaucuagaagucucauaagcaccccuuuuauuucucugaguggcugcugagaacccuaaauagaacagggacagguucaggagucuguuagaggauacaagaaaccucuuuccauguguacacauucauuaaucagaacuuuucacauauaaagguucaacaaguuucagauccaucuaaauaaacaguugaguccucuuuucucuuuugugaguauauucuagggacuucagccaagugcuuugcuauaaucagaauaugcuuuauuuauggcauuuuuuggcuuacccgcccaguaaaugcaaccacaagagaugauaagaaugggauguuagucagcacucuuuuaguuccaagagucagaaacccaacuaaagcaaaaaaaggaaauucaauugcucacauaauaggaggcccggggggugggcuugcuucugauucagcugaauucaggccacacagcuaauuagagggagagccaguucuggaauugacuucagguccuccgacucccagggcaaugcucuuuccauuaccuggugcuaccucuaugcuaccucaaucaauagcagccaaauuaaaaacaaaaugaaacaagaagggcaugucuucuccuuggggucacuaauaauuuauucugauuuuaccucucaagacuugcauuguucauguuccugaaggaaauuagcaaaggcuuuugggugucuuuaugaaggagaaaucauugcuuucuaccuacuuguauuccacuuuguguccuaagcuaagguagaugguuugcccgucaauuauuuguccauccauuuagucugaaaacauuacucagcauuuccuagguuacagaugcugugccaggcacccgagauucaaaugugauaaagacauugauaauuuggugacaaaggacaauucaagcagaaggccuaguaaauguaaaaacacaaacacuuucaugcauucauucuuuucagcaaaaaauauguauuaagcacaaaguaggugacaggaacugugugugcuaggugucauuaguaggcauaaaaaaaggagaacauagguuggggacugcaaauaguucauuauggcagaagcacaggucucacaugggagaauaugggagugagggaaaaauguagacugauguccagucaucagacacacuggggacccuggauagguuugacgcaagaaaguguccuugucugauuuucauccuagacacuccaauugcagaugcguggguuggguuggagagggguggauggcaggcuggaaaaccugauggaggcuaugggaauauuuccuaggggagaggguggacacuaugagguggcggugguugggauggagagaaacuagguucacgaaggaauccagaggucaaaaucagcaaguccuagugacucaucucaugugacaggugagggagggaauggaguucagauagucaggaaccuugugaacagcgagguuauuaccugagacuggaacucuggggaaaggagcugagccguguuuguguuguauccacauuaacuugagcagugccugacauguaggagggacucagucaauguuuuugagugaauaccugaauauuacaaaaaggaccauaccagaaaguacugacaggggaaguuauccuaauucagaaggccaugggaggccaccugaagaagugauauuuagccgaaggucuagaaugauuuggaggcaaucagggaaaauagagaaguuugcacucuuuguguucgagucucaaaugccauccagggcgccugugucuuuucguucuggcugcugccucuaccuuuuucuacuccuggcauugccuuguggccuucuguuccugagccucuucugugugugcagggaggcagcagguuguccagggugauaagaaugguaacgucauaguaacuacuguuuauuaagcguuuaguuuccugaucucauucagcagcccucagucacagaaaaugaaugcugaguucucagaguuuauugcugucuaagugggcacguaggcccuagucagggcccugccagguucccaggguggggaaggcuuucuguaccauuacagaucacaagaguucaagaaaaaaugacuuuaugagguaucuuuagguuaucuaaaaaaaaaaaauuuaacaacuauugauccagccaaaugcacuguuguaucucuucauuggggauuuguguucucccaugguauacaggagguuugaggauacuuaaggagaguauacaaugcaguaaaguagggaaaaaauagaaaauuaacauaaaaaucuggacauauauauauauauauauaugauaaagugaaucuaggaaugugccagauguguuguaguuuaaagaaauauuguguguauuacagauucacaaauaugcagccaaacccuuaaaugaagcauaaguaaucugccagccaccuaguuaaagcaaguuuugugaauuauaaugaaauucucuccaaguacacauuucuaauggaaggaaauuuacuuuagaggaacauuaaaaagacaaaauucuugaucgucucagaaauguggguagccuugucuugcauagucauucuguaauaguaauugggacuugccuaauugcauuuauuauuuagagaggcuuggcugcauuuaaaagucuaaacauucaugaaaaucuguucuaaaugucuaaaaguuuuucaguaugaauuuaaaguugggacauucuggccuuagggaauucaccccacaauuggcugaacuauuuuuguugaaacacaaaguaaucaugguuucaguuuguaaauuagcuauugcugugagcugcuguaccuggugaagagaauuuucucugaaauugacaacucucuuuccaaauguuccacuacagucuuauacugacaucccuugacaucccuauggguacagucaugagauucaaauuguacauucuuaaucuucccccaaaaugacaucuguggcuuuuuuuuuuuuuaagagauggagucucacuguguugccuaggcuggagugcaguggcaugaacauggcucaacugcagccucaaccuccugggcucaagugaucaucuugucucagccucccaagaagcugggaguacaggugcaugccaugccuggcuaaauguuuuuuguuuuuuguuuuuuuuuucaagagauggggucuuacuguugcccagacuggucuugaauuccuggucucaagugguccuccugguucagccuccugaguaacugggauuacacggacaagccuucaagcgaaacuccaucuguggcuuuuaauuaaagauggacguauuguaaucuauguggccauagggaaauaauagcaaauaguaaaauugaaagagguacaucugacaguaauaauaaaaacuuuuuuguaauucuggaaauaaugugacaccgcacugcuacucagagauaacaaaugaagcuuaauugaaguuccaugaaacucuugccaauaggaauuucucaugguguaugauuaccauguggaacgaaaacucuagguccuagacucagacaaugacuaugauauagucauuucauggggauauugccauuuuagaaaaaguagugcuugaaaccugauucagcguuuuuuuauuuuuauuuuuauuuuuauuuuuugagacagagucucccucugucacccaggcuggagugcagugaugugaucucagcucacuacaaccuccaucuccuggguucaagcauuucuugugccucagcuucccaaguaguugggauuauagaugugcaccagcacgcccaacuaauuuuuguauuuuuaguagagaggggguuuugccauguuggccaggcuggucuugaacuccuggcuucaagugaucugccugccuuggccucccaaagugcugggauuauaggugugagucacugugcccagcccagcauuugauuuugacuguguguuuuagacauugauaauuuuauaggacuuuaaucagguuuuauaccugauacgucuuaaauuuaauguauaauuuagcauaucauuuuaaaacaaaaauagaaaaauauuuuaaguggguuuacguuuaguaauuuauaucauauuaauuacauuuguuacaguacucaacuucaagaugcacagcccuauguguguaauuuaguuugcuguguuaggguaauuaagcaugagcugcugcaacagaaaaaacaucucaaaaccucaaucacuuagcacaacgagguuaugucuuguucuugcaaaugcuccgagucugcagugguugaccccuccaugugguaacucagcauaagcagccagggcccuuccagacuguggcagugccagcccaauaguaguucuggggucagggaacagaagcauggaaucgucacaccagcucuugaaugucucugcccagaagggacacguuucacuuucacacauacuuuauuggcuagaaugagucacguagccccauuagacuauagaggggccagaaaguguagcacaaggaauauucguguaacaguauguucucugccgugucaucuuggaaguaauugacagcaguaguaacagcaacaacaaccaaaaggguuugcaauaguauagguucucucuaauuuguaaauggauuuuaauuauacauuuuguuugauuaaugugcauaguugacacagccacagaagcggagugcuguaacgaaagcuauagggaccuaggaaccugggcaccuuucugauuacggugcuauucuguguuagcuaauuuuuccaauuuguguuugucacuuaaacucuuccaccuauuuuguacucauuugcaaaauaacuagaucaugccuaagaucccuuauaacuccaaaguuuuaaaauuucuuuauucaacucaagcucugaccauagguaucauguuauaaggaggcucuauauugaaagagaaccuauaaaagagcuguguaucuuugcaauauaacuuugcauuuuuuaauuaaccaaggauauaauauguuuacucaggaacccccccaauuuaaguuuucaauuccagcuucaguggugugcaugcuacucugaaucuugugaauucagugaagacguaucuguccacugcuauguauaagcauuuugcaagaugcuugggguauaaaaaugaguagaucugguaggauguuguucuggagaaacuagucuucuagccugagagacaaaaguuuagauagaugcauucauugugcccugggagguacuguggugguauggaauaugagcauggaaggaagaagagugucugcguuucgcacaguuugggagaugggaagggcugucugagcugaauuucaaagaaugauaugaguaaguuuggaaaaaagaacaaagguguaaaaaagcacagucuaugaggaagaacaucaagcauuuuauuagugcuagagcuacguuguccauagccacuggccacauguggcuagugaacacuugaaauauggcuuguuccaacagauaugugcuuuaaguauaaauauacacugaggucaaggcaugguggcucauugccuguaauuccagcacuuugggaggccgaggcaggcagauccacuugaguucaggaguuugaaaccagccuggccaauauggagaagcccugucucuacuaaaaauacaaaaauuagccuugugugguggcacacgcuuguaaucccagcuaccgggaggcugaggcaggagaaucgcuugaaccugggagguggagguugcagggagccaagaucacaccacuccacuccagccugggagacaagagugagacucagucucaaaaaaaaaaaaaguauagacauauauauacacacacauacacacauacuggguuucaaagacuuaguucaaaaaaaggaauguaaaauaucucauaauuuuccaaauuaaauacauggugaaaugaguauuuuagauauauaauauuagguaaaaugaaauauauuaauaaaaucaacuuugccuguuucuuuucacuuuuuaaauguagcuagaacauuuaaaaaauuuccuauucaaguuacacucuagcauaguccagcccaauagaaauauaauguaaguccccgccuuggccugggcugugcuagaacauaacucauacaggaagaugugguaggaguugacgguucagagaguggcagaaauuagggcauggaaagucuugggugcuguucucuaagcagauucagaauaagguguuuaaacuggugaauuuuaaauaugagagucaugaggucauguuugcauuuuacuuagcucuaggcugugugggugauggugcaccaggcuccacagcagaggcugggguacugguuggaaggcuguuguugcugcauccagggagaaaauaugagggguugcauaagggcaguggcuauaacuguggugaucaggauuuggaguuuggagcaaguagucaaacgugacucuuggauuccuguuuugggugacaggugggcaguugugucacaaaacugagauuuugaauuucagagaaguagacuauguauugggaagaauaaagagagaguuccauuuuggaaauguugauauaacuuggauguagcauauucaaaagaaguuacuguagaugaaugaaguuuuggaaggaugucagagcuagagaaauaugucuggaagugaucaggugguggcuaaaacagugaaauucuaugagaauauagagugagaaguauaggaagcagaaauaguugcuggaagaacauugacuuuuaagaaaggaccagaggaaaauauaugaauauauaugacugugagugaucacauauauuuaaaaacccaucauugauuccaucaagggucacuaauuuuuauuauaauuaauguugaaaguauaguguuucuauuauuaguaaugugaguguuggcaucaugcaagaaauacauuuuuuucauaauuacuucauaauuuuaaauaauuauauaacauuuguaacuaauaauuccuaaugaaauugauuucugcuuuuguuaauauuagcagcaaaacuaauuccuuaugaaaucuaagaauuucugaggcaaacagaagcuuuguagugguuacaguagcagcacuugcaauuuuguugaauguuuagaagauuuucaaauuagugugaacugauguaauacuugagguuuuaaggagccauuuugcacaaaauaggugauaauuuugugguaaaauuuuaccucuaaaauauugauauaauacuugauaugguguauaacauacagaauucuagauagaaugcaaaauugugguuggaaaauuuucccaaaagcucugaaaggauggugaccaggcucuaacccugaguauaugagcugugguuugucugugcaaacccaaaggaaggguguuguuucccaugucagaacagaaacuugcuguaagauagauuggcuuuagaaggcagcuuuggcaucagaggcuaggggcucuugucaaugucagugaaaauaauuuaauagaauggugugauagaagccagaucacagcuauauuuaguugcauugaggaguaaaugagaguugaggaaguggaaaccaugaauguagauuacucuuucaagaagcuuguccagaaaccaagaaguaaaaguaugcuagaagggguaccagucaagggggguuuuuuugugauaggaggguuuuaaacauguugauugguugaagaaagaggucaugauuuuagacagacugcugagugaggauugaguuagaacaaaaauaaggcuauuaauuucuguacucccaacaaggccaacgaagaagauguaucuaauaaaagagcaguucuguauuccaaguauccauuuucuuaaacuacacucuuaaaggcaguaugacucugaguccaguccccugugcgauuaaaauaauaauaauaaaauaaaacaaguaucuccuuaugucaucaaauuuauuugucugguuguagauaccaucaugauguugguuccauugugccucacuggauggcuugcggugugaucuuaauaacaagcuauauugagaaagugguugaugaaucuauucguaauauuauuauguugcuuugaauagccaaauuagaagagagaauucaagcucagaaguuuuagcagugaccuuugaugacuuccuuaaaauucgacuuugcuucaugucaaauagacuggggucucccugcugaacaguucugaccaguuccccacaaugcugugcucuuagcacuuuuucaggggagguggacaauaguacccucucuuggccuggaacuaaggaggaaccugccgcacccuagggugagcaaaaccugaggaucauaaguuuaguucaaagauugaguuugaacugaauuuggguucaugugggguugauuuuuuuaaauuuaauaauguuauuauuucuagguuccugaggcccccaugugggcauuuaaaaagaggcuguaauuacaccuggugacgagauaaucacaacuucccacuggagucucacucuugcugggaauagccacauguaguucagagcuguccaguuaggaaagugcuugugucuugcuuucuuagacuugcauaguuauuucuuuauauuuggcagugugugaacaaagugaccuguccuguuacaggacauacucuaaaaauucuuauuaagaaaaacuucaaacauugcacaaaauauagagaauaauauaagaaauacccuguucacaucaccagcuuaagaaagaagacauuauagauacaaaugaagccuguugucuacccuccuuccucugucaucagcgcauggaagucuuguuugacuaccuuuuugccaauguuuuucauugucaaacugacacauuugccaaucugaugagugaaaaaugaugaagccauauuuuucaaauuauccuuggaguuccugagaaaaauaacacaugaaggacacauucucaaagaaauauagccccaaaaggaaguaaaauauugauuaaaaaucaugauaaauucauuaaaauugaaaaucagagaauauugacauguauguguguuagugaaucagaauauuuuuaauguccuguuggauuucaauugguugcugaaaugauggauuuggaugcuacccccaaaagaaucaggguaggcuucuuuugacagguguuguuuaacaacaagagugauagucuuguuccugccucuuuccugauaaaaucgcacuacagaugagcucugguucuuagaagcuuuuuugcacacuuguaggaguucuuagaaauccuucguuucccuuuuaaauuauuuuuuuuauuuauauuuuguuucucuuuuuuaacuuucaaagaacacauuucugaaagaauugaauccuagggccuugaagaagauccugaugauuucuuuugagguuuuauguaagauuuagguuuuggugcugccaggcagugggaaauucuguacugacauuugauaacauucaguauucagaauaccaguuggcaguugacacucaaauugagaagcuguguucaauauaugauauuugucuuuuucuacuaagaaaaaaaaaaaaaaagaugaggauagccccuaaagcugcuggacugugaauguauaaagggaaaggcaggggcucuuuauuuccuguuguguccccauacgggugcaguguugaugcguacauagauagcacucacuaaauagcugucagaugaaugcacaccagaguuaccucuguuuucuuccuguaauagaaagccacugcuugaacaaagaauuauaaagccgggaaagcucuucuggccaagacccaagacucuagcuaugcaggaaacuaacuaaaauuuggauacaggcaagacuguauaugauugucagucuuaauuauagggacuugcagaacucauggugauacgaccucccuggguaaccuguuucaguguguagguccucagacauucaaggauuuucuuuuuucauguuuuaaccagucuugcuuauugaaccuuugcacuguugaagaacauuaucuucuuuauaacuguuuauaaguggucgagucucugcaaagcuccuccucuagagcuuaagugaaaaguauauaauuagugagcaaaauuauuuuuauaggacaaggauaaaaugucauugaccuuaagaguuuggucccauucagagguuauguaacucuuuggugacuccagauuccucuuguguaccagaauguuagggcugauuaauagucaggauagucuaggccgcuucugugcuaacagauaaaccccuugaaauuuaagugacuuaauucauugacacuuuauuucucagucagagagagaccaguguggaguccaccaugcacagucauaagcucuggagcauaugaccaccaaggcccucacagcaagggaagggagagcugcagggucucccaagcccagaccuggaaggggcucacagucugucuaucugucugcuuagaugccacuagcaagaggaaggucauguggccccagucugucugcaaggggguuaggccaugcagcuuccucugugaccagggagaggagaaugugguuuucauacagcaucuucucucauguaggucauucuuacuggcccagaugugacuugacaaaguuuguugaugaaagggacagccugcaucauuguuccacagaugaacuauaccaauuugguuugccccauuagcacauuuuguuauagaaguuucaugugcucggaccagcggaaguauguuuuuggcuuugccaaccaauaucuuauuuuuauccaucgcuauuccaauguccuuuuaaguuccuccuccaucuguuuucuuucuuauauuccguagccauggcuaaaagaugcauuggauuugcuugggaagaguggccauuuucuugacuaacuggaugaauuuucuggcaagauuuaacauuggaaagaaaggaauaaaaauagagaaauuggaccuauuuaacccacauuuaucucuuucauuuuucuuucuucauuauuucuacuuaguuuaacaugaugugcuacucuaauuugagccaggaauaaaguauuuacauauuucaaguauuuguuagcuagaggcauaaggagacaaggccagauaugggaucgaacgaaauagaaaggagaagagaacugaguacagacauuugggaugaagggaggagagaaggaagguugaaguaaaacauagugauaagcauugcauucaaugagcuggacucagcggaaguaaacuucuagaauaguuuuauuuuuuacaucccacugccuucacagaguucugccagagucuuccucauucagagugaaauuucaagggaucuuguaacuuuccucgucauuuucaugaccaguccagucuaauggcaaagcuuccgucuuccgucuaauuuaaagcuucuuucccuccuucagcucagaacaccugcacgggcauagaagcuugagguauggugguggugagcugggaagggucagguagggagaagagaaguagggcaaggacaacagagggcuuuuuugacugguagaguuggaauccaccagcaugggugugaccaguauacauaugcuaucuuuuuuuuuuuuuuuucucaugggagugcuuugguggauuucuuggagauuccccauuagugacuuuggauuggaagcccgggcaugggcgaugucauaucuggcuggugguuggguccccgcucagggucucuguauucagugguaugccugugggcucuuucugcugcggucggcucagccgcugcaucagaccuuaugcauagggcacuuuucauggaggcucacagacagcugcggcgugcuugggugccaaucuaggcuacagcaaacucacaauuuuucuacuguuaccuagcacacuuucugugugugccuguguguguguuuucucagcugcacugcuauagccuuuuccauuuugucuuuacccuuuaggguuugucagguauggaugaugguuagucucuaggucccucaaauccaaggagacacaugcaaaguucuccacguggcuucccaaaucccccuacuucuuugaugggagagccacuguuucuuuucccuaggagugagggaaaggcaauuaucuaaugauaauucuucaaaggggucauguuuccaagaacaugaugaauucuuaguuuuuaccaauauagcauaaaggagagugaugagaagacuggucucacuguuucacagucugcccagccucuauucuuuuuagccuuuggaaccucuacugacaauagauaaugaauguaccacuugacauucuacuccuauucacaucuuuagagauagcaguguuaccuaugggaaggaaauauuaaggcgagcaauccauaagacacuaaaaguagugagacccauaggagagagggaacuuggaagaggaugugugcuggguuucaaggaugaagggcauaugugggaaagaggaacugugagggcacugagugccugacuacagagugagcuggucauguagaggcccuugguuuccugggcagaggaagcuacagggaauccuagaaucccuaagcagaauaaaagcuacugugugaacaugagaggauuuagagaagauguauuaacguaggauaugagugauuuguucacagugaagauucauaagacaaaucccaaguuaaaagcagagcauguucauugcuacuugacguguuggcaucuacacagagcugucugaugauaauacuuacaaguaccuuuguaauccuuccuuugcaccagguccucuucugagcccuuucccuguaauaacugauuuaggccuuacaguagcucuaggagguaaguacugccaauuauucuugcuuuacacauggcgaaguugaaucagagagagauucaauaacuuguccaagaucaccagccaguaaaugguguagccaggauuagucuggcugcagggucugugcucuuaacucgucuacucuuucgauaggugaauagugugugauuaagcuaacuguauggcuaugcuuauaggacaggaagaggcugcagcuuagcuagagcccaguuuuccucugagaaggaaagcaaacccuggugacucuacaguagcuuuuugucacuggccugagaccacuguguucuacuuucuacuaaagagcuggcauugcuucuuggggaagcucugagcagggaauggccaauaaauaggccucuguagaaugcaaaagggugguguuccuucuuuccucgggcacucgcuuuccucugaaauuccuggaaaagaaauggcugccgacguacagccucugcuucccaucucugccuggcuucugcauucuucccagcaagcagagcuccccccauaaaaaaacuguuauuuucuauguugauagaaagaaauccauuugguguauuuuuaauauuauuagugacuuauuguuaugguuagauuauuauuccaucccuggcuuuccugcugugggaaaucaguagcuggcauuuuguagcauugccgacuguugcauauuucauaacacagugaaugaagagugccccuucaggacuguguugcgacaugauucaugcauuuccagguuuuauuguaaguaguugcacacagcugagaggcucaggcccuggagaauuccagcguggcauugaccacaugccucuaaucaaccucugauuaccguagcuucauaagggaugugcccuccaguagcaaacacuuuguuagaguuaagucuuauaaagaaaacugugugagugucaaugaggggaacagaaacuaguagauuaagauuuaaaaauaaggaggaaaaagcaguucaaagagcuugccuagguuuuaguuacuugcccuuaagauacuugggaauagauuggaucaagauguuuaacuuucucucagaaauuuuguguauugauaauuaacuuggcuucagccaaggaguuauagaggccacugaauuuuguguuugggcaaauauuaaaagaugccuuuucuguugguguagauaguugguaaaauagaugcucuaacaggaagacuacaaaugugcaacucaauaaauuuuacgcuacugaagcaaacugagggagaaaacagacgucuuuacaagguaacccuauugauuuguuuucuuuuuggaaagguugaagaauauuucugcagcagugaaacuacucaauuaguaucuauccaauaagauucaaugauaauauuauccaguguuuccuguauugauacgugagauuggugcuccagagccacagcugaagcacaaaaguuagaaguuagagaugggaguuucucucaaauuccucucagcgcucaaguggaaggaaagaguugucucucaguugcuuuuccuuugggagugagaugcaguuugauuuucuaguuuguuuuuaaaugucaucuuuuaauuauguuuuggauaaugaugaagagagaugcaauuugguuaugagaauaaaucuuaaaaggcucaaugacuccuuuaucuacugcuuaaaacaacucccucuaguaaaaaguauuucauuaauugucauuacuugggaauuauggaauuagagcagcugaucccuuuuaucauucauauauuuaagugacaguggcauuacuuacucuaaauuaaguuccuuuccugguuaaaaaauuauaacagugugacaagaaauagagcacuauuaacuuuuauuuuggaaagcaauuuuucuaguggagauaugaaagccacuauuaugccugguuucuuuuuucuuuuuucuuucuuuccuuuuuuguuuuuugagauggaguuucgcucuuguugcccaguggagugaaauggcaggaucucggaucacugcaaccuccaccuccuagguucaagcaauuaucucaccucagucucccgaguaacugggauuacaggugcccaccccuacacccaguuaauuuuuguguauuuaguagagacaggauuucaccauauuggccaggcuggucucaaacuccugaccucagaugauccgcccgccucagccucccaaagugcugggauuacaggugugagccgccacgucuggccuaugccugguuucuuaacagaaagaaacagauaaguauauguaccauaauacuucaagaauuucaucaaggggugaaaguguuuaaaagguuuaucaguggguuuucguauucuccacacucaggaaggaaucagacagucuucuuaauguauacaguauuauauagauauacauaaaaguuauucaacugcuauauccacuguuuuuuucuuucugucaacucuucgguuauauucucaccagucagcaaugugcugggccagugcuucucccaagcuggaacugacccuguaagucuauuuugugaguggaaucacagcaauaaagucucauggcauuugucagagggacugcguugacccugccguccaacggcauaucuccuacagucauagugucuccauaauuuuggcucagaggauuuauucaauuuccuuucccuucugcucuauucuuuccgaaagacuuauuuuuacuguagugaacucacuaaacucuaguuagcuuucuacuuguggccuaguuuugauaacucuuguuaauaaggaauuuaauaauacaguugaaguaaaugaaaauauuucccaacacucacaacucuguacaauguuucaacaguguuuccucaaacuccucuuauggauaugacucacauuauaaaaacugauauaugaagaaugcacauuaaguugaaagugauuauuugaauaaugaucauuuuaaugcacuuaaaauaucacucagauuuuuaaagucuugccuauaaauuugggggaauauauuguucccugaagcucuguaugcaauucaauucaagcaacuaaaaacaaaccacaacaaacaaucaaacaaaaacaacuucuaucugaaaaauggaaauuguucaagacugguaaacuguuaggaaauguaucuuuugcugaaugaaaacuguuuguugcaaugaucugcuuaacaauacuuaauucugaguuccaggaacuuagauugaaauuugagggaaaaggaugaaagacauaaugcuguacugggggcuagucaaagggagauguaggaggugguaugugaguccuugguagaucauaugcaagucaguauauuuagccuuuaacuauuaauaaaugcuaagcaaggcauaacuauucccuuuacguuuucaaaagguucugcaauacccuaucccaauuuggucaauucaucuucauuucacauuucuaucuucguauguuuguguuuacuuuuccuucuuguuggaagaucuuuaccuuuuuuaaaauuuguauuuaaaaaaaaaagagauggagguuucacucuguugccaagguuggauuugaacuccugggcucaaguaauccucccccuuuagccuccugaguagcugggacuacagguacauauaugucauugugccuaguucaccuugaaaaccccuacaugucauuuaagaccauacuugacugacuuuuccaaaacauccauguucaggauguuuaaagugaccucuucuucuucugucaccccauagaaccuaauuucuaacacucauggcacugauuugcauauguauuuauaggucuuucucucucugcuuucaaaguaaacaucccuugaaagcuugaacuauggaguuacgcauaccuggguucacaucccagaucgagcacuugcuugcuguugguugacugacucaguggcaguccuagcaccacuuguccuuacauacauccacuccagaguuuggaaaagccaggcacuuaugcucuucacauccuuuaaaucuaaggguggucaagcaaaccaguuuggagcaaugaaauguaagacaguuggggacccuugggaaagcuuguguuucccuauaaaagcaacagguauguaagucaugcacacuggaacuguuccugcuuuccuccugacugauacguggugacuggagaucgaccagccauuuuguaguuaugaaauuaccauaauaauaauggaagcugaccugcuaaggauguuggagcagaaagauaaaaagagcaagggucuucaguggcauccucuugcuccuguaccaaaucuggaaaugccuaucuucagaauccuuuuuauggaaauuaaaugucucuuauuuagaucacuuuuaauagaguuuucuauugcuugcagccaaaauuauuucuagauagcuguauaaucuaggacaaauuaaacucucuaaacuuuaguuuucuuaucuauaaaauggagcuagugauagugaccuaacagaguugaugugguaauuaaugaggucauauuuucugacucgugaugagcaagucaauguuucuuucuccuuccuuuauaugguauuguuugccagaaagcaucuaucacauuuuuuguacaaaaacaagucacaguaacuuuuuuuucuuuuuugagacagagucucacucugucgccuggcugcagugcaguggcacaaucucggcgcacugcaaccuccgccuccuggguucaaucgauucuccuaccucagccucccgaguagcuggggcuacaggcgccugccaccacacccagcuaauuuuuguauuuuuaguagagacgggguuuuaccauguuggccaggauggucucaaucucuugaccucgugauccaccugccucagccucucaaagugcugggauuacaggugucagccgcugugcccagccuaagucacaguaauuaucauuugaaugaguaaaugaauauuagaguaaagcagcugaacagacuuugcaagauaagccacucuaauggcuucucacagccuuuuuaauggcugaguagacagucuuucucugccucuugaaucugacuuggcucuguuacuugcuuuggcccaucaggggaguagcaaacaugaugaaaacagaugcaugaaaggugauugcacccuggggcuugcucucuugaugcaauuagaacccugcaaccaccacauaaauaagcccaagcuagcugguuggaugauguaagagaaccaaacugccccagccagcaggcagccaacaccagacaugugaguuccggcaggccacauaugcaugaguaaacccagcugagagcugaagaacuuuccaccuaaguccaaagggccagccaacuuugagcuaagugaauaguuguuguuuuaaaccacuaaguuuuggggugguugguuuuacagcaaaaaauaaaugaucuagaggagcucugaagugaauaaguaagcaucggggucuccagaugugucaccuggagaaggacaucauagcacuuuuguaguguuacagcugggguccagaaccugaauccaaucaugaagaaauaucagguaaccucacauugaggaacauuucuauaaaacaagcggccaggauucuccaaaaugucaaugucuuauaagauaaaggaaagcuagggaaugguccuagauuaauaaagacuaaagagacaugauauguaaguacaauaugugauccucaacuggauccuuaaugggagggaaaaaaugcuacaaggacaugauuggcaaaaaugucaaaauuugaauauggauugcagauaaggugggguuauugcauccaugugaaauauccugaauuugauaacuguacuauggauauauaagagaauaucuuuguucuugggaaguauacacagaaguauucagugguaaaggagcaugauguauguaaccuacucucagaugacuuaaauuauuguaauauuuaaaaauauauuuauauauuuauauuuauaaauauaaaauauauauaacaauaacaauaucuauauagcuauauauuuguauuaauaucaaauauauaacuauauauuuauauauaaauauuucauauauuguauaauauagaacuauauauugacaaauauaucaauauauaaauggagauauauuuauaaauauaucaauagauauauauuuauacuuauauaucaauggauauauaguuacaaucuauguauaacuauauaauguauaaauauauaauuaaauauauaauuuauacauagauuauaaauauuaauaaaugucaauauaaauacagggcugcugaucuccagcuuuuugcuccuggucacauguuagcuacugcagcuccaggcauuauauucuugagugauagcaucugaugugggaagaaagaaggaaguaguucagaagggccuuuuuuucugaaaagaaacucuugccuaugagcauccuagcagauuuucacguauaucuuauauuuuauaucacucacaucucauuggccaugcucuccccucagccagucacuggaaaaugguggggagugggagucaagccccugcaggggguggugcaucacuguccaaacugcagagaaagagggaccaacacuuucuacacauuccauguaaggaggauucucacugcgcaggaccguugggaauugcuucaugcacugcucauuagcacgugcuucagacacugcaguuuucuuuauuaaacuccagagaaccaaaaucuaggacucaggaaggaaaggggaugguccaaagugaguuuuuuugagaugguugugaaaguuuuuugcaguaaguugauuagaaugccauccagcucagaccguauuaaagaacacugcuuguaagacccagagacucucauccacagucugcucuguaccaugaaaagcuuucuuuuaaaagagaggucugccuuuggauuaggugaagcacuuuuugacagaguguuuggggccaaggauauauacagcuggagaaauguuucaggcaggagauugaucuuugggcagagcuuggaaagucaaucauccgguggcgagucuccgaggaagcaguucaaguaucgugacuggaaagcaggggaugaaggacuacaugcaugguuggaagagaagaaaucggaauuuaccuagcugugcugaccuuucuaggccugcuucuggaugugcagugucucaacaggauacugcagugcuuuuauuccugcauguccaucauuguaacuaacaaucaagggacguggaugccuucauucaauaccacugcuaacuacuagacccaucaguucacucaguagguuuguguguauauuacagucaaaucuagcgugaaagucauuuuggaacgauaaaacccaacauucagaagagaaaucuacuguuaugugagcaccuaccuacacaaaccauuuuacuggcuuucguggaauaauuauagucaaccaggaaaucagcaaugacaacauagaaagcacacagaugucaguagcacuuccugauguuuugaaauaccuugaacauagccguccucaguuaauguuucagcaugaaucuaggggaacaucuacuggguguaaacuuaaagucaaaacauaaauucaagucccaauguuuaugugaucuugcucgaacacuguuuaucuuuucaacauagaugauaccaguuugacauuucccauaggaacauugugaggauaaaacucaagauaauauaggugaaguucuuugucauuggugaaguucuguaauauaugaauguuggcugggcgcaguggcucacgccuguaaucccagcacuuugggaggccgaggcggguggaucacagcgucaggcguuccagaccagccuggccaacauagugaaacccugucucuaccaaaaauacaaaaaauuagcaggguguggugaugggcaccuguaaucccagcuacucgggaggcugaggcaggagaauugcuucaaccugggaggcagagguugcagugagccaagauugugccauugcacuccauccugggcaacagugugagacucuguuucaaaaguaguaguaguaauaauaauaauaauaauaagaagaagaagaagaagaagaagaagaauguuaauugcuagguuguuuuaguguuccuuguagcaguuguuuuggaaacaugcgaguucauuaaauugaagaauuccuagaagucaacccuuuugacaaggaaggaaaaauauacuuacaauaauacaaaacuuuuuuuuuucaauauguaguaguucaagcauuucacuugucucuuguaacaaaacaaccuaugaggagaaaccugaggaugcaggggcuguuugcauuuccagagcucagucauuggggaggaaaauaaaauagaaagacagaauguugaagcagaaguggugauaagauccugggccucaggggacuugcgacgcugugccugcuggugcccuguauacaguagaacucagcgaauggugaccaagguaggggucaaugaauagaauauucacuuguuucuguuacuuuguguguuccaauucucuccuuucugagauaucuuuucagaaauggcacccccaauaucacuacuguuaaauaucacuuuauaauaugauagauaaaaucucucacagauacaaaauuaaagaaagucaucacuuguauugaaaacuuaaaguaugaaauucuucggaauacuauccauuuaaauuaaguaaguaaacuaaaaagugggaaaaucuugaaaccuuuccuaccauacuauucuguuguuucuuugcaaauauuuacugagcacuugcuaugugccaguguuccagccacucgagauggaucagugacgaaaaccagugaagaugcugcccucaugcacugcaggcuagcaggggagucugaaggucaacaauaaguaaaugaaaaggcuguagcguauuagaagauauuuucugaggaaaagagggcagaguugaggggguuugggagaguagguugauggagagguuuacaauuuucaaguggauggcugggagaccucacugagaaggggauguugaaacagggaccugaaacagauggaagaccguuaccccggacaugacugccccaaaaggggugugacauugaauguaccuguaugucucaaggcuuuaaggggacccgguggcaagaggagagagagcaguuggcagauaccuuuuguuacgcugugaaauguuaagcaaaauuauucugcaguaguuuguauuuccuuaaggaagauuuagaauagaaccuuaguuaacuauuucuaaacugagccaaaucauacacuguucagagcugggagggacuugagacacccuaucauugcuguucuucauuuuaugagagaaaaagcugaaguccauugaaaugauuggugguauaauggcucaauuaguguaucucaguguuuucagagacagauguggugaugagaaaaaauauauguauguuguuuuccuuucagaaagugacgaacacaugaaaacuuucuucaaaauuuuaaauaucuacauccucugagauuuuauuuuuuugugauaaaauguuacauaauauaaaauuagccaguuaagccauuuuaaguguacaauucaguggcauuaauaacauuuacaguguugugcaaccaucaccacuaucuaucuccaaaauauuuucaucgcuuccacgagaaacucuguacccauuaagcauuaacuccccauuccaugcucccuccagugccuaguaaccucuaaucugcuuacuguucaagauauuucacguaagggaaagcuuagauuuuuuuuugccuggcuucuuucacuuagccuguuguuuuugagguucauccaugcuguagcauguaucagaacuucauuccuuuuuagggcugaauaauauuccauuguguguaaguaacauauuuuguuuauccauucaucuguugacagacacuugaguuguuuccaccuugggacuauugugaauaaugcuguuaugaacaucggugugcaagugucugagcuccuuuacucaguucuuuuagagauacacacacagaggcauauauacauauauagagacacacauauguauacacacacaugcacgcacacacacgcacgcauacacacuugcacgcgcacacacacacacacagagacugagagagagaauugcugggugauauggucaaauucguguuuaacuuucugagaaacugccaaacugcuuuccacagcagccgcgcuacuuuacauucucaacagcaaugcacaggguuucaguuucuccacauccuucucaacacuuuuuaugauuauuuucauuauuauaaccacccuaguagaugugaagugguaucucauugugguuuguauuuauauuucccugaugacugauaauguugaguaucuuuucaugagcuuauuggccauuugucuaucuccuaaaauucugucaguaacauuuuauaguuuucaagguacaaauauuuugccuauuguuccauuuauuucgaaguacuuuauuuuugaugcuuuuguaaaugcaauuguuuucuuaauuuccuuuucagauuguucauuguuaguguauagaaauguaaauaugugcaacauuuuuaugugucgauuuuguaucaugcaacuuuacugaauuugucuauuaguuuagacagcuuuuuguguguggauucuucagggcuuucuacauauaaaauuaugucaucugcaaauagagauaauuuuacuucuucuuuuucaguugggaugucuuuuauuucuuuuucuugccuaauuucucugguuacaacuuuuagugcuauacugacuaguagcggugacugugagcaucuuugucuuguucccgaucuaagugaaauuuaucuaaguggaaugagugaaaaguuuucaacuuucaccauugaguaugauguugguuguggguuuuucacacauugucuuuauuuuguugagggcauucccuuguauuccugguuuauugaauauuuuuaucaugaaaggguguuggacuuugucagaugcauucacuguaucaauugauaugguuauguggguuuuauuucuuuuauccuauuguuacaguauauuacauugauugauuuuuauauuuugagccauucuugcuugcacuccugggguaaauccauuugaucaugguauaugauccuuuuaaugugcuacuaaauuugguuugcugguaauuucuugaggaguuuacaucuauguucauaagagauauugguauguggcuuucuuguagugagccccugugaaacuaucuuuacuuuaaaccucuaguuuuaauuuaucuuuuuuuuuuuuuuuuuuugagacggagucucacucugucgcccaggcuggagcacaguggcgcgaucuuggcucacugcaagcuccaccuuccggguucacaccauucuccugccucagccucccaaguagcugggacuacaggcucccgccaugccuggcuaauuuuuuguauuuuuaguagagauggaguuucacugucgaucuccugaccucaugaucugcccaccucggccucccaaagugcugggaauacaggcgugagccaccgugccuggccuaauuuaucucuuuaauuuuaauuuaucucuuugguuuuaauucaucuuucuucauucucauguuauaaguucugaaaaaauaggagugucugcugggaauguccuuccuuuuuuauaaguaagucaaaaauaagcucugccacuuauuaguauggugaagauaaaaaagcagaacccuauaaggaggucaagaaugcagaauauuaauauguugauacucuaaucccuuuacauucucauucauagccacaaguacaaugaaaaucaaaauaaauauuauauuucaucucugaaagauugauguguuuggaccugaccaauguagccugguguccauguagccugguguaaauuauguucucaaguaaggauuuuacucugucuccaaaagguuaaauaggucacugauuagaauuauagauaaaagaguacuugucuuuccagguuucucaggagagaaugagaaagaucuucucacuguagaagcuucuuugaauaggcacaagaaguuacaucuggcuucacuuaaacaccacuugccuuacaacuuguucuaaaucuucagaaaggauuagucugaaaagcuaauuuuguuggaaguugagagauaaucauguacauuucagacacuguuugaaacuuaauuuccccccacaauuacucaccuucuagcguugacugaugaaaguauaaugguauaaagguacccuuuuuuucuguggcucaggaucaucacacacccugagcugaaggcauacaggcugcacuugccuugauacaacccaaguacacugcugcuugcauauagaccccaguuucauauuccacaccuggccauucucagcucuuucuccaguuuugaaguguacuuuuccugcaugaugcuguacaggacuaaggacucuggggauagagguuugagaaguaucccuaccccuuccccagugccuuccacagacagcacagacauccugugccuuugaagggauggcauugagcaauaacauuuauuuuuagucuugccacagugcucuuugcucccucuccaccccagacccuacacagagcugcgcuccuguuggagaugucccaggccuccucucgaguuggagaugucccgggccuccucucgagcuggagaugucccgggccuccucucgaguuggagaugucccgggccuccucucgaguuggagaugucccgggccuccucucgaguuggagaugucccgggcuuccucucgaguuggagaugucccgggcuuccucucgaguuggagaugucccgggcuuccucucgaguuggagaugcagacaagaggccacaugcagaagcacugugcuuugggcuuuccuuugcaaaugcuucccucucugacgcuguagaggcagagcuuguagagccagcugcugcuuagaagggucgcccugugggauuagaaucuuucaaguucuaagauaaauuuuguuacuguccuuucacacugauaacuucucacuguccucuuuucuauugccauucuccuccuccuccacuuucuccucuccuuuuuuuuuaaaguuucccuucucuggauucuucucuuacaucuuuugcuucugugcauaggcucgcccucuuaggaagauuuucaacaauuauaaauacaaaaaauguucuugcaugggaugcucaauacuguacagacuuucauuagucaaaaugccuaacugcuuccaauccugcauauucugucuaauugggaacauuccuccacagugaguucuguacucuggugacucuaguuuacuggaacucacuaguuuuggaaugaggcaaaaaaaaaaaaaaaaaauacugccuuaaaacccugucagaccuggguacuuggcaacaaauuacagcugaggagugccaaagaccugaaaauuauaccuaccuugguugacaguaccuuuaagugucuauguauuuaugacucacuuucuuccauaaagaauuugaagugccuuauuaaaguacauacccgaggauaaaauaaauaguugagauaaucagggcaaagaggaaaugcggauaagaaaauaaaacuggagcaaaagucacaaagagaaauguacccugaacaguugugcaguuguagagguggccuccaagguugccucuaagcuccgauggggccaaaguaaaaagugaauuuugaccgauuauguagcacauggcauccuuaaaauuaaaaaaauccaguugucaagaaaaggaagccuuuucuguucccaagauccgaagucauuuucuuaaaucuaagaucaauuuauuuccugaagccuccuacagaaaacuauaugauagaguggucacguccuucacaggagucgccaguauugucuuacugauggaauaggccaaugacacaaugcaggggugcgauucagaagaaauaaaucgaaagggaaccaaaacaaaauguuuuaaagguaaaauuugaugcaacucagcaaauggacaccguauccuuucuugcaacccuccaugaaaauugauugucacaggcaaacuuuuuauuaggaugauuaugcgaaugaaagguuguaggcagugguaggcagcugaaguccaguugcucucuguuccccaugagggucugguccauaagcuuugacacacagguggugggauuuuaugugcccgcgggaaugacccccucagucaccucagcacuggguccucucagguagagccagucuccucucuuuagaagagggugucccuacugacagccacaugggacugaggcccuggagucacgcauauccccagcacaaccaucagccuuccuuucccccaucaaccuuucagugugguccugccaaucauccacuuaggccagugaacauuucuuuuuuuuuuuugagacaggagucucgcucuguggcccagacuggagugcaguggcacgaucucggcucacugcaagcucugccucccugguucacgccauucuccuaccucagccucccaaguagcugggacuacaggugcccgccaccaugcccaccuaauuuuuuuuguguauauauauauauauguauauauuuuuuuaguagagacgggguuucaccauguuagccaggaugguuucaaucuccugaccucgugaucugcccgccuuggccucccaaagugcuaggauuacaggugugagcuaccgcacucggccaaccauuucuacauuucuaauaaaccagcucuagaacaucugacuuuuagcaguguagcuuugcagugagccuucugagaaaagcaauuggaaguuguauuugugaagguaacuguuuuuaucuuuucagugaauucuuggauauuagccaaugugauuaaugacuuuaauuuuaagacucauugauguuaagccauucuguauggcaguaauggaauggcaggagcaacuaucucuuguggccauuucaaaugcgaaaaacugaauucucaucaucagcauuacucccagugugcagcuuaccucgucacacaggacagcccagccuccccucgccguguucugcagaugugauuuccagcuggcggugcucccucugcuccgucucacccugcuccauucagaagacgugccacaucagucuggaaaagcaaguccuccuuuacucugagacauauuacaguggagccuagacugccaucaucauggcaaccauggggcucccucuuaugugaaguucguucgcccuuuaccugagccauguuuuucaccugucccgcuuggcagugcaugcguggguccggccucuucaggacugcugugcuuggcagcucccuggcucagcugggaggaagauagcaaaugggaaauuucucuguuuuuccauaacuuuaugauaauucgauuuuggacucauaccuuuauuucuuauuguuucugauauuucuauuuugacaaacauaauagaauguagauuuaccuuuuagaugguauuuauucccuucaaugcuguuacuucugagcauuuugugaucauuuccauuucucaucugugaaacugguauucagugucuagcaagcaaugaaugaagcauuuagugcuuuuuuucuucuuccguacgccuuuagccucccaacccuuaauugugaacaucguguaaacuuugcuuuucagaacaccagcccuuuuuugcuuuucucugagacaucauucauucgcacugucgugucuucagcuuugugcugugagagugacucaaagaauccacugugugggaagcacauguucuucucauuagcacagauauaugucuaaaacucguuuauggaguagucaauacuguguaugacauuguguagggacuguuuucucagaacucucagguuuagauggggagagaaacuuguaaaugugauaguugcuaauagaaauauguacagcguguuugucacggggaaaugaagguaaacuuaaugcuucagggucagaggaagaaucucacagucagaauacuucaaugaaguuuuagaggaccaugacagguuacuuuaggagaggggcaaguguuaggaagauccgcuauauuaugacaaggacauaugauguuuagagaacuguggauaaucugagguggugggcccagcaccaggugugaggggccuuuggugcuguuguuagggguuauauuuucuuucccagucauaauucucagcuugcagucugcagauuccuagggggucuauggaucagcacuuagaauauguaagaguuugcuauggaacgucuuaacuuuguggguuuaaauauauauguaagcuauauuggcauguucuauaucauuuaaaucauuacaccucaaaguguggugcucagaauggugcugauccacaaacuaucaguuuccaguucacaaggagauaaccacagaggcugagaguaaccguugagaaacuuacagcaauuugacuugguacugccgugucauucaaguguaguauguuugaaaugccaguuuguugaaguaguauuacacacaacagaauucauacuuuuaaaacauagcuacaugaguuuugaaggauauauacagucauguaaacaccccacaaucaagauagagaaaauuuccaucuccuggaaaaguucucuuauguccuaccaaucuguuaucugucucuauaguuucgccuugucuagaaugucaugagaauugaauucauauuguagauaaucuuuagugacuaaucucuuuuuguuaaacauaauucuuuugagauucauguauuuuguucuguauaggaauaaguuauuuuuauuacuaggucauauucugcuaucagaaaaggguccugauccacaccccaagagaguguucuuggaucucgugugaaaaagaauuccgggcaaguccgcaguguaaagugaaagcaaguuuauuaagaaaguaaagaaacaaaagaauggcuacuccauagacagagcaguggcaugggcuguuccacugcauaauacuuaggguuaucucuugauuauaugcuaaacaagagguggauuauucaugaguuuuccaggaaaggggcaggcaauucccagaagugaggguuccucccccuuuuagaguauauaggguaguuuccagacauuaccauggcauuuguaaacugucauugugcuggugggaaugucuuuuagcaugcugaugcauuaaaauuagcauauaaccagcaaugaggaggaccacaggccacuuuugucgccaucuuggauuugguggguuuuggccugcuucuuuaccauauccuguuuucucagcaggguuuuugugaccuguaucuugugauaccaccccugcugaccuccuaucucauccugugacucagaaugccucaccuccugggaaugcagcccagcaggucucauccuuauuuuacccagcuccuacucaagauggagucacucugguucagaugccuuugacaauucuacuauauggauauaccacaauuucuccauucacugguugauggacauuuuggguguuuugggguugagcuauucugaauuaagcugcauuggacuuccagugcacauguuuccauaucuuagguaaauacuuaggaauggaauugcucugucauaugcuaagugucuguuuaauucaggguuucucuguuucauguuuuggguuggauaauucuuuguggugggaaaccauuccguccauuaugggaucuuuagcaacaucuuuggccucuacccacuagaugucaggaugcuccccacucccaguuuugaucaccaaaaaugucuucagaccuuaccaaauguccccuggugguuaagauggcccccaguugagaaauauugguuuauuguaaaaaacuaccaaacuguuuuugaaacuaccaaagugguuuuaucauucccacccaauaauuuacgaguucuaguuucaaugugucauaucuuaauuuuuauucauuuaaauauauuuucugauuucccuugugaugacuucuuuggcucauguguuacuuagagaaguauguuguuuaauuucccaauauuugggagauuuuucagauauuuuucuguugauuucugauuuauuugcauuuggacauagaacuuuuuuuguacaauuucaauccuuuuaaauauuugaaauguauuuuguguuccagaauauggucuguggugguggaugacccauguacacuugaaaaaaaugucaauuauguuguuguugaguggaaugucaugugcauaauuuuauaugugaccaaauuaucagccugugaugugcuggaaauguuuaaaaaguucuuugcuaaugaccagugccucuccaucugucuguagcuuauagccuguguucccauuugucuugaugauugccuugaugccaagugauaaccgcaggugcugguguuucacuuauaaugaagccuuuucccuccuggacuuugcacaccuaauccugaagcuccaugaauguucugguucagcuagagcgaauggggauuugugaaacaauuauaaggguuuucuguuguugguggugguuuuuuuuuuuuuuucucacucuguggaccaagcuggagugccauggcacaauuucagcuuacugcaaccuccaccucccagguucaagcaguuuucuugccucagccucccgaguagcugggauuacaggcacacgccaccaugccuggcuaaauuuuguacuuuugguagagacgggguuucacuguuggccaggcuggucuugaacuccugaccucgugaucugccagccuuguccugccaaagugcugggauuacaggcgugagccaccgcuccuggccaaguuuuuuauguuuuaggaaaacauuaaaugcaagguagaaaugagaacaaaauguuucuuguggcucguugagacgaguccugccuguaucuccagaauccacuccucagccuucccgugcugcaucccgucccauugcuacugaagaaacuccuucagucuggaauuuccuaucacuuuucucuacauuuugaaucuggauuaguuauguuuguuuguuugcuuuuuuuuuuuuuucuggguaacaaauuacacuuaguggccuaacauagcacgaauugacuauaucauaauauccuugcaugaggagccuggcuauggauugauaggguccccugaucaggaucuuaccagguugaaaucaaggcagaggcagggcuguguacucugaagcuggggugcuaucaucagcucacuccagcuauugggagaauuuguuccgucccacuguagaagugaaguucccauuuucucccuggcugcuggugccucucugagcuccuuuaggacuucucaagggcccgagccauguggccucuucacagccaggagguggaucucucuccaaucggccaagauggaguccuagauaaaaaguaaagcagucacaggcuuaaauucccauuguguuccuagaucccacccauacucaacgggaggaguuuacacaaggcaugugcaugcggggugggagucuccgaggccaucucagccuaccacaggauccuacucaucuguuaguguccaguuggaauuauauccuuucaugagcucauuucauaagcuuuccugcagugugaacugcuccuuugccugccuucauucugcaguuucuaucuucccuuuuacacugccucaguuugugaaguaaacccuucuaauuuauggcacugacacaaucugagcaggacacuguaccuuuggaguagguggugcuaguuauaccccucgucugggccugcuuguguucucugcaaugcugaaguggcuguugguaagaauaagcauuaugguguuuaauaaaacugagguucuuaaaggcaugacguauguacuuucuucauguaaguucguucuaaacauguuauggccacuauggcauguuuugaauguaucucauuaucuacuacacuuaaggacagagaccgucuuuucuuuccacucuguaaccuauauucagugggcuaaauguuugaaucagagcaagcaaagacuacagaaaaaucauaacucaguucaggaaccagugcuucagaaagccuagaauguaaucagaaaugaaagacaguacuccagacaguaugacuucagaauccguucaugagggcaguccggaauauggagaugagaaagcguggaagauugggcacccucauggaugucuuuguagcggcugcccagugccuuugcccgcugguaggcaucuaauuagugucacugauaacugucagggagugguaugaaccuauccaaucucgauacuuuuuaaaaacaacuauuuuguuuccuaaucacagcuggugcucaagaccgaaucggcugggcuuuuggccuaggauuagaaaggcuagccaugauccucuacgacaucccugauauccgucucuucuggugugaggacgagcgcuuccugaagcaguucuguguauccaacauuaaucagaaggugaaguuucagguaagaugacuugcaagaacugaauagauaauaauaaaaauggcugucaaggaucgacaggaucauguacuugaaagccacugaauuuuauuuuauuuauuuuauuuuauuuucauuuuacuuuaaguucugggauacaugugcagaacgugcagguuuguugcauagguauacgugugccauggugguuugcugugccuaucaacccgucaucuagguuuuaagccccacaugcauuagguauuuguccuaaugcucugccuccccuugccugccaccccgcaacaggccccggugugugauguuccccucccuguguccauguguucucauuguucaacuccaacuuaugagugagaacauguggugucugguuuucuguuucucuguuaguuugcugagaaugaugguuuccagcuucauccauguuucugcaaaggacgugaacucauucuuuuuuauggcugcaugaauuuuaaauaaugugaauuuguaaagaaguucuggccaggcaugguggcucaugccuuuaaucucagcacuuugggaggccaagacggguggaucaccugaggucaagaguucgagaccagccuagucaacauggugaaacccugucucuacuaaaaauacaaaaauuagcugggcaugguggcacgcaccuguagucccagcuacuugggagacugaggcaggagaaucacuugaacccaggaggcagagguugcagucagcugagaucgugccauugcacuccagccugggcaaaaauagcgaaacucugucucaaaaaaaaagaaguuccuaaauagagguccauaaacacacaagggguucauaaaccuucagaaauuuuaugcaagagaaaagauauuugucaauauuauuagucuaagcagagaaccaauuuuguacuuuuuuuuuuuuuuuuuuuuagacagaaucucacucugucgccugggcuggagugcgcgaucuuggcucacugcaaccugcgccuccuggguucaagcaauucuccugccucagccuccugagcagcugggauuacaggcgcccaccacuacgcccagcuaauuuuguguauuuuuaguagagacgggguuucaccauguuggccaggcuggucucaaacuccugaccuugugauucgcccgccuuggccucccgaagugcugggauuacaggagugagccacugcgcccagcccucaucuaguaucuuuuccaacaauucuacuccauucauuuuucagaaugaagcugcauauauguuagaccauuugauccuaugccauagaacucugaugaaagguuuuuuuaauuaacgauuuucuuuuccugugugcuuuauuuuugauaauuuuuauugucuucucuuuggguugcucaucuuuuuuuuuuuccuguuuuguccaaguaaccauuaagcccauccagugaauuaaucauuccccagauaacuguauuuaucaauucuagaauuugcauuugcuuccuuuuuagaguuuucauuuaucuacugaaaugcuugauuuuuucauccauuucauccauucuuccuuaaauucuuucacauauucauaaugguuauuuuauuuuauuuuauuuuauuuuauuuauuuauuuugagacggagacuugcucuguuccccaggcuggagugcaauggcaugaucucagcucacugcaaccucugccuccuggauucaagcaauucucccaccucagccucccgaguagcugggauuacaggcauacacugccaugccuggcuaacuuuuguauuuuuaguagauacaggguuucaccauguuggccaggcuggucucaaacuccugaccucaggugaucugcccaucuuggccucccgaagugcugggauuacagguaugaaccacugcgcccggccucauaaugguuauuuuaaaguacuugucuguuaauuccaaccauuugauuaucuaguguucuuuuguugugguuguuuucccuuccuaaucauggcuuacauauuuccugcugcuucacuugucuuuuuguuuuuuuuuuaauuguguuugaauggacaaagacugagguagauaaaauuuauccccagaaagucuuaugcuuucuaccuucuggcugcuaaggugacuaggccagaucuuuuuguucuaaucaggaguugaguugaauuucacaucugcuuuccucuugauggugagaucuagcccugcagcagaguuugggaucuaaccaugugagaucacaggaucucuuucugcuuuccauccacuuaccagcuucuuccaccaccagcguuuguaagcagaaauauuaugaaggagaauuggcuggcagugaggguuagcucuguuucuccauuuuccaaucugccaugccagcccaugcuuggcugacgcaaguguggcucauucuucuuauuccaacaaaaugucuuugccaguagcaggcuagcucuucugccuacucacgccccaguggcgacagcagccaucagugucugucuacccuagaagggcucaucucucucuggaguuauacuuauuuauauuuguguacagaccuuuucaacuguauuaguccauuuucaugcugcugauaaagauauaccccagacugggaagaaaaagagguuuaauuggacguacaguuccacauggcuggggaggccucagaaucauggcggugggcgaaaggcacuucuuacauggcagcagcaagagaaaaugaugaagaagcaaaaucagaaaccccugauaaacccaucagaucuugugagacuuaaucacuaucacgagaauagcacaggaaagaccggccccugugauuccauuaccuccaccugaguugcucccacaacaugugggaauucugggagauacaauugaaguugagauuugggcggggacacagccaaaccauaucaucaacuuuaaggacagguaugauuuuuaugaguguauuuuguuauuguuauagugaagcacacugauuuugugugugugcccaucugcaucuugaaccuuucuauguauauaugcauauauuuuugguuuuaccuuaugaggacuuuuaaaaacuucuacuugaauaauuaucuguuuuauuuuagcaucaauuuccuuguagacuaauuugaaauaaagcuguaucuaauuuacaauaaaaccuggcuagggcuguaacuuuuucucauucucuuuuuaauauauugucaguuauuuaaucagcaaacauuuaaagaacaccaacaucguguagaauggugugcucaacaccauggugugacaaauaaagaugaaaaacacaguugccaccagaauuaaguggcuuaaauucaauuuuaaguguacuuacaacaaucuuuuuuuaugagacacauagaaauagacucuugaucucuugcacuaaaugucauuuuuuuucuccuuucugccuucaaauuugaaagccaauauaugcauaccugcacuaauauauaauuuuuauaguugucuuuguguaacaaacuuaagaacuucuaacggggcaauuaggauuuguacauucauauuuaguauauguucauaaaauacuuugugaaguauagauuauagaucauacuauuaccuaaguauucacuuauaauuaguaucuauucuuguuaguuuccuguugcuuagguaaccaguuaccacaaaucuaguagcuuaaaacaacauguauuuauuauuuuacaguucuagaggucagaaaaccaaaauccacccaacugggcuaaaguuaaggugucagcagggcugacuccuucuguaggcucuugggggaauccaccuucuugacuuuucuggcuuuuuuuuuuuuuuaauuauacuuuaaguucuaggguacaugugcacaacgugcagguuuguuacauauguauacaugugccauguugguuugcugcacccauuaacucgucauuuacauuagguauuucuccuaauguuaucccucccucuuccccccacuccacgacagacccuggugugugauguucccugcccuguguccagguguucucaugguucaguucccaccuaugagugagaacaugcgguauuugguuuucuguccuugugaacugucaccuuuuccggcuuuuaaaggccauccucaguccuuggaucacagccaugcaucauguugccuuuucucucuccuucaucuuuugucacauugccuucucuuugaccuuugcuucuuucuuauaaggauccuuaugauuguaucaagccuugcuggguaauucaggauaaucuucccaucucaaaauacuucucuuaaaguaauccuuuaauacuuuaauacaaauuaauucucuaauacaaaaggaaauguaaauuuccuguugaauauaagguaauguauuucuagguuacagggauuaggacguagauaucuuuggguaggguugggggcauuuuucagucuaccagagucuucccuuugaccccuaaagauucacaucugucuuuuguaaaauacauucagccuaucccaaggucccacaaacucugaacccauugcaaaaucaacucaaaauccaaaaugucaucuaaauaucaucagccccuaagucccauuucaucauuuaauuaucuaaagcugguuuaugugacacucuggguaugauucauccuggggcaaaauuccuccccacuuuugcaccugaagcgagguaccuacucccaaaauacaaugaguaggauaggcauuggagaauaguuguagacauuuccauucaaaaagggagaaaaugaaaggagaagaaaaagaaucacugguuccaagcuauuucaaaauucagccauuagguuucaaggccuggggauaauucucuguggcccuuggcuucacccauuugaccuguauuucuacccucuaaaauauccuucuuuuuuaaaguucuuuuauuuauuuaugaggccaggucuugcucuuucaucaggcuggagcccaguggugccaucacggcucacugcaaccuccaccucccaggcuuacaucucagccucccgaguagcugguacuacaagcacaugguaccacgcccagccaauuuuuuguguuuuuaguagagaaggugucuugccauguugcccaggcuguucuucaacuccugggcucaagcagucugccugccuuggccucccacagugucaggguuacaggcaugaugagccacugugccuuaccuccuuuuuuguuaaggguggcauguauaugcaggugaguuguuuuauuacccuggcuuuugccugaagaauuuggggagucaaauagccuucuuucuuuccuucucuuuuuguucuuuugucccucucaauuccagcugacaguguuccugaugguaaaucauucucaaaaaccuuguggcucucccauuuauaucauagggauucauuccauuacacaagaggcuccucugcagaucuuucuugaauaauucauugcuauuucuggcuucugcugagacgccugaggggauccuugacucauaugcuuaauuucuucaaagagcccucuguuugacuaaauacccugauccuucaaaacuucugaggcauuaacaaaggguuguauagcugcacucauggcuuucucuccaaagcacuuuucuuucagcaaaaccccuaacuuuuugucuuuuucaguauagauaggcuaagaauuucccaaauuaucuaaucuugcuccucuuugcauagcaguucucuuaauuugucuguuuucuccugcaagaauaaagcaggcugcauuuucacuguuugcuuggaaauuuccucagcuaaauauccaaguucauuguuuacaaguuuugcuuuccacuuccaauucaucuaauucugccgcuaugaaugaacaaggauccccuuuccuccaccuuccacuaacauguuccucauuuccuugcgagcccucaccagcagggcuuuugacaucuguauugcuaccaccaguauguuuaugaauauuuggauauucucagacaguauagguuuucucuaccaugcuccucacuuuuuccuugccugucacagucuauaacauccauauuucuacaagagucucuuuaaggcaaaauagccauuuaauaucauggugcuccaaguuaucuacuacccacugaccaauuccaaggcuaauuccacauuuuuauguauuuguuacaagcaauaccucacuuccagauacaaaaauacguauuaguuucuuguugcugcuauaauaaauuaccacaaacuuagaagcuuaaaacaacaugagcuuauuaucuuauauuuuuggaggacagaaauccagaaucagccugauuggccuaaaguaaaggugucagcagggcugguuccuucuggaggcucugggggagaaucuguucccuugccuuugcccgucuagagacaguccucaguucuuagcuuaugacagcaucacguugccuucccccaagcccugccacuucccucuguaaacaccucacccucucucugaauuuuugccucccucuucgaaggacucuucugauuacauggaacccaccaggauauucaggauaaucaccucaucugaacauccuuccuuaauuauaucuauaaagaucuuaauguaggauaacguauucucagguuccagggaguaagagauggauaucuguggaagggggcuauuauuuagccuaucacuugugccauuuuauauccuauuucgucaugacagauugcuugccuucagauauaauagagugguuugucuuuagggauaaaaaauaaggauaguauuaaaguguuagccauuuuuaacuauuuauguagaguagucauauuuacauauauaagaggggacuguguugacagaaaacuuguuuuauuacuacaguugaccugccuugagaaaaauacuuaaaaugauuguaauucucugcaaucucagagguggggcgagaaaauggggaaaaggccugcuggcagcuaugaacuuguggauccccuggccaggaaacucuggaagccauuugggaauccuauugugcaagaagcagaaauuucucuuccuuggucuccuuuuaggcccuccuaagugaugcucuaggcuguguuggcuucuguggugucuuucucugugcggccuccacauccuguccuguacauuuuucuguccagcuguggggcacucuccugggugcuagcaacagucucugauugaugggacccugaguccucaccugugugacucuuuuccugcauaccuugaaacccauuguuuaaaucuagucgguaagaaacucaaguuaaaaugugauuuuaauuuuugauuuucauuuuacauauuuugaauuaagugcuuugccuaccacggcuuucuuuaaccaaccuggaucugugcuugagauaagugggucaacaauaugguuggucuguuaugcaagugauaacuuguucuguccaccacugcagcuucccaugcuguauucguucugaguguuugggucuuuguugcauauacuccugccaacuccccugaagcaaaauuugcuguuucagugcauugaacugaauauucaauaauaaaacuuuaauuuauacuuuguuuuuuaaacagucuaaaauuaugaauucaauauuuaguccuacacagagcgauacuuauugaaaauuacucaacauuguacauuuuacuuacagauuuuauuagaacuuacuaauucugugucuauccaugguggcuuacaaggucagcccucauuggaugaaauaauucagcaauguuggcuguuaucuuuuuugccaguugaaggguuuuacuggcucucuucugaggccacagacuauaauauuucuaauccugaauggagucucaaauacuuaucacugcaacaggaguagaugaggauggauggguaguggcugcaaaccuaugauacuacacucuauccaagaugauaauacugguaguuaguaguuaauacuuacuucagccuuacucugugucaagcauuauuauaaagacuuuccaugucuuaauuuaauuuucucaguaacccucugaguuugggcgcuguuauucuugcaguguuauacgugagaaaguuguagcagagccaucaucucaauagcaucguuauauuauguauguggcucaaucagggcuuccagaagccauucccuaaaguuuaaccugaguauaaaacucauagguagauuauucagagccgaaggauuuaaauuuuuuuuuuaacaaaucuaaaaaucaguauacaguuuacagaaaaauacagcaugaaguuuaaaugaucuaauuuaugaacuuacugguuuguaggcuacaaguauuaaugcuuucucaaacuucagugugcaggugaaucccugauggagcuuguuaaaaugcagauucuaauucagugggucugggggggugccugggauucugcauuucuaacagucucccaggugaagcucaugcugcugguccacgagccacacuuugaaucaaaguaaugaugguuaaaauuauuuaacuugucagggucucagcugcaucgucguucaaucagaugguaaaaggagauggucugacuagguggugaaacucacuuccuucucuguugcacucucauuuugaguauaacuauuauaauaagcaggucuguaauuugauaccuuuggcacucaaucuugaaacuauuuucuuucuuuuugcccuaaauuuuuuuuccauggauuuccaacaguuguaaaacuauuacacuuguuuuuuggauuaaccgcugaaacuccuuccuuccuuucucccuuguauuuuucaaggugagggagcuaugugaauaacucauuuaguuuaaaugcacauuuuuaaaaauuauacuuaagucagagauuugcuugugcauguuaauuugugaugggaaaguguuaguauuuacuucagaaaaaaggaagcuaaagacgaggaaagaagagaaagggcaaagaauuuggaagcaucagcaggagggacaguuacuaucaaagagucuuguaucaauuaggucaucucugaggucagucaugccuagagucccagggaaaacucugggucagaguucauccuugcuauuucuaugguagcaaacaucagccaugagugcugcaugauaugaggccugggaguuucuuaaggccaggauuggcucuuucaugccuuauagcaaucacaguucaauacacuauucaccuguacauuaauuuguugaggaccuuauaauacuuggcauuuguugaaugcuguguguaagccauugagcuaaaugcuuugccuauguuagagcuuuuaugcaucacaguggaugaggcgaguacuauaaauccauauuauagauucugaaacugaggcuuagcgucagcaaguaguucaaccauaacugugguaguaaguaacggagccaggauuuuaaccaaagcugacuccagagagcuccuaauauugaacuaguaagcuguuacuguugccuauaccaagcugcugugcuagaugcuagaguaaggugaacuuggucccugacuuaaaguuauuucuaaucuagaguaugaggcagguuugucaagagacacuuauuaaauaauauguaauaugguuuggcucuguguccccacccaagucucaucuugaauuguacucccauaauucccacguguugugggagggaccagauggcagauaauuugaaucacgggggcgguuuccuccauacuguucucgugauagugaguaagucucacgacaucugaugggcuuaucagggguuucugcuuuuacgucuuccucauuuucucuugucaccaccacauaagaagugccuuucaccucucguuaugauucugaggucuccccagccacacggaacuguaaguccaacuacaacucuuuuucuucccaguaucagguaugucuucaucagcagcaugaaaacggacuaauacaguguguaacacuggugcaacuauacauaggugaaugucgaauuucacugauacugaccgaugaaugugguggucaaaauuuucuucuucguuucuuuaauucuuuuuugcuaguuaauucucuaaguccuuccaugucucuccagaauuguauuaggccuugagccucugauuacuugcuaaucuccuuggcuuggaauagcuucuagaucugguuuugcugucauuaucauaaauguugucuaauagagacuuaaugugggauuuugcaguguuuccucauucuauucccaaauaaauccagcugugagaaucgcaucggcuucauuguguugcagugaaauucauggaucucaaacuuuuucaguauuuccauguguauuuuucucauuuuacuucccccgaaaguauauuaaguauuuucuuuugcuggagaagagauguuuaucucagaaaaaaacuaauaggaagggauacaggaagaaaugugaaagaugaccaaucauagaaccuuuuauauguauucaguaagcauuguugacuuaaaaauaaggagaggugcagugaccgagacuauagacaaguuuguauuggaauaauuauagugcuuauaucuaaagcauuuauaacagagccugucacauuguaagcacuuaauccauguuaaauguuauuuacauuuuuaccaccacuacuauuacucuguugucaccaccacucccacaacuucagauggucacuuaugaaauggaugauagcggguacuggaaaaacuauugcauccuacagucuaucuucugcugacuaaugcuugaaaucuccccuuagagcucgcuuccuuuagcuuaauacuuuaauccuaguuaaaccuaacauguuccuuuugcauagaacuggcugugccuaccuuucauaggauaacuggaugggauuaguggggaguguguagcuauggaacaguuuuuucuguuugaaauugaguauagaaaucagggucaucguggcgcauucaacgaacuuaacuauauuggucaaaaggaaacaugcgcuguucugagagcggcagccacaguccuccugauucucagucccuuguaccgucaguuuccaucuucagcuugcuuugccaacacugauacuguauaacuuuagccuuaugauguuaggacauuuaauugcccuguagucuauggaguccuauggauuguggcccucugcuuguguucaaaccugcuccaucagaggucuaugggcugauuuuuuugugaaaaaggagaucuuuugguauguuuuacauauuuggauuauuguaacuccauauuucuuucuuguuuauuaaguuacuaagaaagaaagaaagaaagaaagagaaaaaaugaacgaucuagguccucagcauuuucuuacaguuuucuuguaguguagauuggaagaauguuaaacauauccaauauccuuguugcauuuucuuggcugugaagcuuaaggaaauaaauauauaagaacuuucuauuuauagauagcauauuaaaccuuaaaucuugccaacagucuauaaaauuugacaaauuagguguaauauauuuuaggaaucaucuaucugacugaagaaguuuuggcacucuguggaaucagagggauacuuuuauacugcacagaaucaccuaaacuguacauuuaauaguugguggauuauagaguuaaaaaguuacaguuguagaaagagaucaucagaauagggaccagaaggaaccgguuugaaggaacugacguagaaagaaaggucguaucaauuaaguguugauggacaaguuaaugucuuuuuuuuccugagugugaauaugggaaguaauuguuacaggguggcaggagggaugacuuuggcuucaaccaagagaagacccagcuaagaauggcuuaaauaacaacaacagcagcaaacccgcagugaugccagggcucuaaaacacugaacauuuuaaucucagauuuguccucucaagauugaaggauggugacgggaccacaagcauuaccucuuacgacaacgucuagagacagaaaauggagcacauuugcuuccuuuucauaagagugagggagaguuuuucugggagaccucagcagacuucccucacaucucauuuucaagguagucagaguggucugugaaguuagccuguuauuuucugauauuuguacugagcucgugucaauaaagcuuaugcuuuugcauuauuucacaacgaacaaugccacauguguacaaucauggccuaucgagaaagauaucucuuguuacuguagauauuuuuaugaacagauggucacuuaugaaauggaugauaggggguacuggaaaaacuguugcagccuacaaucuaucuucugcugacuaaugcuugaaaucuccccuuagagcucgccuccuuuaguuuaaugcuuuaauccuaguuaaacauaacauguuccuuuugcauagaacuggcugugccuaccuuucauaggauaacuggauaggauuggugggaaguguguagcuauggaacacuuuuuucgguuugaaauugaguauagaaaucagggucauuauggugcauucaacugacuuaacuauauuggucaaaaggaaaagggcugaaauacuaacuuuacacaaccuaggaguuagaucuucagaguuaccaaggaacucucaaauguugaucagaacuaauucaaauggaaaagucaagguucauauuaacguucuagggaccaaaugaagucaaaguaauuuacugaguaagaauaauuaguuaagaaagguaaauguaguuuuucugugucguuaacuucccucauccuguacaaaagaacaaacgcauuucuucacuacuucaaucagaggcucauucugcuccuuuacucagaggguaagaggagcacaugggcacaccugagaugugaggaauugagggcugccuguauuuagacagagaaacaaguuacuuuguagguagagugucacauggcuuuucaaacuucaugcguuuauacuggcauuuucuauguguaaucuugcaaccuugaagaugaagaaugugguuaaaggaagcaguacuucauauaguggauaguuuaauuauucuuucuaucauuuggccaaauaaugaauuacauguuuucuuucaauauuagagaagaauuuauuuuauuuaauuauuuauuuguuuauuuuuuugagacggagucucucucugucccccaggcucgagugcaguggcaugaucucggcucacugcaaacucugccucgcggguucaugccauucuccugccucagccuccugaguagcugggacuacaggcacccgccaccacacccagcuuauuuuuuuauuuuuuauuuuuuguauuuuuaguagagaugggguuucaccauguuagccaggauggucucgaucuccugaccucgugauccacccgccuuggccucagaauuuauuuuuuaacgcucacuguaagauuuauuaauuacaaguuauaauucacuguccuuuauggugaauuauaaauggacgacccuuguaagaguccauauggcagaguuugaacucuuggguaacugugauuugagaagcgauuuugcaucuauuuugauuuauuuuuaaaaugaugauauguucuaaacguauauuucuggauuuaacuugcugauaaaaauguagaacugugugccuaccagccagcuauuuaccucugucaaauccuaggauuuuacuacagauuuuuuuaaagaguaaaagugguuaggcgcaggggccucacuccuguaaucccagcacuuugggaggcugaagcgggaagaucgcuugagcccaagcauuugagaccagccugggcaacauagagagaccccgucuuuacagagcaaauaaaaauaaauuagcuggacaugguggugcaccugugguaccagcugcuugguuggccaggcaggaauauugcuugagccggggaggucgaggcugcagugagcugugaucaugccacugcauuccagccugggcaacagagugagacccuaucucaaagcaaacaaacaaaaaaacaguaaaaacauuagaaaugcaguugaaacaccuacgucucccugauuucauucugcuucccagucuccccagaggucaccacuagcuacaguuugauauuuaccuuucucauguucuuauccauuuguauguguccaaaaaacauucuguaggauugcuucaaaauuuauguuauaugguaaaagucacuaaaauauagaaauccagagaaguuuuuuggaaauuuguugagcaaauucuaaaauguauauggaaauguagagggccaagaauagcuaaauaacaauguugaaggauuugcuuaaucuuaugucaucuuuuugaaaagugauaguaauugugagaauguggaacugaugcaaggaucaacacaaaggcccauggaaugcaaugaggagcuuggaaacacaccugcgcacuaugcuagauuuauggcagcacuagcacuauggaacagaggcaggaggacaaggcuucuguguaaauggagcagggauaauuggguguccacauggaaaaaaaaugaaacuugaccccauauuuauaauuguucaaaaaugaauuccaggggguuuguagaucuaaaugugaaaagcaauuuauuagcuuaccgccuuugaaaaagccauuuuaccaugagugauucuuucauucuuuuuggaguaaauugaauugaggagaucgaacuaaaugaacuauggugauauaaaauuaaaacguaauuaaaugucugcucuucaaaguuuugaaaugaguguuuacuuaaagugcuucuuguaaguuuuuuguaaagcauuuuaucaaauuagggguguuuccuucuacuuugaguuugcuucaaguuguugcuacaaaugaaugcuaaaauuuauuaaaucugucuauauauuucgagaugaucuuaugauuucuggcuuuauucuguuaaucuugugacauuuagugauuguuuuuugaauguuaaaccaauauuuuauuccugaaauauauauaauuugacugcaaaauauuaccauuuuauauacuuguagauuuuguuuguuaauauuucuuuaggauuucugacuuuguguucaggggugaacuaggccuuuaauuuccuguguuuguuacgaucuucucagguuuugauguuaagauuaugauauccucauaaaacuaguuuagaaguauuuccauuuucuagccucuggaauaauauuuugaagauuuauguuauuucuuucuuaaguguuugauccaauuuacuagugaagucacuuggggcuggaguuucuuuuguggaaaguuuuuaaauuacaauuaaauuuuuaaauaguuauuaggcuauucacauuuucuguuuuacuuuguaucaguuuugauuaauugugguuuuuucuagggaauugucuguuuuuaaauuuucauauguauuggcacagcugggcgcuguggcucacgccuguaaucccaacacucugggggacagaggcaggcagaucacuugaggccaggaguuugagaccagccuggccaacauggugaaacccugucucuacuaaaaauacaaaaaaaauagcugggugcacuggcucaugccuguaaucccagcuacuugggaggcugaggcacaaaaguugcuugaacccaggugguagaaguugcagugagccgagaucaugccacugcacgccagccugggcaacagaacaagccuccgucucaaaaacaaaaacaaacaaacaaaaaaaguauuggcauaaagcuguugguaauauucucuuaauauauugauuuaaagaaacacuauuuuaaauuagucaacaguuaagcauaauuauuaauauuuuaucaaauuuuacacacacuguuuuuuuuggcauaucaaaccucuuagaguuugcuuuucuucuuaaugaaguauauuguuugaguauuuguuucugugagggguuaugagugguacauucuuuuggucuuuguaugucugagaaugucuucauguuacucccauucuugaauggcaguuuaacaaggcauaacauucuggaaagguagucauucucccuuagcucuuugaagaugcuauuucugccuucuggaaaagucuaauauuaaucaaaguguuguuucuuuguagauaauaaugccuuuuauuuugagugauguuucagaauuucuguuuaaauuugacauucccuaauuuuaauaugaugcauuuugguuuggauuuguuuugguuuauccugcuuaguauuuggaggguauuuuuguuccgggauucauaucuuuacucaacucuagaaaagucugaguuauuacucuccuugaauaguggcucuccuagauucucucuauuaccuucucuagguuuccuguuguauauuggagcuucuuaguuaucaguuaucuuaacuauuuuuugguauuucuuauuucuuugucuuguauuggugaauuugucaguacuuucuaccaguuuaauaauuuccucucuaauuuuuuaacuuaauaauguuuacuuuuuauuucuaaaaugagcuucuuuucuucuccauuuucuuguuuaauuucugucugauuuuguuuccuaauuucuugcuuuuaaaaaugguuguuacuuuguuuaguaauuugaauaucuucaguauacuuguuuuaaagccuuuagcuauucuguauuauuuuuuaucuaaaaugaguucauauucuuguuguugauuuaauugguuguguuucuucauauuauaauuuuucgauguuucaaagucugacuuugcaagcuuauuuugaauacaugcucauuuccccccauuuuugauuaucaccacuuguccaucuugucuaccaacuuuuuacggcauccucuugucccuagggugcccaguuaagaaguggucuuuuaacggcguuauagagugcuugccuucugauuauauugucaccagguuaguggggguuuuggcucaauaccugaucaagaguauugaguaucucuucuuucuguggcuuccuauaaagcaguaggugauucaaagcaugaacucauagcagcaucaugacaggauguugaaaugaggccccaaggaaauaaucuccuuaacauucagguuuucggaugaguguucaucagaaagcaaguuauauggcaugugucuguguuuguuacaucugccuuuucccugcccugacauuuauuggcacagcccauucccacagauguauauuuuauguaagucagucaaauggauauucuuaaaaugacaaccuugacuccacuguaauuuauacacacacacacacacacacacacacacacacaguguuuuucauuguguuaaaucuuuguaauauaaaauuaacuauuuaaccauuucuuuucuuuucuuuuuucuuuuucuuuuuuuuuuuuuuuuaagauggaguuucgcucaucgcccaggccggagugcaauggcgcgaucuaggcucagugcaaccucuaucucccagauugaagcgauucuccugccuaagccucccgaguagcugggauuacaggcaccugccaccacgcccagcuaauuuuuguuuuuuuguuuuucuuuuuuguuuuugugguuuuaaggagcagaaaguuuaauaggcaagaaggaagggagaggaaagaaggaagaagcucccccguacagagacagagggaggggggcuccaaagccaaaagaggagguccccaccugccacguauaccagccagguauauaugcagaggcuggaggaggcaguguuugauuugcauagggcucagaggauuggcuugacuaggcaugucauucacguagcccaugaaaaugcuggcccucccacccuagacuuucaauaugcaaaugcagggcacaauaauguuauauacacgugggaauaugugggggcagccacauugccaggaacauguggggaaaggacaagaaggcugagggaaucuccauguuuggguagacacaguuucuaauggacguuauuugcauaucaaagguuacuggccuggcucuaagagccagggcuuuacaagaaacuuuuccagagaugcuuuaaaaaaugaaaacuucccaaggaccccuuuuccuacaucauucccccuguggagaugccacacuaacugcuguuaggggguuuugggggaugacuccuucuggcuacuuccugcugaaaagggguuucgaauggggaacaguagcuagggcuccuccuggggucgaucuaaggauccuuggaagaauggcauguccaugugugugugguucagcuuacagcaccauuuggaguuugauugcuucuuggugagaagaaacaauuugaguuauaguauggaguauacaggguccaaauaccaauacaagauauauaagcaagaaagugcuuaauaaagggguuaaccaauuccauaaagaagacuggaauuuauuaaagagagauuguagccccucagggcugaggccggcauuuucccugagccugucaacaauuuugacuagauuuuuaaguaccuguagauuuucuucuacuuuacuagagguguuaauccaaaagcagcauguuucauuuaaaacugcauuacuaaacccaauaaaaaguccuagcagacucagugauaguaaaacuuucaugcuuccuuuuugucaacuauuaucccugcuguaaggguaauaauuaagcaaaauacuacagcaauggaaacucucuguccaauauuucaguuagaaggugcuacccuguauaacccuguugcaaauaguagagugaggacagcaauucccacaagugugguguggguagguaauuuccaucuaaaauuuuacuugcuaagauauagaauucuccuuugggggucuaugaaguuccuugguuuuauuuucccaaacaaagaaaccuccggguuaugggcaccuuacucacuuucauuacccggcagaauuugcaagauaauugcccagaacuagcguauugauucacauuuuuauguuacccaucccuuuuuuuuguuuguuuccaagcugcggaagaucaccacuugauucacaggaucaagcagaguuagucuaaaauguaggcaaaaagcuuaaaaacaaugaaugagacuaggauuuaaugacaaauguaagauaaacuuuggagcaaaaucuuuuucuccaguccucauuuuugguaaaaacuaguuaugaauaaacuuuagacuuaaacuugaccugauuauuugcauaaagugcagcaagaaugguuauuuuuacauagaccuuuuggauugacuuugaugaaacuguuccacaaggaauuucacauaagacuucuaaagccaagcccagccauggguuuguguccucuaauaccuguguguuuggugagccuauccucucgaggucccaagauaaacuuggagcuuccagaccuguuagaaagugucauucuuuacugaccacagguuaggaauccugugcggggacugugcagacaaggcaugaggccaguucuuccuaaggggcuuuuuuuaauuggcuuugccugucacgcuugauuccuuaaagggaaacacacacuuucagucaaagccuugguaaaauaaccaguuuuuccaguuguguccuguugaugaagaaaaauggauucuuacugcacugaugcaaacaacuauauugccauaaguuaagaguacucacagauaguuuccaaauucuagaggaaccaggcagagaaaaauaaacaugcuccaaauuuuguuuacaggaguauaccuuacucaauuauuaaaggccauaaauaguuuaaaauaacuuuccuugaugcugaaaaucaaaacaaggaucagcaguauuccaagcaaaaguuaaaaagguuacuuucacuuucugaguguaguccauuuaguuaacuuuuguuuugcuugagauuugucaacaugucaguuuuuuaugagcucuguacuuucuuuauuucaauauuacaaucuuuaaagcuauuaaaaaccugcauuugagaacaccuguuaaaguccuuaauauagcuugaugauaaacugucuuuugagaaggaacaaagcaagacaacaauuguuugugaaugacaaauuuccaggacaguuauaguuaaaaauaugacugacaaguuuauuuaucuucaugguuuacaguaacuuuaccauuaauuaugauugauagcauauacuuagacauuagcauuuuagaaaucccauacaauuuuggaacauauauuaguauuauucaccaaaauauaacuuaaagaagauuggacaucauuucggcaaucucaugugacuaaacaucucaaaugauccuguuuaccucuuuucugaauguuucaggggccuucugaacuauccaaaaagccaggcaucaugaaggacaauuuccagauugccguaaauuauuuugccaaaaugaugacucaaaaggaaaaaaccuuucauuagccuuuacugugacaugaaaauuuugugcaaagccaaauuuuacccuugcauuaguuuauuaauguuaaccccaauucguuuacaugaaaccguguggauuauuccaucuaauccuaaccaauuugaccaugaggugaaaucuuuacaaaccuuucauaacccuuuuacuaaagggcagauuagugucuuaagagcuccuugcuaugcuuuuauuuuaaugcuuaauuuaugagaagaccaucuggaugcuaugggagaagacagcguagugcuuguaccaugcaugucauuacaaggcagcccaaagccaauuggcuuauuuuguaaucagcucaugccugaugggagucucaucucucagucgggaguggggauguuuccuuaucuuccagguggucaagagcaugcuucucugauuuauaacuacuaucagccaucccuuacaguguauuuucuaccuaguuauuacacaccaaaacucucacaaugcgaaguaauuucugauacccccaaaacucaaaaccaucagauaacacaagcaaaacagaacagagccguugauuuugagagggauuuagcuccuuuuaauuccugggguuucaugaggaaaacagaggauuuuccccaaaacaggguuugugaugccuccucuguuuuuccccagaagucccauacuaccagaaguuauuuuagggccuuuuaugcaugcauuaagagugguaagacacaaaauggagaaaaauaauucaguuaacugagaagaaaagagccuuuuuccagaaaaacaagauucaagaagagaaaaacaugaaggacuuuuaaauauaccuauaacuugaguaucuacuuuuaguuaagcugggcacucuuuaagaaaauccuuuuaaaucccuuguuacuugacuuuagccacaccaagcauuuaagauguuccgcuuuugaacuuuacaaaaaguccccuuacaggugaaaccaacaagccuuaauuagguuaugacuuaaccgugaguguacaagguauuuuuaaaggagugauaggcagcuuuugaaacugucauugcaaaacugucacugagacagugaaagagauuugacccaaacaacuucauuuuguuuccagccccaaagcuguccuugcccaugucugggcguaggccgaaccaacuuugggaagagcuggguuuacagucuauagucuaaaacagucuauagguuuacagucuauacucuauaguggcuacaccauuuaauauucccaccaacagugcacaaguguuccaguuucuccacauccucgccaacgaguuauuuuuguuuauuuuaauaauggccauccuaauggugugaggugguaucucauugggauuuugauuugcauuucucuaaugacuagugauguugagcaucuuuucauguaauuguuggccauuugaauaucaucuuuggagaaauguccuuucgaguacuuugcgcauuuuuuaauugaguucuuuguuuuuuguuauuuuuauauauuuuuaaaaggaaaucauuugcaaauguggccaucguauugcugcaaacaaauugcugccaguacagauuacauuguuaagcaugaugguugaaaauauauaucacauuuagaccauuacuggccacaaggaacugauauuauuugaugugguuuuugagguucguucuuugucuugcuguuacucuucuagauacauaucuauuuguugaguauagccuggugucaucacccuagguccuacauguuaagauuccuaagguucagacaauagauggaggauaaagaguugauucuaagagucuuuuaaaauucugcccauguuuaugcauauauacgacauacagucaaauccauccccaacaucaucuuugaguguaugaugagacagaagagaucugaaauuuagaggccuuggaauuauuuagcuagucgcuagcuauuuuccccugggucacucaccugacuguucugucacuacauuuucucacugguaaaauaaguucagauacucucaaaggccacuccuuauucuaggaugcuaugaaagugaguaggauuuuccuaucuccucuucuguguaccucagauugcauuguuacuccugacauucaucuugacuuaaucuugccagcuuaaaaaaguuguugugaaaagagaugaguguuucucuguugacuugugauuaugugaacagugcagagugcaagcccucucucugcuucugucuggucugucucuguccuucccccuuucugucugugucucuugcuguuuuucucuauguggcauuuucuuucacucugucucuugucacucuuguaauaugcgguucugauucacguucaacugucaacauagcaagggggaaauggucccaggcugcauaaauccacaaugggagugauuucucugcucuuuauuaagauuuuuguugauguaugugacauucaacaggauuuaucccaaacacaagagcguuauuaauuauuuauaaaacauuucugagcaucugcucuugugccaggcaccgugcuugacccuggggacacaggaaguauaguuuccugccuucagauagcucccgcacuagugagggaggggcauuaauauguauaggugcuugauaaagguagcuaggccugaggagucugcacuguguggcaggcaaucaguccaguaaugggaaggagacagaagugugagcaaaguccuggaggcgugagacagccauagucugugguucaguguaggguguuuauagcagagugugcugaguuaguguggggaaugugggcaguggcaaacuuagcucgcaaagcuuaggcuuugaaugguuucuguaaggcaauuagcaagacauccaauuuugugaucagauuucuauuuuagacagaucccagugcggauaagaugaggauagauuggggccaugaggcuaggagcccacucgaggcccggcacagaagaaaugaugugauaucauguaggguaguaacagagagacuagaagguaggguugggcucaggaaauuuuaggagaaaacauugaaagaucuuggauccuuaugugaggcagaggcagagugacccuauggcuuaacaccuaaauuggggucuggcugccuuugagacuugcaggggcacuguuaauaacuguguugcaugucucggugcaaacugggauugaccuggguaaaguggguguuuaaucacaguagguaaacaugagccagaaagaaaaugguuccuagguuucugccuugggagcuggguagaugagaaacaggagaaaaaacaggucuggagaagaagaugaugaguucaauuuuggccaggugaguacaggaguauaauuuuuuuuuuuuuuuugagacagguucucacucuguugcccaggcuggagugcaguggcacagucauggcucucugcauccuugaccaacugggcucggucgauccucccaccucagccuccugaguaguugggacuauaagcauaugcccccaugcccggcuaauuuuuguauaguuuuuguggagaugggguuucgccacauuguccaugcugagcucaacugauccacccaccucggcuucccagagugcugggauuacaggcgugagccaccguauuugagcaggaauauaaaaaugugaauuuaaacaacuucauugugguggugguaguggucauugucuuuguuuuguuuguuuuaauuggcauagucaagucuucagcugagcaacuggucuuagguauggcuggcccaagugacaacucaggccaagauagaagugagaaguuggaacaggguuguuuacuguggaggaugagucagagcugagcccuuuaagagaggaugguccaggggaggugaagucagggcauauuguuaugggggagagguaguugcugagcaagcacuggcauggguugaugcuugggaauggcugucaagaggacagagugcaaaggucaacagguaagauaaaggaaagcuuccuccagaaaagaggacugcauuaacagggguuggggagagagguagaagacggaugucagggucaggcauacaguguuucuucccugccugcccaacaugcuggacucuuuaaggauccuucaauucuugaaccuugcuuaaggacagguuauguaaaugcuagucaucagcaaaagccaaacucacauuguuauuucuuuuuaaucauagcuguauuaagcuuuuggaggucuguucucccaaauguuucugucuguuaagcagaaaauauuucuuccuugaccaaggacugaaaagugaaagaaaaaagauagaauaaaauguucuaucuagaaagugcuaucuagauuugaauaguuggaacaucuuccuaagguguuuauuuugguggauaugugaggaaaugagaagagacgaugauauugaaaguugacuugcauuauuuguuuaaaguuuugacaauuuugaguauuauggugugcacuuugcauucuggugcagugauaaaaaccacaacaucuucucuuuauuucacucuucugggcuuaaauuugcaucuuuaauauuguauuaccauaauuuuugcauauuguaagguaauucaguugcccucuuccugcaugguucagauuuccaguuuuguaugaguuucuuauuauucucacccaguuucccaauuagcaccuuguuaacuacacaccugcugcacagaaaauuguauuacgccauuuagccuuuuuaaagaaaaaaagagagaauggaagacacucuguuaauagguuauuucaaccucaaaaagugaugccucugggcacagaaccacaacaugauugcugacggggagaaccugauuguuuaauagaugcuagaacuggaacaagaaaagcuuuuggcagaccucuggaaacggggguaaucugcacugucaccacagcugugcacgcauuuccagcuucaaaccacagaagccaagccugauccgucagguucugcacauuucuuuguggaagaaucacugagccacuuccauuacugugccacucugaaauaauuuccauuuaucaucucauccugggauuagcuuuauuuccuaguauagaagaaauaaauagacuuacugacuguuucguuuucaaauuuuucgugaagacuugguaacuuuucacucaaacgguuauucauuuauuauacuuacuuccacaucgugcaucuauuaaaggcaaauaugcagccguuaguauguaaauggaacuugcaugcugaacaaaugagguagaaccucaaacguuauuuauugacuaauuaguguuauuguaaucagaggagagccuauagaaauguguaaaacuaugcacgaugggccuacacgaauauaagcagaugucaauuucauuuuggucuagcuuaauucaugcgucuucugugacauacggguguaauaccuucauuucaaauugauuuagaugcuuacuuaacuauuaaaugauaauagcuaauuuaguggaaaagauuauuaaaucauauaaaaaagaaagccucaccaacgcacguggagaauccuacuuacugaagcaugggagguugaaaagaaggcacaacuaggaccuucauuaggauucuucaaguuggccuuuccagagauggcuuucugaaucacgagcccucugcuucacgcuaucaucugucaccuccugaucaucccuucugugucaucuaguggcucuagcacccggcugggguucuccccaccagccuagaggcagugcaagugccccaguaacucagucuucugugaacuaggaaaaaagcauuuccuccugacuucacagaccuucacagccacaccuggaucccuagccaccuuucuuuuaucagaaauccccucucaucccacgaucuucuacucuucucucccuuccccccauuuccaccaaucccucucuugggcucccucuuuacccccaucuguuccuugccagucugcuguuaggcaaaccucuagccucacuucuugugccaucaagcccagaccaaacccacagucaccuguguacacuguccugucaccugcagccucagcucccucauccuuuaauuucugccagccuaguuagucaggccccuauccuauaucagcccccaaaguuaucuuuuuccuguuuggacauguuguuuucauguugaacaugccuguaguaggucauucuugcauugcuauaaagaaauaccugagacuggguaauuuuauaaagaaaagagguuuaauuggcccacaguucugcuggcuauucaggaagcauggugcuggcaucugcuuggcuucucaggaggccucaggaagcuuacagccauggcggaaggugaagggacagcagacacguccuauagugaaggcaggagcaagugagagagacaguuggggguggggaggugccacacacuuuuaaaugaccagaucucacaagaauucacucacuuuuacaagacagcaccaagccaugaaggauccacccccaugauccaaacaccucgcaccaggacccaccuccagcacuggggaugcaauucagcaugagauuugggcggggacaaauaucuaaacuauaucaaugccuaaaaaacaaauaguaagaaagagaucgaugacugccucccauacaaauguacgaucuccucuugggaguucuagguuugugccacagcuuccuugcccaccuccccaccccaagcccguaacaaguagccucauuuuauuccaggaaaagaacuuagaccaucugacaugaaaucccccaucuuuucucuucuccacuucugauuuuuuucagggugcuucuauccauccuagaucuacuuaaucaaaaucuuuggggauggaauccagaaaucugcuuuuuuaaaaugcucccagugauucuucugugccuuaaaguuugggcacuucugaccaacgcuauaguaauaaccaauggacugguuccacuaacuugguucuuccuauuucuggccaucauccacauaucaugguacugucucauguuaauaguuuaaugcugucuuguuucaauaguuccucauuacuuaaggaauagaucuugaguuccuuagcacaauaucgaaaauauuuguucacuaaauguuucuuccuauccagucugccucgcccccugcucccuuauaccugcuuuuuggcagucacauaggacuucuauuuucugaagucaguagaaauuuauuuguugauucacugauucaauaacucucuguugagucucuguugugauacagacucugugcucagccauugaguucaugaccaagacauagccccuucccucacugagauuauagccaugacucuguucaauuacugcucuuagaaaacacccuccucacuccauuucucucauugaaaacaauaggcaacuuuuauugagugcuuaccaugggccaagaaaugggccuaagccagccagcccucuuucccuugcuccuuucuuuuauugacacacacacacacacgcgugcgugcauauagacacguguguguauaauuuuauuuaaucccagcugaaugguguagguauuauuguuaaccccauauuauggugaaagcaauggaaauuuagagucuuagagcuagugcgggugaacuggaucugcaaaccuggucuuucugacuccugugcuccauugcuucuuuaggccgcauucagacauucuauccauccuucaucccccauucccuacaccccuuuaccuuauuguuuccauugcccuuuguuuauucaacaaaccuccgacaacguuuaagugccuucuuuauguugggcuuaauuagaacacuuuccaggcaugggaguucucucucugcuucugggcaugggagauccuuaaguauaguggaccacagugcauuccuuguacauucagggcccagcacugguauucuaucacaagcacagugucuggguccuaucaguauucaguaacauuuagugaacaaucucagggaaguagaacauuuucaguuaaaguguauuuucuauggucugugaccuaauguauuugcucaccaaaauaauggugaaaauuggaaaaauguuuagccugccauacauuaaaggcuggcaaacuuuuuccaaggaacacuucaacggcagcauuuguauuuaaguagugaauaugcuaauugcaugugcuucucaacuacuucuuuauuaaaaucacuaggagagucuuuuuguuuuguuuuguuuugagacagagucucacucugucauccaggcuggacuacaguggugcgaucucggcucacugcagcucccggguucagcugauucuccuaccucagccucccaaguagcugggacuacagaugugugccaccacacccagcuaauuuuuuguauuuuuaguagagaugggguuucaccguguuagccaggauggucucgaucuccugaccucgugaucuacccgccucggccucccaaagugcugggauuacaggcguuaggagagucuuuugagaaaaauaggucuacuguauggagcggucauauuuauaauaguagaagguugaaaacacccuaugccucccucaggaagagagugguuaaaugcauuaugcagaauguguaaaagaaauacuuuguggcaaugaaaaaaauacccuuuacucagauuuuguguaucuguguguguacaguagauucucauuauuugcaguaaauauguucuauaaacuugcccccaacacugaauacugagcuuuaguuccuagaggaaaugcaggauuagguuccuuggagcuucugaucaccuuuucaucaaaucauuuaaugaauaacuuuguuuuauguguguuucuguuuagugguaccuuauuuaaauuacaguuguuccucaguguacucagagaauugguuccaagaccucuugcagauaacgaaaccuguacauacucaaguccgguaguuggcccuguggaaccugcauauacaaaaugucagcuucuguauucuaggauccagggaauacuauauauuccguuuacguuugauugaaaaaaaaaauccacauauaaguggaccagugaaguucaaacccaaguuguucaagggugagcuguguguuguugguucauuaacauugaacucuugaccaaucgcacuauaacucaaacaugaguauuuucuccguaagacacaucacagccuucuugggcuaaggacaccagagaguacuucagcacuaugcuuggaagucauuuuaaacagugaaaccaccaccauaaagcacaaaauuccaaacaauguggcacuuaaucgaaauaaaacaagaaugcagaccauagaccaucaccuuguucaacaucagcugggaacauguguguucuguuucucaaaauuuucacuccuccauggagcauggcaaauaaugauuuggagguuacaaauaaauguucacaaguagaugaauuagugcacgcagaaucugggcaucaugaggaucaccuguguaucuguaccucccucuuccacccaauauuugagagcaaaugggagacacauacccucuucuccuaaaugcaucauguguuuucuaagaucaagaacuuuuucuuacauaaucacaguaaaguuaauauaugucaggaaauuucauguugauucaauaucuaauccaaagcccauauucaaauuuugucagcucuccccauaguguccuuaauugcuauuuucuuccugguccaggauucaauacaauuuuauacauguauuuuguugucauagcucuuuggucuccuugaaucugaaauaguuucucagcccuucuuuguguuaguuaaucgugacauuuuugaagauuacaggucaacauaguagaaugggcuuucaucugaauuggcagaaccuuccucaugacauaaaauucuauuuuguucuguuuuauacaauuuuuuggcuucaucuugugcauuuucaguggaauaccacagaagugcuguuuuguccuuuucaaugcauugugucaggaggggcaugaugucaguuugcccccauauugguggugagagcucugaccuuuagguuaaggugaugcacaccguguuucucuaccacaaacuuacccuuuuccccuuuacacauuauaauuaaguuauuuauggagugguacuuuaaaacgauugagucucaucacauucuauucacugguuuuagcauccauuaauguuuucuguaagguauuuauaauucugaugguuaauacugauugucaacuucauuggauugaaggaugcaaaguauggauccugggugugucugugaggguguugccaaaggagauuaacauuugagucagugggcuaggaaaggcagauccacccuuaaucugggaaggcaccaacuaaucagcugccagcauggcuauaauauaaagcaggcagaaaaaaauguaaaaaggcuagacuggccuagccucccagccuacaucuaucucccaugcuggaugcuuccugcucucaaacaucagacuccaaguucuacaguuuuggcacucguacuggcuuucgugcuccucagcuugcacauggccuauuuugggaccuugugaucaugugaguuaauauuaauaaacuccccuucauucauauauauaucauauauagaguauauaucuaugauauauacucuauauaugauauauuauauauauaaaguauauaucauauauuaacauauauauauauccuauuaguucugucccucuagagaacccuaauacaguaauugacauucuuuuauaaggaagagcuuuuccucucccaacuuuauguauucauucaguaauuuguauuaauaucaaaaggacuuuugaagauaguaaauaccuaaauaaauagaauuuuauucaaugaguagcaauuccuuacuaucauuuuuuuuuaauuuugaaccucuuaucuucccagauuuggccacugggagcccuuuccagcugccuccuauguccuuuugaugucuccaugauucuuagacagucucuguauuuccugaggguguuggaaaugcucuguaucuugauggggcuagguucuaaggguauacaccuauauaaaaacccauggaaaugugcguuaugauuuagacauuucauguauauaaauuuuaccagaaagagacuguaaaaaaacaaugaauccuagccaggaggguacuuuuaaaauaauggugugggugagcaauucugaaguuaccuucuauuaauucuagcuugagcagaagaguaaauauauugaaaauaaugggagucagauuucucacugcuugagaagguaauuauagauauaauuacagauauggaaaacagagaagcaauaauaaacccugauuauuagauuagaauccaagguauugauauaaacucaugguuuuuuacacugaaaauagagagagagugagugugugugugugugugucccuuccuagcucugccagcuuugagggccuggacacaauacaacaauagcacugagcuacccuaguacuuacaucuugguuucuaaauaccacacuccauuaaaaggaagcagggcucauuauagaaaagacugaacucguggccagggcagggaaaauagaagauuagccuggaauaucuuguugaacuugauguacuuuuaagauuuuuuuaauuucucucuucacaguccuuucuggaggauuuaauuacauucauuuucuucuuuaaacugcuuacuaaaacuauagagagcaagacuguggaaucucugauaaacauagauccggaaagugggauauaccaauaucuagcaguagcuuuggaguaaacaauaauuggauugccauuguaucuuuuauuuauuuauuuauuuauuuauucauuuuuauuuauuuuuugagagauggagucucacucugucgcccaggcuggaguacaguggugcgaucucagcacacugcaagcucugccucccggguucacgccauucuccugccuuagccucccaaguagcugggacuacaggcacuugccaccaugccuggcuaauuuuuuguauuuuuaguagagaauggguuucaccguguuagccaggauagucucaaucuucugaccucgugauccgcccaucucggccuccuaaagugcugggauuacaggugccauuguaucuuuuauuguguucucuugcaaauauuaaucuuaauguuaccugaaaugugauaauauuuccauuucauuuugauaagaaugaauaaugguuaagcccucuugugucugccccaguaccuucuucagcaccuguuuggugcugguguccaagagaaguucucagccaggguccccagccacugcucccuaacccacccauagcagcuuagacuguggccccuucucacugggcagggagggaacucugggcugcgcugagguuaugcucaaccaaauuccucuucacaguacccagcuugugucucguuccaugugugaauggcugugaaaaagccuggauucauggggugggggcuggaagguggaauuaguaccuuuucaauuuuuuuuaacguuauuuucaaauaaaaagauaauaagaaaaaagaaaacagugggccaggcacgguggcucaccccaguaaucccagcacuuugggaggccgaguugggcagaucaugaggucaggagaucgacaccauccuggcuaacacagugaaaccccaucuccacuaaaaauacaaaaaauuagccaggcgugguggugggcgccuauagucccagcuacuugggaggcugaggcgggagaauggugugaacccaggaggcagagcuugcagugagcccagaucgugccacugcacuccagccuggaagacagagcggcacuccgucucaaaaaaaaaaaaaaaaaaaaaaaaacaaaaaaaaaagaaaacaguggcaagacgugagcucuagagccagacugccugaauucacaucccaacucuacugccuuaugacauuucucuggccuguuuucucauuuguaaaaugggaauaauauuaaugcuuacguggaggauaagguuuuguggggauuagugaguuucaauacacauaaaauucuuagcacaguacaugacauauagaaaacauugcccuaacuauuauagcuauaaacguccauguuaguuuauuaaauaaaugcuuuacauguauuuaagugaguauauuaaggcuuguguauaaacuucuucuugcccugcuggaaguugcuauauguacuuaaagguguaaauaaauguuucagaacacauuuuucacugcuguuacauuuuaccaaugacuuugcccaucuuauuaugaaguuuuuuguuuuuuuuagauggaguauugcucugucucccaggcuggagugcagcggugcaaucucggcucacuacaaccuccgccuccuggguucaagcgauucuccugccucagccucccgaguagcagggauuacaggcugggauuacaggcgcccaccaccacacccagcuaauuuuuguauuuuuaguagagaugggauuucaccauguuggccaggcuggucucgaacucuugaccucaggugauccaccugccucagccucccaaagugcugggauuauaggcgugagccaccaugcccagacuauuaugagguuuuaaugccuguucucuggguuuagcagaaggaacaaguuauuuuucccccaaaccaauaucuuucuuuguccauuagaacaugcuuuauacggcauguggagggaugugugugccucacagucccugaccagcacuucguaucuuguugaguuauuaaugauuucucuaugguuauuucuuuucugaaaauaaguaaucaccauggcaaugcugucacuuacuaaugaugcaaauaagacuuuacgcaucucugcaaaucuacuuaaaaauaaaauagcuuuaaaaaaauauugcccucacauuuggaucaguuacucauucuauccuguuuuuuguuuguuuuuguuguuguuguuguuuucugccuuuaguuuugucugcuuuugcuuugucagaacauagggccuauagaaagaaaggguaggccgggcgcaguggcucaugccuguaaucccaacacuuuaggaggccuaggcaggcggaucaugaggucaagaguucaagagcagccugaucaacguggugaaacuccaucuccacuaaaaauacaaaaauuagccgggcgugguggugcgcaccuguaaucccagcuacucaggaggcucaagcaggagaauggcgugaacccgagagauggagguuacagugacccgagagcaugccacugcucuccagccugggugacagaggaagacuccgucucaaaaaaaaaaaaaaaaagagaaggagggagggaggaaggaaggaaggaaggaaagcaagaaaggguagaguuuaagacgguuugauucucuagauuguguuacucucauuuuucauuugaagaaauggaggcgcucugaggcauauuuauuauacuguagucuggucaaccagaaaaacaaccacacagaaacaaggugccccuguccuaacagcugcacccaccuaaagcccagauacccacauggccagcagcagcagcccccgugugucucugcagccacauuugccucaguuucucucuguaaaguggguauaaugccucccucgcucauaucacaaggguaacugagaacuugccugagagaugacuuugugugcagggauagugcuaggcagugcuaggaggaugugauugaucgucaugcucuggacgccgccauuccugagaugaaaguugggaaaccauucucagggaaaggcagcacccuucccaguccaggcagcccucuucacguccacauuggauacugguuccuauccucuguuaccauuuguggauauaaauaucuaucugucaauaugcacaauuaguggaagacauagguugccaaaaaccacauuuguuuaguaugaacgauaaacagaaccuuugggaaaguugucuauucauugguucuggaaaguuuucccucugugugcaugaaauuaagaauuuggaauucacagcagcaugacagagcuuacaggaagcugacgaggcccaugguuguuguuuugaaggcuugcagccuuaaaggugugcaaaauuacagaggacaagaagccauuuucacaacuggauuugcagcaucaauuauucaccaucuguuuacugagagccugguaugugcccagcaccggugauggcuccugccuuagcaccgagugcagcugaggagagaaaaacaacacccaagaaacaguuucagaacauuuacugcucucuugacuaggaauacaaaaggaaguuaaaaacaaaacccacgcacacacauagagaaaugagggucggccaucgugggcaggaaggggauuucagaaagccuuuaaaugaguuauauuuugcuuuuacauaaaaaaacaaagucugucauaugucuagccggcuagugcugcugcugaagaagcugaacaucgucccagagggcagcagaacucuccgcaucgcacacaggcaguuuccagccaggugugugccaguugcuggguauaugcuuguuugcucugagcccuggcaucccccuccagcugacagcugcuuuguugaaacugcuguuaaugcugaagagggagcaaaaagaaagaagggcaucgugagguguccugccucugcacguugggacauggagugguucuuucugaggagccaggcccuuaauuccugaugugcuuuucuaaauggucacgguaacauacuuccgguuaauuccugaugcgcuuuucuaaauggucacgguaacauacuuccgguuaauuccugaugcgcuuuucuaaauggucacaguaacauacuuccgguuaauuccugaugcacuuuucuaaauggucacaguaacauacuuacgguuaauuccugaugcgcuucuauaaauggucacaguaacauacuuccgguuaauuccugaugugcuuuuauaaauggucacaguaagauacuuccgguuaauuccugaugcgcuuuucuaaguggucacaguaacauacuuccgguuaauuccugaugcgcuucuauaaauggucacaguaacauacuuccgguuaauuccugaugcgcuucuauaaauggucacaguaacauacuuccgguuaauuccugaugugcuuuuauaaauggucacaguaagauacuuccgguuaauuccugaugcgcuuuucuaaguggucacaguaacauacuuccgguuaauuccugaugcgcuucuauaaauggucacaguaacauacuuccgguuaauuccugaugcgcuucuauaaauggucacaguaacauacuuccgguuuagcaacauaacuggaugcuaacauaaugacuacaaauaaugacuuaccuauguuaaguacuuauggacccacgguggcuaugcugaauacuuugcauguauuuccuagaaucuuuacaauaacaccauaaagaaaguacgaagagugucccauuuugcagaugagggaacugacauuuagagaauuuagacaucuguccuacgguacacaacuaucagguggcccauacgaaauugcuuuuuuagguaucaaaagccagucacuuauuaaaaauuucauguaguucaugcugacaauuucuggcagagccauugcuaccagauaacucuaaguuuguguguauauacugauguaaaacucuccauggcuccauggcugggcuuuuagucagauuucaccaaauuaaaaagaugaacuucuacaaaguuaaaaaauuuuuguuugcacuuucagcaaaauagcucuuuauguuaaacucugagacauggaauacugaaguuuaugauaucauugugguugcaacaguguucaacuugcagguuccaugaugguugauuuuugacugcuugaguguguuucccugcaggccugcagggugagcugugaagcucacauagagacauuugaguuguauuaaaauggguuagccaaggccuaaugggcuguaaaaaauaaugugcugugguggugugucugaugauuuccagcccucauucuuucaucauuagaccagugacacccucuaaacaaacaucuuaccagucaauggauaaguggucccuguguccaauacauaauucucaugcuuaaaauuaaaaaguuauuguaaaaacaaaauggucacuaugccuaauauaucacuguucuuccuuagcaauuagaaccucuaaaaugagugaaauuagaauaaagaagaacauuucuaucuuguuugcaugagcagauaggucuuggaccucuggaaguucagcucaguccaccaguguuuauugagcaccugcagccaggugagaggcauucugcagaauuuguggaagaaucauacaugcuuaaguguucucugcugugccucagucucccuauuuauaaaaugaauaaagacggcucugcuuccaagagauuucauuuguauggcagcuuaaaaucuuccagagaaacauggcugccauuuacauuacuaauaaauaaaauuguucccuaacagaaaccagcucacucaaccugccuauauuuacaauuagagucguuuguuuguuuaacagauccuuaagccuuacuuccagguacuguucuaagcauuuuauguauuuuuuaaaaaccuauuacauagauauuguuacuauucccauuuuacagaugaggaaacugagaccuagaaagguuagauaacaggccuaaggccacaggacucugaaaguaagugaggaagccagguuaaacccaggcagucugguucauaucguuccugaaugugauaacccugcagucuguuccaucccgggcacaggcaacuggcuauucucacuggggaagucuguuuugcaaggguccuucuuugugugccugaaugugaugcauuuugcacuuacuuccugagaaaacuauugcuguuucuuaaagguucaauggcuuuuuuauccaauuugugauggaauucaaaaacagaaggaaggauuuuuccaggagguaucucuguuucuguaauggaauagccauuaguuccaguuucuccccuuagcuagcuccccccgacauucucucucucuuucucucucugacacacacacacacacacacacacacacacacacuccuugaguguucggaugaggacccugcgggcccugaguuccugcccgacagcauaagaaguuggcguagagucagccccuucccacugccugucagaauucuacacucuuccuuuuaguuuuagaaacccauucaucaaauguguaugauuaaaaacagcagaauugcuagauucccuuaaagaauuggguaauuuuugcaacaucaucauuucucccccaccccagcaccccaccaucagaacaaacaagcagaccuuuuagcuugacuuuucagcacucagccauauuugcaaguaaugauuacucugguuaggaauuucauauauuuuaaaugugguuucaaaggucuuuuuaaaauuaauuccuccucccagccuuccucuuucuuuuucucuccccucuucccucucuccuucccgugugugccugugcauguguguauguuuauauauuuaaaauguauuauuugaagacaggccauguuagauuuugucaguggcacauuuccuugauggcuguuuuaucagcauguuuuuuuuuaaccuuccauagauaugcaucugcccccaaauagcguuuaaugaagaggucuucgaaauaaaucucugaaaacaaaagcuacuuuauucaucaucugcauggagagcagccauggaaacucaucugugaaaugcauaauuagaaaccagaggccuauguuugugcauuugccagagaguggggagauaucgaugguguuaauaaaauccugauuuucaguuccuucuucucugaucagaauaagaauuagauuacacagaaacuaaauuacaagaggcagcauagagaagaaaaaugcauuauuuuucuuauuguaauauccuucuucccauauucuuuuucauaucaaaacauggugcuaaagcucuuuaagauucauauauauaagcuauauaugaaaagcaagcagaauuauguggggaaaacaaauauuuacuuuucuguaggcuaaaaaucuucauauuucuauuuugcugguuuuuauuuuaaaauauuuaauugacaaaaauuuauauauucaagguaugcaaugugaugaugcgaugucugcauaccuuguguaaugauuacuacaaucaaauuaauuaacauauccaucaccacucaguuaucauuuuuuuuguguguguaaguguauguauaguaaggacaacugacgucugcucucaucaaauuucaaguaaacaauacaauauuauuaacuauaguaaccauacuguguauuagaugcccagaauuuauuaaucuuauaacuagaaguaugugcccuuugaccaacaccuccccauucccccacccccauccccuggcaaccaccuuucuacucuuugcuucaguuaguucaacuuuuuaaagauuucucauguaagugagaucauguacuauucgucuuuauaugucuggccuauuucacugagcguaaugucuuccaaguucaucuauguuguuacaaauggcaggauuuccuuccuuuuguggcugaauaauagucuaauauauauaauaucccauuauauauaauauucaaauauaauccauuauauauggaauacacacacauauauacuuauauuuacauauaaacacuuauauacacauauauaugucaauuucuuuauucauuuaucaaugauacuuaggcuguuuccacauauuagcuaguauaacuaaugcugcaaugaacaugggguacagaucucucuucuaaauacugauuucauuuucuuugaauauaugccuagaaaugagauugcuagaucauaugguaguucuguuuucaauuuauggauuuauggaggaagcagcguacuauuuuccauaaugauuuuuuuucagguaguuuauuauuaguauauagaaacacaacugauauuuguugauuuuuguauccugcaacuauacugaauuugucuauuaguucuaacagauuuuuggugacucuuuagaguuuucuauaugugagcucauauuaucuucaaacagacaauuuaucuuccugccauauuuggauaccuuugacuucuuuuuccugcuuaauugcucuggcuagcaccucuaguauuauguugaauagaaguggcaagaguaggcaucuguaucuuuuccuuaaucuuagaggaaaagcuuucagcuuuucaacuuugagugugauguuuacugugggcuugucauauaugguuuuuauugugucuaauuuauugauuguauuuaucaugaaaggguugcauguugucaaauccuuuuucuaccucuuuugagaugauugcaugauuuuuaucugcauucuguuaauguggugaaucacauuuauugauuuguguauguucaaccauccuuguaucccagggagaaauuccacuugaucaugguguauggucuuuuuaaugugcaacugaauuuaauguacuaguauuuugcugaggauuuuugcauccauguucauuagaaauauuugucuguacuuuucuuucuuucuuucuuucuuuuguaguacccuugccuaauuuaggaaugagauaaugcuugucucauaaaaugaguuuggaagugcuccuuccucuuuaaauuuuugggauaguuugagaaggguuguuguuaauucuuccuuaaauuuuugguagcuauguuucuguuuuaaagacuguugacacuuaggauuggcuuuuugguguacuaaaguccuuguaauccugauaugcuaaaccacauuacuuagaagacugauuauaauauauucucuauaaccuaccaagguugaggaaugggauuaucaaaauguguggcuaauggaagcuauaugacuuaauaauaugaauaaucucccgauaaguaagagaacuaaaugcuuuuauuauaaaaacuguagcaguauuuagucaguacauuaauaucuggcaacccuuaaagauguacugucacuuacuggguugcucuuugaccuuugucaauucauuuaaccuuuuugggccuaauuuucuucaucuauaaaauggaaacaaaaucauuucuccuucauaaaggugguauuaaggaauauguaaaacaguaaaugucaaaauauccuauacauaugugagauuauuuuuuauuaucuugcuauguuugaaguguuagagucaccguucauagaauuucagauuaauagaaucauaacaacaggauuuauuuuaauugagauuuuagguuagugaggaaaaggugggaucauaagcuaauagacaucuauacaugaaauacuguuuucaaaaauguaagguuugcaaauaauugauuuggcuuagaaaauccacguugcucaacccauaauuacaaguuuucauucaucuugcuuuagaagccaucuuuccaccacagcauauuucaugcuguguuucuggcaaaguuuucaugacucaauuuggagacauagauuuucuuacuugaagauucacacagcccauuaguauuuuaaagauucugagaaucuuaugaaagaaaccugaaacgaauauuucccuaacuuacuugacaugaaaaauccuuuuaaagagagcaucuguuaacauucuuugggucaaauaucccauacuaccuuaaguucaugagcuccggggguggacugcccuuguucagaucuccauugugugaccuugggaucauaacucucuaaaccucaacacucucaucuguaaaagggggacaaugauauuuaucucauaagguuguuaaauaagguaauauaucuuuuaauacguguuguuuaaugggauaguguauguaaauuaugaaacaacauauuuuaagauagguaaaacccugacuguggugggaaugggaggugggagaaggcuggaaucacucaugggcuagugguccuuucuggccuuuaacuccccagugaaggugacagcuaggccucuucauaaucgaguuuccccuuacuguaaaacauggguccuuguucuaccccaaggcagccauauucccuccucuucuuaguaucugaacuuagggucaccuauucaaaugugcacaugggccaagcaggggaugcaaacauguuaaggggcccagggugaagggcgggggaaguggugugggcgugggcagcagggcauugccagccucuucuccucgggaccacgcuguggccuccuggaagcccaaggccaaucugccuugacuuuuauuuuuuaaaaagauaaguuagaaaucuggaagguguuaacauuccugauuuuucuguagacaaauuguucagauuaaaacacaaagcagcacacuguuuggcccaugagcuguugguuuugcagugucugcauauaaaagcaaaguccuagggaccucugcuaaugggcuucugguggcugcccucucccuccccugccagcuugcucaccuuuucgcuuuucuuugaccucugcccuuuucccuugcuaagaagaaagaaaacccaugucuucuguucaaccaauggguuccacugguucugccuacugggccucuguuuccaucauaggacucuuucuccaagugcuuccuaaccaguaaucaccguuuauuugauuguccaccaggcuccagacuugcuagguucuuucgcgugcaguucuuuguggggauccaacugccucaucugugauccccgggcaaccuggcauuacagccuucaguucuguuuuucauccuaaggccacgccugccugucuuucuacaccuuugucuauauucacaucaucgccauaggcaaucagcucuuuggggccauuuucgaggaauuaauacuguaugagagggagccauuccuaauagucuuucuugacaguuuuagguuagucuuuacuauguugcuaauucagacuuaaagagacaacuggcccuccaugucccagcuccacggugauggguguguuucucagcuucucaaggaacugcaucucugauaccuuuauaaucccaaggccugucacacagccugguccauagggaggaggugguaaaaagccaagagcuagagccagcuccccccguccuaggucccccaaccccaguucggcugcuuccuaacuuaacccugggcaaauuucuuagccucacugugccucagucuccucagcugugaugagggguuggugugaggauuaacagaaagccccaagacagcacuuggcagguagcuagagcugcauaaauauugauccuuagugguaaaauuaguauucauguggcaggauugcaguacaugcuuaucagaggacagagcucagaaaacuaguuugucuuuggcaguaaucuucucuugaacaauguaagaaucaucuuuuauuuugaagacagcaagaacccugcagcuucgcuuuggcaguaccauguuuuucagagccugcucgauuuguacacugagugcggcuaccucugcagaugugcuguaaugcagcaggcucacugcagugauuccuuaaguguuagacgaagcacauugcaaccugccauaucugggaacaccagugguauccugcuaagagucugguugcugagauuggacagagauaagcagcaaaaugcuuuaugaaaauaagugcugaauauauaaccuuuugguaaaucauuuccaaguagauauuuuauuuuucucuauuuuauggauaaguaugugucaacuagcuguuugugcauagauacagagcacauuaaaaaauugaauauuccauacauauaaaugagcugcuauauccuagugauuagaagcauaaacuuggaugccaagcagagagcguuuccauccgcagccccacccugcauagcuaugagacugcacagucacuuaacugcaaguuacgguuucuccaucuauaaauugggaaaccaauauaguacuucacuccuaaggugguuuuugaagauuaaauaucaaaauguauguaagguucucaguucaguaccugacauacucuaagugcucaguaauguuagauaauguauuuaaaguugguggugcuacuggacuggaucucagugcaggcaaaugugauagugaagaaugaugcauagaugaccaguggccuuuuauagagcgagauaaacacauugcaugaggcugguagcaguguuuccccaugcaccguauguguccaaguucucuguggagcuuucagaggagacugaugcccagcacuauuccuggagauguagauucacuugcauagagucucaggcacccagccagcccgguugagagcccuucagcucuggcacagugcuccacaguuacugaggucauagcuaccagcuguaccuuggugucgucuagcacagagguguucguuguuugaugagggacaggcugggaaugugagcauucauucagauccauccccaucucugagaaaaauauucccagcauagcaucuguugauguggauuugaguaggaaaugggccucaugcacuauucacauucaucuuuuaccccucaaucccauaugugcaguccucaucccaguagacuuuauauuagucaguggaaguacagcuuuguacauuguacugaagcuggccagcacuuuaauuuuuugagggaagagauauuuugcuccauuuuugcauuuggccuaucaugucuuauguuauaaacauuuuuaggccuuucccuuucucuaaauuucaaacuccucuugaagaauaccuacaucuuauuuuaaauuuccuaacagcucauugcuuugcacauuguaagcuuagagugaaauuccuggaaaaugaauuaaccaugagaaauuacuaagcagucauggagaugagcugugaaaauguauucuggugauaugguguaaauuaugcauaucaaucacauauaaaaaacacacagaucaaagaaaauaaguauaagugcaacauuacacuuucacaaucaacccagacuucuguuuauuggaccuuuggggauggaugagggaaucuuuugguguuaaugccauugaaucuuagauaagaaaacccuaccauuucaucuuuuuugacaaaguuauaaauuaauuuccuggaacuuagagaaaagaauaccauacuuaaaugaaguuuaggugucugaaagucacacuaaggccaaguaacagcaggaacaagggaaaacacuagaaccgagugguccaagacaagguggucagcuuucuguauuugagaguugauugaauaugagaagaaaucuuacguccccuccgcaacuuacaucagcuucucugagcacagcugugaccacucuguuggauucuguggggaagaucacagaaacacaagacgugacuucugcucucacgagguuugccucuggccugaacgccuccucgagauaugggcgauccaggugccugcuggcauguccacucggaugaccuguuguguuucacauucgacauaaaacucauucaucuauaccauggcauguggagcuugaaggaaccucagcuuuaucucccaggguuugcugauggaaaugcugacccauuucuucucgccccgaggauccuuucccuucccacuccugccauuauacaaucaucaacucacauagccccucacucugugauccucccaacagaucaugauugcgcuuuggauucccauaguacuguguuuguacuucauuccuuaaauuaguguaaccaauguuuaaauuaaauauuuaaauuaauuuaacccauacuuacuuccccaucacuuuguaaauuucuuguggaaaaagaguaucuuacuaaucuugugugccuuucauguuucuucgcacauagcuuucuauacauauuuguugaauuaaugagucaagagaaaaggaagacugucuaagaugggucgauugaugccaaaguguuugcagacaauacauuuuguagaugcucauauuuuuauauggcugcucuagccuuuuaaaauaugccauauuuggcugagcgcgguggcucacgccuguaaucccagcacuuugggaggccaaggugggaagacugcuugagcucaggaguuugagaccagccugggcaacaugggaaaacuccaucucuacaaaaaaauacaaaaauuagccacacauagugguauaugcuuuuagucccagcuacuugggaggcugaggucagggaaucacuugagcccaggagguugaggcuacagugagccgugaucacgccacuauacuccagccugugugacagagcgagaccuugucuccaaaaaaaaaaaacagaaaagaaaaacaaaacaacaacaacaaaaaacaaaccugccauauuuacuuugacugguucaaaucuuuaagagacacagccucuacuaucacuuguaauauuuuaaaucccuugaaaacaguggugugaucuuacaguagaaaauucaccaaccugccaacccugaaauagacugagccucuaccccagacucuuucuuuguuuauuggauuuaucuagugccuuugcuuuagagcugagaggacauaugcuaggcaccuggagagaucccguauuucaaaacaaccgauagccaguaagaauggggaaggcagcagacgccgucucugauguugauauacccugcuuugucuccccucgcuuucccuuagcaaagaaauguuucauauucgcagcacagucaguacuccuugccugccacgaggcccagagcgagaaaagcccagaaaggaggaccuagcagguacccaggccucuugaagucacagcugguggcaugagggaccaaccauccaucacacugggccacacagcgccuggucacaaccugcuugcagcccagccucuuaaggcgaucggcgcuucuucucucucugccucaucucacaaaucuucccucuggcccucacccuccucccaucucugcuuucugccuuaucuccuugucacaguacuagaaagggugagccgaccaaagccguccugagcaaugccgugcuucugguucauuagcagcacacagaacaagugaggagggguggacagaacagacaggauccugccgaccgugagugaguaacaggcguauccaugcaagguuuuccagcucacgcaaagccgugucucuuggaagguuaccccuauggcuccuccaugaaggaacugcaccucccgcccccaccggccucugcuggugccuuuccaaacacagaggugcacggccguacccaguaaacaguuaucuucacagugcaggggcaaagugauaccuguaagagaaggugcagcaagagaacauguugcagagaaacaccuccaacugaaaugaugagccagugggugucuuuuuaugcccaucgucuuccaccucccucuccacaaaaauaaauaaauuaaagaaauucagcaccuguggacaacucugccaaaaggaaguuaccuccugugugguuugucacauucagguucuucacacuuuccgugggaacaaaggcugucuccauauuaccugucaaguaaggacaauggugaggcuccgcaaaccacuuugaauccuuggguuauuuggggaggaaguuauugaaaaaaauagcccauaggaaaauguuucauucgauuuuauucaggcucaggcgaauuuuuuauggcauuucggggcaguggagaagccauggggacaggaagauggucggagaguccugugccagucagaauguagggcuguauuuucuggcucauugcuauuguucaaacacaauuaaugauggccccacaggguagcagguggcugaacacacagcagcuaaaucccuggcuaagggucuguggaaggaguguuuccacguggcaggcauggggacaggcaccuccaguccuguuccauacuccuucacccuuccugacauugauucccaggucccucaccuaguugggaguucucuucugacaucgcugaguauuuuuuggguggaagggaaagaaacuugagggcauguaggccuaggaucuuuucuuugcagggauggggacccuucaguguagggcauaguacuuggagaguguuuucuuguugaguaucacaagaggagagggagcugguaccuuugaaguuccccucgaugagcagaggauucgugccugaagcaccuuugucauucccugagcaacuuaucaacacccuuguuccuucaguucuuuguuuaaauuuauguugugaauugguuuuucuguguuuucuuucuguacuuuauuagaaucuggugcgauaacagggauaaagaccacagacuucuugauaaauuuguuucucccuuccuucuuugccgcaucagugaggucgaggcaggagacagaaaccaugccauuuguuugguuuuuaauacagagaauuuaaacuaaagaaauguuagccuuugagggagguaauuaagaagucaagaggagaacguggagguuaucauggagguagauggcagaaagcagcuccccacccuggggcugagggaacaaucgaagaggcuggaauuaaugaaacuuaaaaccucaguggaggguccuucagagcuaaggcccagaccccugaagaggaggacaagccaagcaggugucucugagcucagaggagggacccguggggcugggacccaccuccaaggacaggggcugugcuggcaucucugaggagggguucgaugaggccgaugcugugauguugggaaaacugugaugugaaugaagccucugcuccugguugccaguguauaggagccguguugcugagccccugacaggaauagaaagcuggcagaauggagccagcccuuucuccucuguccggccggcagccuuccuccagggccaacuggaggauccuccuggggagcugcuggccuagcugaagggcaguuugcagaguccaacccagucucccaccguagagugcaggaaggggguuuggagcugagagggcacagcuuaauuacugcuuuauuagcccaagagcaaagccgaagguccuuucugucuuguagcuuugagcccugcacuuuuucuucuuguuucuuccucucuagcucugaguuugacccuuuagcucuucagagaaaaagucuaaaagacccucagcauuuccaaguguccauuuuauaaucccuucauaccuugugccuaggaggucuaccccuuaauccuuugauguguaccuaaggggaaaugacgccucagcugaaccgccaaucaugugcucuuucugauagguuuucgcuucugucggcauucucugauggcccuucuccccauuuccugugucccugguaccacagccagaucaaggcuggugaaaccagaaaucaugaaagagagccacagacuuucucauucaaguccgcaaauguugguuauuuccacugugcgccaggcacuaugguuaauagaacgagggagaaaaugugaucccugccccuaacacuugccaccaagugacacaaacagaaauguaaacucuuccccagguuacagacugggauggucauugccacagcuugaggaggugggagaagcagauggaucugaacuaaauugugguuggccaugaauggaagagcaguaaaauaguaaacauguauauguuuacgauacgcuuaccgacgcugacaccuuuaauccccacuggcaacaccaugacagacgacuggaaucaucccucuuuuuguagaugggagauugggcgauugaggaaacgcccaaggucacaaaaacuagcaaguagcagagcugaguuguagcggcugagugaccucccccuuagaccucauuugaagaugagauaaaguaacagugccuggcaagagaaaggggguaguuaauuauaccuuaccuaguauggaguuuuguaauuuauaaggguuuuaaauauguuaccccauuuaauuuucauaauaauucaaugagguaaggauauuagucuuauucuguaggagucuacugaagcuaaaauaggaauagagauggucccuaagagauaggagaggugccgccaccguuauacauucagcauauucagggaggccgucaggaagaggagaugcuuuguuggugugcugugauugauggcugaacaggagauuugggagucacacgcaccucugcuuugaucccagcucuccucucgcucauuaaccgugcaccccugagugcaguugcuucugcacccccuuuccccguccacaaaaucuggacaacaccaucugccuugcuccauugugagaauggguaagugaaaguugaaaaccuuuuugucauauguagguaccagcauaugugauaguuuuuggagaaagaagacaucccuaaauuugguuuccugacuagugcuguguauggaaccauuauucauuuugcauaagggaaauuaaucauuaaagggcuuggaauuuuagcucuuaauugaugauuuugcuuguucauagccucagcgacauugcauaggauuuauuugauggaacacuaaaaagcuacuuuuccagauuccaaauaguuaauauucuuaaaccagcaagaagcccacggucauuuugagaaacaggaauagugauuuggguggaggugagaugugagauacccugcaagucggaugugaaugccccugccagguucucuucuggccucuaguaaccaguggaauccaaaauuuggguugcacuuggucuuuucaguuuacaauguaggaaggacaaacucacuuauaaucuuuguuagguuuccccugccuaacuugguuaaauccagcaugucucagagguacuugacaauggcccaggguuuucacagucccccucgugacacccugugggauaguuuuggucaggugacaaugugugaggugcugagcacccgcuuuugcagaugaggaaaccuggaugcagaaagcuggcaguuugugccuggucagggagaagaaggccuggcgcuggcacugcugcccuggacggaaagcagcugcuccagaaagcacucaguaccuucuucuucucccuacuaaguuuggcauuugacccaacagauggccaaaaacuuguaaauauucacccauguuuuguuauuugaauggacugaucuuacugagacuuuugcuugcuggauggaagguguggcugucuuugggaaggggagagugaccugaccccuugaggacuuugggccauguuugccaagacagcugggucugcuucugcuccuggugcacagugccacauuuugcacuugacaccucuaaaauucccuuuccccucuggccuaugagcucuugggaagcagggaggaagucugaguggcugaagcagccauugcaggcaagacacagagcggcgccugauguucuuuucucuggucugauguuugaguucugcaggccaccgccugagcucagagccggccauuucuccagcagcacuccaaacucacagcacucugcuaaccaaggcauugcagggacccgcugugaacuuuggcguaggcuuuguuggacucauuugaauuuggcccaaaagaaaauaacauuucacauuucucccuaacguggagaaauugaacucauugucuuuuuuguugaagucuacucuaauauuaacagguggaauuuuauuuuaaauauagaaaagccaauuuuuaaaaacauacaaaugcauaaaccguagccaauauuuccuuccauuacauaauuucucuagcuaaugacuaacauugauauccuuuuuccuuuaauuuucuuuuuuaucuaguacuugauauuuagaaaauauaugcucuguugaaauuaugcagcauaauaauacaguagcuacccaugaagccgccaccggaccugugaucaaucucaccagucccuugggucaccaagaguuuucuuccccauccugucucccugccaccccuuuccuugcccagagcaacuaugauguuuucucuuaaaaauuuaggugaaagauggggcaaggaggcucaugccuguaauccuagcacuucgggaggccaaggugggaggauugcuugaggccaaaaguucaagaugaggcuagacagcauagugagaccccgucucugcaaaaaaaaaauuagucaggcauggugguaccugccuguaguucccgcuacucuggaggcugaggcuguaggaucacuugagcccagcaggucaaggcugcagugagcuaugaauguaccacugcacuccagcccaggcaacagagggagaccuugucuccaaaaucaaucaauaaauaaaugaguaaguaaguauguaaguaaauaaauaaguggucauguuuagcuuuuuugucuucucuccauuucuacccuguaauugagaguugauguuagacuauuuucuggaaguaucaaucaauaaauguuuucagaaguaaucaacucagcauaaccacuuucccuggguauuucugucaccaaaagggguacaaaacaaugcuuccaacacaggcauaaggugaaugucuacuggggggcuggggucacugcagagaaaaaacagaaacaguguuaauucuuuagcacuauggaggucaggaagaaaucgaaaacauguaguaucaaagcaucuggccccaaaggaccacuagaccaggacauggggguagggguagggugaggaagaaaggaggaaggucagauucaaggggguccagucuguaaaaggccuuccuucugugagauuuggauguuugacauuugcuccaauuuugaacaagccacuggaaaucacgucuuaaguucuuuggguucauuucaauuugcuccuuuuccucuguacacuggaacagucagaaggccagcuuuguguggauucaggcaaauucaagugacuucgcuagcugggccucaguuuuaccuugcagcauauagagucccuaucagaaugggggccuugcagagacugagaugaugugaaauuaacaagaaacugugagccagcucugagaguucauccucuaaguauauuugagguuaaauucaagguuagggguucgcagaccuagcuucucauuauguguguuuucaccuagcaucuccacucauuuuaaaugaggcagauggaaggcuuauaucugucucacaguaagcaugauuaacugggagaaauuauaaccaaaaccauacgugaguucacuuaaaguacaugauggcacaagaccaugacgauacagaaaagaaaugcuauggaagaucuacacagaugggcaaaccuccugcaaauauuuuacgucugagaggaaaaauagagugugacgguaaugccgccuccagaaagacuaguuauuuaaccgaaaaaaaugaacguaaaagauuaaguguuugguaaguucugaagaugagauagagacagaauagaaaagagaaguucucuguauuucuucugucaauauauuuauucauuuuuuguuuucaugaaaacguuugcaagauuaauuuaccugcuauacaauucacccauuuaaggucuguaauucagugguguuuuuuaguauauucacagauaugugaucuccacagucaauuuuagaacauuuucaucaccccagaagauacuguacuuuuggcauuuuuauucuguauaaaauaccuggccagauguucaaaggcagugaaauauuaugaacucugggcugaggccgccaccuccucugcaagcccuuccuuaaccagaggcacaugugauauuuuauuuaacaaagauuucucaggcuugcuucuuuuuuuuuuuuugugaaaaagcauuaaguucaggcaggggcauugaaaccuugcuucagacccuaaguccccaugaagauuuuggagccacaugcaaugcaaaugggcucuuacuccccugucuaacuaaaguagcacacuguagcuccauuuuccaaauacaugaucuguuuaaguaaagcauucuagagcuguaaggcaaauaugaaaggauucaaaaagacuugaaaauccauuucuguccucaaggaauucacuagauaguugggggaccaugauauugaaacaucaaaaguuaauugaauacaagguuaccagaaugauuguuccauaugauuucauuauggaaauacuuacagaaauucugucaaaaguuagguacaaauaugggaaacauuacaauuuagagggauguuuagaacuugaugagucucgugugguuucuuaaugaaguaacagaacaaaaguugccugaguaggaacugugccuaacucuggccaacacaguaugcuccugguacucagugaaaguaagaauaaaaacaaaaauuggaacaaagugagaaaaucuguaaauaucaaagcagcaugaaaucauaaguuaaaacaaccugaauucauaaaguaccaaacucaccagccaaauuugauaagcaguuuuuauuacaaaaugaauagauggaauuaaaaguaagggccaucaaacauuucgauggaaaacaaaguaacugauagugcaugcuauuuuuuauagguaaagcugauuuuuaagugaauuuagauaagaacacgaucgcaugggcuauaaacagacuggaagugcuuaugacucaagauaauuaaucuaaaagcuaaauuaaucauucgaaaaggaaaugucauggaaggcaccauagggauaaauguuggauuugguguuauuuacauaauuguuaauuaggcugaauagacuacuucuggaaacaguaguagaaacuuggacuaaauguuugugucccucccaaauucguacuuugagauccaaccacuaggguauuaggaaguggagcuuuagagggguaauuaguucaugaggguagaucucucaggaaugggauuagugccauuagaggaagagacagcagaacuugcagcucucucuuucucucccccugccaugugaagauucagcaagaaagccgccaucucuaaaccaggaagagggccuucaagcacccaaccaugcuggcacccuguggccuccagaacagugagaaguaaauguuuguuguucaagccaccgagucugugguauuuuuguuacagcagcccaagcuacaucagagcccuuaguuuuaaaugggaggccuuggggccgggcucggugguucacgccuguaaucccagcacuuugggaggccaaggcagguggaucacccaaggucgggaguucgagaccagccugaccaacauggagaaacccugucucuacuaaaaauacaaaaaaauuagccaggcaugguggcgggcgccuguaaucccagcuacucaggagccugaggcaggagaaucacuugaacuugggaggcagagguugcggugagccaagaucacaccauugcacuccagccugggcaacgagagugaaacuccaucacaaaaaaaaaaaaaaaaaaaaaaaaaaagacgagaguggggaggccucaaaguacagggguuaacagcauagccuggccuuaguagaccugcauuugaccuuggcucugccacuuacuggcuguuggaccuuagacagcuuaguuaaggucucuaagucucaguguccucguggacacauggauugguaaugguggcuaucucguggaguugugcuguguguuaaugagauaauacacaugaaguggcuggcacagucucuggcacacagcaccccacaaacggugaccauugguaaucauauaaucacaaucaaaaucaggggacgugugcucugaucuagaaagagaacaagugccauaaaagcugcaaagugguccuuuaacuaaacguggccaugguuagaagcugacucaaagucaccuugacaaugccauaacuguggagaacuuguggagaaaacagagacccucuccuguuugacaugcauuccaaauaauuucugagcugagaaagaaaaccaaaaaacacaguaacuuagccuaaagggaaggaaaccagagaaugacuuaauaaugauugacuagccuggaaaaauuugcaaguggagaaugauagugcuacccuguuucaguaacauuaaaaaggagaagaguuuuaagguaaggggaauauuuugaugcagaaagaaacuuuacugaaauaagggugcugcaguacuggguugaauuaacaacugacaaugcuuucuugagaauuauuagcuuucuugagaauguuuaugaacagauucaugggagcugaagaauuuuuauucagucauggaacgauaaaaggaaaccuccagccgggugcaguggcuccaccuguaaucccagcacuuugggaggcugagguggguggaucacgaggacaagagauugagaccauccuggccaacaugguaaaaccccaucucuacuaaaaauagaaaaauuagcugggcguggugguggccaccugcagucccagcuacuugggaggcugaggcaggagaaucacuuggacccaggaggcagagguugcagugagccgagaucaugccacugcacuccagucuggcaauagagugagacuccgucucaaaaaaaaaaaaaaaaaaaaaaaaagggaaccucccaggauuuuaaccuuggaaggugcauggagacauuuauauuucauauacgggggcuaggcccggagcaggggccaguuaggaugggguagcauuguuaaaccagaaucccacuuuuuaccccuccccuccucagucccuuuuggcacgcuuauaauuuauaaccgggucauggacaaccgucaaacuuguguaucuguugaacucuccaaaucaguguuuugucuagaacacuaugacgucugggcuuugugaauauuauuucaugucaucuucaccacaguaugcugucuccauuuuauagaugaagaaacugaggcauauuggccucagucaugugucaagcccacggcacaccagucagggccaaggccugaccgauuucggcugguaaagauacaaggggccacucuguuuuuuauuguguuauuuuuugacacagggucucacucuguuaccuaggcuguagugcaguggugcgaucucagcucacugcaaccucugcuuccugggcucaaauaaucuuccaaccucagccucccaagaagcugggacuacaggcauggaccaccaagcccagcuaauuuuuguauuuuuuuguuaaaaugguuuucgccacguuggccaggcuaggagccucuguagauuuagacagcuuguuacuuacauaaaugcagaaggaagaguagccaaaguugcaagcucccacccaucacaaaaggaggguccugaaacaaagggcggguauguuaguuuaguagggcggucauaaacagguaccacagccagcguggcuucaacagcagaaacuuauugucucucaguucuggaggcuggaagucuuaagaccaagguguuggcaggguugauuccuucugaggaucuguuuugugccuccuucaccuccagugguuugcuggcacacuuuggcauuccugggcuugcaggagcguuaucccagccucuggcuucaucugcagguggugugcucccugugugcaugccuguguucagaccuccccaguuugauuaggauaccagucauauugcauuaggguccacuccaaugauuucauuuuaaauguauuaccuccguaaagauccugucuuuaaguaagcucguauucugagguacugggguuuaggacucccacauuaucuuuuuuugggaggggaacacaagucaauccauaacagagccggugauuacaaugccagcugugacauagcccauugcagagaagccaguuaaaggcugcagcucagagguuuuauauucuaugguaccauuccaaggagggaagccagagagccucacaccccuucagaaccugggaggugaggagaaacugccucaugacagccucccagggaaguagggagguggauaggagauggcuccuagcagcuccuuaaaggccuggaacaccagaggaucacaagacuuuauccuuucaagacacagaugagcugcgguucaagucuuugcuugguggcuuaugcggauaugugcgagguugccagggggcccugacagagccguuccucugucaucgcucguaggauggggcagauucugagccaggucugccacacucccaucuacacuccuugaggcuugcuguuucccuggacaccaauucuuaugucgacugguugcugacauuuuguugaugucuuggagucacaggucaguuucccccccagaaagcaaacucugaggcagagaugaacaugccagaaagcucauuagcaggugcucgcagguucaacaccuguggaaaggcagggguggcagcaggaaugggcaggggaggaggugggcugccgugcacucacuaccaggcccucggcggaccccaggcgucucugaaaccacagaacugugagcugcaggcagggguuucucuucuagcccauaaaaggcagacuuuuuaaauuuaaauaaacaugcugcauugaaaguaguuaccacaagacaaacaaugauugccuuuauguaugauuuuaucauaaaguauauauucuuaacaauaucgagguauacacaguauauguacauacauguauauaucauguuaguaaaguaugauuuuuuguauuuuuuaacucccuuaagucggucgucucagcugucuguauuugaacugcaugacacacuuuugagucugggucauagaccagauccuuauuccggucauugaaugacuuuauuggguuuguaaauccuaaaaguucuacaugaaaaucuguauuuaagaagauauauacauuucuggaacaagaauuugaaucuguuuucauauccucggggagaccuuuguccuccucccugacaaaguuaagaaccauugugugaggaaacagagucaugucguggcugcuuuguaggcugcacuuugccugcuccaaacacacagcagugacagaucaaaaucuaaaaagcgaaaaugaaaaagucauaaucgugcccccuacuccccuaaaaaagauauaucacuacagaccagagacaaacgcaaagcagagugugaaaccagacacugugggcugcaggaucgcuagccgggagguggaaacagaggcuuagcucugguggcaguaagacuaaaugugccaggccagagcauuacucugcuugaaagcgggcaggguagugguccuguccucugaucuagaagggaggcccgaaucacugccugcccuaaccucuagccuauagaaagcuuugauccugggaagagcacaggacagagacaaggccuccuucucaggaacugagcuaagcaccccaugucaucaucagccguaucaccauugggcaagaacccagaccaccaagucaacuccauucugugugagggguucgagcagaggaaccauaaaaaccucugagcagggagggugaucagcaagagaacauucacaauuaucucccaugcaggccaagccugcccacccaaauuccaugccacgugaggaacucugaccuuggggugucagccauccaaaucagcaaucagaaugugaauucacuggagacuaaaguaaaauaaaaaagcuaucuuggaaaaaaaaaaugccugaugcccucaaagagaccauuggagaaauaauaaccauuaaacaaaaaaggaaaauucugaauaagaggcaaaaacuggcagaaaugaaggguaaguagauaaggaaaaaaauuagaaucucagaaaugagugauagauucauuaaaauaaagaaggaaaagcagaugagacuacuagacucaguugacaggagaauuaguaguuaagacgcuguuacugaagaauucacccagaaugcagcacagacacacacagaauaaaaccuaaacuaggucaguuaagaggagaggaagauagauucagaagcuccgcaguauggauuauugcaguuccaggagagaaugaaaggaauggcagagaaguagggcuggaauuuuucagaauuggaacaagacgugaacccucugauugagagcgcugucagaguacugagcagaauaaauaaagauaaaugcagacccagccucaucagagucaaauugcagagccuuggggauaaagcuacaccgcuuccaaacugccuggaaggaaagauagauuaccugugaagaaguagcacugacugacagcagacucgucaccauugcuaauaggcggcagggaaguugucagagugcuuggggaagacaaacaugaagcuagaauuuuguguccuaccaaauuauuaaagugugagggguuucagacauguaaauaccgagagaguuugccuccuguggacuuucacugccaaaaaaaacuguugaaugauacuuaucugagagagcagaagugaaaaagaaggaaagguguugggacuaggaaaggccuaagauuuuaccucacuugcagguuaacaagguaccgcugcacuuucauagaugcaggcagaaaggcaagagacuccugccucaaagaccaaggacuuuguuacucagcacagagguggcgugaguucucuuagcauuggcucuucuagucccccaguucaauagcggggagguggagcagcucuggaugcuguacacacacugggcuggagcacagcugaaaacccucaagcuugggcaccuuccaguauuucauuuguccauuugcguguguuuguuuuuagcccagucuuuuaaaggggcuauuaguaaaccugcccagucuuugucccugaggaagacauuauguuuaucauucuggugagggaacaaaccagcuuucugcuccagagggagagacuaaccaucuuccagugcuauuugguguacaagccaccacaaguuuuaugaaaacuccauagagcacugucccccaacaaagagguggaaaacaagaaaaaauacggaauuuaaaaauauuuuuaacuuaaaauuagcuguugaguuaauuuauuguuuuaccugugauuuuguuuagaagaugaaacucuagacaagaauaaccaggaaggagggcugcuagggaaaaugaagcuuccugucuuuuuuaguagcugaauagagacacuaaauaacuuugugcuuggaacaauuuauuaaagaauaauauguauguguguguguguguguguguguguguguguguguguguguguguauuucuuaaagaagagaaauacaauuuacuccuuacaccagggggaaaauauuagaauauuuugaaaaucaagcaauccaauaggcacagaaaaggagaaaauuuaugaaaagaggaagacugguuagcagaaaacacaaaugaagaugguauaaauaaaauauauugauaaucacagugaauauaaauagauuaaagugaccuguuaaaaaucugaagccauucagucaucaugaccuuguuccaccaucucaagcaggaaggaaggguggaaaagcuguccccacugaggucugauguuuuagucuccacagaauugccacaacaucucauuggugaaacugaggucaugcccccuccucgccuggccaaugguguaaauaaccaugacgcguuuauacuagucuugauuaacaagucaugacuuucauucccugggacugaggagggaccuuucccagagaucaagugggagauuuuauuaucuuuuuauuagaaagugauagaucaagaaaaucagcagauaaaagaaaggauauagaagauuagaauaauacaauaaagaauugugaccacaccagaaugagaggucauauaccuuucaaacaccccaagaacauugauuauauugcuacuuuuuacuugggcauguauuuuuuuuuuuuuuuuaguuuccaaauauaugaauuuuaugacuuuuaacaaauaucuuuuuaucgugaacuucaaauuuaauugcauugaugucggaaaacguaguauuacucauucuuggaacuuuguuguaacuugcuuuuuaaccucaaauauaaggauaucguuucaagaccauuggaaauagcugcagugugauaaauguaaggguaagaagagaguguuacaggaguguuuaccaucaguuugcgcauguccaagucauaugccugguaggaaaacuuuaaauuugggaucacacauuuuugccuaugccauuucuauucauuagguucauagcuguuucuuguuuacugccuugguuagaccugugaugagacagagcacugcugaugguggguaccuagucaucaguuuaaguuuucuguuuugagugaaauauccauuuaaucaaaguuuccaaguucauucuuacuaaauaguucaaaauauucaccuaugacuucuaaagucucuacuguaucuguaguuuuuuuugaguauuaaaucguuuauugauuacacaugauaaugaaugauacacaaacuucauuuccaucuauaauuuuaucugguuccagauucaauuuagauauauugcauaggaugggccaacaaucauuuuuauaaccaauaauuccaugauuuugcuuggguaaucccuuuuaauggugaacuucagaucgcaacaguaaccaucaguucaccuacaccaagguuucugaagacaauggcuucuccacccaagcagguuguauauaaacuccaaaaagaaccuggcaucacccugaaggaauucuaacuucacacucuuggggaaaauuuaccaagauggcuucagagcagacuaacuuuauacagcacauuaaaaaaaaaagacauuuauucaguaucacaaucagacuauuacauuuagcaaucaacagcaugggugccaaaaaaaaaaaucuguauuaaaacccuuuguuggaaugcuuuacacuuuccacagaacagaaacuaaaauaaccuguuguacaguuagucacaaauacaguccucaguuuuuugcccauacacaugaguauuugucuaaaauaugucuucuuuguagcagcuaggcccugccaccacugugcuuggcugaguucacaaauccguuguaaccuguagcuucccugacacuucucuggcucuccucuccggcuaagcuuuguuuccuaauuaaaaucuucugccacugccuuagcuacugcugcuacuggaacugcccuagccaccuugguuucaugguuuggcaaaguauuggccucuaccaccauagggaccagagcuucugccuccaaaguuuccucccuucauggguccaaaauuugaagacugauuguuguaauugccaaaaucauuguagcuuccaccaccuccaaaauagcuuccaucauuaccaaauccauuauagccauccgcccugccaccauauccaccaccaucauggcugccaccaaagccaccaugaccacugaaguuuccuccaugaccaaaguugucauucccacugaaaccaccuccacgaccaccaccaaaguuuccagaaccacuucaccucuuuggcugaaagaagcacucaccaucucuugcuuugacagggcuuuccuaacuucacaguuguggccauucacaggauggcauuucugaaugacagucuuauccacggagucauggucgucaaaaguuacaaaggcaaagccccuuuucuugccacugccucggucagucaugauuucagucacuucaguuuuuccaaacuguucaaaauaaucucuucaaaauaaucucuuaggugauguucuucagugucuuuaaugccaccaacaaaugccuuuuucacaguuaagugggcaucugguguuugagaaucuucucuugagacagcucucuuugguuccacaacucuuccauccaccuuguguggccuugcauucguggcugcuuccaccuccuccgcaguggcauagugacaaacccaaagccccuggagcaauugguguuugggucucucauuaccacacaguccaggagcauuccccauugcucagaauggcuccucaggcucucauugguuguuucaaagcucaacccuccaaugaagagcuuccucagcuauucgggcucuuuaggagacucugacuuagacaggacggcagggagaagagagacuuuaaugauguuuuuucagcagcauccacgagcagaaaguagcaagcugacgaaucguaucuguaguuuugaugcccuuuucaauucuuuuuaaaaaaaaaaaaaaagaauuauaaagaggaucaacaaaagaacacaucaaugcagucagcucucuguauauagggguuucacaucuguggauucagccaauuguagucaaaaauauuugggggaaaaacaauuuaaaaauacaacaauaaaacauaauaaaaauuuuaaaauacaauauaacagcuacuuacauaacauuuacauuguauuagguauuaugaguaaucuagaugugcauagguuauaugcaaauacuacaccauuuuauauaagggaccugaggauuuugguagcugugggggcccuggaaucaaucccccucagauacugagggacgacuauaugcaguuaucugauaaaacuaguaaaauagucauccuucuguuaagaaaagaaauaagaaaacaugaauaauauuguacguaaucgaaggucccuuuggauucuaaaauuccacaauucuaugguuguggguuaucaagugcccaccagguggcuuugccuguccagcuucagccucucugccauuccacgugguugcuaaacccuaggacaauccagggauggaggcaacgcucugugucccaccgacgugguauguccacuagcucacgcaguuagaagagaaaacacagcugaaugcacugacuguacuguagucauugcucacagcagguggcucuguaaugugcuccucuaggcucuagaauaccugcaauguaacagggacugugcacaguaaggagauuccagagguggagacagagaugcacaccccacccucaaaaauggcagucucucaggaagacagccaugaaguaaguaaguacacaaacagugaggaugaaaaguacugugcaagagaaggauagggugcaguaaugggauugauggagucugugaggauaccaagugaacaggguggcugagggccagaagugagguagggagggugggaaauuuuauauggagaaagccacuuaguguguuuaagaaacccaguaggcugggcuggccugaaccuacagaacgucggaaagagguagaagcuuuuaggaauuggaggcuuucuccuggggcaguggggagccacaggaugguuuuuaccaccaccgcugguuaagcaccuaaaagaaagcccacaucucaguaaccaugaucuguaguuagccucuuauuucccaacaaaaucguaugucucccauucaaaaaaacaaaggccacuaguagauaucccauguccgauaccuaccuauuaguggauuaaaugcuuucuuuuccguuaaaccauuaaacuuuuuauauuuuuuagcuugaaauaggcuugcaauauaauaagcugucuggguuuuucuuuuaaacugcauggauuuuaaacuguauuuaccacaauguauauuuuaauaaugucuuggggcauguguucuggcugccugcguuauuaucauauugacuguuguccaugaauuguugacacguguuucauugggacaccuucugccauuucucugucaccgugccuggcaucagaacucaggaagugugguaccucagcuuggauuaauugaagaggagauuccaugcuaauucuuggcaaucucagucucuuaucucccuaaauuuccauuuuccauaaggaacaaaagggaaaacaaccuguguaaccaccaaacuccugucaucuauuguuacauuaacucaugggucauuugucacagcagugugacuucaggagagaaaacaaaacgcuucucaggaaccaauauauuuugucaacagcacccggaugcuaacuaucguguuuguaugaaauguguguucuaaacugaugcauuuguuugacaacuuuauugauauuucaaguuggauaaucauuuauguuugagcauuuaguucuucagauacuuugccauuuaaaagcuuuauacuuucucugaucaaugauucaccaaaggguuuguagcaaugucaggcuuggcauaaauuaguuuguaaauuugcccuucuaaaagauguuuggauuuagcagauauuuccuuaggauuucauaguuauguaacaaaacuuuuuuuauugcagcaguaacuuacagaccaaaacauacacacauauaucuauguauaauuuugauguauauaugugagaguuauauguuuaguugugauauauauauauuugugugugugugugaaagcaauaaacaaauacaguaacuucuaaacauaucuaauuuuaaaugucuguccuauauaauggugaacuacugagcuaguaagcuggaaaaaauggaauaaagugggggaaauggcuacauuuauguuuaucacauccuuaaaggcauaauuugaaaaauaauuccccaaggaacuacuuaucaacccaauccuuuauuuuaguaauuagaaauacuaacaaauaaugacauuacuaauugaaauauuaauuuugauaagcucuuauuccucuacuaaaauggcuuucugaaaguaucacaagaaguuaaugaauugcauguuaauuaaauuugaacuuuucuccucuaguauucaaaugggaaaaacagaaauauaauacauucaaauuucuuuguacuaaguugaacguuaauggcaauauaaauauaauauaugguaauguuacacaugaaugugauaagaaucuguaauauucauaauggaauuugcuaauuuugaauauugauuugucuuuuaaguucauuuuguucugcaaauuuagaugcugaaaugauguuuuacuagcauuuccuaauuagucaagugcaacuuuuuaugaaaaauuuaaauauucucauucaacuaacaaguucauguaucuuuucuccucuuguuuuguuagccucuuagcaaauauccggcugugaucaaugauauuucauucugguugcccucugagaauuacgcagaaaaugauuucuaugacuuaguccgaacaauuggaggagaccugguggaaaagguugaucucauagacaaguuuguacauccaaaguaagugaaaagcuuucugauuuuacccuugacuaucucugugugauaaaugucauguggaagcauaucauaaaauuugcugaaacccaggguaucugagacaaaaugucuucugaauuuguagugaauguauagcuuaucagaaaacucuuugauaucagucgucucugaaaaucuuuccaagaugcauuuuccaucuuuccugccuuaguaaagaaaauauaugaaacagaaucuuuuaaaaguccugcagcuuuucaguauuguuuuuggaagugacuucuuaccuuagcauguuccaggugcagaggaaaugggcagaaagagcaguuuguggaguagaagcuguuuugauagucucucagcaaauauuuguuaagcacuuaccacacgccaagaucuauauuacguccuaggaauuaaauguguuccaaacagacuuagcucugccuucuuggaacuuauagucuugugagagaggcagacguuaaauacauaauuaugaaagcaugcuauuaugagggaaaaaugcauugggugucaucaaaaaacuaauuucauguggggagucagggcaggccacuuugagacauggaagcugagaacagaaggaugaugggcagugaagaaagaagaaggagcaucgcagauagcacaugggaguccuggggggaaaagggcacaugagaugcagaaggcagccaagaacacggcagcucaaggaccaagggggaggcuguguaaagugaugauuguuggguagugauguguuuccagggccaggugggccuggaaccugcaaggucucagacuuggaauuuuacccuaauuguagugggaagcuauagaaggauaggagcagagagauaagugacgugauuugauuugcauuucugacuggucaccuuuaaaugguccccuuuggcuccuagcuguuagagaagaaacagucaccaaauccugucuaauucacaccuccauuuucccuuccccgccugauuguuccaggugugucauaucuaaauugucagggcuccuggcucccacguuauauccugucauucagacucccaccuguuuccuucuuugucuuuuuuuuuuuuuuuugagacggagucucgcucugucgcccaggcuggagugcagugaugcgaucucggcucacugcaagcuccgccucccagguucacgccguucuccugccucagccuccugaguagcugggacuacaggcgccugcuacggcccccggcuaauuuuuuuguauuuuuuaguagagacaggguuucaccguggucuccaucuccugaccucaugauccgcccgccugggccucccaaagugcugugauuacaggcgugagccaucgcgcugggcugccuucuuugucuuuuaaagcauucauucucuagauaaagauguucaguguucacugccaauuguuuugccucccuuuccccaauuaucuaaaugacugaaguucaucaucuagaauuuugcucaacaacuuguggaaacaauagucccugagcucucgcauguucaaaacuguuuaucuguuuauacuugaauaacaguuugguuggaaguaaaaucuuggcuuggucuuucuuuuugggaggaucuuguaagugcugcucgauuguccucucaaguuuaauuucauauaaagaaaucugaugccauacuugaucuuuuugcuuuuuguuuuaaaggauuccuucuuuaucuuucaaguuuauuaucuuuaucaggcuccaccucaguauugaucuuuucucccuaguauauaucauuguguuucacaaauuggauuggacucuuauuuauuuuaggaaaauuuucuugaauuauaucuuuagggauuuguucugauccauuguucuguucuguuucauucuucagggauccaguuaugcauaaguaggcucuccuuugucugacuucuguaccuauuauuuucucucuaauguuuuaaaauucucauuuccgcuucauuugguaugcucuccucauuguuaucuucucugucccuuacuguguuuucuucugucuuuucucccuuguguaccuuccaucuguaguuacuuugcuuuucuccccguucuggguucugcaagcucacauuuuagcucccccugcuuucuugccaucucuucucugaguuauuucugcuuucuggucuuccuucauagagaaauugcuucacuacauuuuaaaaauugauuguaaaauauuuagccagaaauuucguaugcuccaauggcaacauuuuucugugacuuuucuguuucucugccauuguccucuuuuuucccucaauucuuuuuuaauugaucugucaguggugugcauaugaucgcuuuuuugccgcucauauuugaaugcauuggguuuccuggaccagcuauuugcacaagacuagggggagguugaggguuggcauagcaggcaggggcugggauagacauucaaccuagcuuguuuucaugcucuuaaggcuuuauuuuucuagaaugccaagaaaccaacuuucuuuaaacaugacucaucucuucgauuuucuuguauaggucuuccucccaccccaaaucuacacuuguuagaaacagaauaauuaccuuugcuuacuccauuaucaacacuuggagauagagacuuuacacuucagauuguaacccauagcucuuaaaaaaaaaaaaaaaaaaaaaaaaacaacgaaacaaacaaacaaaaaaaccauguuuuugcuggaguuuucugagaugugccacucuguguguuucuucucuucacuuccucucauuuggcuucuacuugauuucagcugcuguuggcagccuuuaaauauauuuuggagcuugcagaugauaucugucuccuaacuuuacagaaaauagaauguaugggguagucuggaucccugaugcuguggagugccaauucagcccuggacuuuuaugugagaaagaaauuuccaggaguuuccauguugauacuagaagucuaguuauuuacauuugaagagaaggaaaaauauuggaacaagacugauugcugaguacuaauugauaugccaaaggcaugugacuuguaauuuuuucccauucuuuuuuaguacaaguugaguaucccuuauccaaaaaaugcuuggggccagaaguguuucagaguuuggaucuucucagauguuggaauauuugcauauauguaaugagauaucuuggggaugggacccaagucuaaacacaaaauuucuuucauauauaccuuauacguguauccugaagguaauuuuauacaauauuuuuaaaaauuugugcauaaaauaaaguuuauguauauugaauaaucagaaagcuucagauuuuggagcaguuuggauuuuggaucuuuagauuagagaugcucaaccuacagaaaacucuggaaucagggauuuggaauucauucuuaauuuuugaggucacagucccuuacuuucugauauggccguagcuucacccuugccagcgucaaaagugggaugaguaacccuuucgcacuggagauuuucagaaccuacuagguuacagagagaugcuaaaaaccuaggaagcugagagaaauuucuguugugcuggaugugggggguagaugucacuugaggaggggguaaacauugaaucuuuuugauaauuugguaguguucaaggggaaugcugaaugggcaugcuaacuggaaagacugcagugggaguaggguaguguugggguccuguggacccagggacagaucaggcaggcagacaccccauuaaaaaaaaucacugaaaaaaauaaauauuuuucuaaaaaaaauagaguauuagaaauacucuuaaugcagguauacacacacaaccccauacugaccugcuaaaaggugaacuuauucaguuccuucugaaggagacaguacuuuugauuagaaauuugaaaacauucuucauuggcacugaucuuacaaugucuugaauacauauuguacagauauuuauagacuauuuuuuuggagcuaugccaaagggcauggcugccaagggcaugugucccuuauuaagaaauaaggggcuuggugauuggaguaagguuccuguggcagagauugcuaauuaucucucaauauccaauucccccugcccccguccuucugccucaugccauuguuguaauaacaaaaaccugguuuuuuagcucagcaauuuuccacucagcuagaagucuauacuucuaaauuggccaaugauuuguaaguagauguguuuagugguauuuccagaaguuucuuuaaaaguugaauugaggguauucuuuuuucuuccugcuacuucauugugacugugauggcuaguauucuugcagccauuuugggccauggugcggacuuggcaauggagacuguauggaguggagcaacaacauagaagaaauagccuggggcuugaaucugugucacuucagcccuggacuuguagcugagagagaaauaccuuguuuaggccacuuauuuuuuagaucucauuauugacagccaaagcaaaaccuagcuauuacaguacugggaaauauaccugaggaaaaggacacauuauuuaguaaugauggcuuacugugcagugauccucaauaaguaucuagggcaagggcugaccagauugugaauauuuuugacguugugggucauaagauuucucucguaacuacucaagucugcaagugcaaaagcagucacagauaaaauauaaacaaaggagccugguuguguuccaaugaagcuuugacuacaauaucagacaguggaaugugaauuuggcccaugggcuguagguugcuaacccuugauuugggggagggggauacaugaaguuuuuuuugaagacucugacucccaaauuccaaaacccucuacugggagaucauccuuccuugagcacccugugcccauccuccccaucuccccaccaagucccugacuacuuaggugauaggaagugaauggucuccugaccuugaaccuugaccucaagauuuauuuuauuccauaaacauauaaaugaaauauagccugauagugcaaaagagcgccgacccuuucuuugccuaacaucaaagcaugcuuaagugugagacgugauaggacugagugaaagacaaagucguuagacacguugcauguuauuuucugaacaaaaacagaucccaagauguuucagggagacauaaacugccgaagaagagccuaauuucauaauauuagacaaauggagaaauuuuuucuugauuacaaauaacagcuugugcccugaaggaggauagauguucagguuagaagaaaauggcguuuuguuccagccagucauuuagaaccuucucccagagggucuuugccacuuaaucuaugggccacuuaacgugcagaagaguucuuguaguucuaaacuuaauguaacaaaaaauagaauggugauuaccuguagggaaggggaccagguugccauguccuuugacaucuuuggaauaugguacuauaugaugcauugacuaaaugggagacuugagaaggcaaucauguaugucaguauaugaacuugauauccccuccaucacauuuguaauaugaauacauugaucaucuucagucuccaaguucaugcaccuuaaggaauuaugguguuguuuuuuguuuuauucuguaacaccaguugcucagaauauuucuuagcaaaaugggguaugaggaagagugaagaguaucccaggggaacuuagccauugccuuuagcugccaacacuucauuuggagaugccagcugauuauuuaugaacuguggagauggacuguaagacaaaguagaccuuaauaggucagauuuggucuggcuuuaagacagaccuuuuugagagugggaauuggggaguaaaauuuuuuuuuuacuaccaucccuuuccuuugauugcaaggagggguuugguggugaaaaaugccccagguaucugcagcaagggcagguuugaaaggguggauucacugaugccccuaacccgauucugcucauagacucacuccuuguuccggggacugcuggccugccacuuccugcucacagucgcagauggggcuuccugagucugugcacugucagucagagcugagaugcuagaggugagcuccucccucaaccccaggucacuaaaggggccucucaguucucuucaucccuacuugaacuuccucaugguuauauucccuuuugugaucuaucacuugccauuuuuuauaauuuggcuuaaguggguagacuagaacacuugugaccaugucugacagaauucucaagagggucuucaccaugagaggcaccuucucgguguggcuggccuggcuucccagugugcaugagucauggacguugaccuggucaaagcucuuccuccugcaguacuggagcagugcauucuccuuccugucucccucucuucauucuuuuuuccauauguucauucauuuucacuuugucaaauuacacccaauaaaaaugccaaugcauacaaauuugaaaauagaaaagaugagauucacccaucaucucaacacccgaacacaacagcucuuacacuuuuacauuuucccaaucaugacuguuuuccauaugugcgcaucagacgaguuuucggcccuuacauagagaaguugguauaugcuuugcauugucaucccuuggucuuggggaggguuuuuuaaccucugcacuacugauauuuugggccugguaacucuuuguccugugcauuauacgauguuuagcagaauccccggccucuacucacuagauagcaguaacaaccuuccuaccgugcacgcgcacagacacacacauacacgcacacacaugacaacuaaaaauaucuccagugcccccuugguaggcaaaauugcccccaguuugagaaccacugggauuuucuuuaauggagaaugucuuaugcuucuuauaaaaaaaguuucauaaaauuguacuucauuuuauguuaugagcaguggggagaagggauagaacacaucacaggaggagguguucuagugggggcucuugucccaaggaacagagagacccacuuguucaaauguaggacaagcuggacaaauuaaccaggcuuuggaaagagcaggaacugaggcaguugaagggucugagcuucacucuuuccauggugucaccacuucccuauuccauuucauuuucucacacuuauucugucucuccccaccuucccaccaugucguuucugcucuuuuuugucuuauacagaguucagaauaccccaccugggccccgaguccacaugaccuucacuguccagcaaucagcaccaacuucaagucccuuguguuauucugauggucucaacaaagggaccggauuagcccaacucaacuuuuccugcuagaucagaggcaguugguggaugggcuccacuugagucagaugcugcccagggucuaguuagccacgugggucagguggacaggccuccggccuucuccuauaugucaguagguuuacuguucuuacacauccuucuuuauuuucucuuucaccugaacuacguagcugcugauuuaggcaccaccacuucuagccuuccuuaaacuucaugcaaagagaugugccauaaauacauuugccaauugauucuugaguucuugugcuguggaaaacauugggcuaauugcuguggggucauaaggguauggaggcaagauucugggguguuuguuuguuuuuguguuuugagacagggcuuuguucuguugcccaggcuggagugcaacuccuaggcucaaguggucuuccuaccuuagucucccaaguagcuaggacuacaggcauaggccaccacacuuggcuaacuuuuuuuuuuuuuuuaauagagauggaggucuugcuucguugcccaggccgaucuugaacuccuggccucaagggauccucccuccuuggccuccuaaaauguugggauuacaggugugaaccacuacaccuggccaagaucccgguuuuuauggagcuaaauaacaugcgaaaagugaaauagcaauaaaaaauaugauguaacaaggcugguuaagccuaaugaauggccuucccaguuucuugcauguaauuaacacucaggaaacuuugauugacuugaaauggaagguacccaucauccagggcugcagauucagaggaaagaggccuucagucugggaaaguuuaccaaggaaaccgaauagcaagcuguguaugucugucucccuucuaaucccuuaugaaugggauguacacagucccaacucuaguuaaugugugugaacuaccugucauagaaacucagcuuccaaaaacuguugccaggauagacccacucaugguggguacuuuaagacaaagggaauuuaucucaggauacaccugaaucaaaacuggaaagcucuucagaacugagggaaggucuaagggccagagacccucagccucugggugccucuggcucuguuucuguccuuccuucugcuggccagucuguauccucuacuuccccaccauacacacauuaacaucucuucucuuucuacauuaccugcagucuuuucuagccagucugcuucauuauccagugcaaauucuggagggaaauagccugacugacugagcuaaacaccaucaugccuuucaggcagauccccuugcaucaggcugccuccuggggugcugggccaccugcacauggaccaccguuggguuaagaauccauugucaaucucacuaggggccacuuauaaaacagcccagcccuacucgccagagcaggaagcccucggcagagcaauuucaaccuggagggcucaucagauuuuuuacaccgccuuccucuuucuccgaccugccaccggucagcuccauguguagaacucuguguaacugcagcuuauuguuggcucauucuuagcuuuuauucucuauuugcauuuaaacuuuucuaggcuauuccacaugauggaaacuccuuagaggccuguggcauaguaagugcuaugguuugaauguuuguguuccuccaaaauucaugucaaacaggaaucucuauuguguugguauuaagaaacgaggccuuugggaaaugauuaagucaugagggcucugcccucaugaaugggauucgugcccuuauagaagaggcuucagagagcugccugcuccuuccaucucuuccaccuuggggaggacacaguguucgucccuuuuguccuuugucccuccgccaugugaggaugaguaagaggagccaacuaugaaguggagagagacagccuucaccagacaccaaaucugcuggcaccuugaucuucgacuucccagccuccagaaccgugagaaaugcguuucuauuguguauuaauuacucaaucuaagcuacuuuguauaguggcaggaacagauuaagacaauagcucauuuucgucuuccugcaauguuuauaucaguggagggagacuuacuacauaaugcuugcuggaugguuaacuagugcuucuuccuuccuuagaggaacuguuauucaaugacuggaaauaguuuaugagaaguagaguccacguaguuuaguggaagagcucagaauuuagaauuggaaggcaugggugaguccugacuuucacaccuuagaugugugauguugggacuuuuggagccuuaguuuccucaucuaccaccaggaguaaugucauccauaaaugguagcuaggaaaacuagaugacacuaucuaugugaaaugcuuugaaaauuuaagacaguuuccaaaaaacgaguuagcuauuagaguaaaaagccagugucauagucaaucuaacuuguacuuuaaaauaaagaauaaccucaguacaacugggagccuuggacuuggcagccaaaugcauauaacugggaaguugggauaaugaagggaaacagaaugagacuuuguauaaaacugucauuuggaaaugaugcauguuauuccugcaauuuaaggaggaaauuuuuaauuaaaaaaauacuuguaggccgggcacgguggcucauguguguaaucccagcacuuuuggaggcuagggcaggcggaucacgaggucaggaguuugagaccagccugaccaauguggugaaaccccgucucuacuaaaaauacaaaaauuagccagacgugguggcacgcgccuguaaucccagcuacucaggaggcugaggcaggagaauuaauugaagccaggaggcggaggucgcagugagcuuagaucaugccacuacacuccagccugggugacagagcgagacugugucucaaaaaaaauaaauaaauaaaauaaagacuuuguaaaguggcaucgaugcuggucagcagaguuauauagccagucuggguguucucuggguccuguguugggaaaaugcuguggacaguggcagaugagaugacauuucugguuugcaaaucacauccuggucuuauuccucuggacagagccaaauaagugcaguuaucugaacuuaaagauagccuagcgcugaaaagccaaugacagcuaaucuugagagagccauggguacagggagcuugucagaaguugugucuccuugaaauuggcagcaugcaguaccaaggggauggccagacacugccaggccucuuuaaaacucuccuggcugcuuccuuuucuuuuccauuuuuauuguaaugcuggugauguggguauaagaacuuuuguuguggugguucagacagccgaaaaagcaauucucacaaacuguuuuuagccuggauaucuguuuuccccuucuuccuuucucuuuccuccuuccccaagcuuucuuuuaacagcuuacgaugggugcaucucauucccaucacauagcagcccugcuugacaccagcauuagaugaauuaaaucacaguuuguucaguccccaaacaccuuguuccuccuuguugcccugcacaucaccauuugccuaaagauucuucgggauucccuucagugcuguccuggcagggacccaggaguagugucucugcagagagaagggcagaggcagagagacugcuugcucaacagcagcuaggcagggagagaagccgggcgcugaaggagcuguaucuucaauguucugcuguugcaaugcacaccuucaugaaauccuuuuuaacuuucacuuagcgguuuucagcgagucuuuggcuauugucuucccuuggcauccugggcaccuuuuuguaguguggcgauggaaugcucucuuuccaagaugagggaugagaguaacucacauccuuugauguucccugccccacccccucaugauuagauucaagcaaguuaaacacacaccaagagcaaccugugacaugauauaagucacagaauugcuggcagaaaugggguaggguggggcggccccgcccccgcccccucauuuugggcaguuaugagugacacucugaauuguucgagguuuuuaaacuugugcccuccguucacaagaucacuucuuucuggcuaccacccaaauucgauguccagagccagcaugggagucugccccucauccccgccuaacucacuguccauccaccugugucuccugaguucuucccaucccacacauggcucagccuugaauguaccauagcucccacaguuaaugauauugucuugaaaacgaagagauuuaugaauuuggauacauccuggccccuucagagggaccauuaucuugacuguagaucuuggaguuaggucucuaaagacaggccugugauuugugagaaagucucaaggauaugcagguaacaccuacuggagucacgcuucaccaguucacauuucugagcagcacagacaggucuggcagucuugggccucacguugcuggucuucuccagagcaagaaacaagcugggcuccaggaucacacaagcagggccgcgacugacacaggggugcaggcugaggcagcucccaugucucuugugcuaauucuuuucuuuaauuugcucauaacugaggcuugaguagcagccaggagggugaaccaaagaaggcaaggggccagcauagacagggaugaggucagccccgggcggagggacugaugaugugcacagaugucugccagggguccuaauggcacccaagauccugggugucugucuuaggagggauguuugguagagagacaaguggccaguggacacuguggauaugugugguggggcagaugaguggucacagagaaauaaggcuuagggggacagcgauccagucauuggcagaguggaguccuagguaaggcccaguuacagaggaauguggaggccacagccugggaugcgggacucugcuguuacagcagaaucaucagcaaggcugcccgccugcccugauggugagccgcuggccaggcuccagauggucucuccggagaggugggacugggcuuggaaucacaaggcugaaucucagaugcgcaggugguggggaugguuaaguuagaacauccaggcauccagcaggucuuuacagaggcuucagcugguuuuuugcuuuguuucuguuuuguuuaauaguguacagcuucauagugaucuacauauucauguaugguuuagagccagggaagguguuaucaugauuggaauuuaauugggugucuaguaaggaaaaagcaagguagaauguuccaugacauuuacaggaagaagauaaugccugaaggaggccugguacgaaugagggaaucccuguuuucuagugggaacuaccucaaggaaaaggcacucaucagacacguaggaaaugaguucucagacucagacauccccagccugcagguccagaugaggguacguaauaauguucauacucagauaucccaagugcaucgccaccuaccugcugucauggaucccaguaucccgcagagccccccagaaguauuucuguaggucccaggggguguccacagcaagcuaacuuccacuggacaugacagugacucccauugggcccccaggggacaccaccguugaggcuuuggggccaucaugguguccagugguauuucagagcuguacguuuccccacugucaacuugucaccugggacuuaagcaacucagcuuugagccccgccuuucuaccagccuugcaaagccccucucccacauccuccuuaggcuuucccuccagguaaacccaugcaaauaaagguuuggauauuucaccucagaccugguuagaucucaguuuugacuaauuucuuuuccaugggagcacaguucagagaugaggacaaaaucaacaaaauuccaguuaccuaauaaucuuuugugaacauaacuauagucaugcaucacuuaacgacggggauacauucugagaaauucgucauuagauuuuguuauguaaguauuauggaguguacuuacacaaaccuagaaggugcagccuacugcacacauaggcuguaugggguacaguguagccuauugcuucuaggccacaaaccugcacagcauguuacuguauugaauacuguagggaguuguaacacaauguuaaguacaguaucugaacauaucuaaacauacuucauaaaaguggcagcguaguagguuuguucacaccgcaucaccacaaaugcaugaguaauguguugcucugugacuuuacacugaugauaaugucacugggugauagguagcuuucagcuccacuauaaucuuaugggaccaucauugcauaugcagucuuucuuugacugaaaugccguugugcagugcaugacuguauuuuauaagaugagccuaauuuguguuauacuucucgggaaugaaggcauacccugcaguagguuuuggauucuguguuugacagauguggcugcuuuucuuugcuuucacuuuccccuaaaggaaauaacaguaguaagaugaagaaagaggaaacuaguagugaaaauuaagcaggugaaauauuuauauaaggcaggacagcuguggucuagacauuuacacagaauuuuacuagaguaauugcuuaucucagaauucauucaauaugcuaauuucucguagcagauugccuguccggcaaugcacauggcauacaauuuuugaaauucugcagugaugauggaauaagcauuucuaacccauuucucuguuauagcaauugccacauugccugguguuuauacgucuuuucaucacugcacugaguuacuaucaauuacugggucuuuagcuuucuacuauauuugggauauagaacagaguaaguacucaauacguauuuuugaugaauuaaugauaaagagaaagaaauuccaucaacaacguauguuauauuguuuuuucuccagagguaacuaaccuaacuugauauauaggccacaacuuaaccucaguuggcaguguuuuccagcuaggugaccagaacucuuuacuauccauuaugaugauuucuugaaagggagaaacugacuaggguggagaauacuccuuagaaacagaaguuggguccuaaguaaauugaugauuuaaaaauuauuuggugcaggccaaauauucagauagggaaaaggaaaaaaggaaacaaaaagagaagggauuuuaacgagguuggucauauccuauacaaaauacaguuuuaaacucuuuagcuuccaggagcagaaaacuguaggaaguauguaaauuauucacgguuaccugggaaacccuuucugacaggaacgggggagaucacaggguuggauggaaauucaagcagucaaauuguaauguguuuguguguaaguuugcuuguuuguuugccacagaugaggaacagggaaaauuucugaaggaagguaacaugaaaggaagaaaaaagcuugucuguacagggaaggcagagaaacuucaggucucuugaagguguaauuuccaaaccacucugucccuagaccauccuauuuggagugacagcaauaguggaccucugacccgggcugucagaaccccuuucuagaagcagcuucuucccgcaaaggcauggucaguaagggagccuccacguuggcagagugggacuccacgcuuuggccccguggacagaucugaagaugggcacccagcaaagcugggcaggcgaggccucuucucuguaauguuuggacagaaaaccaaagggcgcuuggauuacuccuccagcggcugaagcugugaguaccuaggaaccauccccggccacguuucccaucaaggggagaauguggugaacagagaugagagauggagggaaagugcuggugugccugagucccugguucccugguguucuggcgcccagccgcaugcugcccuucccacagccugguuauccaguccuuccucagauucccuaagccggugguaacucuccuguuguuuaagcugguuugaugugcacugccaucaccugagaucaaaugaguucuaaaacacaugcaauugcagacuucaggcacuggcagaggacaagaaggaagagguaagagguugaagugaucagcuucccucugagagaacucuggagcaccacaggguugaggcugaggugaccauuucaguaugaacugaaaauggcuuuuuuccuuauagcuagaacggcugaaaaucagcaccaugucagguuguaacacaucuguuccagggaucacaggaugucccauaaauggguuaaacacuuaccaugggugaggcaguuugccaucugugauauuuauggucugagauauaaaaauaacuuuuaaaaaaugagugcuuguccucaagaagcucacagucugauaggagguaucacauagguauaugugauucauugugaaaaaaugucuuaaauuagaaacgugucaccaugauuucaaacagggguagcaccuuacuuugccuuauauacucaagaaauguuugcggauugugguucagcugaaucuugaaaaacaaauaggaauuugauauggaaggggccuagaaauuucagguagaauguauaugucugucuuuguacauguugcccacguauacagacagaaauguaagagugaaguagugugagcagcauaauagggaggaugggagaguugggaaaacgaggcugaggagaugaggggcuagauccuaaagccuguauucccuuauaaaaaugugggcuuuccugguagaaaauguggagagucauuaaauaauccuacuaugugcaguuuuuaaaugauuaccuaucuuaacuuuguuggccaaggguaagguuggugguuggaaaacaggucaaggaaaaauuuaauaaauagucugagugacaggagaugagagucugggcugaguuagugccgggggccuuguggggagaagcugacaauauaaaaaaaaagacaggagcucaaaucuaugggaaacggggccaguucaaaggagagaucguggggaugaagaaaccacauaacucucagaguccugaccugugcggccaagaguuuggugguuggaauggagaugaggauuaaguaggggcagcagugcuuugguggagaagaugauuuagugacuuuuggacuuccugaguuugaggcaggacacaggggaauguuacccuaagagcucagcagagagaggccaggauuggaacguguacuacucuugaccacuggagcuccagacaugacccaaaugccuggugaaugucuagaacaggugaagagcaaggugaggaaaggacccgagggaacaccaagguuuaaaggaugguggagacagugagugaggaacuaagaagggagacccaagagauggaagucaaagagcagaggcugggaaugaaagccauuggaagguacagucucuugcaggagugagacuguagugucaucagaaaacaagcgcagaccacauggauuugacaaugaguagucuucuaguagucaguucaaugguagaaaaauacuuuggaugaucauguuucuuuaaauaucccacccguugugucuuuacuuguauuuauuccacaaauguucauaacuagagaauacuugauuuaauggauuuaugcaaaggguuggugucucauggagcaagcaaaacguccugacucuggaaaccagaccugccucuucauacuuaugugucugguaauaggcauuugaaauaauacugcagggaaguuucacguugcugucauuuacccguucugauuuuccuuccucguauagcucacuugaagggugggauaagauggcugaaagcgcuccugucagcccucucugagaagggagaauuacacagacgugaugauuggcuaucagaguuccccagcacugggguggcccacuuaagacaagccucauuaaauucacuucaucaaguaaagccggugugucuaacuuaagaaagaauguggcaugcaaauuaagaccugaaaauaugaauggagucugagcgaugcuuugaucagcauuucuuaauauggcacaugggggagaaaacuucuuaaaguugcauuuacuuccccucaguuuuguauggcaggggaaucuguucaccugcuaccuagaauugccuccuccaaaggagaaacccacuccuugggaagcaaagugcaauacaauaccaaguaugcacaauuugaaauuagacuugaccuccacucaccucacaaacuaaaaacagccuccccaaaauaagagaaagaaagcugggaaaggaaggugugaggaacauauugcugggaaaacagauaagaguugauuauauuuagaauuuuuuucaacccagauugaaucaaugaauaccuaugcauugaacaucuuaguuuugggauuccuacugcaggagaaucuauuuaaauaugaaucccaaauaaauuuauaucaugucugauauaggaauaaaucuggcaauauuaaacagaucaaauucucaagacaacuagucugaauggaagcuauucuuagcauaguuuaaguaaaggagaucaauauagauauucaagauugaaaaauccuaauaguuaauagaaaaacaaaauucaaggucccucuaaccuucaaagccgagcuguuucaagugcuucucaagaaacaaaugucucuuagagaauguagccagggcccucuaaggcaggugugcuccugcauccugucuguguggaguccuucuuccaugacuggaauugucugagaucuuggauaccacucugccccacaggcagcuucacucagccaguggcuggaccaaguggaggucggaaauugaacccuguaccaugugacccgcuuuaugcauuuuacauacuguaauuauacugcuugacuauuuuaaauaauauuuuuacuuaaguuucaugcuucuugcaauaaaaggagaauuuuuuuuccuucucaagcuauaauguaaaaaugucagggcaguuauuauacucauaggugcaaauuuguuuaauuaaaauuacacucaacuguucugacacauuuuuaagcaacugugaaaaauagcuauuaugaucuguugguaugcuuccuugaguggcuaauaauuuuguuagaucaugauuuaguucuuuuucaucgguaaauaugaaaauuaaaguuagauaaaacgagccauaauuucaaacuuuguauuuguuuaucaguugggcuuuugaauuaaguuuuaaaaaucacuuuuucacccuaugccccaauaaaaauucagaaacuguaucuguuaaaaugucccguagguguauucuguggaaaaauagauccaaaaaauucauagcagauuauaggaggagaaucucuucacaggcgagacgugcucuacaggcguuucaacucugaauccgaggucucagauucaaggauaugcuacaaaucuauuuuaaguuguucuccauucaguugcugacacucuagaagggccauuccaaacuuuuuguggugagaugggaagaguguucuuuuuucuuuuuuuuuaaaugagaugaaauucacaugacauaaaguuagccauuuugaagcgggcaauucagugauacuuaauguaacgaccaccgcuaucuaguuacaaaauauuuccauuacccagaggaagccgcauacccauuuagcccacccacucuuccuuccuucccuucuuccuuucccuuccuccuucccccuucccccuucccgcuucuuccuuccuuccuuuccucccucccucccucccuucuuccuuccuuccuuccuuccuccccuuucuuaccauccuaaugagugugaaguggugucucaucgugguuucaauuugcauuucccugaugacuaaaugauguugaacaucuuuuaaugugcuuuuuggccauuuauguacugcuuuggagaaacaucuguuuaaguccuuugcccacuuuucaauugaguucucucuuuuuuguucagcuguaagaguucuuaauauauucucaacacuagacccuuaucacucuaaacuuuucauugccuccuaaccucucgaaagugaagaauucuuuccuuccuuccauccuuccuucccucccucauuuuuuccuuccuuccaucuuuucuuauuuuuucuuuccuuucuuugcuucuuacacacugagaguauuggauuuuuguuauuagaaguaauggguuuuuauuuuagcaaagaaagauauaaggaguaaaauuuaaauuccccaucauccuaccauccagagaguuuguuuuguuuuagagacaagaucucacuauguugcccaggcugaacuugaacuccugaacucaagggauucuccuaccucaaccuccugaguaacaaggacuacagguacaugccaccaucccuggcuuuuuuuuuuuuuuuuuuuuuuuuuuuuuuugugacagagucucgcucuguugcccaggcuggagugcaguggugcgaucucagcucacugcaaccuccgcuuccuggguucaagugauuaucgugccucagccucccaaguagcugggauuacaaacaugcgccaccacacccagcuaauuuuuguauuuuuaguagagaugggguuucaccaugugggccaggcuggucuugaacucaggugaugcacccacuucagcaucccaaagugcugggauuacaggcgugagccaccacgcccggcaccuggcuuaccagagauaaguuuuauauccuuuuucuagucuuuuuaaaaaauguauaggauaaacuugcauacguauauacuaagaaaauucugccauugucauauacuauuuuaauauuuuaacccuuuuuuacauggcaaaauuauagcuauuugcaucuauuuaucagagcauuuguuaugacuggugaaacaaaauauuuuccuauauuuguuaaucauuuguauuccucucuuaauuguucaagucuuuuuuugcccacuuuuucuguuggcauuuuacaaacaguaaaaaucucuuaucaaugauuagcuaauuauauacccaaaauacuaguccauuuuaucucauauuuguuacaaauuuuucaaguuguuaucugccuuuuauuauccuucaucauauguggggcauaaauuuauuuuauauuuuuuguuuugucauauccaacauuuuuuucaucaauuuuuguccauugcuuuuacaugcaagaaguucuuauccaucaaaagauuauauaaauauuuacuuacauuuucucuuaaguuguuuauuauuaaacauuuuuuucuaguuccaucuggaauuguuauuaagauauugugagaugagagaaucaaacuuuuauuuuucuaaacaguuaaccagcuuuccugauacaauuuauaggacagauaauuuacaauaagugaaucuuuuacaaaagauacaaaaccaauuauuuugcucaauuuuuuuauuuuuauuuuugagacagagucucgcucugucacccaggcuggagggcagugguaugaucacaguucacugcagccuugaccuuccgggcucaagcaagccuccugugucaaccuccugaauagcugggaccacagguguauaccaccaugcccagcuaauuuuuguuuuuugguuuuuuuguagagaugaggucuugcuguguugcccaggcuugagagcccaggcugggcucgaacuccugggcucaagcuauccucccaccuucaccucccaaaggcaugagccacaaugccaggccuugcucaauuuuuaaaauaguacuuuagguaccagcuguauaugaagcaauucauuugugguuuguuuugcuugugcuccuauucuuagcaaaagauagccuuacucucauuucagagcagaguagcccacguggcaauccccuagucccuuuuuuggaggccacaguguagccagaaguaacuggaaugcaaagccucugugugcccuucgacccagcuaaaucauuccacgggcagauugaucaauuuccugagcuuucaucaugauuucuggaguucaguugucuugcaguugcuauacaauguaguuuuugucauauucccucuuauuucuuaauguguccuggaaggaauggaauaugaagucuuuguagaguaguggcuacagcacuggcuuuagaggccgcccugagugcaagucuuggcuuugccacuuguuggccguggaaccauucgagcaaguuacucaccucucuaagcgucaauuucuuaucuuuggguuuaacagugaaccgaccuuagaagguuauuuugcacugccuggugcauaacaaguguccaguaaguguuauuguugauggugcugguuacauccuaauggugaguuuccucugggaaaaacuaauuguaauuaaguacaagcauuaaauacaaacaaagaacagccaaguuucuaaugagcaaacuuuguguuuuauguuuacucuaguuaagcccaugcucaaaauaggcaccuaguugcugaugauaauuuacuccaaacaauaaaauuacuuucuuaaggucuaauuguuuuugauagaaaaaagaggaaaaaauaauaaagcagguugaagaugucacaagcugggaauaaaaguuugguggguuuuuaagaucugaaaaagaaauuuuuuuaacaccuuaaggaaaaaaguugcaauauacuuuuguuucuuuuuuuaugcacaguaaguguuauaggaugcaggugacacaugugcugguggggaagugagguagaggaaaugagaaggacgccccauguagaaaauggcagaaucggaacacgcacccagccccucugugugcaggguggcguuggaugagacgugcagccuggccaggccucaugucguuguuuccccagguuuugauuuaggcccgaagcccaccccauggagucuacauggcaaagggagccugcagaaggcaugugacauuuuguauuugcauuuggaauucagugagcugcugauuugaugauggaagcaaauaccaagcagucacugucaguguucaugaaauaagagaugucagccauauuucuaggauaugacacuuuuguauuaucuauugguauuucaaaaaaaauguuaugguaaaaaaaauuuccaaaacacauaagcuacuagacaucuguuuuagaauagcaccgcuauacucauucacaaacagcaguuguguuucuugugggaguggcgcuuuaaagaaguguaauaggguuuuguuuuuuuuuuaaucagcauuucucuuuggagauguuaaugagcauccccaaauuuaaaguucuaaaugaaauuauaacacugguuauugcuaacaaaaugagcaacucuucuaaggaagacuaaaaggaaaaaucgcugugaaguucccucuaugugauagcaggguugagaaaauuugauuacagaaccugagcuucugcagcgaaggccugacaguguacggucgcugucugggguguccacccagcucccggugauucccccuuugcuagcaacugcuucucccucccaauccagaacugugggcccuggcagccauuuugugcagugaggcauccuuuuacccugcagucucugcugauuggacccggacagaugcuugacccacgaaggaauuuacaauuggcaaugauagagguagucuuucauuccacagucacuuuccacauugucuguuugccuugagcagcagcaaggcaaagaauggcagucugcagagagcagaagcaaguuucccuucagagggaggcagagaagggagaugagagaguccagaggacauugaaguccccauuucugugccucgccuucgucugcuggcuucugaaacaaguuccccaccuggucaagccaccaggaguagcuuuccacuacuugccccgaggaguucagcagaggcacccugggagcacagagguguccuguuucugucccuugagagccucuucauuagccuaaguguccaccucgaucauugaguuacucucccugagccacuacguugacagaagcagcuggugcggcaaagggaccucagguagugagcacagcgugccccagggccucacagggagaaacgccacugcaggcaccagauggcaagaaguccauagaacauuccgagaagaagcaaagcucuuuguuuuccauaaacacucucaguugaagggggcuuuaggcaagagcauaggaagaaaccaggauccagagccgaauagaugcauacagcccucccggccucaguggcgugagaggcuccugacuugcagagaagagaacccagagcugacagggagcguuccaauugccaagucagacgaggcucuccaaccauuccuggugaggaggccuuagauaccaagagcuucaucuuccacauaucacaacuagguaguuguaucugauggcaucuggauuaacuggguaaaaauaaaagcaaaucuuucuugaggacaaggaucacaggcucuagcaccaugccaaggcuuuugcacgccugggcaucacuacgccuucaccacacccaugacccgugcagcguuccuggcugccuuuccuuuaugaggccacagguaaagcagcucgcccagggagccacagccuguaagugacagagacagcaucgcccucagcagucaaaauccaggaccauauucuuaccaaauuucuauguugcuuccagcguauugauuuaaucacuugugagccucuucuuuucauaaaaacccaacuugaagacuuauguaugaauuugcuagggcugcauaauaaacaccacagacugacuuaaacagcagaaauuuauuuccuuacaguccuggaggcuggaaguccaagaucaaggugugggcagaguuaauuucuccugaggccucucuuguuggcugguagauggugucuucucccuguauccucacaugauccccgcuccguaugugucuguguccuccacuucuuaucaggacacaaaucagauuggauuaggccacccuaaugaccucuuaucucuuuagauacccuaucugucucucaauacagccacauuugagauacuggcaguuaggacugcaacauacgaauuuugggaggacacaguucaacccauaacagaugccuccagggauuuuuauggauagccauaaauuucaguccaucugacguccaaggugggugaugaaagccaggagagcccuuuuggaacagcgacuucugccuggggaugcugugccuuauacugcaagauggugcuguccagucacucucugauccuauauucuaauacaguacuuuuaaacaaugauaugcuuggcucugcuaaguuacaaugaaaagagcuacuacagguacuggaggcuugcagagagaauauacaagcuguuaggggagacuuaaaaccaucccgggccgggcgcaguggcucacgccugucaucccagcacuuugggaggccgaggcggguggaucaccugaggucaggaguuccagaccaauguggccaccuuggugaaaccccaucucuacuaaaaauacaaaaauuagccggaugugguggcacgugccuguagucccagcuacuugggaagcugaggcaggagaaucgcuugaacccgggaggcagaggcugcagugagccaagaucgugccacugcacuccagccugccugacagagcgagacucugucucaaaaaacaaaaaagaaaaaacaaaaaccaucccagucuucucagagcaggccucacugaaaacugaggacucucaggagaggcugccuugcuagcauuccaggaagccuguucccauccccccggcuguggcucaaccgcuguggggucugggcacuugacggggccucccucaguggacccugcugcuccugacgacugucuguggcauguucaguuuccucgcgcgagagaaucugauugguccauagagccaccaccaggauaggggccuccacugggcagagcucaggccacucacagcugaaugccuggcacccagcccuggugaugagguccaagcacagacuuguacaggggccuuggagguggcaggcacucuaaagcugcucauagcagcacucauaacugacuagcaacuuguauagccugucaacuacaagaugaagucucugucuuaaagauauuucucuaaaaugcauguacggugaaauugauugauguaguagaaagagaccuguguucugaccccagcuucucucucaucuggacaaguuacuuagccucucugagccacugauguaauaacccuaccuuaaaagcaguauuauaagucuaaaaugaguugaagugcuuaaacguacauccacauauuucaaagcaagguacuggauuuuucauuuugacauguguuucuucagccuuucgguggccagcauauucccagugccagggcccagucucucugccuuugcauuucaagucccaucaugggaguuaccacuuaaccagaagccauauuguucucagugauuauuugaaauuugcauaugaaauguuaccauguuuacacccuguacuuaaaagaacuccuaaagauaggcacucaucugggaaucaugacagauaucuucaggauaccuuuggggauuuucaagaaugagaaguagauuucucuugcuuaaguagagggguguguuuccaugggguccuuugcauaaaugcccuaugggaaacucuggugccugggaaaggccauauucuguuguaaacuggggaaucagaccuaccuuccucucuucuucuauccacauuuguucuuuauuugcaaaugagucagcuaagaacagugccaagcgaggcucuugaguguaagcgcuugaaaaguguccuauuguacuuacaacacuucguugaugaccaguggcugcuuaccacugaagauggggucagugccucugugcuggggucccuguugcugccugucacauccugggcauuggcuggaacccagaggucuuugaagagugaccugcuuuauuccacucacuucagagcauuagugccccaaguggguccccugcuuuuccucaguggucucuuuaguaaauucucagcucaucugguggguuucggaaaaacguuuuuuuaacaucgggauccauuuugccauaucuguuccguuauugcacugagcuuguaaaaguuguauucccaagauaauguuuaacuuuugggggaguguguguguuucaagucccuuuuuccuuuaaucauuugagggaacuuuugucagguguguguguguguguguguguguguaccugagaaaacgcgcacacaugccuggaugcacacguguacacacguacuugcacaugccauugagugcccauucuguaugaggucccguauuauguacugguacugugggaggaccaaggcucagagcgucugacuuacggguuuaaggucucacggccauuaagcagucauggcaggauuaaaggagaugcagcagaucugaauuggcuucauaucacggcaaacacggaagcuaaaucugcgaguuggccacucccagcccgagcuucccccgaguuggagcaccuaaauguuacuccuucuaggucccuauaacagacuggaggccugguuugcucacauaguuacugaggaagaaaaagaaacauuuugucugaggaacgugagcuaccucuaaauuaucaggcccagagaggcaugggauugaggcagcggccacaucccacugcccuuuugagcuaauuaaucaucucucgaagccgccugcuaugcggccucuaggccgacuugucacaaguagccacaaauuaaccuaacaauacugcacaccagacaccugacccauaccacauaguucaacugcauauagccaaucacuaaucaaugcuauuucuguaaacuaaugagaauuccugacaaacaccuuucugacaccccacuccuugucccuuuucuuggcuuuuaaauccugcuuguaacaagggucaaauggaauucauauccaagguuacuugugucugagucuucuaagaagcucuuaucuuggcccuaaucaacuccccucuuauugauuuugccucaguuucucccuuuagguugacauggcuaugcuaauggcaaagcuuuccugacaaagccucccagugcaggcuggagaggaggccagcuugucauccucuggggaagaggaguacugugagaauagcaaacaguuguucugcaacauugucuuuauuuucagaacacccuucacuucccuggguguguuucuugcucacagugguaugccaucacagggccacugagaggcaagggcaccaacugauucaguucaccaggcauuucuggugaaccugcacucuguaaacugcacuauccguuucacguguccccaguuuauuuuauuuuauuuuauuuuauuuuuuugagacauagucuuacucuuucaccgaggcuggagugcaguggcaugaucuuggcucacugcaaccuccacccccuggguucaagugauucuucugccucagccgcccauguagcugggauuacaggugcccaccaccacgcccagcuaauguuuguauuuuuaguagagacaggguuuugccauguuggccaggcuggucucaaaccccugaccucaggggaucugcccaccucgccuucacaaagugcuaggauuacaggcgugagccauugugcccagccucacauguccacaguucuaaggaaagcaccuaggcugcauucacuggaugccaagggcagguaaugaaacucaggauugaugucagcccuuugagcuaauauagaagauguuugcauaccccaaauuguuauugauaaguuaccauacauaccaagagcaggauaucaaagauaaccauguaucaaagaucucauacaccgaggccucugggcaaacaccucuaagaugcuucucaaggcuacuucuuuagaaaagcuuucaugaugccccuguucuccacggucaucauccuugguggucaccguaccuacauguagguccaucggaaagcugcuguuugacacuuacugacuuuaugucccucucacuagacuguuaacuccuugaggguaggaaaucuguugauguuauccuugguacuuaccauaaugcuugcacaauuagaauauucacugaaugaauaagaucuccuuagccaaggacucacacuaauacuacauaggugcauacauacauauauguauguguauauuugugugugucuguauguguguguguaugucuguauguguguauuauaacacaugcauauguguauauguaucugcauacacaauacauauuuuagacgcauguagcuuaucauuuugggaggaauagguuuauuucucuagggcacuauaaagguagagugauagacuuaagcuugagcuacauugauccaggacaauccaugggaagugcucuucugagcacuguaaauccccaauaggacuuuuuuguuaaguuucuugucuaagcuuucugauugcuuggauuaaggacuaaugauaccuuaugccaagguaaaaauguuacuaaaaaaaaauuguaauuuuaaaaccuuuuggaaugucuugaguuauucuuucuccaucuaaagcagucauugagacuugacaucagagcaugcccugucuucccucuugcauauggaaucuaacccagcaucucaggaagaagaauggaagaugauuuuuuaaaugucaaaaaaaaaaauugaacuuccuccugugcuuuucaccucagcuucugcugcagaccuuagaugccugcuuuccaguauucgauaagagaaugauguauacagcuguaaacaacuucaaagaaggacacacuugaaaugccuugugugcuguaguugcucguuauuuugaguucaguccacucuuagggcaggcacagaaagacaggaccuguaaguaaacucgcuggauucaucaaaucuccacagaccauuugaugucuucgaagagcccacuggauccugauaccccaguccccugcagccuugaagcguguucacgcuggcugugguugggucuggcccugcaaugcaggacaucuggacgugaacacagccucuucccagagagaugagcuuaaagagaacgacauuauggguucagagcaugaguuucaggaaaaagcuugauuaguaauuuauuuuaaagaaauauuuacuuacgauuacuuaaagaaauaaauagcuucauucuaaaaaaauuccugucucccuuaggaucugucuucacacgcacaaauuuucuuucaggaggagggagcaaauguacgugggugaggcaaagaacugaaauaauaauccaccuuugaucaaaacuccuuguuauaguguucccugugaaaacgauuucuaaucaaugagcgcugccacagcacacugaggaguaauuaccuuacacgugcuucacucugagcugugauuagaaacaagaugugggcucagaagggcagacgacgaauauaaggagaaaaaccucagauaggagccaaaacgugcaggcugugagauacugaauaagcauggaggucugcuccagggagugaugccgacauucguucauucacucgguaaacauuuccucacuguguugggcaucaguggugguauuagcagccacguuaagguaacuuaucacaugcuacccuuauauacaaagauaaggcaacuggcuggcucucacugaaguaugagguugacuucagaggugcucuguacuggagggggguuuggguugcuaagacuacaccuucugaccagacuucccagugguuuggagccaauuuccaaggguaaacugcuugauccacagucuaccagccugagcauucauuguaccugggcuucaugagacacuagggccuggaaaagggaaagaaagacuuggaauaauucuaccuagaagaaaaacucgaggaggggcuagggucaaguguguggcagacuuauugagaaggugaaggccauuuggucucuguagagaagcuagaagaggcuuuuggccugacagugcuugcuggggcauuuacuguacccacgagaaagaguuuccaaacucugauaaauguuggaugcagauguaaugaacacucuugcccacugagaaacagacaugcuuguugugauggcccugcgcuucugggggugucuucauuugucauuaagacagcagauacugccacagcaccaucaccaccuagccauagcgcagccauccuuggcaguuuccuucccuucuuggagaggugccagucauguuuguuguuucuuuuuucuuuugcuuuuuuuuucuuuuuuugagacagggucucacucugucacccaggcugggugcugcagucacagcucacugcagcucaagcucccugggcucaagucauccucccaugucagccucccaaguagcugagacuacaggugcgcaccaccacgccuggcuauuuuuucuuuugcauuuuguaguaauggaguuucaccauguugcucagacuggucuugaacugagcucaagcaaucugcccaccuuggccucccaaagugcugggauuacaagagucagccaccgugccuggccuguuguuuccuuuuaacccuuguuuucagacagcugcaagaaugccagcagaucuacucucaugaccuuaaaaacauacucagcaucuuuagcccaccuuggccacccaaagugcuggauuacaggcgugagucaccucgaaaacauucuuguuaggugaugugccccagaggaaagcuuggacauucugaaguuugaccuaccuguucuaaacuaucauuggcugcuuacuuauugugccauguuccuaaggcucagccugcauuccuaccccuaguagguaaugauccaguuuuuaaaauucuuacccucuccaaaaggauugagagaaacuagaaugaguggcaggcuuauuagagcaguuguucucuggauacguuuacaaaugggaauagcugcacacucaggaucauugaagacucaccuaaacauaaccuagaaaagagacugaacaaacucucagagccgacucagcacuuaugauucugaagaagugauaugcaggcacagaauaguaccuuauuaaacaucuuugugugaaaggccagcuaaccaacuuggaugagaauauucuccccaccuucaagggugcuuaaguuuuuauuggguuacuucugcaaagcuucuacccaucaguaaauauuagccaccuuggaaacaguacacagaaugacagucauucucccucugguguaaaauuaggcacuggacaagagugcauuuaccugcuugcaggcagaauuaaaacagccagaaugugcuuuaagugucuaaggaaaaauuuggccaaggcucugggccagugcgucuguuguuauuuuagauuuauucaauuagagucacaagcaaaguaaauugagcugugugguugauuugaauauuaccuuggaagacaguguaaagagauuaacaaacccuaagggaugagggacgagugccaagcuccuccucuguccccacacacagucgggccagguuucacagauucauuuaggaaugacgaaaaugcaugcagaagagcagaugugccuuuuguucagggccacguagccauuuucccgcuucuccauccucugaaacuuccucugugugcaugaacugcugcaaaaaugaagcuggugcauguggaggcugucagauuuaagaagguggccugcccugagaacugggggagcuuggguccagucgaauccugcuuuugucuuggcaaauguauugucuggcacagccggcugcauucaguugacguggugcuuugacagauuggcaugggugaaauauuaaaaguaauugcacgggccucauauguuuucagaggcuauaggauaaauaagccaugcauuucaacaaagaaccuuuucaguguuaccauuuuuagugccauguggcaauugguugucucacacucccuucaaagagugaggcauuuuuacauguuuuuuacuuaguuuaacggagguagggacuagaaugaugccaggaagccauccuguuuuuaggacugaaggggcauuuuucuguguaagucucguaugguuugguggagugagauaaggaugaguuuucuuagaauaagaagcuagaacugacaugacagagagggagcagcagggagauaagagagggagcagcagggagauacaggguaaaaauggugagauuugcuugaggucaccguguguccuuaauuaagacuuuaaugacauuguuacucccauggccucucacuguuuuccgaguauaucuaaugcugcucuaauauccaggcuauaauauugcagugagaauuagauuagagaagauuauaugcaggcuguagugguucugacgaacgagcuguggugugaccuucgacaggucacucagcuucugugaaccugcuuccuaccugugcagugagggcagugggcucacacagucucaugguccacuccagcauugccggucuguggucuaugcgugauggccuuggauuucacggcuccucuacucuugaaaagaggagggguuuuuaaaagaaugccuaguaggguguggauuaugaaucuguucgcuauaacuacaguuggacuuugguauccauaggggauugguuucaggacccccagcagauaccaaaauccagggaugcucaagucccugauauaaaauggcauaguauuugcauauaaccuacacauauccuccuguauacuuuaagucaucucgggauuauuuauaauaccuaauacaauguaaauucuauguaaauaguuauuauacuguauuguuuagggaauaaugucaagaaaaagucuguacauguuuaguauggaccaaaccaucuuuuucuuuuuucaaauauuuuugauccacaguugguugaauccauggauauggaacccauggauauggaggaccaacuauauuuugcuuuuccuagcuccuuguaaagauuuucaucagagaauaucuaguaaggugagaugaacccccuccauguccccuuugcuuauuaucagcugugacaagcuccuaguugaaggcauaggagcaggagaaugaaaacaauggcccaaauguauuuuugguuuuguuuuuuguuguguuccucaccaacgguaaagguagaauugucugcuauugcuuacuacucuuuugucagggagggucuucaccuucaucccaucucaaguagugagucugauucuaggccuaucugccuuuuccugcuuccuuccaccuucccgccucucuuccugggggaaccaaugucuucuucaucucuguucccuuaguguaguuuggcacauaccagauaaucagaauauguuuguugacugcauugguccaaagauuagggcugagaaggugagaaggaagacauggaacuaaaacuagaauuuaacauaaucagccauguccucaaaauaaaauggaaacuaacacgagcuaggaaagguagagcauguucacuuuuaccagccugggccuggaaggcacauuuccugccuaaauauugauuagaguuaucuaaaaaguuuugacaacugauugaucacuuaggauuucuguaucaaaauggaagauagaugacuuauucugucaaacucacccaaaucacugccuucuucauucagagguaagagaagcuuguguuuuauaugucaagcaccacaccuugaaaucaacagagcaaaacagguucaaaauaaaacguggugauggggaaaggacuaacaaagacagguuaaaugcaaacacaugcuuuaacuugcacagaaucaucagugcaugauaccacauacccagugacccaaaccgcuuucuaaauccuccuccuuuuuucaucuccuguaauuagcacguaacccaaugguuaaggguauggaaucuggagccacaucaccgugguuugaaucacagcucgguauucacucaccauuauuuucauuucucuguccuucacuuuccugaucuguagaauggaaguaauaauauuuucuacugcauucagguucuugugagaauuaaauaaauuaauauacaugaagugccaggcacacugccuucuggacucaaugacaguuaaguuucucacuguaaaucaauauacuuuuguuugguuugugcauaguccacaagaccuaagauaauuccggagaauuucccuucagugaagucaccuacuccaaaugggaguacauuccucaaguuaaacacaguagccucauguccuuuagcagccagccggccuccuuugcccauuugccaacaucagcaccuuuucaaacuucagaaacagggcuggcgucuuacguggagcccucagucucugcugucacuuacuggcaagaauacaggguccccccagaucuccaugucgucugugaccccaucaacuccccuuggucagcuuguuucucucccuaccugggaugcugcaugucaggguucucugcauccugagugggacccaaagggggccucccucucccugcacuggggauccauucccuguagggugaagggaggaaaccaggguguuuggacccagggucucuaggugaggguccuuccuggguuccuauuucaugagccucagagcuccuucacuuccuucugaugcuuucuuuuuuuccccuuuauucucuccucuuuucuuucucucuuuccaucuacccuucauaggauucaaauccaaaggcuagauuuuuggguuacccaacucucuuuauuugaaguauguaauucaauuccacuacuauuuuuauaguaauuuuuaguuauauaaaaauauuacguauuagcacauuuggugccccucuccccucacuggcaaacaccuuuugugggaagaaggauuuugucuccauugugcaugcuccauccccagggcccagacaaugccuggcacuuaguaggcgcucaguaaauaguuguugaaugaaugaauacaguauaaaacaacauuguccuguaauuuauaaugucugugggucaauaguuaagguugggauuuaggagcuccucauuauucuauuuugacagacuuacuacaaaaugucuuuucaaagucaccaaagcucaccaugcugcaauuuguuagaggguuaauuuuuaaaauuauaauggugcuugguaaaucuccuugaauuaaugagucuugcagaauuauggcugaugugaaaagguauauaguuagcaucuguuuguucugugcauauaucucucuuccaugcuguacauauauuuuaaggaacauuucuuugggugcuguguuuuuuucuauuuaugucuucaccauaaaaauauaaauagaucauuuaucuccgguauccuuaaaguagcuugcaucacuucacucuuuuaaacuuuuacauaaccaaaguuucuguccccaguacacauuguuuggaagauuugagugguugggggcaacccuggaacccugaggcaagcuucuggugacccuugagguuuacaugcagggccaggagcugagggugcaggcugcugggggcuucauucccaggaacaccgugaaggauacugugguguucgcccuaccuggcaccagaccagauauuauacuuaaugcuuaauauacgauaucucauuuaaacugauggcaacucaauaaagugaauacugcagcuauuaccauuuuauagaugagaaaaccaaggcuuagagaacugaguaacuuguccucaguccacacaaguagguaaguggcaaagcugggauugaacccccaguccaugugauucuagagcccguacucuuauccgcuaggcuguguaggauagacugauggggacccacaggccaaguuuggcagauguggucuaggguugcucaugaguugaaagcaguaauuguuggugagugaggccuaaaaauauccuucucauugccuuuuugauaaaaagaccccagacuuuuucugagaaggggcuucuuagauuuccuacagguacuuugaucauugggaaagguucaggugacaaucguauuauagggcaagcaagggaaagggccccacugccggacccauuuucuuuccuguuaggaaaccuuucuaacuaaggucagaggaccgagccugggguuuuaaaagaauucacggagcaaaagugcaggggcauucaggagggggacauggaauguggcacgguaccagcaguaggccgagagaugucaccugaaucuucaaggucuaaugguaguuauccugguaccgaugucaaagugggccacauuucuuuuuuuuuuuuuuuuuuuugagacagagucucaaaagcacccaaagaaauguuccuuaaaauauauguacaucauggaagagagauauaugcacagaacaaacagaugcuaacuauauaccuuuucacaucagccauaauucugcaaggcucauuaauucaaggagauuuaccaagcaccauuauaauuuaaaaaauuaacccucuaacaaauugcggcauggugagcuuuggugacuuuguaaagacauuuuguaguaacuuugucuggagugcagaggugcgaucucagcucacugcaagcucccccuccuggguucacgccauucuccugacucagccucccgaguagcugggacuacaggcacccgccaccacgcccggccaauuuuuguauuuuuaguagaugggguuucaccguguuagccaggauggucucgaucuccucaccucaugauccaccugccucagccucccaaagugcugggauuacaggcaugagccacccugccuggccaaagugggacacauuuccaauaaacaauuccuacuggaagaggccccacguuucccuggagagggagugugcuccaaugggaaggguuggacuuuaggaucaggcugaccugauccugaguucacuuucugauucuuacugguuuugcgagcuuccaccaauuauucacccucuugugguaccucagcuacuguaccaguaagauguaggguuaauagacuuuugauuaaagauggcagauugaacauaagcuuuaaccucaguugccucucaauacaguaauaguaaaggguuugguuuuuucccucucagguauaaaguaauuagagacuaagugacggggagaggagacaucagcaacauaauuuuggaagcugaaaagcagauggagaaguggagcaguuagguuucaguagacccaagaaagcugaaauccaaguuggcaggggaacaaucaagaagcaauccagcuugaacuacaaaaccccccaaaagauucaggaguuaguaguacaagcuuccucuugaaguagggcuaacacaggacugucgauugaaaauguguuugaggagcagaacccucgauuuucuccucacugacguguagcaaaaggaccacucugccaaucaccaacaggccuucaucuugguagaagucuggagauuuauucucuggagaugauaaaagcaagguguuuccaccaaaacgagaaguaagcuaagacaagauccacgaaguaagaguugcaacaaaaaaagcaaggcaagaaccaucccaaagccucagcugcgcggucaucaucagagggggaucuguucagacuggagcagagcugaaggcuucagggacacuucaagaggauuaaguaauugcaaaccuaauaacaaccauugccucuucuauuuauugaguguucauugugugucagacacaguucuaagcauguguguauuaacgauuaaauccugauaguagcccuauuagaugguagucauuauccuccuuuuaucagugagggaauugaggcacucagugcuuaaucauuagucuaaaauggcauagcugguuaguggcaaaacugagauuugaacccaggcuguccacacucauagccagcauaccacgccucacccccuugacaacaggagaaaccaagcugaugacaaguuaacacagcugggaaagcugggggaaacagaacguugcacagagaagaagucaucuuaguuuacuguggagcucaguagugaccugaacagguaacagugugaaaggggaucugacaggagucuccgcaugcccacaucaggaagauccgggaggggcacaggcaugggcaggagaugugaggcaugaaggagcuaagugcuucucuucggugauacagaggcaaugccuaaaacaaauaacaaaccagaaguagcaagaaaaauagcuuguuuaaagcuacagagagacccaccaaaggaaccaacuagaagaguugaaaacaggucuccuguaggucgucugggcagacuguggcaggauaggggaugggggcugcugucuuucaggaaaaguccugagaauuauuugacccuucgaaucugugcaaguagaacuuugauaaaaauaaaagcgaaacuuuagaagggaauaaauaccugguaguacugucaugaaauaaaucuguuuuaucuuccuaggaacucgguaaauguuaguuuuucucuuuccuuuuucuuucaaaggacaaguucccaucccaggcagaaaugaaggcccagugcggcgcagccgcugauggcucaccucucucagaauggcccgacugcccuucaggccuucauuucucgcuugccaacuuccagggaaggacagaaaagcaggggauucuguugacagagaccuuugaugagcgcuuguuaccguccguggccuuguggggugccuggauugaggcccagcaaauggccagauguggggcauagcuaauguggguagagcaccucccgcggcugugggaagggacagugacagugucugacugcucccgaggcgcuagcaaaggugcccuccuggcugcagguaaugggggagcugccccagacagucuguaaggcagugaucguguccaggauccuaagaguuuccuuuuagccaccuccaacuagggcaagaggccaguaucuugaaaggcagaguuuggggcuuguguguaugcaggagagagagacaaaguguguguauuuauaaagcaugccauacgccguuuguucagugcaauaugccacuuuauuuuuaucucuucuuacgucaaagauagggaaagccuauuaaucaguaaaucuaaucauaaauauaugcauauauaucuacauuaauaucaaguguuuauauauugauaaauugauuuaagaacgcuuuucauuucuggcagaaccuuagacauuaaugaaccugaauucucuuacugaaguauccucuuauuauuuuauagcaguucuuccuacuacaggguaauuaugaaccugauuuuaacaaaaaaguacacugaucuacuguaaucugcucaguaauacaagugagcuuuucuaugcaaacccuauugcuccaaaaagaauugaagaaaaaauguuuuaccaauucagacccacaaguauuuauugugcaccuacuacauggaaggcguuggaccagcugcaguggguauaaugacgaguaaagcaggcucagcccuuagcuuuuugcauuuuauuuugaaaaggaaaauccuaagaacuaagugaccacaauacaagucugacgagacugguguaugagaggaacaagcaggccccuccugggggaucggaggggaagacaucucauuucagggaucaggaagagauagacaugaguugagggauuugcacuauuggaauuauaaaauaacacauccccaaccuucauucauugauucauuuacccauucaacaauugugagugccuguuaccugucagaugcuccucuggacccuggggaugcaccaaagcaaagcucaccuucauggagugcagggaagagaauaguggagaagggcaggcugcaucuucguggagugcggggaagaggauaguggagaagggcaggcugccuuucccugcucugacucuacccugguuucugugaacauucagaaguuuccuacguaaugcugggcaguccuuggcagucuuggaguuuggcuggcaugggugcuguguguaaguauaguaucaguggcacccuggguucucugacagcaucaggacaucacuaguagagucagcaguguuucucagaagcuucugcccugacccuuugaccauggaauccccagucacauuagggcccuacguccacagaggagcagcaggagcagagaccuucuguggaaaccacggcugccccaucccagccgggucauaggucaguguggucugcuuuaaugggacauaacauccuuucuggaccacccuacuugccacauccauggguuuccuccuggcagacuguggggucggaugccucuucuccaauuaucucuguuacaguauucacugauaaccaucuuagagggauuaaaucagaacuuacaaauguuuuccugcaguugauguuuaaaauauuuauuccaaaaaaaacaaagauguucucagccugauacauccuuuguggauaauagcuuggacugcaucaagugccucugggguuaggauacugcccuuccccuuagguuuaacugaauguucaacaaggaugaguguaacaccgaaaagcauuaagacucgaagaccugcuacucuucaaggguggauuccaggccuugggaagacuguguuagggguauuuacauacuaccuguguaugucgggagccccauacaccacugcaccugagaccccucggugggagguuucaguaucuauccugucaggaagugguucucuuuuaauugcaguugacccuugaacaaguuugaacuucaccggcccacuuauacguggauuuucuuccgccucugccaccccuaagacagcaagaccaaccucuccucuuccuccuccuccuccuucucagccuacucaaugugaagaugacaaggaugaagaccuuuaugauaauccauuuccacuuaguuaauaguaaauguguauuuucuuauuuucuuaguaacauuuucuuuucucuagcuuacuugauuguagcaguauaguauauaauacauacgacauacaaaauauguguuaaccauuugugcuguuggcaaagcucuuggucaaaaguaggcuaugaguaguuaaguuucaggggagucaaagguuacaugugaauuuuugacugggugagggguugguggccccaacucccauccuguucgaggguccaccguauaugcuuuucucuccuugagaaaaaauuucuagccaaauuuugucuuccuuaaacucuauagagcuugagcuuccagcuuguggucugagaaaccucucuuuccuugguguuugagcaguaauccuuuuuagcaugauugauuuuuuuuucauuccuuuuuguguccaggaucccaccuuucacugcacugaguagcuguacaaguuucacugcccuaacaaauuaccacaaacauaguggcuuaaaacaacacacacugaucauuuuacagcugcagaucagaugccugaaaucaguuucacugggcugaaacggacuuguuggcagggcuggcaccuucuggaggcucuaggggaaaauccguggacuugccguuuccugcaucuagcggucccugcauccuuuggcuuguggccccuuccucacaucuccuccucugacucuggcccuccugccucccucuuauaagaauuccugugauuauguuguguccacccagacaauacacaucuccccauuucgugauucuuaacuuaggcaugguugcacaguccuuuuugccauguaaggcaauauuuucucagguuccagagaauuggagguaggugucuuuggaggaucauucuuuuaccuaccacaggugcuaauuaaacauuuuuaaaacucagcugguuguuuccuuuccccaucucugucucugaguauuuauggaccagguuuucaaaacacauaacucacuucccuguuauaaaguaauaaauguuagaaaauuucucucaguucuuuaaaacaguugggaaaugauuaaauugucuuugcagugauuguggcuuauuacucugaaaacuggacuugaacuccagguauguuggguaucauccuagggaaccacuaacacucuagaaaaaccaguaucgccauuuuucuuggaaacucuccuuucaucuccaaguacaauggaagacaaggaagaggacggucccuguguuguugcuguugccaucaucuuuguuguuguggauucuugccuucuuuauccccaacuccagaauuccuaucugugccaaccugucacuggcuuugcuguggaagccuugaccuccucucacacacaucagcuguagcuggcuccaauaugucaucugccacacguaaccuagaauuggaagguaaccaagaacuggaaguguaaccagguaaccuagaauuggaaguguuuguagaggagaggaaauaagcugagugaguaaugugcuugagcuccaggguccacuucacuguuacuuaccuugugauucuugccaccccccagagcaccagagcagugacauuaaacaaacucuugacucucaaccauguuucuccuuaaccuuguucuuuguuuuuuuuuuggagacagagucucgcucugucgcccaagcuggagugcugugguacaaucucagcucacugcaaccuccgccucccggguucaagagguucuccugccucagccuccugaguagcugggacuacaggcgcauacuaccacacccagcuaauuuucguuuuuaguagagacaggguuucaccauguuggccaggcuggucuugaacuccugaccucaagugauccacccuccucggccucccaaagugcugggauuacgggugugagccacuguguccggccaaccuuguucuuugacacagguguuuuaagcauacaugugguguguccuaaugagaaugaaaauuguguggguggcuaaccauaccguauaugucuuagugcuccagugaguaucacuugaguggcuuuugaucuguauuugacagauacuuuaauaauguuauacagauauuuuacagauacuaaaauauuuuauauuuuacauauccuuauguaaugcauauauguauauacauuguguauauauacauauguaucacaauaugugaaaauauauauaaaggccuugugaauucuuuucaacuauuaucucuuuauccccuuuuugugggauguguauuuagaaaaaauaauaauagaaaguacccuuuauuauuguucagcuuccaccccccucacaguucagaagacugauccuuguaucuuucaagcuggaagccuuuaucuaaacgagggccugugaguuuaaauuucucuggacaaacccagaugaaagauggcuuguugaaaugaaggcaucucuuccacugugcugcacugauuagauugaccaaucaagcuuagaauaggaaaugacauggaagaucagaugcgggaaaucauugaaauauuugcccuccuguuacaggaucacugaaguccacuuauuaugagacccagagguuuccccucugaagaugcgggaaggcagugacuaugaaacugguccuggaagucuguuguucuggcauccucugcccuggcuaaaugagguucuggcuucagaggggucuugguuuauaagugcuccagggagauguauaugcauuuagcuacacaaaaccugggcugcauuaacgguucuuaaaagcagagaauaugaaagggaggacagaggcauuuucaaaaauugauguucaauuuuauaacucucaguuuccaguaaaacuuuccguuauggucaguaguuuauaaaggagcaguucugagucauuguuaagaguggaggcucgcaggcagauugccuagauucaaauuuugguucuaccccucaccagccauguugguuagaagguuacucaacuucaauuuccucuucugugacauggggaauagucauaaaaaugccuuccucauaauuguugugaagauuagaaauaagauaacauauuaaaagcacuuagauugggaggccgaggugggcggaucaccugagguggggaauucaagaccagucugaugaacauggaggaaccccuucucuacuaaaaguacaaaguuugcugggcgugguggugcaugucuguaaucccagcuacucaggaggcugaggcaggagaauugcuugaacccggaagguggaguuuguggugagccgagaucgugccauugcucuccagccugagcaacaagagugaaacucugucucaaaaaaaaaaaaaaaagagaacuuagaacagugccuggcacaaaauaauugcucaauauacauuggugguuguuacuguuauuaaguuauuguuauuacuuagcagagauuggaagcauuaacacauaaucuuuccaagacuuuuuaucuccaguaacuaaacuccaaaaacauauggguacuucaagggggugaccacugagcuauucaaauguacccuucuauucccaagaguacaccagugugcacucuaauauacacaagaauacccuaacuacauaaacuacauuacaugucuacucauacauugccucuuuaagaaauguauauggcacagcauuuuauugucauagccaugauggcauuuauguuuuauaaacuggagggaaguuauaagaauuuuucaucaaagaacuaaucuuuucuagaauuagauagaugguuagcaaaauguaugacuggauuucugucauagaaauuuucaaggagaugaauucuaggagaaauuaagcaucuuccccccaccccaauaacacaaguuauuggauaauuuuaaauuugugucaaauggcuuaauauccuuuccacagacccugaaaauacaaacauuugauaugugcucguauccaauuucaaguucugcuuauauuuuauuugaauuacugucuccuuagcugccaggcgccccaacacgaauguuggccccugcguuuuacaauuguuccugauagugcuuuguuauguauugggagacuuugaugcccagugcccgcguuggacuacaguuguuccuuuaccauucuuagcaguaccucauaugacuugcgguauggaaggcuuuucaaagucauaugugucccacugggauuagugcaacugcuuaagcccuggcuguccccaucuuuucucugcuuguucacaugguuaauuauggauucaucaaauguuagagcugggaaaaagaucuuggagaucaucuggugcuauuuucucauuuucaguccagagaaacaacgcuuuuccagccaaguguaaccccagucguuagugcaagggcuuagucuagacuuugauucguucuguaacuacauuaagggggaugagaagagagcucacguucacucugcacaaggacaaauaaaaaaaggcccugccaucccuugaggaacucacaguacagcgaagugacaguccggugagcagauaauuaucuuuaauucuuagcccauugcuugcuccccuguacugguaugccuuugguauauacuguuucagcuucuuauccauccacaugguuguaaaguggggagcuuuuguuuuugaugccugucucuccauguauccauucauuuauuuuucuaucuauaagucauucaucaaaaaccacuuaggaaugccugagcuaugcugcacaacagagucacuuaaaugcuacauaccaguggagaaaaaucaugguucuugccuuccaguaauuuauagucuaguugaaggauacaagcauauaaagaacaagguacaaacauguguuaaaggaacuguaauauaaacaugacaagguacauggcagacacaguuucauccugccuaaauccuccugaguuguucacagguauuucauguguuaguuauucgaaggaacuuuacaaugcaccuccuucuuuggggcauuuacauuuuaaaguagguugggaaacccgcuuuacuaccuuccucucccuucccucuuuuacuuucuuucuuaaguucgagacugugucccaccuguguuauugcuuagaggaggugggccuagccuugugcuccaugauggaguucaaagagaaugccauccaccaaucuugcacucucuggcucacaaucugcuuguccccuucguugauuaguucuuucuuucauucauacauuuguuuauucauaugaauguccacuguuuacuaagccaguagucacuguggaaagcaaaggcagacguggcugauguucucaaagagcaauagucuagacuagaggggaaauuaacuuucauggaauaaucacacauguagaugugagugacagcugaaauaagcaucugcaacuugaugcuuuaagagcagugagcaggcugggcgccauggcucacaggcccguaauuccaauacuuugggagacugagauuggaggauaacuugggcccaggaauuugagaccagccugggcaauauagugagacccccaucucuacaaaaaauuaaaaaauuggcugggcaugauuggugcaugccuuuagucccagcuacuugggaggcugagguggggggauccccugagcccaggaggucaaggacugcagugaggcauaaucacaccacugcacucuggcccagacaauagagugagacccugucucagaaaaaaaaaaaaaaaaaaaguaacagugagcaguggagucaagguugagugugaggccagggagagaagagcauuauucaaagccaaggagcugccuaagcaaagcucccuggcaggaaaagaaaucuauggaucagagcucuggaaagaaggccaguguggcuggaaaagugggggacaugguguugaggcugaaacggggcugaggccagaccacacugggccucuuugaccauguagggaucucucacuuuaccaagagcaauagaagccccuggaauguuuuaagcaaggaaugucacacgaucagauuugguuuucaaaaacaugacucuggcugcuuuguggagggggacugaaagggaagaguguggcugcagaaccagcgggaggcuacagcacagcuacacaagcaacaaguuguuccaacugagguuguggcgaggggauagagauaacucagcagaucccaaaauaaauaaaacccaaaauuucuacagcuugcuacuuaguugaacacgagggaagagggaugaugcugauuauggaaccagauggaugaugcugccauuguuguuaaggacacaacugguugagauuuagguuugaacacguuugccuugagguuuacuggaggcacugaaguaaacguguugcacagauaguuugaaacagucuggagcuuacaggaaacacagagacuggcauauaaaugugugagugaucuucauugagaauguauuugaaacugaaguauggagaagguggacuaggaagcauggagugagaagagcaaggggcuuugcaugaaucuuauggaacuagggcccuugguggccagauagaggagagcaaaucugccuggaacgugggggagccaggagugaggaagagccagggugugugagugcuggaagccaggguaguagguuucaagauggcaggaguagccaacaucacugaagagccaaugacaugaucaacaaaaagccauugcauuuagcaauaggggucacuggugacuguggggagaaaugaucacucagggggccagaagcaagauuagauagaguggguugaaaaugaagugggaggagaagaaauggagacaguaaguagacaacugaagaaaagaagagagacaaggccaugcuuggaaagguugugugcaguaagagaaguuuuguaaaaguguaauaaacuucagaguguguaaaagucaggagaaggauccaguagaguaggagagguaacuauauaagagagagagacagaggagagauguuacaguguuccucagaagguaagacaucaugggaccccacacuuggaagagggugagcaggguugaccuuagacuggacaaaaggguauuuuacauugaaugaaaaagaaaaggaaaaauauuuucucuuguuuugcuuagauuucaucuugggcuuauauuugacauggaacuaguccacuguaauuuuuauggacuuuuuaccauggguuuuccaccuaacguauuuuuaaauucagaaaguugggguauuuucauucuuuuuuucuuugucagcucuuuuauuacaaacuauucuauucauuuguuauauuuucccauccuugcagugcauugcagacaauauuauuauuacaguucuacaugcauguuauuacuuuaguuuugcagggacuuccccaugaauagcagaauguaauuuaugaaauccaaccaucauucucaaggcaccucugugcuauauguuaaacucacuaaaacagcaauguggaaauagucacccacacugcugacuuccagagcaucagucacguugccgcuugcauuuggaaggagccuccccugauccuucucuggaugaagcccuggagggaggcauuaccuacccaggccacuccucuugcuggcuucaccguuugaacuaacucagggacgggugucucuagauccauccaaauguguauaaagagaugaacuucuacuuucaguuaauuaucaaaacuauaauuaucuuagaaaguuaugcaaauuagucaaguguuaagcccuucaucgagaagcuagcaaaguagaauuggugugugcgguggucaagagggaagauucucagaucagauccccggguuugaacgcugguccugcuacuugcuggccgugugugaccauggcagguuacaauuucuuugugccccaguuuacuucacuauaaagcagacauaauacucccaagcucauaugaucauuguaaggauuaaauuaguuugcauaaagcucuuggaacaaugccugaugcauaguaaguacuuaauaaauucuaugauagcaucuuggaugcagugauggugcuucggaagccuguuaccuucugcugccuccacguguugcaguuucauuugggaaacacuuauuguuuuagucacauacaacucuaaaaggaggugauucuauguccaguuuuucacaaugucuaaaauaauaugguucacaguaauaagauuuuauagcaggugaauguuuacauucucauuucccagauauauaauaaucaguagccacucccuuugcauuaaaaacaagccccccuggcuacugaauggcucuucaauguagggaguaucuuagccagcuuggcacaaauaaaaccucuuuccuuuucagcuguuuuaaacauuuagcagucagaucagaugauugaacuuucaaaaaaauucuucccaauaucuguuuggauggaaucauuugccguaaagaucuggcauuauucaaagcugcucugugcucccuuaauugaaaagcccugacauugacauuggacagggcuugccuuuggggccaccagcagacagcuuucuucagugccucguauuguuaaugacucagagaauguguuucgaugagaucagaagcaauccacuaaagaaaaaguggagaggacuugagagcuuaaaagagcggagaggagagaugugagaaaaccuaaaaaaagacaaaaguugguguggaagaagggguggcgcgggcuccauggcagauuugucauucgucccaguccagcuauuuagaaucauuuuuccagugggaagagagaugaagagaaauccuguccaaaagaacaaggaagaugucuuugaaaugauaugaggggagccagagacagacauggaggugagcaggaccaggucuugcuccuuagaucuccagggaagauguacucagcacuacugugcgcaccugggcugcacuggugucuuuacugcaggcagaaaggauggaugcacgcuggccagggccauggacugcaggugcuuaaguggccccacaguagauggcuguguucacagcucagaucuguggccccccuggccuccucagccccucugaacaguaucccacuguuagcagcucugcagugaaagugcaaucugaacacaaauuaaguggcagcuuugggguuuuaaagaaaaaggaaaacuuuuucauuuuagaaacagaaagcuuaaugucuccugugucaguucauucuaugcucccugaaaugguuucaucucuaugcuaauuuuaugcugaaaauaggaacuccccugugcuggagaggagagaaagggcuuggaagucaaagacuauccaaguggcugagaaucaaguggacccccuugacucauuuccacuuagaaaaugcuuucaaggcagccaguguuacaccgaggguccugccaggggagccgaggccuuugccugucacccugggagcuggcuuccaggccuugggcauggaucccucgcccagagucugcuuggucuugcaccaaugauuucacagguuauauccagaccucaugcuugauaauaagguaguaagcugacuucccuugguuuccuccacuucuguuuuaaaugaauaauuaauccauuaaaagcaucaucucaaaagcacaaaauauccuauaaucuaugacuauaaguucuuagaauaagaaguggacauuguguuaugcuuacuuguagacuggucugucucucuuaguaggacaugagauguugaggauggaucucauccuaguccuaguccuuaagagcaccaacauggacgcuuccucagcguaggcauauaacugugaucucugaagauuccuaugggucuaucauucaguagcucaagggcagcuggacggagaagagauuagaagucuuguuccugcuucuuaacuuguucacaaagauacuucauuuuuauuauuuugguccugccaguucucuucaucugguuuccuguauccuuucauauacagugaugcugaggcauuuuuucauuuguuuguuuuauuuguuguuuuaaagagaaaagggaguauacuuguugcuucagggcaaaacaaagaccagugggaagaaaguuaucaaagguugauuucagcuccucacaaagagcuuucuaaggacaggcuauuugugaagggacuaaauguguuuaaguagagcugggcggucacaugagaccauuguccugaggaagcucacccaaaaaccccgauggccaggauguugacugauggcucacccuggagaguugacaucuggagccuccgcugacaagcagcaugguccgcuggcaggugaauaggggccaugguucugcgggcucucuccagggguggcugaggcuggcacuccacagugcugcuaagcacaugggucacagcugcaagaaugcugggguaugcugacuaggcaggugugcggaggucacgaugcagcuccaucuucaaaacaggaagcauuucucggagcuguagucucacagacucuagagagauuugagaggagacugucagagagacacagaggccuggguguguguggaugaggugauuucuaaccgguugauaauaagguaguaagcuuuauguuucuaucauauuuauuuccccccucagaucagguugucugagccagaaccacauaucccagagcaggcauguuagugaucugggauagagagaaggacguucuaaacaaugucuggaaacauaaggggcugagaugcauuuagccauuugaaaagauaauggaaauuucuuucaacuaauuccuuugagguuuaacuguauaguauugccuuuuucauccuuucacaaaacagacccuggaaggacucaaauugguaagugagaagccaguuacuaccaacuacugggcagcuucuuggcaggaggugagagcuuucugcuuccuuuuuaggacaauuccacccuuccuugagugggaggaguuggugagguggcugaaugucaugaggguuuggagaggagguggcuguaaucgcacaggcacuggcauugaagagaccccgggaagggaaguaccucuggcuccauggcaggaucuggagggaggaagggaagauucauagcauagcaggucuagcguaccgcacuugaaaagacuaugguauuuauugguucauugaacucaacuaaacccaaaauacuggguaccucaugugugcaguucuuagugccaggaaugaugggcuguguaaggaagaauccaguaacucccucaacuaacuuagaauauuuauuuccuaacuaaaagaaacauaaguaagagucaacaauauuguuuguuuugcuuuuuauguagugucaggcacagaaauaugcucaguaaacacuugcugguuaauggccacugcaggucccugaauuugcguugaguugaaagaaaugccaccaaccugccccuccacugccaggaguucaagucaggagagcagccagccugacuauagaagaacuacacagugccuaaaguuccaggaaaccuuccaguugcaaggagagagagcagugcuauuuuaauaaauaguacaugauaguuuugcuguauaccaggccuacacagugcuagacacuggaggcaaagacagacaaacagacaaaauaauuaaaaugugguuaagaucauauccaaauguaaauuagguccaccacuguggaaaacaguguggcaguuccucaaagaccuaaaaacagaacuaacauuugacccagcaaucccauugcuggauauacacccaaaggaauauaaauuguucuauuauaaagacacaugcacauguguauucguugcuauucaaaauagcaaagacauggaaucaaccuaaaggaucaucaaugguagacgagauaaagaaaaugugguacauaugcaccguggaauacuaugcaaccauacaaaagaaugcgaucauguccuuugcagaaacauggacagagcuggaggacauuauccuuagcaaacuaacacaggaagagaaaaccgaauauugaauguucucacguacaagugggagcuaaauguugcaaacacauggacacauacuggggccuaucggaggguggagggugggaagagggagaagaucaggaaaaauaacuaauggguacuaggcuuaauaccugggugacaauauaaucugaauaccaaacccccaugacacaaguuucccuauaugacaaacuugcauauguaccccugaacuuaaaauaaaaauuaaaaaauaaaaauaaagauuaaauuuggcugggcacaguggcucacgccuguaaucccagcccuuuggggggccaaggugggcagaucacaaggucaggaguucgagaccagccuggccaauauggagaaaccccaucgcuacuaaaaauacgaaaauuagccuggugugguggugcaugccuaaagucccagcugcucaggaggcugaggcaggagaaucgcuugaacccaggagguggaggcugcaaugagccgagaucacgccacugcacuccagccugggcaacacagcaagacaccgucucaagaaaaaaaaaaaaagauuauauucuuuguugaauauaacaaagugaauauaaacaaaaugaaaauuugggggaaaaguaaaauaucauuuggcauuaaagauaaccccuuaagaaaaucacuaucaguaccaaacauggagccauccagccaaacccauagaauucuagaacaucagagcuggauaagcccuuagaacaaucuguccaaaucuguuauuuugcagagggggaaguggagacccagccaugcaaagguauuagcaacaguuaguuuacauuucuuucuggcugcauuuacaguggguaaauacaucuuaacuuuaguggguugaaaaagacaggugcuauuuccucaaacaauauuuuggcugcuggugaucgacucuuagagcaagagaaacacuuucuaacaucgaugugggauuuugugugugauguguggguuuccugagcugcugagcuuuuccacaaucuccugcucuauuacuucguagcccacuuuccuuuaauacccaccgucagagagguucucuuuaccauuccucugcucagcuccuucagaagucuguguacaccgacaauaaaugguaggucugaaaacagaugagagguuuuuaaauuugaaaacagaugagaggcuuucuucccucaagggaugaugugggguuuaguagcuucagcuauguugaauuuuacuuauaaauggugaugacuugcuuauaaugugagguuuauuuucuguuuuauauguaucuuauaagcagccacaugagcaaauauuuaauuuauugucacucuuguacuguuggacagcagcagcucaugugaaugauacuauaccaauucaagcucgggaaugacuauuggacacccagcacacuguuaggguuaucugcguguguccaugugauacugaaauggcugguccccuggucaaauagccagagaaaccagagggaaagugaauuccugaacuucauucaauuaaaugaauugagguuuagauguuuuuuacuguuuaauucaggcgaaacauuuguuauucuuuauguagaaacagcugaggcaaaaauggauggcuuagaaggaauauccaaguuugaauccagguuuuaccucuucauugcuauguuaccuugagcaaguuucuuuuuuguguguuuggguuuuuuuuuuuuuuuuuuuuuuuugagauggaguuugucucuuguugcccaggcuggagugcaaugacgugaucucgacucacugcaaccuucgccuucuguguucaagugauuuuccugccucagcuucccgaggagcugagauuacaggcacccaccaucacgcccugcuaauuuuuuuuguauuuuuauagagacgggguuucaccauguuggccaggcuggucucgaacuccugaccucaggcgauggacccgccuuggccucccaaagugcugggauuacaggcaugagccaccacacccagcccacguugagcaaguuucuuaacuucucuaggccucaagggcuuuaaccacuuguaaugaugauaauagugcacagugcuuucaagguuauauuuuaauaaucaauauaagguaccuagugcagucccugaaaaaacaaacagauguuaauucccuuucuccuaagaaaguaguccuggaaugggaaaauaggagccauuccuugacacggagcagacguguuauccuggccuccuaugccauugccuucuguggucaguacuugaacauugugcccucggauuccaucaacagauccugagaaacagagaaaguugcucccgcaggucccauaguaagcuuguugaguguuguccauuccuaucacucagcccaccuccccccacccccccgcugccuauaaaaccuuuugugggaaauguuuuaaaaauuaagcaccaaggguuagugugccucaagauaaggguaaauuugaccuuaaggguuuuguaagugaccauuuuuccuucacuguggcuggggagagccaccguauacgucagcccccagggcuugcuguuguguugcucuuuucccugaucucaguaguccuguacuugcuaauauuuucgcucaucauauugcaguguauuaggagagggcucugaugcuguucugugguauuauaggcccaagucaagagcucccaaauccugcccugcuagucauuuggccuccugauggcaaacagagguccugagauucggagagugaagcggaguggcugccggcaccaccuucucaccugcaagagcacccagagccuuguccggaguugggcuuauuggaggagcuggugaaggagaagaggcugaguuggcuuaagcaccccuucugccugccucuaaccccacaccuucagaucccuuuagcugcuugcacagcucaugaccuaugaacggggguggggaagaaguaggcagaauggagucugacaugagaaaagugucaauaacaucccauuucuuguguugauucuugauuucuguucauauucaaacauuauuuuguuguauauuuucuuucguaggccuccuuaaaauucucguagaaugaggcaagauauaaacacuuacauagaaguuaacagcaguguguuaaugauauaugcagccaagcauaggcgcuuaugcccagagugcgcaaguauacagaggacauucaguggccaaaguuggcuagaguugcuuugguccuugaucaaguccuguuuagauuucuccacccaaauaaguuacaucaauacugacuagauaauacauauucaacaggcaguacacccccugaucauuguggauaucacaauucaggaaaucauuuacuuacuaaacauuuuuacuuacuaaacauuuacuuacuaaacuuuuguguccccuacuaaacuuuuagcuucuagagaguagaaaccauguccuguuguucuuuaugcuuauaguacuuggcccacaacugaugcacaauggaucacgaggggugacuagauaaaugagaauuuuuuaauggcaagaugauucagagcaaaugaaauguagaauaucauaauauuuuauaaggaauggcauuuugggcaaguuauuacuuguacguacuuuuagaaacagucucuuccucuaaccaaaugcuucugaguaggauccugcuuuaauggauagaaaaacaugaguucucauuaguaugcacagcacugaagcccaguuacauuuuuuuuuuaaauaagcacacuuuuuaagugcugccaugcagugucaucgcuccaaaagcuuauuacauuguucauuuucuuagcaggcucaguucuacugaugguguaaaguuucaaccggggcucuucauaauuauuacgaauucuuaagacugaaaucagguggcuuuuuauuuuuaguguccuuauugugcucacucaagacuauauauucagcagugugcagucuaugccugacuguauaaaagacuggaauguucacacacuauaaugaauaaugagugucagugaacucauuacaguaaauccuuagguaauuacuuucugccuuaguugggggacuuaugguagcauaagcuaaaauuauuucaucuccagacaaacccugagguggcuguuggaguuaaauauaauucauuugcagcauguuuauuauaguuaaauuuaacuaauuuagggccuguugcuggccagaagcugaggaggaggaaguugcaguguccaugaguaccucagaaaaaugaggcuucauggccgagcuuucagagcaugacguaagaguuacucccacucugucucugcucuuccuguccccagagcuggauggguuuguucaugaaagugauuggcuaaugagcucuucaggcauaggauuaaugugguguagcaagaggaagucucagcguugagcuggggcucugcucaguucucuccucuguuucugccggaacuuccugguguuacagaaagaacuaugguguucaaggucacuguuguaugaauggauuuaucagcagauggugaggcucccccuucucgugccccauuuccacucaacacugucgggccagucugggcguuauuucuuccuaagccuuccagccuggaagacuuagcucuggaaaaaauaggaaaggacuuacuccaagaaccaagcacauguuuacagaggaugguuuaaccuuuaaagauguugccacugaagaguuuuuagauuagauuuugccucaugagagcucuucugagcuggauggcuugcucuaccaaagauguuacagggacacccgcaggagaaaucgcaucaacgcggggaggugaggcuucugagccaucgcuugugucuaagaacauaagccaaaaaucacuguagggggacuguuccccagaagacagggaccuugccaggagaggaaacacaauuccgaucaucgugaggaacgugcauuugcggaagacauuguccuacuuuuccacaaaaauaccaugucuccauucuggaaauaugugcacugugcuaauugcucaagagaagguagcaguuggaaaaaguccagagaaggaugaguagaugaacacaggaaucagucgguagccgugggaacagcaaagccccuucagugggaaggcaagaguaaagagaagacagcacugaagucuguggaaucuaaagcggcuuuggugggguuuccucaccgacccaaagugcagagcuagcaggguaggcacacccacccgugccugugguggcccgcccuaagacucuauccaggacagccaccucagccucacuauccccuggccacguccuggccguucagucccaccgugacgcagcuuacaagcugcagaaccgucugccucucaagccaguguuccucccacuguaccacaguugcuuccguuggguccagacucuucugaaaacuccccuuuucaauuuuacucaaacagauuuuggccauggaaaugguuugugacuuuaacgggcaagcugugauauaaaaaguaaaccauggguuacauaacuucaggggcagguuaacuuuuccagaauucuggucucaaaguaaagauuuagauuuaguugaggcuauaaaaauucaggaaaaaauaauaaagcauuucuacaccucccuccuuccccuugcgagccccccuuaaaaauagcaucugaaguuucauuguagcugagucacugcuuggugcgaucuagggcuaggcugcaacuggaccugucagaaugaggccacagugauucaugaugaagcuaaguuugguugccacugacaacauguguuccucucuguucuuucccuggaguuuggagacacuguauuuugccuuuggauuagaaacgccuuugaguggugagaguaaugggaugagaugggccacugcaauuaaagagcccucugggcccucuuucugugacacccuagccauuuguuaggggaagguaggaguaauuaacauaaccaaagaccuuuggggcugugaagggaauuuaucuccucugccuuugcaguuuagcaucaagucagucuaccaaccaagagccccccaacaccuuuucugggccccaaacugugcuucccauugaggaaaggcaaaugauagaauaugcggucccuacccugaaggaauuuggggaagcacaaaccaauuagagaagcacugucuacuucccacguugauuauaaucauguaugugucaguuuccacguuugcgccuggagggcagaagccacagcugguuuugcugugcauggcaccuguguuccuggagcugaagugaauggguccugccuccagcaccugcuuccccacuucugccaucagaaagacucguucgggaaaacauuccuucauucccuuccuagggcaccacaguuaauaaggccacaaauuugggccuguccauccuggugcaaguaucugaggaagcaagaagagauccggguuagcaaggauacgauuacaaugcuuuuauuuuuuuaaugggacuugggcggugaggaaauucuauguuccccgucauuuaugcagacuccagcuaaacguaugcuaguugaacucaugccagcucuguggaagugagggacagauacaagaaacaugggaacuuuccaagaaaugaagcuucuuugcugccaugucgaugaugcuuguuucugagaaacucaaauguauggaaguguagaguagagcuucccaaacagggugccguaguucacagauuugcacacaggggugccagcauaaugaucucugcagcucuuggcacaccuugguaugucuggaguaugagauggacuuaacauaugaauauacauauaaauauauauaauguaucuguacaucuuagggacuagacaaacaagguguuaaauguguuccucucuggaugguagguuuauggaauccuuuaaucauuuuacuuauuugcuuauuuaaacuucugaaucuguaacaauuuauuguguguguggaagaauucuuucagcccaaccaaauacuagccaaaauauugaaguggaagguaucaguguucggugauccagccaaagguuuauguauauguuuuauucaaacacugucuuagaaaccauuugcccugaggauguguccucuauuuugucaguuuaaaaaggauucuuuucaguuagugcauucucauuaaaaaaaaaaaaaaaaaaaaaggaaagaaaaagaaacaguaaagcagaugucacauaucagagaaauugccacaucuugauagauucacaccauuuauuuucuuugccuguaagccuaauacuggcaacagcccaaacugccaacuuucuucauuuauugacauucuuaaaaaguuaacuuccugucgaggauguuuuugacagggauauuaagagaaagacuuguuggucagauguagguuccagcuggccacacuguaaaggccacugggaaucggaaccuuggcagauccaugcagagguaauaguuuggaaguugggaauucuuauuucccggcaacuguagacaaggagcaaugauuugcuauuuguauuuuauaucguauuacauuugcaaaauguuuguggucauucaaauuuguuuuuuuucacaguacuucugugaaugccugauuucucuuugccuaggcucucagauucuugaggggguggauggaggugugauauuugccuucuucucacauaggaaugccuauaaccuaaaugagaucaauaucauuucguucuucugggagcaguacuauuuuugccaguuaccaacauuauaaaauacuuccauauuuggaacuguggcauuuuguacuuggagggauuuuuuaaagaaauugccuggucuaguuccuucauuauacaaaugaaaccauugagaccgaacaggcaaagggaaguucucagagucacaagaaguggucaguggccaggcugaggccagacuguaguuuccuuuuuacuacuggucauacucugugcuuucuaccaauauuucccaauuacuauggggaauuaauaaaaaauguuuuuuaaucugcauuuuuugggggaaagauaaaaauacagaguuugucacaacauagguggucaauaaauauuuggugaagaagguguuugauaaaguugcauauauuuaccucuugagucaauaaaaaugcguuauauuugcagauagacacacacacacacacacacacacacacacacacacacacggugcuauguaguagcugguaaccacaugugugcugucaguccauacagggacuugauugucauguaucccagucuuuguggcucuguucaaaggaagaagcucuggggaggaguaacagagaauuuuaggagacagagaaaauagacuucuuuucaauggaaacuuaucagaauuguugaagugagaaagccauacacaucucuauguguauuuugguaucaguguaguauugucugcaguaacucuuuguuuagucaugaaauauguuacuugccauuccacauguacccaauacaguguuaaaaagaguccuguucagcuaggauaaaucacagaacaaguauaguaagaacaucaccaaguaauuauacaguaugucuuugagauuugugucuccaaguuucugaauauuucauuuugaaagaguaacuuagaaaacguaaagagaaguuccacagaagugccugggagagcugaucuuuaccaaauucaguaaaaauuucagaggugaauaaaauaaaccuggacaauucauaauaaccuacagaagacacaucguuuucauuguuuuccauuggcuaacauauccgguaggaaguuaaauuucacugucuuuugcauagcacagaauuuguuuuccuaaucaccuuuccuacauauugaacaacgucucggucauaaucauggcauaugcugcauugaacccaaggugaaaaucauucuuuuuuuucucaccugagggaaauuucacuuuuuuuacugaaugaaggaagcacuuaaaguauaaauuaaaauaaagauaacuacuauuaaauuugguuaggcucauauaaaaaaaaauaguaaaauggcagucaaaacaaccugacucaaguuugugacagaaaggcuuaauuuagcacagcccauuuauguacgcaagaagcuuuucuuaaggacacucaaagaugucagcuccaguccuaaaggaaacacacuugaaccgagcgugagaugaaugaagggauucugcucuugucuuuuauagaugauuucauuuauuugauucuucucuuuccuccuacauucucagauuaggcauggccuucaauuggauuuuguauucguuaaauacaaacaguacacauauuagacuggauacauauuugcaaauuuggauuuauauaaucuauuuuaaaauuaugagacuaacgauauauuuuauugcacaugccugugguguccgagucugggaucugcuuuaauucucaauaacauucaaauaaaaccauugcaaagagcagagcuagcaauaaggacauuuacaaugucacaugaagguggacuguaugccacaugccuuauaaucauauauucaaugauugcaaauaggauuuuuauagaaagugcucacagcaguuaaaagaauuauaucugaagucauauuucugaaugugagacuuucauuuuguuuaauuaucuauugaaugcucccaaacuuacuaggacuuagugugugcuuuuauucuauguuagagaaaaucuugguagucaaucucaaguguaugccccgucuuaugacugcgagauucccucucucauucugguauuguccugugauauuugcugcuuucugcaaucaauauagacagacuugagccaacuuaaauguugucucaauauuuaccuaguacaaagaaaauuccauuugagaaaaccacagaguauagucauuccuggaacaaccaggagaugguuauuaucauuggaaacaauuauuuuuaaaaaucaaucucaauucagagccauauguguauuuaaagugcccacacaucuaaaacuguuuucaauuaauuucaugaaauguuauuuuuucauuuaaaacaaaccaaagaugauuaauuuuuauauaaccaaagaugauuaacuuucauauaaauuugugaaucauaacaaauucuugagcaaaccaugugucuugcuuucuuuuuauauuggcaugguauaaauacugagaaucaaagcaaccauaauuaaaaaggccuggucugaagaggaaccguaaaguagguaagguuuguguucugcuuucuucuaucuccuccuagcucccauucaaguuauuucuuccggcuuuccucucuggcaagguacaaaugcuccugccucugccucgccccuucacacuguaauauugguuaaagaacuuggcaaugaaccagcguaaucaaauuccucuggcuagacuucucuggcaguagagcauuuaaguguucugcuccaaauacuuuccaacaaucagaaccaagacaccugugugggagccagugccacagguaagucccuguuagugacaguggccuugcagugaugcuuugggaaauuauccuggcuucaaugaguaggacagagaggaguggcuacccagcccaugcaaagccaagcaaggggcuguagucaaagagucaaaggcaagagucauuguucuucccugugagcuuauauaacagaguguguguucauuucucacacauauaguuuuaucucgcagcuacuugaaggguucacaugucuguuugcugacuugauugugaaauuccugaggguaggaauuaugucucaugcccagcaccaaggaggagugcaguaaaugggugaggaaugaaugagugaaugaaucagucugucaggcagucuguuaaugcagauggcaacaaugaaaguauggauucgaauggcaucuuugaaaauugcaagaaauggauggauguggaaaacugagagagaaaacuaagagaaaagcaagagagaucaaggcaucaaagccuccgaggcuuugagcugagcaaaacgaagagccugggaagcagucguagaaagggggaacucagugagaaaccucaugagggaagccaacacauaaacaguuugucacaaucucuuucucaaagaagcauccucuaaaaggugccuguguuucuagccucccacguccccuccccuuaccacaccucacccaaguuccuggaggucugauaagcagccaagacuauuuuguagacuuagcagauguccauguuuuaagggacauuuccaucaacgcuugaagguugccauccuuuguagacuugggaggaaagguggaugggagggagauaggaaaucugagcuggugccuugaggagacgcuuuggccuccuggaagaggguacuuguuggcugggauuagccccucaggccauggcuucuuucagaggcacuaaguuuacaucagagaggacauacuuuuauagucugcauugucagugcugcgcccucaaccacugcugcagauagccucuuacuuuauaaguaaauaaucucucagggaagagauucaccucauuucacacauagccauccuuuguaauacgagggcugcuugcacucuucuuggccucuggagcuucaaacaugucucauucccacauccuucagaagggccaaagagggaccuaccuggcugagugguauggaagcuaggagggaaacacccugguacgugcucuuuaaagucugugaguuacagagagaauaugauaaauaauucauuuucuauuuuaagccccucuuucuccaaaguuuuggaaugagcucuguaaauuucccaagaacuucucugaaaguucuaccagcugaccgaaugcggaaauaccugcugugugcuuccuggagauuuuccccacugucuguuuuaugaccuggugaauuaggcugcagucuugucuugauccagaaguggugccccuuggaucagaaggaaugucugaaacacauugauuuguggcuggaauaguaagcuaagcucuaggaacauccugccagaggcuuguccuuaggaaauagucucacaaauuuuuuugcuggugaagagaugacaugcugcaauugaccuguugaaggccagaaaaccgaggugacaaagcaaaccucucaguuucuaaugcuuccuucaggcuaugcuuucuaggggugauacccucuauauccugagagaccuuagcugcacaagacauuaaaacuugguccucaaaaugagugauaccagccucuggaacauaauugcgaccaaaauguguccuggggucaccagccuccuucuacccuucccucuaaaauccaaauaaaaacauuaagcccuacugcacuggccugcccuguugagugcuuuugcagauugccugggguuauuuauguccuccugccuccuccagcucuaaauucuggcuucaagacccuccuccaucaccccucugucaacacucccuggguuguuaacauguccacaauacugaucgccuuaccucccucuuuucccagggucuccuaaacaguacaaugccuuucaaaagaaauaauggagaggaaacuauuaaaauugaauuuccacauugcaguuuugacaguuuaucagugauucaucaccauaaucucuuacucuccauccuugcccugugaauagauucauaccuggaagcagccgucucuuuagaaaagcuucuauccuuuccugguuuuuccugagugccugguccucccaaaacuccuaucuuuuuuguccugacucagaggaacccucacuucccccacccccaccccccaacgcacacauuuccuucauaacaacacccuagagugagauccuuuuacuuuccguuuuacuucccgguuccugagggcauuacuuuucauaagaaaauucaucaaaguguuuuccuaaagaguuguucucccucuaaaguugaauuucauccuccaacccaauauggaaacagcuauugccagguauauguccacagcaaucuuuccuucuugcuacauaaucacaguuauuuuaaugauuauuugauuuucuacagaauguagcguagcucugaugcuguuagggucuugaugaaggcauuagaaacaaugcuuaugcucagagcacuugugugugcuuggacguugugugaaugugagcaaaguuguacuucagugaaggugcccaaccaacacugagacacauaaccaggaaaacaaggcugcagcugauggucagaguagccacggguuaggcaugaguagccauggguuacgcauaagcauccacaccaccagcuugggcagcugucaccugccauuguuuauccacagggccagcuagaaaaggauuucugguaggcaucucuaucaacaacacaggugaacauagggaaaacgcuaaaugagaauuaugaucaacuagaaauaaaaggaaaaucaguccucccuguauuucccauacagcugccccaucgguccugccaucagcaccacaugaggcguauauggaagaugguuuauuguuaccuuuuuauuaggcugcuucuagaaaauucagcaaguacccacaguccuaccaccuaauccauaaccccuggucaacauuuugguauauuuccuucuaauuuuguuuucaugcaccucuuguuuguucugcaaaaaguacagacguugucuuuuuuuuuuuuuugcuucuacaaaguacuguuacaguagcuccaacaaccagugaaaacaaaauuuguucuaauagaaaaaugagcagcagcucaauaaaaacaguucacuaaacaguugaucuacacuuacagccagaaaacaaaauguaaaaguuuuaccucaccaguaaucaaagaaauguaauuuaaaauaaugauuccauuuuucaucuacaguuaaaaauauaaaaacaauaauaucugcuuccgaugaggaaguagugacauaaucgcccucauagaaggccguguugaguguaaaucuccaaguuuguguuuugucaacacgaaucagccuggaagugcccauacccuugaucugguaauucugcuucuuaacaaucugugcuaagagauuuaucugagaaagguucaaagaugucugcauucuucuuuauuagacugaaaauuuggaagcaaccugaauguuaccuauugagaaacaaauacauuauaguuuauucaucuggacaaggaacuauuuugcagguauuuaaaacaucuuaaagaauagcugugcaccuuugaaaaaaaaaguucacaauauaacaaugggcuuaaaggguaaagagaagaauaugugaccuaguucacauuuuauaaauauucauguuauguccaugagggagagcgggacagcagauccaguuuucacaaugguuauccauggcucacaggacuacaggugauuuuuacuuucuuuaugccuucccguaguucccaaauuauuuucaaugaguauuucauuuguguacagggggaaaaaguuacuuaaaaaacggaaaaagaagaaaaucacuccuuugcagcagcuuaugaagcauuuuaacaacgaaagguggggaaauccccaagauagacaagcccuuucuuccccucugacuuuggcugauccaucugcugacaaacugcugacuguauucucaagagaucgaagaaauaaaacaggcucuagcaaggccuuuguugaagucuucucagcuuccuuagagcuguugcuucucccccucccuuccuucucuggaucccucccucuuuuggugcuuuuccugaggcugguggcuacauuuguuuggugcuugaagucauucuuucaucaauaauuuguaaagugauuuagagcuuucuaacagcaaccuacaguuugcucuaauaaacuaacgugguaaagagucggaauucaggcugcugggugacagaccagcaugccauuuuacucugcccuggucagcaugugguuuugguucugcuaaaaggacacuuccgacucuaccuccauuuguuuagcauuucuacucucagugaacuuuuaguaacugaaugcccaaaggaggagacuacaaaaagcaaauuauaguacaucaccuugauggaauauuaccuagcuguuaaaaaugacaauaacuagguugcagcaucaaaaaguauuaccaaagaaaaacaggaaacaaauuaauaucuauauauaguuacaacaauguaaaaauauacauuuguauuggaaggaaauagaggaagcagggaaaaagaaaauuuaauggcagaugagaaauuuuuuaaauucggcaauaaauauugaaauuucaucauauaccagacacuaugcaagacccuuguauuuuuuuaagguaguuuaauaauaaguuguaaagaaguauaaaguaggggugguggaauucauuugcaaagauguuauuaugggcagccuggcucuauccgaagggaacacugaaugugucauucuuuuccacacugaauuuauguaaaacguccugugcuggacuccaguuggucuguucaguccuuagugagcagauggggcuuuucccccuugccuugcaugucauucuuuuauccaugcacucaauagguacggagcccugcugucagccagguccuguucagcugcagcugauacauagggaccaggaugacaaggcucugcccucauggagcuuccaggcauugcgaaagacagacacuaaacuaaauaagugaauaaguucaucugcagugugauuucaaguagugacacccgcagugaagaaaaguaaaggaguguguggggcagagagugaagugaaaagcaguaacucauuuuaaggagagucagggaagacuccugagaaagcagggaaguaagggaccauggaaaggcuggggacauagcgggaacagcacgugcaaaggcacugaggcagaaccgaguuugacauggcugugggaagaaacguguucagagagggaagcaggggcugggacauguagggcugugugggccucagccuggggucuaagugagauggaggguuuuaaggggugggacagauuuacucauuuagcaugugaucugacuuauugagagaauggacugucagagaagaggguagcagagggcuguuagaggcuuucagccgucuggguggccuggacugggagggcgggcacaggaauggagagagucagggucacucugaaggcagaaugcacagggcaugcucuguagggugugaggaaaagccaggagacaaggacacauccuggguuugggacuaagugagcaggugaauagugaugucauuuucugggaggaagaaggaauagguuuuauuauuccugggugaacauuugccuagcuuugauuccagugugcuaaguuagucugggagcugcuccucacucccagaauucccuggcugucucuucagggcaggaaaaggauuucuagggauacaggagagaccaccagccuaggagcugggaaacgugagucugguccaccucugcuacaaaagagcaguguuuuuuuguuuuuguuuuuuucuuuuuuuuuuucuuuuacuuuaaguuccgggauucaugugcagaacugcaaguuauuuacauagguauacaugugccauggugguuugcugcacccgucaacccgucaucuagguuuuaagccccggaggcauuagauauuuguccuaaugcucucccuccccuugcccucuaccucucgacaggccccgguaugugauguuccccuuccuguguccauguguucucauucuucaauucccacuuaugagugagaacaugugguauuugguuuucuguucuuguguuaguuugcugagaaugaugguuuccagcuucaucuguguugcugcagaagacaugaacucauucuuuuuuauggcugcauaguauuccaugguguauaugugccacauuuucuuuuuccagucuaucacugaugggcauuuggguugguuccaagccuuugcucaaaauagcaguuuuauagagagauuauaacuuucccccucagaacgcgguuucuuguauaccugcccggcuugccuuucagagcuuugucaaccgcuuaaagccuaauucaggugaauaacggugucaucauuguuaccugcauuccugugcaugagcagucacagccuggguccucagaggaccauccccgaugugccagcuguguucauaauaaaccccacugacacguccccggccccucaccugguucugccgcacgcccaucaccugcccagcccugcgcacuaguaugcaaaacuacagcugagaaagagucccuucaagagugagaccaagggaugauguccuuaugaaucccugaguauccagaaaauuaaacuggcaugucauucucugaggauuucugccaacuaaggugauucgcuuguuuucaugaucacugcccuccuauguuagcaaaugcugcgcuuuauuuccaagagcuauuuccaucacccuuacccuagaguaagccagcuguauaaacaaaaagcugcaacaaggagcuagcuucacccuccaagcacugcuuagugcuuccagucaggaagcuucuuucucucucuuaaauaccaucucaaaaaucccaguaccugucaccuaaaggagacaucuuacacauugaguggagagguggaauggauguugaaaggacaauuuagggagcuaaucucagccaucagauguuuuucuugcuaacaggagccgaauucuauuauguuugugaaaggacucuauuaagacagguuucugucacucccagcacucuauuuaagcuucugaagucauucagauugcccauucaccagccagggaagaauuugugugccuucccccuuagcaaucaaggaaaaaagauuaaguggagccggagagcaauuuucuuuauaauuucucuucuugaaguaaagaaacucagaacccuugacccuaaacaccguggaacccauggaggcucaugauaucagugugugggguugucacuuggaggcaggaggcucuucacagccagcccaagaagcagcagaggcagccgcaagcagaauggaagcaaaaggggaggguuccuaucauuuggggccagaaccaaucaauaguuuccucacaucugccauuucaaggaagaauuuuuuucccuuguacguauaguugcuuuuucauaaaggauucauuauuuuugagccagguacaggaacuaagauccccccuugguuuccucugggucucuucacacuaaaguauugaaaagauuuagguggggagauccaauggcuggcuucagaacugcccuguccaguccuuccaacccauccuaaaucguggccacggaggugagcaguuaggccucuuugcaacacccugcaagucacuauugcaccaggguggcuuuaguccugaggugacuggcccacugugugacugcagugaaugagggguguccucaggaccuggccuacucugcugcacaguguaggcagaacuuggauuggggagcaauuuaagccagagugacucugggcuggagaaggcauuuuaaauucuaccuggaguagauaaagcguacgagguuuuugcuuuaggccuagggggcuggacgcugggguaaggggaacaugcuauacccucucuuggaccagcuaccauaggccucacccaggaccagagcugaggccgcacucaagggcuuccuagaagaggcccauauugggccccuuccuauucaagucuaguugcuugacaauauuuccuccaauuuuaaggugagaaaacucuccuuguauuagcaaaaaugaagacuguaauuuuuaaaugauguuauuuagauugaauaacuuuagaauacucuucccacaagaccacucggaggauauucagaucacuucugcugccucaggauucccacgugaagggugaaaaugaugccggagcugaauuuacagcucccagaagcacgcccaagaaagacugguggaugaugagauuucaucuguuuccccugcauuucuuagcacagugccugggccauagugagugcucaauagaugucugcagaagucaugcagguuugauauuguggaugauaacagucuuucuuucuaugaacuuuuuuuaauuauuauuauacuuuaaguuuuaggguacaugugcacaacaugcagguuuguuacauauguauacaugugccauguuggugugcugcacccauuaacucgucauuuaacauuagguauaucuccuaaugcucuccccccccgcugcccacaccacgcaacaggccccagugugugauguuccccuuccuguguccauguguucucauuguucaauucccaccuaugagugagaacaugugguguucgguuuuuuguccuugcuauaguuugcuaagaaugaugguuuccagcuucauccaugucccuacaaagaacaugaacucguccuuuuuuauggcugcauaguauuccaugguauauaugugccacauuuucuuaauccagucuuucauuguuggacauuuggguugguuccaagucuuugcuauugugaauagugccacaauaaacauacaugugcaugugucuuuauaacagcauguuuuauaauccuuuggguauauacccaguaaugggauggcugggucaaaugguauuucaguucuagaucccugaggaauugccacacugacuuccacaaugguugaacuaguuuacagucccaccaauagugugaaaguguuccuauuucuccacauccucuccagcaccuguuguuuccugacuuuuuaaugaucgcuauucuaacuggugugagaugguaucucauugugguuuugauuugcauuucucugauggccagugaugaugagcauuuuuucaugugucuguuggcugcauagaugucuucuuuugagaaguaucuguucauauccuuugcccacuuuuugaugggguuguuuuuuucuuguaaauuuguuugaguucauuguagauucuggguauuagcccuuugucagauaaguagauugcaaaaauuuucucccauuuuguagguugccuguucauucugaugguaguuucuuuugcugugcagaagcucuuuaguuuaauuagaucccauuugucaauuuuggcuuuuguugccauugcuuuugguguuuuagacacgaaguccuugcccaugccuaugcccugaaugguauugccuagguuuucuucuaggguuuuuaugguuuuaggucuaacauuuaagucuuuaauccaucucgcauuaauuuuuguauaagguguaagaaagggauccaguuucagcuuucuacauauggcuagccaguuuucccagcaccauuuauuaaauagggaauccuuuccccauugcuuguuuuucucagguuugucaaagaucagauaguuguagauaugcggcauuauuucugagggcucuguucugcuccauuggucuauaucucuguuuugguaccaauaccaugcuguuuugguuacuguagccuugcaguauaguuugaagucagguagggugauaccuccagcuuuguucuuuugguuuaggauugacuuggcaaugugggcucuuuuuugguuccauaugaacuuuaaaguaguuuuuuuccaauucugugaagaaagucauugguaacuugauggguauggcauugaaucuguaaauuaccuugggcaguauggccauuuucaugauauugauucuuccuacccaugaguguggaauguucuuccauuuguuuguauccucuuuuauuucuuugagcagugguuuguaguucuccuugaagagguccuucacgucccuuguaaguuggauuccuagguauuuuauucucuuugaagcaauugugaaugggaguucacucaugauuuggcucucuguuugucuguuauuggugcauaagaauacuugugauuuuugcacauugauuuuguauccugagacuuugcugaaguugccuaucagcuuaaggagauuuugggcugagacgaugggauuuucuagauauacaaucaugucaucugcaaacagggacaauuugacuuccucuuuuccuaauugaauacacuuuauuuccuucuccugccugauugcccuggccagaacuuccaacacuguguugaauaggaguggugggagagggcaucccugucuugugccaguuuucaaagggaaugcuuccaguuuuugcccauucaguaugaaauuggcuguggguucgucauacauaacucuuauuaucuugagauacgucccaucaauaccuaauuuauugagaguuuuuagcaugaaguguuguugaauuuugucaaaggccuuuucugcaucuauugagauaaucgugugguuuuugucuuugguucuguuuauaugcuggauuacguuuaucgauuugcguauguugaagcagccuugcaucccagggaugaagcccacuugaucaugguggauaagcuuuuugaugugcugcuggauuugguuugccaguauauuauugaggauuuuugcauugauguucaugagggauauuggucuaaaauucucuuuuuuuguugugucucugccaggcuuugguaucaggaugaugcuggccucauaaaaugaguuagggaggauucccccuuuuucuauugauuggaauaguuucaacaggaaugguaccagcuccuccuuguaugucugguagaauucggcugugaauccaucugguccuggacuuuuuuugguugguaagcuauuaauuauugccucaauuucagagccuguuauuggucuauucagagauucaacuucuuccugguuuagucuugggaggguguaugugucgaggaauuuauccauugcuucuagauuuucuaguuuauuugcauagagguguuuauaguauucucugaugguaguuuguauuucugugggaucaguggugauauccccuuuaucauuuuuuauugugucuauuugauucuucucucuuuucuucuuuauuagucuugcuagcagucucucaauuuuguugaucuuuucaaaaaaccagcuccuggguucauugauuuuuugaaggguuuuuugugucucuauuuccuugaguucugcucugaucuuaguuauuucuugccuucuagcuuuugaauguguuugcucuugcuucucuaguucuuuuaauugugauguuagggugucaauuuuagaucuuuccugcuuucucuugugggcauuuagugcuauaaauuucccucuacacacugcuuugaaugcgucccagagauucugguauguugugucuuuguucucguugguuucaaagaacaucuuuauuucugccuucauuucguuauguccccaguagucauucaggagcagguuguucaguuuccauguaguugagcgguuuugagugaguuucuuaauccugaguucuaguuugauugcacuguggucugagaaacaguuuguuauaauuucuguucuuuuacauuugcugaggagugcuuuacuuccaaguauguggucaauuuuggaauaggugugguguggugcugaaaaaaauguauauucuguugauuugggguggugaguucuguagaugucuauuagguccgcuuggugcagagcugaguucaguuccuggauaugcuuguuaacuuccugucucguugaucugucuaauguugaccgugggguguuaaagucucccauuauuauugugugggagucuaagucucuuuguaggucucuaaggacuugcuuuaugaaucugggugcuccuguauugggugcauauauauuuaggauaguuagcucuucuuguugaauugaucccuuuaccauuauguaauggccuucuuugucucuuuugaucuuguugguuuaaagucuguuuuauccaagacuaggauugcaaccucugccuuuuuuuauuuuccaugugcuugguagaucuuccuucaucccuuuauuuugagccuaugugugucucugcacgugagaugguuuccugaauacagcacacugaugggucuugacuuuuuauccaauuugccagucugugucuuuuaauuggagcauuuaguccauuuacauuuaagguuaauauuguuaugugugaauuugauccugucauuaugauguuagcugguuauugugcucguuaguugaugccguuucuuccuagccucgauggucuuuacaauuuggcaugauuuugcaguggcuaguacugguuguuccuuugcauguuuagugcuuccuucaggagcucuuuuagggcaggccugguggugacaaaaucucucagcauuugcuugucuguaaaggauuuuauuucuccuucacuuaugaagcuuaguuuggcuggauaugaaauucuggguugaaaauucuuuucuuuaagaauguugaauauuggcccccacucucuucuggcuuguagaguuucugccgagagauccgcuguuagucugaugggcuucccuuuguggguaacccgaccuuucucucuggcugcccuuaacauuuuuuccuucauuucaacuuuggugaaucugacaauuacgugucuuggaguugcucuucucgaggaguaucuuugugacauucucuguauuuccugaauuugaauguuggccucccuugcuagauuggagaaguucuccuggauaauauccugcggaguguuuuccaacuugguuccauucuccccaucacuuucaaguacaccaaucagacauagauuuggucuuuucacauagucccauauuucuuggaggccuuguucauuuauuuuuauucuuuuuucucuaaacuucucuucucgcuucauuucguucauuugaucuuccaucacugauacccuuucuuccauuugaucgaaucggcuaccgaggcuugugcauucaucacauaguucucgugccgugguuuucagguccuuuaaggacuucccugcauugguuauuccaguuagccauucaucuaauuuuuuuucaagguuuuuagcuuauuugcaauggguucaaacuuccuccuuuagcucggaguaguuugaucgucugaagccuucuucucucaacucgucaaagucauucuccauucagcuuuguuccauugcuggugaggagcugcguuccuuuggaggaggagaggugcucugauuuuuagaguuuccaguuuugcugcucuguuuuuuccccaucuuugugguuuuaucuacccuuggucuuugaugauggugacguacagaugggguuuugguguggauguccuuucuguucauuaguuuuccuucuaacagucaggacccucagcuauaggucuguuggaguuugcuggagguccacuccagaccguguuugccuggguaucagcaguggaggcugcagaacagcggauacuggugaacagcaaauguugcugccugaucguuccucuggaaguuuugucucagaggaguacccggccgugugaggugucagucugccccuacugggggaugccucccaguuaggcuacucaggggucagggacccacuugaggaggcagucugccuguucucagaucuccagcugcgugcugggagaaccacugcucucuucaaagcugucagacagggacauuuaagucugcagagguuucugcugccuuuuguuuggcuaugcaugcccccagagguagagucuacagaggcaggcagaccuccuugagcugcagugggcuccacccaguucgagcuuccuggccgcuuuguuuaccuacucacaccuugucaauggcaggugccccuccccuagccucgcugccaccuugcaguuugaucucagacugcugugcuagcaaugagcgaggcuccgugggcguaggacccuccgagccaggcgcgggauauaaucuccuggugugcuguuugcuaagaccacuggaaaagcacaguauuagggugggagugacccgauuuuccaggugccaucugucaccccuuucuuugacuaggaaagggaauucccugaccccuugugcuucccgggugaggcgauaccuuccgcugcuucggcucaugcucggugcgcugcacccacuguucugcacccacuguccgacacugcccagugagaugaacccgguaccucaguuggaaaugcagaaaucacccgucuucugcaucacucaugcugggagcugcagacuggagcuguuccuauucggccaucuuggcuccaccccccuucuaugaauuucuuaggcuguuuaaaauuuaucucaaccucagcugccaaaguaauaacuagcccuuuuuguaucuuuuggcaaaccauauauucacugcuuuggccugggguucccuuucccguccaucaaaacauuggcuaaguacucacucugcaccacacacugggcugggcacugugaagucaugcucagaacugacuuugauaauaggauuuuugaaaacuagauugaaggaaaauagauaggcaaaagcuaaugggcuuaaaaaauauacugcuuaaugguuaaaaaucuuaaucuguuuauguuaaacaauguuagcagaggaauaugaaauuauuucuauaauguauaaaaaucgauaauagaugcuggugugaaaauacauguaaugacgaauguauugaauuuguaaccugugaacaugugggauaugaugugugugcgucacuauuuuuauauccuuguauguuggucaagauauuuaaaaggugucagaaaggccaaaucaggggugcugucaccaagcccaccaaguugcugccaacccucccaagcuucagagguaauacucuggcucuuuaucccaccuccuuuuuuucuccccaccagaaaugaggauccuuauagauucagguuagucaauaccauauuucccuuccccaucccguuguuuuguguuagacuuuguauuagagaauuuguauuucaucuguuuugcaaaacaaauauuaacaauaaguuauuauuguacucuucuggcauaguaacauccuguuaguuuacuuuacacauagcaaauccagccugacauucaucuuuaaugaucucaggauaaaugguuuuaagguuaaacagccacagagacaacugucacacguugucagcuggaacagaugaaagagaaaaauguggcaucugaaaagcaacuugcaaaaugaucuaaauauuuuacuuuauuuucagaaaacccucaccagaucugcccccucaccacuaauccuggagcagccugaugacuuauggggaauccauugcuuagcuuugauguagggagggagagaugaacgacugccucccaaagcguggcugcugagcaggauauuaaugggcaaggcggcuaaugcguuugcauuguucugcagaaguuuugcacugcuuuggggaaucauuuauccuuagcaguugcaagguggccuguuuucaaguaaaccuagaguaaaaaucugguuaucuauugccauguaacaaacugccucaaaacuuugugacauaaagcacugauuuuauugugcucacguguccuugucuccauucugugaugcuggggccuugucugggaagacucgaagacugggagugacugcuuggcuaggcugggaugaggcaucuuuacuuacacaucuggcacuggacgcuggcuggcugcugggacuugcuggggugauggcuggagaacauuucaccucuccaagcggccuggccuuccuuacugcagugucuucugaauuguuagcuuccuuauaugguagcaagugugcaagucagcagguggaagcuccgcuaucuuugucaccuagccucagaagucacauagcaucauuuccaccgcccucuacuagcgggagcagucauaaaagcccacccauuuucaaggcaagaggucauagccugcgccucucaaagggaggauugucaaagccgcacuggaagaucauguaaguuggaugauagcauugcugcuguauuugagagauugugcugugcucuauguagagguuucuguaggaaauaaacaaguugaguucucuggugaaaacacaucugaaaacauguuaauaggaauauagcuaauccuuagcauuucuuauaguagcuaaggucaguguaugcuaggccugguaccugagcagcagucuugaugcuaaguuaacaacagguagccaacaggaguguuuucuagcuauuuggaaauugaaauucaaccaaaaaagcuacugccacucugaaucaguuacaucaugauaccuuagaucuaggcuaccuuuuuuccugaauaauagaagguuacauugauuagaaauuauggggaaaguagauuccuucauauaagaauugguuaaaguuugacucuguucucuguuaaaguaagcagcuuuuuaaauaauugaguucuuuggaggaguuuuuauauuuuauauauuuuuuaccuauuuagccaugauaaauagaaucagauaagagaccgagugugaauauucagcacgaccuucaaccagguguauauauuucucucuauguucuaaaggacucagcaauguguagugccuaugaguucucauuugaaaaaggaggaauccuauauggaaugccauguaacggccaggugcaguggcucauaccuauaaucccagcccuuuggaggccuaggcaggaggauugcuucaggccgggaguuugagaucagccuggcaacauagugagaaccccccacaccucuacaaaaaaaaaaaaaauuagccaaacuugcuggcacgcaccuguaguccuggccauuggggaggcuaaggugugaggaucguuugagcccuggaagaguucgaggccgcagugagcuaugcucacacuauugcacuacagccugggugauagagcaagaccccaucucuaaaagaaaaaaacagauauauauaaaugccauguaagcuuuuacacuuguauuucuugucucaauucugguuuuuucuugagcaauuucuucuuuucauucucaugaaaguuaaggugaugacgcugugcuuacccacaaacuguguauccacguagccuucacugccauuuguccugagccuuuucaagaagcauaaaucccagaaugaucgaaacaucucuuagaucccagagugacuuaagauccaugcuaggaauuaauccugcuuccuaggaaguuacacaacagcagcauuuguggcagugccacagcaagccagggacuggcccacgggcgguacgcugucauucccagugcuuucucugccuuccagagaaacaggaauuugccacaugucugugacucauuugcuggagcuguuaaguggugaugguguuuaaaaucucagggaaguaaagccaccauuuacugaacacuuccugugugccgugcacucaguuguaaccacauuauuuuacuuggucuugacgagaagccuuuaaaggcacuuuuauuaucccaauuuuacagaugaggaaauugaaguucugggaggaugaguaacuuguagaaggucacaccauauauaaguaauggacccagccucuccaacuacucucagcugauuauagagauuaaauuagaagcaguucuuccuuucuuggaaaaguaaaccuaauggggaacucagaagccauaaaggaaaagagugauuaauuuagccacguaaacauuuaaggcuucugcucaacaaaccgcaccaaaaaauuggaucaggaauguauaacaaacuaguggguggggaaggagacugccaggcugugauaaaaggccaauuuuuuaaaacauaacaaaaaacucuucaacagucggugagcacgagacauacagacugcugugaacaugggacaggaugcucagccucacucaugauuagagaaauacaaauuauuugcugcaaaugacauuuucagcuguagguuugacaaagauuuuagaaguggauaauguucagugcugucaagcgugcaggacaacagguacccuccaucuacauugucuguggacaugcaaaucgguacaacucuauauuaaaacugaaaauacacacucuuugacucagcauuuauuuauuccacaaauauuuuaauauagguauucaaagauacggguacugcaauauucauugcaaugccagaaacuucaucaauagaagacugauuaaauaaauuguagaauguuuguacuagcaaacacuaguagccauuauuauuuuuuauuugaaucuuguuuuauauuuuagcacuuuauacagcuugucucauuaaguaucacccagcuaagauuuuuuuuauagggcauggcacauauauuuuguuuuguuuccuuauauuuuugcucuggaucucauguguagccaguagagauaugaaauuaaauauuccacaauagguauggccccucaaguagccauuauaaaguauucuauacaccauuaaguaaagaaaacaaagauguauugaaagaacuaagguauaaaauauucuauaaauuauuccauuuuuuguuuguaugaacauguaaaccuuugugcauaggaaauaucuauaaagauagaaaggaaaucauuaacaauuaucuacugaggacuggaauugaggguauuaucuacuuugcaguucauaugcauacaauuuaaauuuuuuacuaugaacauacaucauuuuuauaauaaaaugcucauuucuaaaaauacaauguggaagacauucauuuauuagggcccuguuugcaagaagcagcauaaguaaaucaucccauguugacagauaaaacuuauccaaccauggagaacagauaucagugacuuaauaagcaguaaagauaauaaaaguuuuagcaaaaccagcuagaaccucuugggagugaguuucucuagcuaggugaguucuucagccuagcagaaauaggagaaaauaguuuuuuuggaaagauacuuucugaagucuuauccaauuccauguauacguuaauaccuuuuuuuuuucuauuuacaaagugacacauugauugucaaaauuuggaaaauaccgguaagcucacaugggcuuuauuuuuaacaggcuacaaauuuaaauacagauaacaauugcaagauuaugucuaagcaaagagagcaaauugauggccgaacugaugauugauuagaaugacuuuugucuuuuuaaaauugaguuauauaagaggugaaggaaacagaccgauggcuggagaauuugacaacguauaagagaaucugagaauuccuuugaaaaacgcucagauuuccagccaagauagagucacauccaccauugaagggaaucuuaagccaucauugcauaaaacuuuggagaugaaagacuucuaacuccuucauuuuacaaagaaaaaauugggcucuaauuuuuucauuaauucaauuuaaaaauaaugaguauccaaugcaauacucuuuccacuuccugacccugucugaugcaagaagaauauuuuucuaggacauuccucauuauugacuugagaaauaaguauggcuuucaacaaacaaaggcaaaaucaugagauauaacuaaaauugaugauucaccuuugaaguaguuucaggucauuguuuuaauaccuuguucacacagaaccuguuuugcauucauuugcagacuucaaauaucucauuucaggguaaaguuuagcugaguggcauuagagcccugugaacucuccuugguugggcaugaagugagaggucugaaaagaauaucaagcuaaauccucaacuuaaaagcaacacuuguuuuuuuaauuuaaaaaaaaauccaauauuauuucaauuuucuucgcagcagauugugucaugcucuuuaguuagaacucaauguagaaaaugcagcauggguugaaguagacagcagaagugaaagccaaauaaugaugucugauucucgcucgcugugauaugggaggacaagggaagaaaagauaaagcaccacagccagcagcacugauuuaggaaauaucuuacucacaagguuuauuagacucuucuugcacugcuauaaagaaauaccugagacuaaauaauuuauaaagacagagguuuaguuggcuguuaguucugcaggcuguacaggaaguaucaugcuggcauaugcucagcuucuagggaggccucgggaagcucacaaucaugguggaaggccgaggggcugcaggcacgucacauggcgaaagcaggagcaagugagagagaguagggggagggaggugccacacgcaccagaauucaugagaacucacugcgccaugacggauccaccccuaggauccaaacaccucccaccaggccccaccuccagcauuggggauuauaacucagcaugagauuugggcagggacaaguauccaaaccauaucacaaggaaagcuuccggagcugaggcaacccuucuaacaugugaggucuugccaaguuucaccagugguccuggagguuaggugaguuauuaggaucaagaucuucaagcaaugucccccauauaaauggaaucugggcaguucuccagcaggcucaccaggccucauaucaccucugccaggcuccuggaccuggcccacaggguguggguccggcugauuaguguaucagucaggaucgcccaggcuuguguugcaguaacaaaucaccugagaaucucugugaacucacccaacagaaguguguuucucacucuggccauguguggguggggugcccucugcaucauucucacacacagagcuggucugugggggaucuucucucucgguuguuccuggggcugcugggcugcagggaaccaagccacaccaccugcguguccugccaacugcuaaggggcgggcacaggcaauucccccaugugccuggaagcagagggaaggcacugugcugugcagguaacucagacugcugggaagggcuguauaucaaaguagacuacaguucacagggucuuugggauccugguagggccuuuuacaagcccaccccauagcaacagcccccuguagaguggcauugaaugugauaggguuacuucuccacagggagccugcuaccaggaaucauucagacuucucaagcccuucucuuguucucucucauuaacuucuuuaauggucuccuuccucauuccuuccccuuuaagucuacuucugcuaagggaugcuugauuccucuuugcacaguucagcuuugguuacaucauuuccucacacagaaauguuuggagguuucccuuucucuacaguuuugcaacucaaacuuguccauagaccagcaguaucaacaucagcuggggucuugcuaaaaugcagccucucaggccccaccccagaccugcagaaucagggucuggaucuuaacaggaucacaggagauuuuuuuuuuuuuuugagguggcgucucacucugucguccaggcuggagugcaguggcgcgaucucggcucacugcaaccuccgccugcuggguucaagcaauucuccugccucagccucccaaguaacugggacuacaggcacacaccaccaugccuggcuaaguuuuuguauuuuuaguagagaugagguuucaccaugcuggccaggcuggucgagauuucauacauuaaaguuugaaaagcacuuaugccuaguacugggucucaaauuuggcagcacaguugaauuaucuggaaggcuucaaaaacugccaauucccaguuuccaggucuggacuggggccuugcaccgagaucuuuuaaagcucucaggugacuaucaugggugagaauuugagaacucuggaguuuaggaacucaggggacacucccaaccaccuauaguguggcucccaaaccuucccugugccaucuuucacucuaacuauaucgacugaccuccaguccccgaacgcucuaugcuuuuauauaauguguuuuagacuauuagcagaagucaccaggcauuguacaugcugccuucucaugacuggagagggccuaggaugacugcaucuaaauuuuucauugaaaaugccacggcuacaagucacggagacauaaauacaugcauucacucaauuguacauuuaguuuuccuuauuaguaaaauguaaggcuugauucauccagaugacagcuuacugugguacuauguaucuuuuuuuguuuuagucuuauugaacgucaaaaauaugauggggaauuggaagaauaugcuuguuucauugaguuaacuuugggaguuauaaacugaggagcuuuuaaaaauauauauaucucaguagcaguggcaauuucuuuuuuuuuuuugagaugaagucuugcgcugucacccaggcuggagugcaauggcacagucucagcucacugcgaccuccaccucccggguucuccugccucagccucccaaguagcugggaauacaggugcgcaccaccauguccagcugauuuuuguauuuuuaguagagacgggguuucaccauguuggccaggcuggucucgaacuccggacuuugugaugcacccgccucggccucccaaagugcugggauuacaggcguggccacaacugcuuuucauuacucucacugcuucaccuccaccugugaucagugacacacguuugagagacaccuggcuuuggagacagaaaucaggauccuugaccucuuuauuaccuuuccuaauggaaugagguugcacacgugggccgcgcucugcugcacaccagcaguucagagaguccugucguuugggggagcacuccucugucacuacagcaccuauuguuguaaaaccuuacccacuauuuuuuccaaacgaccucagauaaauacuuuacuugauguuuuuauucgcgcaagguguuaauuucuaacaagacuuuuaugagcacagcaagcagcaguugcuuuuucaugugaacauuaaauaagacucaagguaugaaaagccugcugcaaaggguccagaaggaucuaugggauuuggugggcugcagcagacaaauggccugccagucugugacaagugugcagucaccgugggcgccagccuugggaggcacaggauccgcuaagucgucgggauuaccgggcucugccccuagcagcccccggagaguuagggccccgugugcacaucucugcaaaggcuguuggucaaacacaugaaaagccgguguuaguggugucugccugagccaccguaaaucaccucucccucugggcugccacugcaccuugucugugcacagucuggaggcguggggcgugugucauugggggaagcaugcaguucaggguccuguuauguccauaugaaugugaacgugaaagcauuuccuggcgccucugugcugggcuauuauugggaccaaggacucacacacaacagugacaucauccaggcgcagaauagauuguacugaaacgucagaagccagauaccagguucucucucacaaacaguuguuuuaagugccaauaucaaggcuugacaguguuagugcuggcaggacuuuuguuuuucauuauccccaucuucaucccuaaacgaacaguagcaaugcagagaaauagucauuagaaugaacuaaauuaaaaucaggaagcaguuaacuuuaugucgacucuaagauaauguuaguaaauaaaaaggcuaauuggaauucucaguauucuaauaagaacuuuuuauuaguagguuauuugugcuuuaaugggcugcucguggcaugugguugagucgugaugcuuuucauuacucauuuuuauuaacauauacgguaaauauuaaaauagaucucggcagcaauaacauagguagaaaaugauggguggcuugucagauacaaaauacagcagcauacuuacagauguguucucaugauuuucaaauuuauguuggcuauuuuuuaacuuugucaagccuuucucugacuucugcuuuauuguacugcuguucuugacauuccucccuuucccaaccagauggaaacuuugguguagcuuauagaaggugucccaaaagcuaggacuuugacagccaaugauauguaucuuuuuuaaauauuucauucagaguaagcaaaugagcaacagcaagggaaaaacacauuuuaguauuuuucucccuguuagacauugcuuggugcuuuuuaacuaggauaccagaaagcgaaguauuucaaaguguuccuuuagcaaacuauauaugcucaaccagauuucuaguagcauuuuucuucaguguuuaaaaaagugaacuuuuaacuuuuacuuucuauucuucuuauccuucuguaagugauauguguacuuuuggcccuguuuagaacagauaaaauauaacuuuaauuuuucuuggauaauuaaaauguuuuucuaauggguuguaauccauaauguuucuagaauuugguggaaagucaauucacuaauuuaauggauuaguguaggucaguucuuacuguaaacuuuaaaagguauaagagcuccaggcuagauuggaacuugucccuaagucauaguuggggaguuuuuguuuuauuuuguaaaaacacucaucucacguuuccuaaaaaugaaauaaggcagcaaaauaauacucauccaaggauucugguuacuuggguuuuauagcuaacuaggauuuuauuuugguuuuccuuucccuuucaugcccccaaacauuuaggacuaagagaaugaggagggaggcccaggcuggagggcuccuggacagggucuuggggggacuuaucuuuccuguacccccugggaugucacuguguucacccuuggggacaccaagaaauuucauaugaagggacuuugguggaacucccacaggcccugcuuugguuuuguggauaucggcuuuucaguguuacgggauccuucugcuucaaaguaaaacuaggucugaaauuuucaagcucaaaaacuuccauagguaaaacuuuuaauggaaacaaauuacuuuuuuuaaaauugaaacauuugucaaaagcaaauauagcugccaagccuguggauuauacauuuugguuccaaagagugaugaaccucugguagccacagggaugggagauuuucacacuguugugauucugaagucaccaacuuaacaacuggaaccaagcacaauccacgcuguucagugccuucugacugucugcuuacucuccgcugggugcugaaaagcccagcccaccuguugcuuaagacccaguacauuauuuuagaaaauaagguuugugggucccuaguggucucugugggcuaacuagugggucugcuggcagcuugguaauuuuagaggaauaugaaauauaagaucaauugugauuuuugcagcuaucccauuguauucuuaguaacacuuuauagcagauauacauuuuaucccacaacucugggugugagaaauguugccaccuucuauuugucuaaauuugauuucaucuacuucacacuaccucuuccucccucuacccacacacagaccagauuuggggaaggccuugggaacauuugggaaaacgcccucucaaccuaccaucuuggccugagagucucuucaaggcagacagcuccucugcuuccgugcaaagguggacacaggggcuuuucacuagggccccagaagcuccagcucuugcuguucaguccguccuguaucccagagcucucccacagaggcccugccacccuuggaaaaggcugugcaggccuggguuccuggcuucuccuucucuuaggauccuccaaccucuugccuucccggcuugugccuccuaaacugucccgaucuagcuguuucuccucccucucugagcuccuuccucccucuuccuccuuccucugccgccuccucccuuuagugagcuuuagaaacauaaugcuggguucuccuuccuacagcaguggagauggggucagaugccaacgcuggucagcuuaguuuucaugaugauggucuuaguccaugcuggcugcuguaacaaaccaccauagacugggacaacagaaacuuauuccucacaguucuggaagcugggaaggccaaggucaaggcaccagcagauuuggugucugugagggcccaccucuuggcucauagaugguugucuucuugcugcaucuuuacaugucacaggggcaagggagcucuccagggccccuuuauaaagacaccaaucccuucauaagggcucugcccuccugaccuaaucacuucccaaaggccccaccuccucagaccaucaucuuggggguuaggauuuuaacaugaauuuggagggaacauaaacacucacuucagaguaaugauaaaguauauugcccauaugcuacaaggacugucuuggucacuuuucagcugacauuuaaguaaaagaguauaauucucugcaacuauguuuugucucauucacgugucaauauauacauaugcuagauuucccuuugcaacaaugguuggaucaguucaaagugguucauugacguccaaaaaaagugaaaauaaugcguaaauccuagaacucaagacauacgcaagagguaauaauuaagcuucuacugugccuguggauugugaaucuacaagagucaugauuuuauaaaagcagccccaaaaggaaaauacaaauaggaaauauaauaaggaacaucugaagauucgaacuuauuugcacugcagaggcacugaacucuggccuuugguaguugucuguuaacggaauucuguuaaauaguuuccucauuuguaaaugcagaugauaauagaacuugcuucagggugguugugaggcauaaaugagguaauacauguggcaugcuuguguacauguugaugugcugucugggcugucauuauuauaguucucaaaauuauuauuauuaauauaaaacacagccaucucucuaagccuaucagguuuuuccagaaugaauuaaaauaacagugcuuuguuacggaaaugcuacauuuggucauucaagauggagaaauggccaaaauuguggcaguaccaugaauaguuguaaaaguugguccaaguuacaaucugaccaaauaagccauaaaguaaauagaaaauauaguuugaaucaugaaauugccguuuuuuaauagucccagguagcgaaauauuagaaaauccccauguuucuucucgacuucaugcucagaggaaaagcagagugagcugcuggcaaaauuccucugcuaaguggcagcguggaggccaugcgaaaugaguugcaugcgccaugaagagcgauugcggugugcugaagccacagaucauggcgcuucacacagguggguugagagucugaagaggcacucaguaacugccaguaacugguuuccugugccugccuccuuaccucgauucacccugaauuugcugugcagccagcccccucgauggcagccuugacaccuggccgcuaaagagggcacagugcuuccgcauucuccccacugaaacccaggggccucgccuguggcucacugcccuuuuggucccaucauauucccaacguuauuuccuuuuguuugccuauuugcauagucucugcucgagccauuuggaauguucccauuucuugaacaccuccaugcacccaucccucagcucgcgccccugugccuccccauucuccacuuuuugagcuuaugcccaucuuuccuugcccaucuccagugcaaccgcacacacaaagccaccccuucuuuuccaguugccugcgcucgcugccuccucugaaccucaaucucacuuugccauuuucuccucauuggugaucauuaucuuaguccucuguguccagcagugacguauuuguuuuacuccaucuguuagagaagcaguccccaacguuuuuggcagcagggaccaguuuuguggaagaccauuuuuccauggaugggguggguggggaugguuucaggaugaaacugcuccaccucagaucaucaggcaucagauucucauaaggagcacacgagcuagaucccucgccugcgcaguugacaauaggguucucacuccuaugagaaucuaauacugccgcugaugugacaacaggcagaacucaggugguuaugcucacucacccaacccucacuuccugccacgcagccugcuuccuagccggacacaaacggguacugguccacagcccgggggugggggacuccuguguuagacgacagcucucugagggcaggggcugagucuugaucaccaucaugauucucccacauaguaugcucguggucaguaguucuaaucuuaaaguuggccagugcuguccccauuacucuagggccccuucccauuccauggcagcauugcugacuucuuauggacuggaggcucacagggccuggcugguaggugcuacuuacccugccugggaguccugacaguagcccagggagguucuuuuaaacucguggcuacaucgacuguuggguuuccuacaaggaagaccauauuuagcuuuugaaggaggccuucagcugcuaccccaagcaagccagcugcgaaucacuggccauguuuuaacuuucuguguuguugcuccuuguguauggacugagaaaugcauucagcaacuccuccuucuguuaauccuauugcuacaucuccagccuugagauuugccaaauauugcugaaugaaacacucagaacagcauucagacaaggcuuugugagacuuugauguggucugagaaauuucgagcuuuccauccguugauggggcuccuguuguuuccaugucacagucagcggagcugugauagagucugagcagcagcagcucagcuuucuccagcgcgccuugaugaaccaaaauguuuuguuuuuguuuuagcagaggcacgaucagcacagaaccuguaagcacuugcuugcucucacucacuucuauucuuccauaugugcuuuuccugcauucuuuuauuagagaccuguuggauaucaucaucuuguugccauauuugccgaaaggaaugaaugugucugugcaguuuccuguugaucccugucuggaguuagcagcauggaccuaccccaagccgagcuggcaaugaggguuucacucauaaaaacgacuccucguuaccaguugaggaccaaccauuauuccaauauuacauggauuugaaaaacagauucagcaccugagaauaaagugguaccagggccuuucacaagccgcuaagcaucugaaaaccuuggugcuaguucaggcuuccccacuuaggaacacguggccuaaggggaggcguagacgguugcaacuggaucagagauauuguagauaauuccuuacagcccaggcccacagacuugcucacagucacccagaauacucuggaggaaagccaaaacuagagcucaagucuguaugggucuaguuuaggacuccgggcagcaucaggcucccucucauuucacauuuuccaacacuaguauccuugugaguggagcaugaauaauaccuuuucugccuccccaggaggggaagggcaaaucugagcacacaugccagucuacuuugaaaauccugaagcccuacacugccaguguggagcagccacguccuuccguccacguguccauccccggcgcacaucucacagagccccaucuugucccuggguagccucggggccccagacaggaugaaucucaggcccugccaucggggccucacaguccaaaacagaaggccggaguugaacaagcagcggggugccgccgugggagcccggggaagaaaggcuuggcuacuaauuccuuauggcuguggcaaauaucauggaaucuuagggacugccucacagggaaggugccauuggaauugaaccuuggagaauaagcaagaauucccccagguggaacaggucagagggggcuacuguggguaggaugaaaacaugugggccucaaagucauggugugguuguagaacagugaacugucugggugguagaagggccggguagcagagcuuuguacaacauugcccuggagguaaugaucaguuauuguagaaaauagccccuuaauuuugugagaaauuuucauuccuuagauuugcccgggagaugggauuuccuuauggguugaaccuaaaucuugcauuggauggauuuuucuuuuuucuuuguuuuagcaucauuucacucucuuaucaggaugugagauccaaggggaccugucacuggccagcucacacauuacucaggaaguccuacaugaucagugagcuccaguuuguccugugguccccuaggcugugggaguccacagcuauggccccaggcagguguccugaagggaaucaggugaaaagggggcucagucauggaaacuacuucaguuucauccagcagagaucuguaaguggcaaccaaguguaaagccucuggucaaaccacucaaagcaggcuuccugcugaagcugagcucaugacaauccccccaaauccuucuacacccccacacacccuucccucacuuuaugguuuuuagagacaggguuuugcucuuuugcccaggcuggaguacaguggcacuaucauagcucacuguagcugugaccuccugggcucaagccauccucccaccucagccuccugaguagcugggacuacaggcauacaccaccacacccagcuaauuuuuaaauuauuuuuuguagagacgggaccucacuauguugcccaggcuggucuugaaauccuagccucaagugaucauccugccucagcuucccaaaucagagacccuuucccuucuuaaagaugaauauauuaauuaacucuaaagccaggguugcuggcccucaucugucuuaaugggacacuuccucccuugucgugaacaacaguaaacaggucuugaagaagcuccaugucugaaacaaggaguuccacggucauuuaugguugcuucgcuaauuagaagucuuuuuuaaugaggagaaacauuuucauuucucgaagggcuuuguugcuuugggugggccagaaggugugguuggugggagguguggaaugagacugaaggugggguugaggccauagaugcugagacuggaccuuacccucaggacaguggaggccuggcaggugggcccgagcagaggagggcagugccucuccuuggcaccuuuuccaucccagcugcaccugcccucacagcugguugaaggaggacagagaauguggucucauuaacucacuuggugauggcuuugugguucuuacugcaaacuacagguaaaucugccaguuggaggaacucugauguacacagugagcugcuugaagaaaauuuucuuugcacucaccuuuggaaaguauucuuuccuuuaguguaagguuccuggauuuaaaaaaaaaaugguuugcacaucuuuaaagccuaccucacuguuuuagaaggaaaguuucuuaagaucggaagacaaugacauugagaccaagaagaaaauuaugguccccuguugauguuccaagagggugugugugugugugugugugugugugcgcaugcacgugcauguuggggggggugggguugugugugugugugugcgcgcgcgcgugugugugugugagauucugauguaguggagcugaaggaaagauacugagcagaggcccgggggcauucccagcccuauucuccaccuuccacccuuguuagccaaguggguuuucaagcucuuggugagugcucauauuaaccugcacuucuuagcuugcccaggaugagggggaucuccugugaaacuaaucguucuccugggcucuugaggcuacuugugcugccacgcauaucauuucuaugggccauuuucauuuaaaacccgugguggcugcuggccaacgcagacccuugucuccugagaugagugguugggccugcccagcagcccucccugcagccaccuucugaugguccuggagagcaaguaggaaggccuuuggcuuucagagccucucagucuaaugcauucccauuuugcaccaccagcaaccucauaugugauagagacagaugagcgccgcuguacaacgcagcaugguccaagccacaucccucccuuggucaggagauucacugugggucacugacugugaugagacuacuuagcaucccaggaaagucagucucauugcuaaaugggacccuuuguguaguaaauguuggagucaauuagaaguucuacucaggccaagauagagucacaaggacuggauuuaccuucccaucuuaaacaacuaaaaacuaggcaaaauaagugcaacaaggguuuucagacauuggacauagaguaguccaggacgguggucgcugagagggacagcgauggaggugagcccugcggcuucccccgcucacuuccccggggggcuuccuaggccacagcacggggaggggaccccacacaaagcccaggagucucucaauucacaagacagagauaggaaucugggacgcggaagcaucuguaauucucaaggcagagugccagacaggcaagagcugcccagagagagggcucuggauuuccggagaggauccccugguccucggcugggcacugaucgauauaugggugagcauaggggcucacguggcaacugcggaaaaaacuccagaaaggacaggcagaaaaaucucugagcucaugugcaucagggaauaguuugugcucccagcagccgcgggaggaugaacuuuggguaugauacucagaaggguauuacuucaaugguggcgaacaaacagcccuggacugaaagcugcuaacagcuuaaaaagcaagucuacaagucuucuuggagaagugauugauucuaggacugggccaggaaauauauaagccaauaguuaaugcaguaauaauauaauacaaauaucucauaaugccagaaaauaagaaagugcuccaaaaaggccacaauauuggggaaugggggaaugucaaaggggaacaggagccaacugaaagaguuccaacagccagacuggaacacguaagaagcaaaauaaacaauagagugcuggauuauaacacaaaguauaaaauaaaaauccauccgauuauaccaauauaaaugaaugcgggauggaugaaugaaugaaugaaugaaugaaugaagagagaaaucucccaugcacaggaauuccaaguaauucauacucuucccccaacaagguggaacauaacuccccacgcuuuagugugggcuguacauaaaggcuuccuuccagagagaacggguuggaaagggaggaaagaaaguaacuucacaguggaggaagcugacgaccacugcuuccaccacgugaccaaggccaacgucaagagugaagccaggcugacaguauguccccuagcucuggugugaugagaaugguacucaaccucugcgaucuuccacaaaaaagaaucccauaaccccggucuaaucacaaggggaaaaaauaagacacaugucaauagagggccauuaugcaacauuccugaccaaugcuccucaaaauagucaaugccacccaaaccaagggaagucugagaaggugucacagccaagagagccugaggaggcaugacaacuaaaugcagugugggauccuggacaggaagaggacagcaggggaaaagugagggaaucugaauaaagcguggaugcuggugaaaauaauguagugacguugguucacuccuucugacuaacauacucguguaccaggcuaaugugugauguuaauaucaggggaaccucagugggggaaauauggggacucugcaguaucuuuccaauuuuucuguaaaucuaaagcuucuaaaauaaaaaguuuauuaaaaaguaauuauauaaacuuaauuacauaauuaaaacaaaggcaauaaauauuuuuuaaagcguucacuuuaccagauuauuuuaaauauuaaaaaaauaccaagaugaaacaaaauacacagcacagcugaaguagcuaccucccccuuauucuuuaccuccuucuccuuuccauccucacuaugacagcccuuccuaauaucacaagugauguuaguggcuccauagaguaacauaaugaauuuagauugaaaaaccugaguuacuucauuacaaaaauaaaucaggccacucagugccuucagcuugagcuaucccuugagauaagcagucagccuguccaggacccuucugguuuccaggccucccagucucuugcgaguggcaaguguccaugagggaguggguaggucuggguaccuggcauggaccuccauggcuucugcacccaccuuuuagaaccaccguuuccccuacuguucaccugcuguucacuuuccaucuccucagcaacucggaaauguagacaguuccuguuucucaugugagacacacagggcuaggagaagcgaauucacuccccuacuuacaaagcuggaaagcggcagagccaagcuuccagcuaaggcacgucugaucauaaagccugcagccuuucugcugcagcaccugccugucuuccagcucccuccccaccugucccaguccuugccguccuugcuuuguaauccugaacagcuuggccuagggagcuccugcacucacacugccaaaucacugcucuguagcugcuguggucacacagacacagucaggcaugcacagaggaaccuguuacgaaugcuuaguccuggagcucacacaguagacacaccuagcuguaucuaaaauggaguguacaaaaagcguaccuguagaacuuucacugucaccguugugauccuuccaucugauaagcuuucuggaaguaagagaaagagccauguuacaauguacagugugugcccuaccuuauccugaccuuugccuccagugugcagucacaaaccuuuaaugguccuggcaauuuggcauuaugguggagcugcugauuugugauuuugucuuuaaacuuuuacucucuuuaacuugaccuggaaauggauacauuugacagggaagaaggcaaguuauacacaguguaugucagguuacacuauguaccuagaggugguagcguuuugguuguaaaacaucagugucaauguuguaucugggcaaaguaauacaguacccaguucuauuucaauuuccaaaccaggggaauacaaagagcuuaugcaagucaauuguaaaaucacuacuuauuuuggcaaaugcuuaaaaaugugugaauucuggauauuaucacagaaaaaugaaguuuauuucuggcucauucuuuuguaggacagaccugcucaccuuacaaaaggaauagaggucuggagacguugacgcuuaggaaaauaaauuuaauuaacaccaccuuuauuuuucacuauaaaugacaaccucuuacucuuguagcauagcaaaugcaggcacccacagaaauucaggacuccggauugcuuugcuaauccugguguguccaugggcaggucuugcaugugagugagcauugcucaaggugcaaagagcaccgcuaagcagcaccgcagagcuuucaaaggggcuuuugcauauuugcacaggccauuguugcagacaggaggguggcgcuuugagcaggagccccaggaugauucggcccagguguaacacggccccuccccagccaaguggcagccccagagaacaguggaaaagcauauugccgucuugcucuacuguguucuccaaagacaugaaauuuaguccauauguuuaaaucucucuuuggcugauugccuugugcaguugauacauauaguacaacaaaauaaaauuaaaaaauaaaucaguuuggaagcaaacuugaaggggagaaaaugcugcagcccugugcagagagcacaugugagcaucuuaaacacgccauugugugugugugugagugcgcgugugucgagcuuugcuuucagagugccauuuauaaaauauuuaucauaguuucacugaugagguucaaaaagagccuuuguuauugacaaggagccaaagcacuuugcuaguuuaggaggccaucguuggguugcaagagugaggacccaggcagaaggcaauguugggauccaggggacagugggcaggucugguaaugucaggaacagcacacagcugccuccagguugagccagucuucuaauggcaucgccaaugggaagggucuggaaggacaauccaugggauuuauuauccuuugcuguccccgcauguauggcccuggggaggaggagucaggcccucuagcacagaguccaugaauguggcucaguuggucuucuucuagcucuugcugcuacuccuacauuuucuucuauagccuaaaaucacagagaaaacaaacuuauuaagucacaaaaaacagaaccuuuugaagauaaggagcaucauaaaaacuaaaaagguuagagccaacaaaggaagacuuuugugagccccuacuagguuuccuaaugaccgugguuucugagggagaugcugaagaaaugggcacuccugaaggagcugacccaaagcaagcagaugagaguaauaaaacuucacauccggccaggcgcgguggcucaugccuguaaucccagcacuuugggaggccgagguggguggauaaccugaggucaggaguucgagaccagucuggcuaacaugguaaaaccccaugucuacuaaaaauacaaaaauuagcuggguauggugaugggcgccucuaaucccagcugcugaggaggcugagaugggagaaucgcuugaacccaggagguagagguugcagugaguggagaucgcgccacugcacuccagccugggcaacagagcgagauuucaucucaaaaauaaaaaauaaaaacaauuugauguccagugaacauuuuacaugugcaggacacucuucugugugccuuaaauauaucaacuucauuuaacucgugcacgcccauauuacuauccucauguuacauuugagggaacuaggguucagacugguuaaauaucuugcccagggucacacagcucauaauuuugagagugaggauuugauccagggggucugaugauagagccuacacauuuaaaaacuuucaacacauggauuucaccuguaccccugcccacacccuccccagcaugcguuuuucaaagcauacaacucacuggcuuuucguauagucacagaguugugcguucgucgccacaguugauuuuaaaacguuuucaugaccccgaaagaaacccaagaccccucagcaaucaccgcccuuucccugccacugcccccugucuccuuguuccugacaccacagccccaggaaaccccugaucuacuugcuguuucuacaauuuaccuauucuggacauuuguauauaaggaaucauauaauauguggucucuugugucuggcuucuuuuacucagcauaaugaugucaagguucauucauauuauagcauguaucaauauggcauuccuuuuuauugcagcauaguaguuuauuguaugaauaugccauacuuauccauucauuauuugauggacaguuggacugcuuucacauuuuggcuauuuaugaugcugcuaugaacauuuauauguguuuuucuguagauuaacuuuaauuucucuuggguguaugccuaggagugcaguugcugaguuacacaugauaacuauguuuaaccauuuaaggaauuaccaaacuguuuuccaaaguggccacacuguuguauauuuguacuagaguguaugaggguucaaauuucuccacauccucaccaacacuuguuauuaucucuuuuuuauuauagccauccuaguggcuacaaaguguuaccucauucuaauuuugauuugcauuuuucccugauggccaguaauauugagaguuuuucaugugcuuauuuuuccagcuauucuuuugaagcuaauuugggaugucauuucaucuauaaauacucauauaguauaccuauaacaggauaaagacacuuuuaaagaacauaacugcaauauugcuaucacuaccuuaaaaaagucucuaauuauuacauauagagugcucagauuuucuuguuuuccauguuugucucauacuuaaaagaaaauuaauugguuuaaucuagauccaaacaaggcccacacuuacauuugguuaauauuuaucuugggggucuuguuuuuuuuccagcucaggggauccccccuacccauuccccugagcuugaaaaacaaaacaaauccccaaaauguuguuccucugcucucauuccacaacaaucaacacagaggacuucuguggccagauguacagggauuucuccccgccaacaagcaagcaaucaguucugcagcaaacaccagcagguguccuccaauucaguucugacacugucuaccuggagggcccacagguugagggcuccaucucaccagacugcuuccacuuaagaugacuucacaagccucagcuggcuguaauucagggaacccacaacucccuccuuggguuugauuaauuuccuagagcagcuuacagaacucagaaacauguaccaacaucuacuggcuuauuuugaaggauauaacaaaggauacagaugaagaagugcagagggcaaaauaugggggagggggaauggagcuuccaugcccucucuggguacacuacccuccaggaaccuccacaugcucagcuaucuggaggcucucuauacaccguucucccaaagcuuguguggagacuucauuggauaggcauguugaagcauggacaaccagguagauaugugauuggacaaaaagggugugaucuaauacuaauagacugaguggggaacccagcaaguccugucucuucagauucuucuucgucucucugugcaacauuccuucccccugggaugaggcagggccccuucagaaauggggaacuuauaaccuacagucagacaagguagauaagagaaauguggggguagauuagaguccugccuuggggagaaaaaggagcagggaaaaagaagguagaaggucagagagagauucuguuuucuaaggccugcaucugagaccuaaagugccccaauguuguaacaaaagacuguaacaaaggucgugggaguuaugagccaggaaccguggauagaaacauagauauguauaugugugugugugugugugugugugugugugugugugugucuauguauaucucucucacaacccccucucuagccauucuguuguuuuugaagaaacuggguuguuggcccugugcaguuucccauguuuggaauuuugccaguuguauccccauggugucauuuaacauguucuucuauccucuguauugccugaaaacuaguagcugaaucuagaggcuugaucagauuuaaguucauuugguuuggguuuuggcaagacuacuucaugagugguguaucuacuuacuuccauauaucucuccuuucaugcuauugagauugaucaauagauucagguguuguuaacugaauauauuuaauuauaaaauucccacaucagcuuuuuacauaauauauuccacagccauugaugagcacugccuaaguccauuauccaucagggagcuggcuuuccucauaacucuaguaaaugccuccuaagaaugcaacagugcuuuuucuaccaugcccuaguucccucauauugcaaaggcaugaaaaugagaagguaucagcuauauauauauauauauauauauauauacagagucucacucugucgcccaggcuggaguacaguggcgugaucucugcucacugcaaccuccaucucccagguucaagugauucucaaaccucagccuccugaguaaugggauuacaggcgugugccaccacgccuggcuaauuuuuguauuuuugguagagaugaaguuucaccauguuggccaggcuggucuggaacuccugaccucaagagauccaccugccucagccucccaaagugcugggauuacaggugugagccaccaugcccggccaguaucagcuauuaaagggccauuuuauuuuuguauuaauuauguaauaauuuacuuaacccuuccaugcuagacugaaaacuucccaagggcaggcacuaggucugucuugcuaguucucagugcccacccacccccaacugggcccauggugggaucuugcuaaguaguuguugaguaaaugaaucagguacuuguuacuguauacccuuuuugaagauuuccugugauacaaguguuggcggcauuuuugcugauagcuuuucaacaacuucccuauuuucagacgaugccacuguucaacaguaaaccgggugaaacaggcuguaacuuacauauacacacaagagacauuugaaauaucaaauuuaagccuggcaauucagaaugcaagcucauuuuuuuuuuaaaccaaagccucuuuuaccuaauugagccagaaaauauguggcccuuuucccucccaauuugcagcuucaguucuccuugacugaguagcuaauggaagauggggccuguuccugcucugcuugugaaaucugacucucagcccgaggcuguguggcuucauauuuuggaucugaaaauaaaaugcuuuuauuugauccuggcguauuaaauucagguuagguguguugcaaaacagggaaauguuaucuagaaucuuccugcuaauacugaaucuuugguucuucugagccacugugucuuaccagucuuccuguggaagauggcgggaauguuucuaaucccacuuugagccugagugcuugcaccuuaugcagaacaaaucacaauucguaucauagucaggaucugagauuugucucucaccucacucccucuccuacggauuuaguuaugcucaucugaaguaaaggcugccugacugggugcaguagcucaugccuauaaucccagcacuuugggaggcugaggcaagaggauagcuugagcccaggaguucaagaccagcccgggcaacaaggugagauccccucucuacaggaaauuuaaaaauuagcugggucuggaggcacacaccuauggucccagcuacuugggaggcugaggugggaggaucucuugggcugaauggucaaggcuacagugagcugugaucacaccacuacacugcagccugggugacagagugaggcaagacccugucucaaaaaaaauuaaaaaaaaaaaaaaaggaagaagaaagaaaaagaaaggaaagaaagagagaaagagauaaagaaaagagaagaaaagaaaaaagagcugccugcuguagcugaaagauagcacuuagaugcuaaugugggauuuugaaagcgggagaccuuucuucagaaaucucagguaaggcaguugcgagggcacaacucaaugcccucgugaggccucaacucucuggggccucacacaaagaugagcuuuauguggacuuuaccagaaguuccagggaugcggccagccaggagcuguggcugucaccaguuugucauuggugugacacuaacagagagaagguacaucuuaccaagacaagguaguucaaguucagguucuguagcaucauucagcucaucugaaagcuuguaguugauuuuauguauugcagcccauucaaaaauaaucuuguaaagcauaguguuugcuuaaacuugagacagcuugcaauguggcuuccguuuagugugacacaaaccuguuguggacucucuauuauaccacagaaauuguuauaaccaccacgucuauugucuuccagaaggacacuugagagucacuuguaaaaguuggccugugcuuuccuauuaaaaacugcuguuuaaaugguaguuagucuccuguuuaguaugcgguguagcuagaucacccugcauucacaaugcucuacauaaaaaaaaaaacaacacugcugcaauaccaauaguuaaaagcaauuccauuaaauacauugcgaacuaguuuuaaauuuuuaucuugauguaggcacuuaagaaaaaggaagggauaaaaaauaguuggagacauuuauagugauucugaggguaacuucugaguucuggggcuuacagacucuugccauugggucuucaucuaaguagcgcuacucaaacguguaugagcccuaguuaaagcauuauggcucacaagaaaauaaaacaaacacaucaguuuuccagauguuaauugaucaguuuuccagauguuaauugaucaguuuuccagauguuaauuggagauguuuugaaagagagaagcuucagaaggcagacaaauacuaaagagaaugugucuuuacaauauucauucagcauuuauuguguaccuagcaugcccuaggcucuagagcagcauucucagaccacuaguuuucuagauugccuuuacauucauaagucucaagauuauuaaauuuaaauagccucaagauccccuuuacauucuuaaaaauuauugaggaccccagagaguuuuuguuuauuugggguuauaucuacugauauugaucauauuaaaaauuaaaacuguauauaaauguuuaaaugcuuugccugggcauaguggcucaugcucuauagucccagcacuuugggagguggaggcagaaggauugcuugaggauaggaguucaagaccagccuggguaacauagcaagacccccaucacuacaaaaaaaaauuuuuuuuaauuagcugugcuagguagcacaugccuguagucccagccacuuaggaggcugaggugaaaaaauuguuugaggccaggaggucgaggcugcagugagcugugaucauaccacuauacucuagccugggugacauagugaaaccugucucuuuaaaaagaaauaaaguuuaaauguuuuaaguaaaacauuuuaaaagauuuuauuauuuaaacauaucaauaauaaaaccauugcauauuaaccuaauauaauucuaugaaaaauaacuauaaaaauuuuugugaaaagaaugacauugauuuauauuuuugcaaaucuuuuucgggucuggucuaagaagacaacuagcuucuuauaccagcuucuguauucagucugaugcucuuaaguuguuuugguuaccccagauauuuuguuagaaaagggaaaaguguguuaauagacuuuugagaaaauuguggcuauucauucuuugacacucuaccaaaaccggaaaaguaguaguuuuuuaaaaguuaguugcauugugaaaucugaaauuauaucaaugacugauauaauuuuucacuuguuacauugaaaucgauuagucuaucuugcaauuuugaauggaucauucacucuuucaugauugugugaaaucgugcaucauucaauuagaaauauugguucagugaguuauguaacucuuuuaagcgucgacacauuucauuaucuaagaucaaaaaaucacauucauuaguaucaucaccaauccuaucaggaaugccuuaaguauugggaaauauggagacacauuuuccaacguugacaauuuuccaaauuugcuugaauuuuaucauuggccaaaaacacugucaguucuugaaguggcaggcucauugcauuuauuaucucugccaucauuggucugucaguacuucuuccauguaaaaauaauguuccaugaaaaagaguugcugguucagcucacaguugaaucucagaugcacauuuccuugagacaaccuugugcuucagcguguaccacggguucucuguguguguuucccacugagucacacagaauauaaaaaaggcauaucaaggguugaaacuuaauaaagguaauaauuuguagugcuuuuuaaggacguuuuaaauauucucuuuuuuuccagcuuuaauggaugaaacaaauuguuguuuuuuuccuuguaagugugagaugguaaaaaaugcagugacugccaguauaagcuggugccacuaccuugaucccagcuaaggcacccacaguuuuaucuacuguugcuuuugcaccaaagauguaaguggcaauacagcgaaaagggcaaauaaagucuuaauaguaugaaaaugcuuugaccuuacaaaucccugaaaggguuuuggagacccccacaggucugcagaacagucuuuuaaaacuccucacuagauauacaguuugacauagacaagacguuuuucuuguaaagggggaagauagauaauaaacaaaauacaucaggggugcuguaaccaaaacaaagcagugcgcugugacagagggguuaucucaggugggauggcccugaaaggcugcggaggcagugacguuuaagaugaaacuuaagagcaggucgacugggauagccagcccaggcuugauggcaagagcucacagggaauguuccaggggcagcagaagaaccccugugcugagcauggugaggagggggaagcgcagggagagaaaaggucagugaggcugucaagggcuacacugaucgggccugaggaaccaaggugagagcuggauuuuauucugagugcaacgaggauguccuuggaggggugugaagcaaggugaaaggucauguccaccuuguagccucaggaagucuccccucaccccacuuccaccuccauucuucucuagggggccacgacuggguuugaaacucuaaacccuaguuaugaaguuguaaauauaaguaaaaaagaaaaucccaaaagauuacauacagcaugguauucauuuuauaaaauaaacaacuuacuaaaaccucagagcuaucuacaaaggaagucaagggagcaauaaacaaggauucagaacagugauucccugagagagggcaggcaggaggaugaguuggggaagacuccacagauggacaaaaguccucauccgaguuccgguucugggggugagugggguuuuguggguguuugugaucuuauuaaguaagggugagugagugaaggugacaggccacgaaugggccacucgcgagugugucgggagccgugggucaugacagacccaaguacgugccccuggguuugauauaaaaagagaauaaggguagaaaagaaacaaagcucauaucuauauauuucauuuauuuacaugccguuugauuucuagcuuguucaacccuaguuauugcaaauaucaaguguaguaucaugggucaugggaaaaggcugcuggauucaaaacucggcuuugugugcacccuuggacacgcugcagacccuuccaggccucagugucuucaucuucuucaucuaugauguggaauaauugcaggauccgcucauaggcuuguugagaacaucgaacaggacaaugccugugaaccgcugucacaagccucucagucacguuuacugcacagguggagauucucucuccuguauacacugccucucucgauccauuuuuccuuucuuuauguaacugggaaaaaccaagaaugaagcagguuuguuuuuguuuugcgugugaggaaaagguuguugaaucuguucucaagaauguuugaauuaaauucucuuugccuggggaugguauuuuuaucuuauaugauuguucuuugaacaagcaguaagaaaacaaaaugaaauugggaggcuccuugcuuucuuccugaaaagaggcuucagggcuuugggccaaacugugccuugaaaugaauuuuagaagcggccacagcaggcggucucuguugugaggggcccagcuaguaacaggcacacucccccaagacagaggaaacacccugcagagcgguggccacgcugggcuguccaccgcacaggggcugucagagaaagagugggcucggcgggaaaggaagggccgccccaguggguuacacgggaggccgcuccaggcaaggguuuucaauuucaguucccuuuuccccacacugcaugguuucacuucucugauggggcuuagaaucugcgccauuaggcagcuuccacagcuuagacgccuuuccuaaggaaggguuggcacagggcugucagccaucagagaccugagagggcaaccaccggugcccucccugcuggauucaagaggagcugggugauucuggguuccaggaugaagaggagcuagcagggacaaggaguaagcagaauguuugcacacaggaaaugacaggggacuccguugcuggagccaucccuucccuuuguggucaucacgaaauauccaugaccauaguagugccacuguggccugagucucaggauugccugugcccaugagguggccagagccagcucugaguccccaggguggcccacagccaaggaacagagcccccaggacgcaaaaagaaaccaccacuaguugagaagggaggaggagaacuccucucaugacugugccuggcaggagacagcgcauccugcagccugagccuggugcucuacgggggccagccgaggcuaagacugucccucacggaaggaucuugaggcuucuguguccuccccgacacuggcugcacucaccuccccucagccucugugcauagcagcccaccguacuucaggaccacucuuuguaaucagggaauucuucuuuacauugagccauaaucugccccauaauuuccacagaugaauccuaauucaggucuccacaguaacaugaaauacaucugccccuuuuuggaauauauguuaggucuacucuguguccugcaccaugccaggcagcagacaagacacagacauagaccuuuccuuccaggagacuaaaacguaguggggcagaugccauuaaacaaauaaucacacaaaauucuaaagaugaaaugaaguuucucgcuauuaccguguuaccacacguggaaaacagucagcuaugucuucugucuaagggaagguauuuugcaauggccugacuuaaaagccgugggauuuccaugaaaucucuggaugaugcggagcagacaccccagugcugagcagcuuucuuuaguugaaagagaggguuagugauggccaaauucguagccuguuuuggggauggcgugaugacuuugaacaugggcgcugggguguauggaggaaggugaaagguguccguggggagaaaauuggaaaggagcuuuggaggcagguugggcaaggcauuaagugccagaguaagaaguuggaacugcguuugaugaucaucaggugagaagaccuuugagcagggagggaaguuaggucugaguuuugaggcaguuauuuuaaaaugguuccaagcauggccucugcagccuggcugcccgggcuccaguccuggccacuggcagugggaagaguuaccuggccucccugugccucaguuucuacaucuguaaaacagaaauaauagugguauguacuuaaaagagcaaaugaguugaugcaugugacauuuuuggagcuuugccuagcuguggaaaagugcuuuaaaaagguuagcuggggccaggcaugguggcucacaccuguaaucccagcacuuugagaggccaaagcugguggaucaguugagcucaggaguucgagaccagccuggccaacauggcgaaaccccgugucuacuaaaaauacaaaaauuagcugggcguggcgcgcacaccuguaaucccagcuacucgggaggcugaggcaggagaaucgcuugaaccagagaggcagagguugcagugagucgagauggggccacugcacuccagccugggcaacagagcaagacucugccucuaaauaaauaaauaaggguaagcugguauuauaaucaccaccauugucaucaucauuguuggaauaggcauuggaaggagguggaugaauuugggucagugggugucauucacaguagggcacaguagaggccugacuuuaaaagacuagguaugcugccaccuuccucaaaacggcaccugcacuguguucacucacauaaguagaaaccuggcucuuuuuuucuuuuuagaaucuuuuuuuuuuuaauccucacuugggauuaaucaccuccagaaggcccucaucagggguuacaauacacgugugcauguuugaggccaugcugcccacgcguagacuuggggaaggaauuugcagcgccucacucccucaccagcaggcccagugccagggggcuccuagaugauggcuggagcccgccaguaugaugcuaagaaugaagacucugcugcagcaugggcaaauauuuaggcaaugaugauaaaugaaauaaagccugaaaccacacaugcaugaugguccucacgauguaaaaacaugguugcacaugagccagggccguaaagaaacacagauaaacaguggcacucguguuaagaugggcagcgcaggagcacaugaauuguuuuccuuuaauauuucugcaauugucuuaacgauauuuuuaaaguagaaaaaguaaaggagggagcaugugcccaggaucccucuaugccucggagaccacaacugcagagcagccauuguuuuagcagagauggagggcuccagaggguggggcaugucaguucuuaaagaacugcucuugaucugcgaaccccucugcccucuuuaagccccaggggcaccgccaucucuaggaauggaaauucccagccaauggcuccugcaccagagacagugggcccuucccuuccucacagacagugcuuccucaggaucauggcccuuccagggugagcuucccggguaacuggacaggggcugaaaguagcauccuuaggcuaucccauugauggucuugguuaaaacaagcacaguucaaauaccuucgugaccgcugucaacugcaaaugguauggccuugggucagauacuuggccucauugagcuucacuuccaccgucuguaaaggagcaaugccucugcaguaccuaccuuccucaccgggcuguuacugguaggaaaagcgugacugcagugcauggcacccaggaagcugcucagucaacaguaacggcggcugcugcuguaggggugggcaugggaggggcuguuccucucaucacuaguuuuauucagugguucagaugguucaaaugcagccuccucuaugagguuggaccccguuccucugcacagaacuuucccuccucccuuggucuccuggaacacugcguuugugccugucucacagcgccugcuacuuucucugaggcaguggugucacuuauacuuguuacacuuuucagaggcagggugcugacuggccagaacguaggaaaggccaggucagagacuuucuguuuaaauaaaaugccacgcuagcggguuucggguaacugaagaaagugcauuccgcggucuccauguggucaggacuuggcucugugagucugcagccuuguucagcccucccugcagcuguuacuguaucccugucuuccuacugaggccaugcuugggccauuguggcaccuauacaucuuuaauacacgccccaauuaaugaguuaaguccagauaaagugggucugaggaguucacagauuggagugccacagggaucauauuuucaggugcauuuucuuccaaugcacucugacagcucaaaacacuuccucgagcuucuauacauucugcucguugccauguguccccagcacuuggauauguaaugcgagggauaccaacagacugauuucuaaaugagcuuccugccucaaggcaaagguugaguugcccgugcagcugggagggccaccaggugaaugacgcuguuagaggggaaguguuggggugaaaggucccugggagcuucgcuuaccaccgugggcacuuaauggaugcuaaauaauugaaagaauaaagugagagaugaguggaugccgccuugauggccccucgaugaacuaacaggguccgagaacauuugcaaauuggucauuaauguuucaucaacagugucugccuccuuuguucaucucaaaggguagccaggguuuccgaucacagggauaguuuccugagaaacuuaaauggaggaauuaggccgggccugcaauuccacccaauaauuuggguuuguuucaaaauagccuaauagcugggaaugggcugguuuggcuugcuaaugugcuuagaagggucuugagugcuuucacucagugacauuuggagggggauuauggauuuuggagcauuaaagcuuuauuguuuuuguuuuuuguuuugcuuugccuguuuuuggagugagguuugcugacgcuaaaaugacuguuuauucaugacagggagggggugaggagguauagggaauaauucuacucauggaaaaaggaugccuucuucaaaaugauuuuugcuguuggcaaagcugagaacacacucacaugauucucugccugcaguaagugacaggaaaaacacauugugcgccguggauagcuauaacuagcagcaaauugguuuaaaucauaaagaaaggcucaguauacacagcucccucuucuucagggaagucuagcuggaggaaagaaauggaggcuggguuuagaguacuagaaguggcaaguccagccuugagccucccgcggucggguuucuucagaaaauaaccagguacucucccgaugugagcuguggauuugggugaaacuuuccucucucagccacugcgcuggccucccucggcaacccuacguugcagggacugccugccccgaaacccugccugagcucaccacugucccuucacugacuuuugaaggugguagacggggagagauauuccuuguccccagcacuggcuggugugcucuugacaguggccuguucugaagccugcuaggacgcccgcuaccugggaagcuggcaggagauuccgauggcuuucggcaucugcagugcucacucauacugcagaugacucuuauuuccguuuuucacaacuuaacugaaaagggcacuuaagcaaagcaggcauuuagucccagguggaaucaaucuuccugcugcaggaaagagccaggcccugggcagcugguguuuggaguuggucuugaguguguguugacucaccuuccucucgagguaaaggaaaugaauagcucgugcuaaugaaugagguguccccagagcaucgucagucucuggagguguccaguuaggcccugugacugucccagcccucccacgggcacagcagaggcgaggcucagagccugccccuggaaugggggcguggacgucccagagagcaggggcugaggacacuggaguggggucacuggaggaaaugggcaaaggcagcugaguagacacauaccuuagaggcuagggagcuuguccagaaaaagcagccugcaccuggccguaagauuuuccaaagaugagguuuaugcucauuguauuuuucucuuggaaaauguuuagggucuuuugcaaugcuuuguccuccucgguacucagaggacugcaucugccuuucccucuucuuuccccuucaaggauggacguguagguuacccacaaguaccugugcccucauuuuuuuaggcacaggcuucuuucucugcuuuguuuuuguuuuuuguauguuugcuuucaaggcacauauuuucaaguauaaaaugacuccuaugcuccuucacuuacccugaaaacaccuaccuguuuccuaagagccaccuuugaaaacucuauggacauuuugaaccagauuauucuuuaucaugggggcugaccugggcacuguaggcuguuuaccagcaucccuggcuucugcugacuggaugccaggagcagcccccugaccccaguugugacaaccacaaauaucuucagccguugugcagugcccucuagggagcaaaauucccuucagauaagaaccacuggucuacaggaaucacaccaaggcagcccacccauuuuaaagauaugccagucuguuuguuuacugaauguuuaauaauuguucauuuauucaccuaucugcuuacccauugaucuguccaucuguccauguagcugagcugcccaauauccauccugggacagcagugccuugggagcuaaacauacucaaacugugagccuuucuagaaagagagagagacagcgagagagcgcaauugauugauugaggauagaggagauaauuacugagcaagcuggauaagauccaagguacuaaauaguugggggaagguacuugggaggaagagagaugcugcuuuuuugagaccagagggaaggaagaaugguaaagacagaggaaaauguuuuggucacagggaagaucacuuaccgaguccuagaucuauuuauguagaaaaaggauuuucuagauuacaaagagguuuuuuuuuuuacaacuagaacuguuuuucuuagauuuauuuuccaaagaugugucacaaggcaguaauucaccaucaucaguuaauauguccgagcccagggccaguagagaggaauuaaaccuccuccuaagaggagcaaaauauucaucacaaaggacagauuuugcaagaguuggcaaucuucuagaggucaugagcaaagucuucacuuacucuuauuaaaugguucuuuugguaguaguaaucuuaccuccccuaaccacugcaaugaugauugccaguucuacugugugcuuauguuucaagcacuguucugagagcuuuauacggauuaacuccguuaauccuuucagcccuagauggucuuuuagagaugaggcaacuggaacacagcaagguugaguaacuugcccaaugucacacagcuacuaagugguagagcugggacacagacccacacugcuggcucugaaagcaucaacccuaaugacuacacgcucauuugucuggagaaaacacugagaccuggagcauguguguacaugcucaccauacagcccgcccccgaugauugucaggagagucagcugaucugagaaagugacaagcauuggucauuucagagaaaccgggaguugggcuuuuuaaaagaggcauaaagaaacugggaaaaugagacugaguauauuggacagaucccaggaacuaccacucagaggaagacaagccccgcuccuguuuuuccuuccuuccucuuccuccuucucuuccaugugccuucuucuuucccuucuuccuccucuuuguuuucagcucuccucucucuccauauagcccuccagacucuccuccucugugaggcugucuccuugguccccucagagaccguggccccagauccucaauccucuugcuccccagauucguuccaugucuccugcuucugcacucacgcccugggcuccugccccuuggauuagaagccaugggcgccauucuuugagcacuuuucacacaccggaguaugguuuuuaaugaacaguuuuauucuguuguacccuuugaucuccuguguacuccucuaugaguagcaccaugucauagcagggcagaagccagggcguaucguguacuuggagcucaaagucccuuugcagugaaauuccaccaaaaccuauggaucuuucacuuugggacacgcuguuugaucucugucugucuucuccaacauccuuucucauuaaacugaagaucagaaaaaaucagaaaaauagggccccuuggucccucugagguccucaacauuugcuagauggcugggacccuucccccucucaguguccugaugugguuuauucuuucauguuucaucugggcuguaugggccuggcuguaugagacucucacgcagcccgagcuaggagagccucccuguagagccgcaccuggcccccacacucucugccucccuaucuccugugcuccuccucaggguccugcugaccccgucacugagacagcuguccccgaugauccucaugcaggguuuuguguucuucuuaugugaguguccuuucuuguuggauugaaagucgcuuaaauaacacagcaaacauugcucagcaccugcuauguaccagccacuaugcuagaugcuggggacacaaaagugaaugaacagucguugaaagugacagugucaacaaauggcucuaguagcaggaaacaggaguaucaugauugagagagguacgugucggugauauggcggugcacacucuagcccuccauggagggcagugacccagguguguucagccuccuagggaggcaguaaggauuagacagguuaaggcuugggaaagccucacagucgggccuggcacguagcaagcaugcaacaccuguuagaucucguuguucucaucucuguagcuccucucccuucugacccguucccccagcuuucaaugucagaccacacagauuguguucagcaaaugaauaaaugaccaugaaugaaaugaauguugggcccaucaagagagaauuagagaacuuggaaagaagaguggacauucucaaugaggagggagaaaaacagcacagugccaaggggcggagcccgggagcaagagcccugauccccggacacaucaagcuuuccugccaugggucagccggacuccagccccagucacgagcuccuggacagcuccuagugagucuccucuucgcuucccucuuucuuuuuuccaccagagauagguaggaccuuuucauauccuucaaaaaaaaaaaaaucaggcaugauucaaauccuguucuucuauucacucugccuucacuucacaucacuuccacaguugcugaauucuuccuucaugccacauacugugcaaggcucugaaaaugcaaccaccaggagacaguccuggccccaagcccccggcuagguggugcccaacccaaccucaccuuccacaccaccaccaauggccagacaggugaagugagggguugagcuuggauucccuuuucccagaaagagguuuugugugauuuuaacuuauuugcagauaauuaaccucagggucaaaaaauccuacccuucugccucugcggagauugaaauuagauuuuugaagagaagcaauugcuguauagaauuaaaaacuucuugaugaauacugccaucaugacauggggaggaaaucacaguagcacuuucuacuguguaauuaaaaaaccaaaaaagcaaagaugaauggaauacccacaagugaaaaugggauuucguuuucaacagaggaaauuggaguucugucaguuacacauggaguguguccugaaucauuucaaauuacagcaggaggucacgugggccauuuucuuuaaucuaugcaauaccacggaccaggaaagggaauuuuugcucuaaaaagaugugauuuuuuuccauccuaaccauugacucucuuuccaaaauaccaaaaacauuucauagccccagguggguuuauauuuuguuuuuguucucccuccucuccacugccuugcccuaauuuuaaucaugcugacucuccagucuuuaacugccuuugcucaagaacauguaaggauuaguagcccagaguugagucuuggcaacacuguggaguccaugcuguacccaccuaucuggguuuuccucagugucaugaaaucagaucagagaucucauagcugccacacacugauaggucccacugaccauggaggacaccggcuccuaagugagggagaacugaguuuuggucccagccuaguucuuugcuguguaacccugugaaaucacuagccucucuggacuucguuuucuuacauguauggaguagggauuggaauagccuugcuauugcaguuguuguaagaauuaaaugaauggauauaugaaugucuagugcaugguaaguccacaagaaauaccugcuauuauaaucaccauugcuguuguaaaaaguaaucaagggauccaagagugcuaaacugguguaauagcuaagggguuugggauugccgaaaccugcuguggacaaugccgucccuucuuggcaaguuccagugguagauggaaauagagcccuguauaauucuugugagaauucuagaaagcuaggcuggagcaggaccccuguccuaaaggccaaagagaccucuuccugccccccgcagaccagcacugggggucugaccagaggagcacaagagccugcaauccugaauccccauuauccugagaaagaaagccacagccagcucuugucccauaggaaagagcuggucuucuuuaggacuucaagcacaugggagaaggaagcagggcuugugcuuucagucuuguuuccacugugacauaaagcaaggagagggugucaggaggggccaugcaucugugggcaccguuucaacacauggccagcuugugcucucuauuugagagccagcuggacccagaaucugacccaucagaucagaaucccucucuguagagagggagcaaggagaugauggugaugaugacagggaacacguacauagcacuuaacauagccagauaguaguuuaaaugccuuguauaaaguaucuuacugaaucuucuuaauaacccuuugauauaggcauuauauuauauucaucuuauaccuagggaaauugacacaaaaugaggacaguucauuagagccuggagaguucuucuguaaauaagacggaaagauagaugguuguuugauuuguagauagauagauacauacauacauacauacauacaugcauacauacaaucugaaucuauaguguagauagaaacugugucugucacacagauagaaaccguuaguguaguacacuguaucuagcuguagguaguuaauucuucuucucacaacugcugcauccagaaagaccaccccaauaaacuaagcagcuuucuagaagauucacuccgcguuuauugccagaugugucaccuggucauuuuguggauuauauuaaaaugcaaaacaguauuauuaguuauuaauuuuaaaacaaagucuagaaacuuuaauuuucaauuuagccaacaagggcuuuuuuacucuacguaccccuggcuacauuuauuauacauuuauuauagaauuacaucuaugcaauaugucuauguaugaaugacucagaaagguuaaguaacuuacucaaggccacagagcuaauaaguagcagaacuguaguuugauuccagauucucugauucuauccacugcuauuuccacgucauuuuccugugauccuuccuuugguguguguagcucaccaggucacacuaguggacuggaccaaggaaaaugcuggacacuuuggugacuaagggcuuggagcuuuggaggaagacagcuccaggcccacuccugacuccauccgcuccaucgcuccuugcugccuggguccuugaccucucggggccuccguuucucucgaggcuguugugaggaucagaugaaagaaagaugugaagugucagcacauaaguggucacugugauuauaauuaauaguacaccauacaguccuggcuguuuucucccaagaauucuuuaucuuucgccugcuaauaaaacaguaugaagucugaaaggccuuugugaagcuccgcguauuugcuauuaauaaccguggucaauagcgguaauguucuaacccuucaaauucacuguuugggagcugccuucauccccagccuaucgaacacaugcuguggggcuggaccugucuguggcaccgugcuuugugacuugccaaaacucauaaggaaguuaagaguguccugacagccacugaugcucuucuuuuaggaaacuguucucaagaagauuagagagcuggcuugaaccauuuaggaagugggaaggauauuagaugaguuauuuguugcugcagaaugaauuaccccccaaaacagaggggcuuggcagguugauucuggcugucgauuucucacgggguugcagccaagaugucagcugaugcugcagggaucugaaggcucaacuggggcuggaggacccccuuccaagcucagucagucggcugugccaggaaaggcucgguuccucccuggcuguaggucagagaccucagcuccucaccaccugggcuccuccacagggcaagcauugcagcuggauuccccagggagugacccaagagcagggagaggccacaugucuugaguagccuggcuuuggaagugacacaccaucacuucugccauauucucuugaacacacagacugacccugguccauugugggaggggccacacaagacaggaacaccaggagguggggaucucuagggggcaucucuggagauugccaccacagguggcacauucuugucucuggagagcugagagaauucuccuccuccuccucacaacuguugccucuaaaaagaccagcgcaaauagggcaagcagcccuucagaauaagguuauguccacauugauucuaagacaugucaccugauuauuuuuuggauuguauucaagugcaaaagcucaacugauaguaguuuaaaaacaagcuagaaacuauuuuuccagcuuaaccuuaagggauuuuuuuuuuuaaaaaauugcauguaccccuugcuauuuauccuagaaauggcugcagagcuuuaaauauagaccagcaugaauucaacucuugcauaaauuuaaaccacauaggugcuagaauaccccuuuuuuaauccagaagggagaguuaucuaagagugauggguaaguacauggcaaaccaauuuacugccucagcugcuguaauguggaauaacuugcaucccaucucacucaucucucuucugucuccaccaugcccauuagcacgugaguuugcucccuuccucucgcccuccacacuaaggcagauuauuuuggaugaaaacauucauuuaaauuuacucuacuuucccuucacccuaugaauuaauguaaggaaaugaaaucagacuucacagguaccauacauuagcaacacagaugacccugcgugaagggagaucacacaguuacuuccaucagaaguaaaacugagccucgaaaacuucacagaaauacacucagagccacucaaaagggauccugaaaggcaaugggggaaacaagaaauagaauaggcuucagaaauaagauccuggccgggcgcaauggcucacgccuauaaucccagagcuucgggaggccaagguggguggaucacgaggucaggaguuugagaccagccuggccaacauagugaaaccccgucuccacuaaaaauacaaaaauuaacuguacgugguggcaugugccuguagucccagcuacucaagaggcuaaggcagaagaauugcuugaacccaggaggcggaaguugcagugagccaagauugugccacugcaguccagccugggcgacagagcaagacccugucugaaaaagaaagaagauccuaugggaagggaagugagcccccucccugcuuucuggaauagugugaguggcagauggcauuggucagcugaccuagccugcaugcauaacuuccccaucccagccuagagguggucaugugacccaguuuuggccaaugagaauaagcagaaauuucuggaugagguucccugagggcuuuuugucuggcaugccccuuuggccuuuuaccauguacccuucuuccgucuaucugugcauugcugauaggaggacuggagagggagcagccaucuugcaacccaugaagaccguggcuugcuuccuaaggauggugggacagaaagaagagcccagauuccccauggcacuauuagcaguugcuuuguucugcauaccuucagaauucguuguuauuauucuuguuguuguuguuguuuagagaccacaucuugcucugucacccacgcuggagugcaguggugcaaucauggcucacugugaucuugaauucuuaggcucacgcaauccucccacuucagccuucugaguacuugggacuacagaugcacaccaccacgcccagcuaauuuuuuaauuuuuuuguagagacagggucucacuauguugcccaagcuggucucaaacuccaggcucaagcaauccuccugccuuggccucccaaaguguugggauuacaggcauaagcaccacacccagcuacuucuagaauuuuuuaaauguguccuuuuucuuuuguugaaugcagcugcccucaucagaagugacacaguaugccagagcucugaagagauugaauauguugcuguacugcaaacagucagaggaaacagaacccuaaaagauguaugaauagaacagguucuuucaguguacauuacuacgauccaaagugaggucaaugaguaagagauucagaauauguccaaagaugaaugacagagagcaucaucauuucuuagaaguaaaacagcaagaacagaguuuuuccuguuuacuggguacaaagcuaucuacauaauuauaagggauguuuuuauugccagaaacaucuaacuuuuauaaaagcuuaaaguaguuuuuuuaaucauuauuucuguaaaauguuuuuauuaaaggaaacaccauaugguaacagcaagaagaguugguuacgagucacgaagcuagucagauuucuuuccaacaguuaaaauaaaaaaacuuaacacagaccauacauuuagaaaaaaaaaaugcaguuucaagacuccugaaagcauaaaacuuuaaccaaagaguugcguguguaucguugucgguuuuuuucauuuucuagaacguaagacaaaaucuuggaacgcuuagggguuauauucauaauauuuaacagccagcgcagccuggacaaugacucguuagaacaggcaucagucaugccacauucugucacgaaaaggaucucccuugugcuaguccuuaucacaccugcucuccuuacccccaccaucacuacccucuggcaccuacuaaucuguuuuccaucucuauaauuuugucccuuuaagaauauuauguacacggagucacacugaaugugaccuuuugagaugggccuuuugcacucaacauaaugcccuugggauucauccaaguuguugcauguaucaaaaaaugaagaauccuggccaggugcaguggcucaugccuguaaucccagugcucugggaggccaagguaggaggauugcuugagaucaggaguucaagacuagcuugggcaacauagugagacccccgucucuaaaaaaaaaaaaaauuguaauuaaaaaaagaucaagaauccuaacuucuagcauggccauuuccaauuuuggcaaaguuggaacaccugccuguuguuugaccaguuauuccugggaagcaauaauaaaaaacaaaauaaagcaguggauuguuuuuuauguuuaaaauuaauucaaaauggcuuaggagaaggaauuugugaccuggggcccucaggugcccaguggccuguguguaggaggcaggaccaucuucacgggaaaugucuacaagacagauguauguuucucaggcuagcagcgaucacuuugcuucuuacagcaaaauucuggaguguuagaaaauaaucuuccuucuaaaccuucuucuguaguccuugcuuugaauccaggaggacagugggugagggguuccccuacccagaacgguaggucaggcaggauggugccuagugccgccacaaggucacacagccuuugugagcaaaggcaggggaguugaccugggucuacauccagacccucuucuuggagccugucauguuccugccaccccgcuaaacacacugcuugcaucauuugauuuaaucccaucagcaacucuacgagguagauacuauugcugacccaauuauacagacaaagcaauuauggcuuagaaaaauuaacacaucaaggucauacagcaaagccaggacuuaaaccgagguuuaaaggcccccagaguccaugcuuccgaccacugcaugguuuuaguccaaagugaagagcaggucaaaccacuacauacaguggcaucugucugcugugugcugguagggaauguguccuggggacacuggaagucuagaguaucuccuccaggcuuaucauggguccccuccuagaguggguuagggcccuucaaagcuuuuucaucuaaggcaugauaaaauacacacgagaaaguuucagcuguugcuuaaaaguaaggaaacuauucgaaauaaguuuuuugggaaccucauuguagagcagccugccuugaugguuuuuugaaauacaugugaccuuugaggccauuuuaauuuuuaccaaugagguaaguaaauaguagagauuucuuaagccuguggacgcacaaccugugcaaagguuguuccuaaucaaaaugaaguaccaaguaaggguuuuuuuuuuuucaaaaaagcaaaauccaucagcuuggcuucagcacugcggauauuuacaaaccucccucccaggcuugucguggagccacaaaagcccccguuuccagaugcuauguuuuccgauugcucaccgcuuaccugcaggaagaaagcgugcuucaccugggcaaagagaaacccuccuggagaccugccuuuuauccccaguaagcaagcacacauuauccaggacauugaaggcagggaaacaacucguuagucuguaaccuggggggaauagccccacugcuagagacuucagcacuccaggauccguguuguacuucauucccaggcuccgucuuuuguagaccagugccuuugagaagauuacugcuggcacacucugcccuucauggccuguucuccuuaccaggagccuuauugaggcagaauaugcaugacagcuuacuggaucuacuaaagggaaaauggacucacuucugacugccacacuguucaaacaagucagugcuaacacagacugcggcaggguccccaagggccucucuggaaaugccugcccuuccucccacaccaaccuccgcaucccgagagaguuggugcacauccagaucuuaaagcauccugagaguuggugaacuaauuccuguuaaaaccaacagucacuuuaaguuugaggaagaaagguuuaaccaaguacuaguaagauucacauuuuuagcuuuuguucuuccagcugacucuguauacugggcccacaguuguacagagaguuacccuaugcugacugcacgggagaugcacagggcguguggaugcuaugggaauggagagcauuggucaugcaacagcuucgccuaugaugccgugucuuucccugcccuucuauauguucuucauguauuuccaggucuccuauugauucauccacacuauguacaggauuagaaugcccagcagcugggggagccuuuccaggguaugguucagcggguguuaccagugacccuugcucacuccuguaccuuugcuuccacgggaccacucccauggggucuauaaccccuguggguaugcaccagcagccaggcuugcacaacagccuccuggccuggcugcgcugaaggacuucuuuuuguuuuuuccuguuguuuguuuuuuucugauagagucuggcucugucgcccaggcuggagugcaguggcacgaucucggcucacugcaaccucugccuccuggguucaagccauuuuccugccucagccuccugagcagcugggauuacaggcacaugccaccacccccaguuaauuuuuguauuuuuuaguagagacaggguuucgccauguuggccaggcuggucucgaacuccugaccucaagugauccgcccgccucagccucccaaagugcugggauuacaggcaugagccaccacgcccagcugggacuucucuuuaguuaucagggccucugugucaacaggcuccugggauauuuccucagucucucucucugaugucucagccagcuauucugcccaagacagaaaguuucucuguagaucuggccuugggaaagacagaucagagucucaauucuaagaugaauagguacguuggcgucagcuuuugccccaggauugccugcuccuacauucuuuccuauuauuugguuaccaagaugcucacaugcagccggcaucucaugucccacagaucccauuuggggugcagcuuucacccuuccacaacuuugcuuuuaaucgucacgcuuaacucccaucucuuacuuugaaaccuucucucugcguugcuucuuuucccauauuucuuaucccuuucauucuaaacaguuucuacaaaagaacaaagucagucuacgggaugagagcggggagagggaugacaauucugaagaauucuaguagguuguuuuuuauuaggcacucaguauuuuuuuccccauuauauguaguaccuucuaagcccugacuucaaugagaauuucacugguagaaagcuuuuagaguuggagacuuuuguuguuuuuucuguacaaaguuuccucuuauuuuuuaucuggcagaguuuuucauuuuguuuucuugguuugguuguuugguugcauuuuccuacccucccaccaccccgccacuuccacucuucugcuugccucuugcuuuuugagugucugaaaaaaagaagauacguuugaggguauugcaaacaaggaaaaaucaucaggugacauuguucugaacugguaaacuuucuaucccauaagaguuucuuuaaauagaaaacaaagcaaaacgacauaguauugaaggaauucuuggaucuaggaggaaaggagcaaguauccacagcccugccaggaaauggguucucaggaaaugggcucccaggaaaugggcucccaguacuccugagagaauguguguguuuccugaaggccagcaggguaccuccaggggugcguguguuugugugaggguggagugggguguauauaaggcucacagggcaggggcaggauauaugggccccaaaaaucaauggcauuaucaauuuugccuuguaggcuauguccagguauuugaauuuugaaaaucccucccggcugucaucucaagcucucuugggaaccuuuaaggaugccaauaucugauuaaauggcaacuuuagcucccucuugaaccuuucacuuuucucaucucuaaaauucuauugaugggccagccuuaaguuggugacucacauccuucaaaugaccacauuggaaauggcagagaccuccuuucacccaccccagcccuaacacuggaauccacagcccacccuguuuugggggugcuggccacaagcucuggaugccaacggaugaggccaggaccuuacaucaccuuccugacagcagcugaaaggccacaguguuuguauugauuuacaggagcacuuccuaguuuugucgucccuuugcaacuguauagaacagcuugaauauuagaaggugaaagccaugcucuauaauaaccuuaugaaaguuucaugcuagcauuugaucaguagcaagccuggcuuagaacaaaaccauguuccuucgaaugcuguuguugaaggcucacacuggcaccgaagcuguuuucacguuaggguggcuucauaagggagcacauuguugguagacaccacugucuggaggaguugggggagaaagaagaugaauggaagcuuggaaagcauugucauugaaaacaugcugaguucaaagucagcuguuucacucuccuuggaggaaguuaaaaacaaagguauucuaucaacaggcauuuaauaacugucuuguuauauacucuauuacacaguaauaguuuccacucauugagugcuaaucacauaugugugugucacacucaccgugcguuucuccucaacguccuuccugucuuaccucuuauauaggagcucggccauuuggggcauuaaccccagcuuucucaccaggucuaagccagucagugcacacuacuuccugugagacaggauugguuuaggaacaggggauaacccaaaugggaacagugguuugugaggggaaggugugcgagaucugaggaccucugggagugaugccucacucuggagagagaagccuggggagggugagcagcugggccuguuacaggccuagggacgaagcugccacaaagaggacagcagaggugaacagggguggagagaccaagccagaaccacugcggcaggacaacccuguccuccuccucaugaaucgaauucaguccaacacaguucugcauccuuugaagcuguuuggauuggaaauucuguuacccacgaccaacaguauguucgcauugguaacaaucaguguuaguaaauuacccauuacagcaguccucugagauaaguaccguuaagucuccguuuauagaugaggaagcagaggcuuugugggguuaguuaacuuuuccagaucacaggacuaaguagcagagcuggguugcaaacccaguucugucugauucccaagccugccucuucugcccagcgguaucugucuguucccacauccucagcagcuuaucgggaaggcgcucacuuucugggaagcaggaggaaacccacucuggcucugcccuugagccaaaauggauaaaggccagaacacagggcaaguguucaguggcuucugcaacacaccucaaagcucagggcagucccgugauuggcgcauagccaaggaaaccuaacaggaggcagcacauuaaaucuuucaguccuuuuuauggcuagauauaacacacaugcauaaaaaugcauaaaaaauaaauacauaauauaaugaacaauuauaaaaauaaugcccgaaucaagagcuguuuggauuuggcaauuaaauguugguggcaaaggaaaucaagaugaucauccuagucacgaccuuaccuguaccuguagcauuugacacucuuuaggaaaagucaugguguuuauacccuagucuguaccauucaugccacaaugagcauccacaaauauacccacaaaaugcuauccuagaaaagagccauuaaugaaauaaaacugacugaguuagggcgauagcagcaaugaagcuauuauuagcccuguucuacuuucuaucucucaugaugcccaauucucagggaaaauggccccuaaagugauuucuuggaaauccaaaguuagagagugguuuccaaggccauuaggagggacaucugucaugccacccauggccuugugccagccagagcgcacuaacaguugagguaggccaucuuaaauagacacacuucauuaugugugucugugcuuuaaucaucuuuccauuugucaggagauauccugcauagauaaauaccaauuucuguuuguguauaucucuuguaauugauucuuuauuaguucuuuucaaagacaguguaaucagaaggucuguuugcagaauguccauuugcugcaaagaagagaauaaaucaaucgaugagucuuuuuuauuuugagacagggucucacucugucacccaggcuggagugccacugcaugaucuugagucacugcagccuccgccaccugugcucaagcaauccucccaccucagccuucuaaggagcugggacuacaaggcacgcaccaccaugccuggcuaauuuauguauuuuuuguagauaugaggucuuacuauguugcccaggcuagucucaaauuccugggcucaagucauccucccaccucggccucacaaaaugcugggauuacaggugugagccacugcaccccaccaaucaauagaucuuuacagccaccuuuauaucagggggagcccucugugacccugugugguacagagucggaggagaacccuggggagaccucgucauuggaaggaaccccaaaaggcugugaggaggcaacaagccuccaacugcaugccuguaauuaugagauggauuaauaaggauguuccucuccaauucauauuuuagcccuucuuuagagucuucaauuaaaaagauaaaaaauaucuucuaguccugaugauucuuuucauuauuuuaauuacuaagguaaucuauuugauaccuuacauucccaggcggccggcagauaauuauccuuuuacacugcugagaccaacccaaagccaggcaggcuuuccacuaggagcagucagaaccugcccucaugaacaaagacagugacacgauggccacgugguccuuagauggugcguggaagaggggauuuuaaagagcgugugucugugugugugcacuguuacuccauacggaugguaucugcuuuauguguuugacaacggcagguuuuugucugcuugccauacauucauuugcacuuggagugcaauccagacagcagcauucuguccccauugucuuugagguccugccacucagaguccccgagccaagcagggugacagggugcucuucauuuuuucaaaccaaaguucuuugcaagcagcaucuccuugggccgagggcuucagugaauauuguccuggccuccagguggcagcaggauuuggcuggugagacugcgggcucugucaggagaaagcaggguggagaauaggcagaggugggggugggggcugagcuuccuuagggcaagagucaggucuuauucaucuuugucgccccagucagugcauggaacugugcacaucacuaauagugaucaguaucaauaucugcuaguauuuauuaaacccuugcuguuugccaggcucaaagacaacagaagagaacaaaacuaagaaggagaaagcucugugcauguacagcuggcaaguggggaaaggcagaccauaaaauaaaugggaaacauauguaggaccuuuagauuaugaugggagagcgugugcaguuuuaaaugggacagucaaggaaggcuuugcagagaugguaacagaugagcaaagacaugcaggagugggccagauggagacugggaagagcauucuagacagagggagcagcgguugcaaaggguauggcggcaucaugccccaaguuugaggaacaggcagugguaccauggacaccagccaagagaggccacagcaguuagagcaggguccaugaugggcuucgcaaagagauaaggucacaaagaucaggcgagagccagaucacaugggcuuguagccacugaaaggauggccucuacucuggaggaagugggaagacgcuagaagauuuucaggaggagggaugugaugugccuugcuuuagcagcauuacuuuggcugcuauaaggaggcaaggguggaagcagggugcccaguuagaccauugcaaaaauguaaacaagagaugguggugguuggauagcagugaugagguggugagaggugcucaggugcaggauauguuuuggagauggagccugugggauuugcuucuggguuaaauguagggugugaaguaagugacacccuguccugucugccauaugcuguuggucucacaggccaaccccaguacgaugugggagggacucaggccagggaugagugccagauggcaggaguuguugggcacugucuuagaggcuggaugccacaauggauggaggugaauggaugccugagaggcacccagcagccccugcagugaggaucggaggguucagucacuuguugaaacugugcauguaaucuugagagcuggaaggacagagguggcagucaccugacagccuucacuucauugcuaaauaaucuuuuccuauugauugcugaaguauuuugaguugucaacccauuuuuuauacacccaagaugcuucucuuuuuaaaauuauucaauucagagaucaacugaucuuaaaaaucuauaucugaagccuccauuuucucugauucuaagcucauuccuuucugaaauauuguuucauccuggaucauuucuugagaucaagaguucaucugaaauagcuuuaacaaauaauguugcucaaaaucugccuccaaacccaguucaacccacaucccaagaaaacucccauugcuaccccuuucugcuucccucaccccuccuacccacucucaccucuccccucggcuucccaucacuaucccugcugugggagcaggaaucugcuuccugaggcuugggccuucuccccuucacccuuucccacugguaccuggagccccuuucuuugugguuggccaagggagaaaaugacaccucucauuuuuucaaaagcuagaaauaagugugucucagggacucaucucgaguggaaaagauggcauguuugguacaaagggcacagccaaccucaaugcagaaaauguaaagagaaaauaaccucaaaagcuuugggacucucaagccucaaagcuaaugugcuuggccauuuuuuucuccccaagaauggugagggccaggcaugaguccagccagccaucauggccacgggcaacaaucagggauaagaguaaaaacugauaaaauaaagagcuagcauugauuaucaguguauaccagacaauugcuaaguguauuacauccaguauauuauuuuguccuaauggcauggcuggggccgagagaggcugaguaacucguucaaagacacacuacuagucagugacagagccuggagcaguaaccaaaaaugaguuaguucaacuauugccagccaguucugaauacuuuucauucacucauucaaccaauacaaauuaagugcugccugugggcgaaugcuguggaugcuugcugcuuugcuuucuaauuuguauaugugagccugcaacuguaaaagauugggucuguugauguuuugagggggaccuaucaguggcaucccucuuccuuugcugaguucagaugucaugaagaguacagacaggaaucaggcgaagaucaaauguucauuacuguuaugaugaaacgagaggcuauggcuugguuuauagccacagucaggcucccuaaccugccuucccagaagucaccucuacugcaacucugaagagauggccuugcaagccagaagaugagcugguccaaaagggggcugagccacgggcccaguccucuccucccguccccucauaccagcccucccccagggaaggguccaggucugggagugggagcagccugugagaaugccuccaagaacacgccaaagggcuguggggcuccagcugcaggagugaggcaggacaacagagugaggaaguggcuggggacaggcaggcuggcuaagcauuuucagcagggugugacaugaucagauugauguuuuuaaaggaucucaccagcugugguggggauuggaagaaggcugcagucaggguggggaggaccagaaacagagacccugcugguggccuggauggaaggugccaguggcaguagaggccagccaggggcuucugugucaccuccugcugccagcuccuccuugggacuggcacugacccaggcggggcagauacagcugcugguccuucagaccaaccgugcugugcucaggccucagacccuggcccgugccuucugugcugaaggccccugugaacaguguuugcucuucaagguucauucucagccugaaaacuucuuccuucuggcauguuuacaguuuaugaaguaaaaaguccauaaagagauuuauccuccccaucccaaagcuguaaccuaggugcagucauuggcaggcuaccagcccgacuuccuccccuggggaagaaggcuugucacuagggaaggcaugcauguugcuaaugagagaacaugaagcaauccagguccacaucugugugcugccuccacucacggcugccacgaaggugcuccagcuggccgagcggaguggcccuugggaggcugaggauauugggccugcggggaguuacacgcauuccacccaguaaggaaguuuguucauuugccauucaccagguaucuguggagccccuccugugggccaaacaucaugccaggugcuggagaugcaugugaaagugaagaaaggcagagucccugcccucuccgaguuagugggucugggacugggggaaaagacaagugucagaccaucaugauacgacagcauggcaaugccaggggaauaccuagaagaguggggcagggaaaucuuuuccagggaggaccuuccaagcagaaaccugaggaaugagcgggaauugaugaaauggaaggucggggguggggcaggauauagaggaaggggaagaacaugcccucgugggagugaugacugggcacccuucucuccucggacgcagacccagcccugcaccugaugcacaaaccggccuucaguugcuacuuguacccuugaucagacaagauggcagugggcuggacaauggagauauuuucaggaagcuugguugagaaggacaggcaagagauaaacaagacgaccagagaggaggcccagucaggagugaguucggcuugucuaagugcugguaggcgggaagagaagggucccaggugaaagagggguugcaggugcaggaggaagaagggaucaaugguagacaaggccccugaaaagucgaaggcaguggaaugcagcucgccaugguaggguuagacucaggaggggacagaagagaacgaacaggauuggugugaaugcaggaggcgggggaguugugauuuugguggcaggacuuugaaagcguuucuugguggcuucuuauuucugccuggaaagaaaggcuagaauauuuuaaaacaugacuauuaauaggcucucuuucaacuuccccacucaucugugaucaucucucauggucaaccccuucuuuuaggauuucuaagucuuucgucaccaucauuuuggauauuguuuugcuagacacccaauugacucaaccuagaacuugaugcuuccauuuucccaugcuaaggugaacuucguaaauauaauaaguuaggcggguuuuggggggcugggccggaauccuaacaccauauacuguucaauguuuuuucugaguuguacgaugcauuccaggcccaaacucagucuuacagaugauauuuuggaacauaacucucuguaaggacucucccucgagugauuuuaauuguauuaggaaaucauauaaguugaaccuccgcaauuugucagucuuggaaggaaagccaugaguagccaaugaauggagucaggcuaagucugggcuuuccaucuacuuuuaguugaucaggcaaauggcaucuucuggccuuggguuuaggugcuguuauccugggcacuugauggcuguugaaauaauacaaaugcaucaauucucagcaagcaguagacaccauuuuccuguugggcaaaaagcaagcuuaagaaggagccauugugugaacugccuuuaacucuguccucacccacauucauucuagugaggaauccuuuaaaagaguccuuaaaucuaauugcaaucauggauccuuuccaagcuucuagaguagaauaucuccucccucuccaugcccaacuccaaaggaggcuuuuggaguaaaugcuuuucugcccacuagugccaggggugggccuaguggaagccugugcuggccugggccacccccaacccugggcugugcacaggaagacagguccuccccacgcccuuguucuauggcucugauuccacacagugacccuggacaugccaagcacugacauuccuccuucaugauaagccaaugagaucacaaaaaaggacucucaguuucuuccauuuaaaaaugauuuuuccacuucaguuugugccugagugcccuauuaaacauuucuuuuuaaggcauaaugacacauuucucccacuucucaccuugucagugcuggaagauuaaaaaaucaaagucccccaccagcucugcccuggccccucuucaugggguguccugggaugcgucaugugcccggaggugguuuagugaggagccaggcucacuucauaucucuguugugccgugcaaagaucccaagaagggaaaguaagugauuuauacgaaacacucaagcuuccucccuacccuccucuuccaggaagaugucauaaccaauacaucaggguguccagcgcucuguuucucccccgcccccaucagaaaucugugcaaaauuagagcuaaaccaugggacauauuuaauuaaaagacuaauggcaaauaagguucugguggauguugucuaauugcggucuguuagauuuuaauuacucaugguaaauugugaaaacuaauccacaaugugucuuugcacacuccuguucuuuuuaaucacaaagaaaauguucucggcagcugacaggaugggccucaucaucagcacagagcaacuugaucuuacacgacagugacucagcaacuugccgaauccaauuagcagcuuuguagcuacuuauucagaauggcuauagcaaagucucgcuucaaaugccacaaacagccaggucucccagccccugauucacuuguaugcuaacagcaaggaucacugccagaguggaacagaacagacggguucugcgaugaguuagaaacaugcuuuccccuggaucccagauuuuugucuguccucaccagagauugacacagaagcgcuaggaagcucuuggagacuuuuagagcugaggagccagagagagaucuuaguggucaccugguccugaugaaggagcuggggcccagggauggaaggcaguugcucaggauuacacagauggguaagaagaaggcccacaucauaggaacccaaaccuccugacaccccacgccuugcccuccccaagaccccccccaggucucucucccagguaugucuuaggaagggacagugugguguccggagagaaccgugcugacucugccccacccagcagggugaacuggcaagucaugacccucccagcucucaguuuccugauuguuacuguaagcguaaugcucuguaagagaguuugagaaguauaugagauagucauaugaaauugcccaaaacaaguagaaacucuuguuuuaggcaccuaaaaucccuucguucuugauuugagggcaaugagguggagagagggugagggaggagagagagagcaagaacauguguugugugaaaacauuaugaaucaaaguuacuacugcaaacuuugaagaaagaugguggccagaggggacucuacuuuggacaucaauuuauuugguagauaauaaagaaaaagggugcccucucggacauuuuucucuaggacucagaauuuauauuuaaaccucuguuccagcuauagagcucugcuccgugccugccaacaagauauuagaucccucugcagcuuucuccuuggacacuugccugcauuugugaguugcuguuuuugucauuggaauagaccaguuucuguaccuggaggcuaaagugaaugagugucuuuuaaugaaucgcagaaaugaucagcuguggcacggagcugucaguaacccagccucucuugccaccuaucaccuccccauguaacaugcauagacauuucaugccuuuguccuaucuguugaaaagggaacagcacgucugucuucucucucugcucuguuuugauuuuuccuaugaccagagguugcugcagagagugauuuuuaaaagacaaaaccaaacaggaucauucuucuuccaaaucaaauauggucaacguagccuuucagagagagacucaccggccauuaaaacuucucauaguuuuaaugaaaaguggcaguccagcaccaugguggugcugagagaggaccugccuacaugucacaugcagcuagaggggcucacaggccaggaauaguaugagauugccuacauagugucuaacacauggcaccgaaauuuuaguuaacaucagugcucuuacuuuuuucuuuuuaaguaacaccagggacacauaacuuuuuauuaaucuaaauaaauauguguguugcucauuaagcaaauuaacaaagcuuguaauacugauaauuauaguaacugcuaucuuuuauugaguauuuauuuuguuccaggcacuguguuaggaucucauacacauauaucuaucugacuuaaaggugaugaaacugaggauuagaaggauucaguaacuugccacaguggaaucaccuaguaugcacugagaguggguccgugugccuucagagccagcgcucucagcccuucugcuguuuugcuucacaguguguuccagggaguagucggaucucugggaagccugagacugauuguaacggccaggacaggagaucagcucuccugagcuauuuacuccagccuagggcacuucugcgaaaaccaucugagaguaucucuggaagacuggggcaucugaaaccacggcuuuaaaacagucuugccagagaguaaacuuaguuuccauagguugugaucugaaccaucauguuaauguugcuagcuucucacauccacuuccuuuaugaguucauuuuccuuuuuccugaaauauacccuucuuaggucuuucuucaaagguaugugaguugcagaccuuuucauugugucucacuuugaaaauguuuuuauuuugccaguguucuaaaauaacagcuuagcuggguauaauugauguagguugacaguuucuugguauuauuccauuagcuccugaacucuuuguagcuacugagaaagcuauuucuuuguuguugcuuuguaaguccuauuuuucuucucuaguuauuuccaaggucaucucuucaucuuggguguucugcaguuucauuacaaugugacuaauacaguuuuuuaaaaauuaaccccauucaggacuuauuauguuuccugagucugaagaguucauuaauucuggaaacuucucagucauugucucuuuagauauugccucucuuuguucucucuacauuuuucugauacucauauucuauccuauauguuucuuaaccuguuuuauauuuuccauuucuguccuucucucuacuguauuccaaacaguuccuuagaguugucuuccaauuuacucauucuccauucagcugugucuaaucugucauuuaacucugcgacucauuuuuaaauuauauuuuuauuuccauacauuuuuauguaagucuuuuuuuauuauacuuuaaguucugggguacaugugcagaacaugcaguuuucuuacacaugccauggugguuugcugcacccaucaacccgucaucuacauuagguauuucugcuaaugcuaucccaccccuagccucccaccccuugagagacccugguaugugauguuccccucccuggguccauguguucucauuguucaacucccacuuaugagugagaacaugugguguuuaguuuucuguucuuguguuaguuugcugagaaugaugguuuccagcuucauccaugucccugccauucuuuuuucauuaugcucuuucuugugguucuuuuaugucuuuaagcauuuuaaacauucuuaauuguuuaaauucauuuucaaucauuuaaguacuuuuuuuauuguucuuguaucugaaauccuugggacacugauccuucugucuuuuauguuuaguauauaauggguuauuucuucauguguucuguaauuuggggccuugagguuauguucauuggagcauauccugagacaauccccuguggccagccuuuuccucagugcuguuucugcauuuucuucugccaggucuucaaggguuagcaccuucccaagaccaguuuuaugguaauuucucagcuugagggucugagguacuguacacuuugaacucuaaauccacaugagacacagaccuggaauuuuaauuuucaggguaggcuucuucuccguguucuucaaauccagacagaggcaagauuccuuuuugccagucugugccaaggauauguuuuguuuuguuuuguuuucccuagucugcuguuacaucaaggguggcaacccuuuagaauacccacaccgggcaggaaucucaguuccaacuucuugguucaugucggccaaagcuuucauucucaggugaagguuaaaaucuaagcucuagguuacaauaauggauacuuucucugcuccagguagcuacagcauugggcacuuacugcugugguuuguguuauuuacuuuuugcgucuggagauuuuuuucccuugcuuucuuauuaucuccucagcuaccuacuuuuuuauaaagucacuacucuuacauauuguauuaguucauucucacacugcuaugaagaacaacccgagacuggguaauuugugaagaaaagagguuuaauugacucacaguucugcaggcuguacaggaagcauggccgggaggccucagaaaacuuacaaucauggugaaaggggaagcagacaugucuuaccauggcagagcaggagagagagagagagcgagggggaagcacuacacacuuucaaacaaccaaaucucaugagaacucacuaucacaagaucagcaagggagaaauuuuuucccaucauccaaucacuucccaccagaucccucccccaacacuggggcauuacaauucaacaugagauuuaaguggggacaaagagucaaaaaaaucauauuaacauuauucagcacaucuagguacauguagcaguagaaucuuuaguuuaucuuauucugcaucacucuagaacuuucuaagucauacuaucugauuauaaacuaacugucauacauaggaaaaauugugguagacaaagagguagacauacucuucgaucacauguuucagccaccuguccaaaacacacacuuuacccaaccugugcucauuuauuugcccaguaaaaaauucagcacgaagcaauggggccuaaaaauguugggccacaccaguagcuucuucaaggcaugacaguguuucacaauccccccaagcccguaauugaagccucuugacauuuugccuuugaaauuaacccaugggcagucuuauuaaauucugccuaagcauucauaauagacagacuucaacuugagaaaguugauuauguuucucuccagugccccagaaauguaagccugacaucuuuuuuuuuuucuuuugaaguaagaaaauaccaagaagagaacacuucuuuucacaaaguuuggaaauggacaacugcaacucaauacaauuuugaaagaguuuauugacucugacuuuuacuuuauuaguacuuacuuguuccaaguugcugacaaugcuucagucuuauggcuucaauuuuuccuaacugagggaguaguuaggagcaaauagcaucauuucuguuuuauugagaccuggagagucccuagauuuauccaaguagcaaagauagccagaccuccaaaaaaaaacugugcccuugaacccaacccaacccacuugccccaagcaaaauuacuuuuucgcagaaguauauuuuaagauuauucccucaaguuucaucaagggaucagccuuaugaaaccugcuagugcuuugaggugggauauagcugagacguugaccgcaaacgucagauaauguuuucuagccaggauuaagagcauagcuuuggaggcaguugcaugccuaaauuggaaucccaccucugucaccuaauauuugggugcaucucugcaauaggaggugacagugucugccucucaggauggcuguuccaaucacagccagugagaucauguggguacaagggcucuggaagccgcauaacuuuauaauuguucauugucucuauuguugcuacgguuacuauuaauaaaaugucuucaauuuuaccaacacugugugauggcaaggcccagagcuuucuuuaguuuuaugcauauuuggaauuuaaaaguuguuuucauagagaaguacaugguucuaggaugaguuuccaucaguuuguuauguuagcucuucaggugaagagguuguaugggauagucacguuccucccuagaagguaaaaaugaauccacaagacaugugccauaacugugauacagcuaugaaacaguaagcacaaacauuccagcaacuucugaauucagacaaacacuacacccuccauguggucuauguugaaguccuguaaugcagccaguuuuuuuuuuuaaagaauuuuuauaggcccaauaauaagccacaucaggaaccauaucuuguuacuuuaugguuaugccuucuuuuaacauauauggaauauuaaucaauuagauuacuuuuucucaccaauuuuggcucuaaauguugccgggccauuugcaaaaaugaagucucccuuuuauagugauacauuuaaauagucauuuauaauuauaaagugccugaaaaacuuauccgcucucaguaacacugugaagcaguuggaauccucacuguaaaacagggcuaccuaggcuuagagccgugaagggacucgcaccaacucacuucucuuacaaagaggagcucuaagcugagaauccagugucugaccuccucaaccaaccuguuuugugcuugucuugcugccuuuacgcucugcagagcaaggauuucucucucuuuggaagaauguguuccccuaaaugaguucccaucauaucuucaacaaguuucacuugaauuuguaaauucugagaugaguuugggcaaaucgcugucucuggaagcuucgcucucuccuauuguuaaaaaauggagucaauuuaaaguugcccccugagccuuagggguucugaggagcggaugggaaagggcuguguugaguggggcagaaggcuaguaugugggguccucuugccccuucagcuagagcagcuuugcuuugagcugugccacauacaguguaauuuaggggauacaaauaggaagggcagagagauugggguucuguuucauuagaaaaaaaaagaucuaagccaggaggcccugagaugguggugcucuaaacugagcuugacgggacaugcagaacuguuuucuccauguuauagaugagaaaacccauauguagagaagguaagcgaucuaccuagaucccauagcucagaggaggagaaugggaauuuaaacucagaucacagggccuugauaugugccauccccucugucugggacugcccgccacccgcucucacuuucuuucacuccaucgguuccuacaucggucaggccuuagcuuguugguacuuccacagggaaccuuccuugacuuuuaauagcccuuuuguguggccucauggcaccauguaccuucccuccauaacuuuuagcacauuguaauuuacauuucuuuguaauucuuuaacuaaugcgugucuccuaugcuagacuguggaaucuacaagucaugucuuguuuguuuuguuuuguuuuauuccaccauuagguccucaguacccagcagaauacauggcauaugguggguggucggcauucauuugcugaaugaauaaaugaauugaguggaugcaugaauggggacagugauguuaaacaucauaugugcugcuuccagggucccuuucgacucugaccaccagugguccuggcguuuccuagccagggcugucaugcuguuuugcugccaaaaacggguagaggaguuugaagggcuaucauggaggagaaggacuggagugaauccagggcgagugaggagaaacacaggacacacucgucagcuuaguauaaggggagcccacacugucagagcauggaaugggcugccccacaaggaauccaacauaaggccuggcagaaagagcucaagcauggaccagaagaccccucuggugccuuaccuuugacucugugauuucaugaacauguuacuuguaugaugaauauuuaaucaggauaucacugcuauauuccagccuagaauauuguagacggaggaggugcauccuaccagccaaaucccuguuuugccccucuucccuucaaucucucacuguuugucgagagauggugcaauuaauuagacccagaguuccccucaaagguauuugcaaaauaacagugucauuggaaauguauacaaauuucucuuuaccgauguguaauuccuucauaauuaacggacacugagucuuaaaguaauuaaccuauuucuuccauuagucgcugaagaaauaaaaguuuuacaacauaacacagucauagguaauucuacucaugaauaauggggguugagggugaugccgcagugaacuccuuggauagguggcucuuaauaccauaugggugacaugguaaucucauguccucugccuaucuuuucugaccuccaacuuguuuauggucugugccauucauuuaacaucucaguaguucucucuuauuugccaggaaugagaccucaagugaacaggaggcuggugucuguaugcagugaagccacucagagcagggucaucccagccuuucagaggagucuuuucaggaccugauccuggguccaguuuuuccugucgcuuucuuaaugauggauuuuuggcugugccuucucaaacagaaauauaaggcucucuucugugaccccaccccucccugccgcaucccagcccauuucuguacucuaccgucuguacacgcagaccagcugcucucagcuauuugcgauuccuuggacuggucugugcaggcucacaauucugucugugcucuccgcagaaagggcuuuuccucuguaccacuuaaccaugugccaaagucaugucccauccuuccaucaccaguucauuuggcgccagucugugaaacugcucugaucgcuccuggacagggugaaccacuuuguggacauaccauggccaaagccagcuuccuacggugauuguacacagccuguccucuuucaguaggucaugcgccgucugaagaggucccuauugggccauuuguaccuggaacauauacucagcaaaucuuuuuugaaauggaaggggaaauaauacaaugaaugccccuugccaccaguaccucuggugacguuuugccagcuggacugagcuccuugcucuccaccugucaaaauccuacuugugcuuuaacaucuagaccuaaucucaucuccucugccagucuacugacuuccaaguugucuaugguccaugccauuuauuuaacauuuaguauuaaugguuucauccuguugacugucuauucauguauaaaugucuuauggaccccaaguggauuguaauauagccuaauccuucuuucuguaacuuugagauacaucuuccccucacacuaccacugugucaugcacagaacagccacuccaugaauauguauguauugaucaagcaguucguauaccuguuugugucuccugcaauguccaccucagcacagaacaaauaaaugcugaucaauugcuugaguuggaaacguagcacuucaccugccacagaucuucuguucuguuaccugacucauccaccaaagugucgacacgauugggaggcugccuuguaacaguacagaguuaaaguuagcucuguugacuuuggcucugcagacuaagccagagagaaaaauaaaaucucuuccaaauuuuccacacaaacgaaaagcacagggcuuuggaaauaugugcaaaaugagacauuacuucuuguuagaaauguaaaaggauggcucagaagauaauggaauaguugaaaagaauguguuaaauauggccagacccugccauagcauuaagaguggaggaucuaaaaaaaaaaaaaaaaaaaagaggcauuuguauacaaugcaagguaucuucauugcuaagcuaaugaaaucaugaagaugcuccauccagggagggcagaaaccaaucacaugagacucauugcagccccccugcugugugcacaccagugagcuguugucuguuuuguuuuguuuuucaauauaauguggguucccaacuugcauuucuaguaauaaucacugggcaucauguguucaggguucaucuauguuguagcauguaucauaucagugauccaucuguacagacgaggaaguugaggcucagauaauuugucuaaggucauucaggucuuucugugugggcugaaguagagguggauaaccuucagcugccugaauaauaauaccaacuguuaacuguuagcaugaacaacacuuaacacuuuaccuauacauuuuuuucauucaauuccuucaaaaacucuuguuaguucaugaucuauauuuuagaaggagaaccuggacuagaaauuaagaacuagcccaagacucuguaacugagaagugguaaagcugggcgagucugcaucccaagucucuccauaagagaguccauuagauuuccccggagcaguuauugucauauacacacgcaugcaaggaccaaggagcucggccacaucccgcaggaggugcuuggcaggagacacucacugggaaguaccaggagaagucacagggagugaugggaauaaaaaccuggggguguuuugaaacaucccugaggacuuggcgaguauuugauguuaaaaagcauuucuugccugcaaaacacgugucucuaaggaacucuuacguugccgacgugugcuggcuaggagcugggcccggcgggggaggcccucucucucucugccucuggcccugccuccaucaaggccuggauuggaguugucuuucccaaggcaguaacugucagaggaaccaucuggacugguuucuugugacugacucugaggaacagaaaucccucugggaggaaaucacaggcacagcagcagcagggagcggcaacacugguguucacuggcugggagcugggggaggcaccgcucagaauggccccacaggagcgucaggcccaggacagaccguugugagaacgaggaggagaaccuccucuccuccucuggggagugcguguaugguauuugcgaaauaacaaagggaauagauggagggggcgaagaaguguccagagcauuguuaacugauggagccccaucaucugcacgauggcuuucucagugggcccugccacgcugcacuuugcccucauuaggccagcgugcuucccuccggcucccaucgcucauaucaugggcccauccuagccuugcccuuucuuccugugcaggcucugggaaugcuggaggauugcuugagccuaggaguuugagauuggccugggcaacauagcgagacccugucucuacaugaaaucaaaaaauuaacuagaugugguggugcaugccuguggucccagcuuuucaggaggcugagguggaaggauugcuugagcccagaaggucgaggcugcagugagccaucauugugccacugccacugcacuccagccugggugacagagcaagaccaugucucaaauaaauaaauaaauaaaaggaucucuucugucuucugaggugacuccuaggauucuagagccagaaggagccucagagcacauuuauuccacuccugucacugggggcaaaaaugaggccaguagagguuaaaugacucgcccagauucacacagucaucacaggagcuugggcuggcacccaggccuccugccuccaggccuguguccucuucuugcauuaagcccagagcaguucauuaggaaaaccguauagagucaugagacccuaagucucaugaucagaauuucaucuucucuucccuuuugguuuuuuuuuuuuuuuuuuaacauagagaagguaaagggggaaaaugauuuacuuaguuuccagaccacuuauuuaaauccugcccaaucugacuuccacuccucacuucacuguugcagccaaagcuaacuaaugcauccgugcuccaggggaaggaaucucuucccauccucaguccaaagucagaguccaaacucugaggaggguaaaagaaacacaggaaauacaagucccucacccccacagccucauuacacucuccaauaagccacaggaguaaaggaggaagauggggcggaugcguagguauggagcgccuacucuggguggcuggcucuguauuaacacucuacacgcccccucauucaguccucacaaacccuggaaagcaaguuuuguucgccucacucugcagauggaguuauugaggcgagaagggugauguaagcugcccagagucgcacagcuagcaaagggcagagcaggaauuagaaccaaguuucucuagcugcaaagucugguucuccacuccaccaugcccauucacuucuauauuuucaggagaggccauggaaccuguccucacuuccuccuccuccuccugccuuacugugccucuugcccgaguccagcccuacccacuaaagcauugcacguauugacccucgcagccaugcacagugccucugacgugggcagcuccagacugagcuucugcaucagacaagcaggagacagaugaggagugagccggggaaacccaguguuuguuacucugaaaauggaagcugccccgugacagcaucuucucucccguugaguaaucccugcaugaauagauggcagcugcagugacugcuggucauaugugaucuauucugggagguguugagcgcaccauccaagaacaugaagucgcugcucugucacagauggagaagcagacuauuguggauguugcaggagcugggauuuggcuggauccccuggaaagguuuuauuuugagugcagagccuguuugguugccaggguaaaccaagugguuguaugauagaggaauuccaacccucgcuaacacucugaccccuugugccagcuuuccaauaaggcuugagaguucuuuagaaaaucuccuucuuggcacacuuugaacuggagagcagugacacucuuggcagugcuuuugguacuuguuaguuguaucacuuaaguugaucgggaaaagaaaauaaucacuggggagggaccccuuuuaaacauuuauaguuuugagaaugcuucacugauccagcccugacuauacucagcaccuauacauccuugucuuuggucuaggggcucugguaggaggcggcauugaaauaugccauccccucccugcuguugcauucugccguccagcccagcucucccauuggcccacacggggcugccccucuggcccuggcucucggcuuccacacaagcagcuacucuuguacaggaugguaaaguuagguggcauucacacuggagcagggaccaggauccaagugaaaguaaguuucaggaaaagcuugagucauguuuccaguuucaagagccaggcugaaucucucagaaggggagcugacgggcggcagugggagaguggaagaggugggcccugggcacagcauguacuauggcaucgcucaucaccugccaauggcagggagcgugggcugucuuauauucuguuugccccucucaagagguaagcuccuagcaggcaggauaaccugaagcccucuggugggcccuguagugccgcacuguacuagacaaacagcgcgugucaguguucucggggaggugggagaaauuaugcacugaagagcaaaucucgggagaacaugagguuccacguggggugcgguguggcugacuucaucgccaagcaaguaccagccccuccugcugucaugggcguacuagggaacaguccuuugcucagccggcuccuggguuucugcaggaccucagcaggcugcuaacucccggaugugagcugguugagggcagauacuggguccccuucaugugcuucucuguguccaacucagugacugaaacaugcuguuuguugaauaacuaaaggaaucuaugaauaaacuggugacaauggaagccccagagguucaaacauucuaagaugccuauaccaaaaucuuuaaaaaaaaucaaacucuauccagugaccaacucauuuuagccaauaccccaaugcaaugaaauuguagcaccaaaaaaauuuuuuuagaaucucucuucaaacuccuuauaaugggauuugaccucucagacuuaguaaugggcaaucugguuuacuuugccuaugaguagaagcugugaaguacauaaaagagaacuuuuguuugccucuaaaacuccagguagucagugcagccuguucuguccuucggggcaggcuucuuguccugaugagugugccugcgugaguugggggaggacaguagcaaccucguggugcccaccccggcccccaugcucuuacccuuccuuucuuacccuugcagccaucccauuuucccagccagcugucuggcuucccagaccaccuuuuaaugccccuauaagcaggaaagacauuaaaucgucugugccccaggcacagcccaccccacucacagucauucuuccuguccagcugugcccucuguugguggaagggcagagccagagaggagcaugggcucauuccaucucauuuuuuaacagaacaguuaaaagaaauuacucuucuccauaacuugcaaaccuugucacuucuuagaggacauugggauuaaaggaagagggugacaguuaauagcugggcucugaaaccagauuuccuaguuuuuauuauuuuaauugaggaaaaauugacauaacauuaaccauuuuuuaaaguguacaauucagugguauuuaguaugagaacaguguugugcaaccaucaccucuaucuaguuguaaaauaugucauuaccccaaaggaaaaccauaucccuaugaagcagucuccccuaugaccccugguaaccaucagucugccuucuaucucuauagauuccccuuuucuggauaucuucuguaaauggaauuguacaauauguguucuauugcaucuggcuuucuucacuucuguucuugagguucauccacauuccaucuaguauccauccauguaucaguacuucauuccuuuuuauggcuaaauaauauuccauuguguggauauaccacauuuuguuaauccauccaaaaaaaauuuuuuuuucagacugagucucacucuauugcccaggcuggagugcaguggggcgaucuccacucacugcaaccuccaccucccagauucaagccauucuugugccucagccucccaaguagcuggaauuacaggcgcccuccaccacaccuggcuaauuuuuguauuuuuaguagagacgggguuucaccauguuggccaggcuggucucaaacuccugaccucaagugauccacccgucuuggccucccaaagugcugggauuacaggcaugagccaccgcgcccggccaauccauccagauauuaguggacauuuucaucuuuuggcaauugugaauaauacugcuaugaacauucuuggacagguuuuuguuucaacacaugcuaucaauucucuaggauauauuccuaggaguagaauugcuggauuauaugguaauucuguguuuaacuuuuugaggaaccaccauacugugguuuguacuauuuuacauucccaccagauugcuuaguuuugaauccagcccugccacuuacuuguuagcugugugagcauagguaaguuacuuauggucuuugugccucaguuuccucaucuguauaaugggucaguaaugcuguuuacucaaugggguuaugauacuuaaaagaggugguguaugugaaugccucagaacaguaacggguguacaaaacuggugcauaaauguuugcugcugcugcgcuguuacugagagacaguguaggucauggcagauggaagacugaaaaggguuugggcuaaaagaggcugcauugggugauauaaaagaaccagcagaacuagaauccagacacuuggaguugguugcugagggcaucuuucacuugaggaaucaauuuucuuaucuguucacugaugagcuccaagaaccuucagcuccaugugccuguggcuuuccucgggagaccacucuucaagaaugagggaccaggguccuccacuccugaccacuugccagcuccauucuuucagcucuccaacaugaaaaaggaagacaggaguauguccugucaucugaaagcuacacacagaaguuucuagaaaaugaagccuucucugucaucauucauguuaggaaaaggcaaaccugguugacuuucacuugauucuauugaauucaacagaaucaccaaacaaacauucugcuaaauaguauuucucucauaucuauauauuaugaguauuuaucucauaauccauguauuuaugaaucauuuacaccuaauucaucaaaaugcucuguauaaguuguuugaaucccaagaauccuuauagaggccuuuuucugagcacauagaaauaggaaaacagauuuuuccccauccaucuucaauuggcaauaacuuuuagaggugccauauuaccagcucuucugcuaggagggaccagagugaaacagugaaaaaacacaaugugauaauaauugccacaaugauacuuucaccucacacccaauuagcacuuuauaauuugcagaguccugucaauuucuaaacaggcccugauuucuccauaucuucuccaauacuuguuauuuuccuuuuguuuuuaaaaugagcauccuaaugggccugaagugguaucucauggugguuuugauuugcauuucccugauggcugaaguugaacauuuuuucaugugcuuguuggccauuuguuuaucuuugcagaaaugucuauucagaucuuugguacauuuguuuuacuauguuguuggcuauuuuaucguugaguuguaagaguucuuuguauauucuagauacaaaucccuuaucagguauaugacuugcaaauaucuucucccauucuguguguuccuuuuugacuuucuugauuguaugccuugaauuaaaaaaaaugccuaauuuugaugaauuccaaguuuaucauuuuuuuuaauuuuuucaccugugcuuuuggugucaucuaaggagguuuugccuaugcggucaugaauauuuacucaucuguuuucuucuaagagugauaauaguuucagcucuuauauugagauauaugauauauuuugaguuaguuuguguguguguggugugagguagggauucagcuucauucuuuugcauguggauauccaguugucucaguaucaauuguugaaaagacauuucccccuuggauagucuuggugcucuugucaaaaaccaaauaacuguaaauggagcaauuguaguuugaauggaaugggucagcacuugguggcagcaggggucuuggcuauguaguuucauaagcucccacuccuggagagccucuguuuuccucucaaagccagguuuuucugucucgcugcguuuuggugccugaaaggcuugggugggcaugguaccuggaguacuguuguucggagcacaaagugaggagaaaagaccacucuacuuugugggagguccuuggggcaguuugggcagcagugccucccccaggagucaggguccccaccccagaggaauguccacagagcagagccauuggccugagcuggacugaaaaagaaagagccagguggggagaggauuugauuucucccuuggucuaaagcaggcagcugacauugggugagggaauggggcaggccuccaugugcuaucgggaauccccaggaggucccuacagaaaacuuccacccccagcccagcuuguuuaucacagcccuucagugguaacuuccuccuguggcuugauccaaacgggggcugcauauguggccaaaaugcacauaacccugugaggcacagcauagcagcuuaucuucccugaaaguggaaggacaaaagcaggacaaagaugaccaagccagggugggagagaggggaggagacacuggaaggggaggugaaggggcagacuagggaggccaggaccaaggcagacucucaugcaccaggcauauucugcccagccaagggcucuggcauucagaugagggagagggagaggaaagaggagagaauccagugagaccaauccaugaagugucgggaggacccuggaagcaaaggcucuggacucagguggcaucaaugggacuaccaguuuccagugaauaugugggaguggccuagguccagcucaaucagaagcccauuuguucaaggcccugguauuacugaaggcccagcccugucucaccugccagaaagcacguggccucucccuggcuaggcuaagggcugguugacggcaucauaaaaggaaucugccugggagcccucaauuuguuucaguuuccucccccaaggccaagaagggauuggguugccucuguuguuguugcugcugcugcugcugcugcugcugcuggggguuggaaaagaggaauuugugugaccagauccccuuauuguauagaagaagagaaaugugagcauucagagauggugagaugucagacacccagccacacagccagugagagacauguuggggacagggccaggccugccaguucauggcccaggggucuuucucaugagaucaacugaccagugugucuuagcaccugccaugcaaauagaaggcccuacugcugucaucuccacguauuccagaauuacucagcuguucuaugcaagccaagucaacaccaaugucauaaaggagagacuaaaguaauucucuacacagcacauacacggcauauauggccuguaugcuuccuggacagccaacaggggugccgagggagugagucccucagccuugccuggagccuugcugauacuucaguuugccucacaaacacgguuaccuuccaugacaugaaggaggcacacgcggguugaccccugacccugucugcuuguuagaaucacgucgggaaccggggacaggcuuagaagcccaggucccaccucccaccugcugaauccaaaucuccagagcguggccugggaaaucaaauuugucagcuuccuucccaggggacuuugauacauccaccccaguggaaaccagcagccuccuuuagucaagcgaauguuucccugacugucaccuucucccccuguauaagaugcagauuguuagcgguaaaugguaccuggauuccaaccucaguucuccacugcaguuggggagaucuggccagggcaagccacacugcuccuucaggcacagccuuguucaucccgcacucaccuguguucucuuccucucuguaggacgcacaagaccagccacugcuaccgcaucacguaccgccacauggaacggacucugucccagagagaggucaggcacauccaccaggccuugcaggaggcugcaguccagcuguuggguguggagggcagguucugaugucaccacuucacucaggcugcagcccucuuggggcuccaggauuugcugaaagagaaaaagauaugguuugugaacuggggcaucaaucaucuuuugauaaauggaucaguuuuaggacuuucagaaaauaaaagaucgcucuugaaaagcu

SEQ ID NO: 192416 - RNA, 41150 nt, Homo sapiens
aaaauuuaauaauuacucuuuauuuaaaauaaauaagcccucuuacuuacagggaaaauaugaaagcaaacucuguccuccuggucuaagacagaaaccacauucagaauauguucauugaaaaaggaaagauuuguugauuaucaaacaaaucuagguacuucaauacacauuguuucuuugaaaaauaaagacugaaaggaauaauucauuucaaaaagucacagguuagaaaaccaauuuuccuucugaggcucauuuuagcaaauccuccaaguguucccaaaucuuuuaaaaaagcuacauccccugagaaagggcccuuucccuguagcccucuugcucugacaccagcagcccugcacccuucugccaaguggcucccugcaggacggugcuguugccgggcaggaauggcccuccauggcaaccuccagcaggcaggagcucaccaccugcuuucugcaaacucacucacuuggcucagcuauucugcaauggagaggaaguuuccuuagcagccaaaguauucuaaguaucacauuuuccaguauuuuccagauccguagugugcucagaaagccagagcuguaucaccaggcuuuuagagaagauuaacaccugcacaucugagugaccuuuaacaggcuccgcagcacugaacgccugcagacacugcuucaugugcccuuuaaugcugaucaauuuccagauucaacaguuacacaaauuacauugucaugaaaaacagaagaaaaagccccaaagucuuuuucagaccuccccuccuuacccaaaauacagacacacaggcaagaacucucauaaauucaaauucaucauuugagagguugaagccuccaaggauucuucuagcuccaggguacauccacuguaugcuuccagauguuuuuuccagauuucaacuaaaaugagaaaacagcacgagugaggaauaggcaucaacaaguaggaaaacuccuguaagaaaaccagcagcaugagagagggagccuguggccacugcccagcagcucacggugcucagaggugcccuggcagacauucacucacuguucucagccugcugggccgggcugccccuuauugaggagaagcuggggggccaucuucuauagggcagcuggggccuuguguagguaggcuaggagaggacugaaccuuuacuuggccuuccaagccugucuuggguacagcuauccuuaaggccacccauugucaaaagacaucugacuugaagucugagacagucacugacaagcccuucccacuucaaaagucugauaauaccucuuaggcaaugggcuggacuuaccaggcccugcuacucagcuggucuugcagcauugucaagcugcucaccuagggacuccuaauuaaagucaguaaauaagaggacacucgaccugacacaacucucccuuaagcacucacuguaguguggcucuucuuuuucuuucagggcuggggggccaucuucugcagggcagcuggggcccuguguggguaggcugggaggugccugaggccugggcucucccaccagcuccugcugcacauucuccagcauggucuuguacgccugucgggccgccacugucagcucaaccaucuuguggaacugauccuugggcacaagugagagcacacagguaacaucccagcuacagaggacacgggucccucaaacucagcaauggccaccuccacagagaagcaggggugacaugggguaauguggaccucaugcuuauggguggguaccagggaugcugccccagaggaaagagugggcuaggccgacuucuugggccugccugaggugccacuaugucagcagcaagcccagaacagagcucaguucagaaccagacaacccaugaugucaaggagacaaaggcuacuuuuuuauaagaagguucugccuaagugguggcuccuccucaaugacagccuacuggagguucuggggcugcucugugggugagcccacacugaccaccugcccccacuuccucccacgggcagugacugaagaggccugugcccugugcacucaccugggccccaucauagcugaagauccccaccacacugacaggaacugccuuauucaaacugcgccccagagcuuugcgguugagagcaaacacaaagggaauguucugcucacaggcauaaucaauaauugugugcaaagugucauccagcccaccuggucaaaggacaaugaaaaaugacaggaagacaugucacauggagugugguguuaauacugguugcaaagagcuuuuucuuagcaacacacccaucuaugauuuuauauccaaggcagacgccccugaaaauacaaggagaaagcaaguugcagaaucaacucuccaaaaauauggggaaaaauggaaagaaaacacacagcugguauugucuuaacaggaaaaguuaacuauuaguauuacugaaacuuaccaccuauuagcuccuguguccucccccaaaucccaaaaggcagacagaugcuguguccucacugacagaugcacaaccagaggcacagaaagguuaaguuucuuaucccacauuguaccccuggucgaggcacaggucuggcucccgagggcucaccacccucuacucccugacccugcuucugggccagggaccagccaaggcuggugcaccagagagaggauggaggugaaaugaguaccaugugcaggugaugcaccuggaaaacccaacagcaccugagaaguacuccuaacagcaugagaaauacaugaggggguguggcacaagcacacagcagccaguuggcauauaucaaagagaugacuccauuuacaacagcagcacaagacuauaguugguaggaaugaauuuuucaagaaacaugaaaagauuuacaggcaacuucagcaugcuguuaaagaacgcaauaccagccuacgcaacauaguaagaucccgucucuacaaaaaaaaaaaagaagaaaaaaaauuugcccaguguggugguaugugccuguagucaaucuacucaggaagcggaggcaagcucaguaacuugagcccaggaguucaaggcugcaaugagccaugaucaugccacugcacuccagccugggcaacagagugagacccugucuuuuaaaccauccccgcaacagaaaaucugaacaaaugaaaaggcaccuaugcuccugcauagaaugauccaaaaugaugaaaugucaacuccacauuaaucuaacacuuuaaaacagcgguccccaaucuuuuuggcaccagggacugguuucguggaagacaauuuuuccacggacaggggaagaugguuuugggaugaaacuguuccaccucagaucaucaggcauuaguuagauucucauaaggagcaggcaaccuagaucccucacaagcgcaguuuacaacagaguuugugcuccuaugcgaauccaacgcugcugcuguucugacagaaggcagagcucaggcaguaaugcucaccuccugcugugccacccaguuccuaacaggccccagauaauacuggucugcagcccagggguuggggacgccugcuuuaaaauacuguaaguuacuacagacgggauuucacuaagaaauaaaaaauauggaaaaaauauaaaaagaugucaggcuaacauggucagguauuaaaguuuacuauaaagauaccauaguguaaacaaggugaugcagauuaacaggauggacgccagaaaaaaccggaguuugauggaaacagcaugugaggaacagcauuuugguuuaguuagggagaagauccuagaggacugggugggcccauccuguccaucuuagaccacaauaaauccuaccuaaacauauacaaaugaaggaaccaggagauauacagaauuuuaaaagcaaaccuuuuaaacgcuggagugggaaggcugagaaauaacacaauaccuagaugcaacuaaaaaaugaaauaccaauauauaaaacaccuaaagucucugcauggccaauuuuuuuuuuugguggagaaacugacaaaccagaagaaauacuuggaacucuuacccaaagggcuaacuuauaaaaaagguacaaaucaaucuaaaagaggucaacaucccaaaagcaaaugggcaacaaauaugaacaauucacagaaaaugccaagcuccugaugcugacccucccucauaagaaaacugcuaauaaaaacuccuggagaggaugcucacaccacccugggagggaacacaguggucucuggaggaaggcacagcauaugcuuucgaguuaccaaggcacacagcauuguaggccaggcaucuggccuacaggauacucacccagucuuuacggagcaacuguaaaaaacaacaacuguuuacaauuagcauaguaucaccuggaaucuacuuacauaucgauccucucauuucaagagaagaacuucuccaaugcacguccuaccauacuguggaaacugggaacucauucugcaucuaguuggauaggagauuaauuucuaaacccacagcccuuauucugcccacacccugccccugaucuacccaaagcauuugcaaagugaugaggaggcagccuccugggauagaaacuuugaagaaaaagaccaguuccagaugggcugggaaaaggggagauagggcagaggugggguggaguguuccguauuccugagguauacuuacagugaaaucuauauucaguuugucaggggagacauaugaagucccccguaacaucagaugcaucucucucacuggagggucucugccugguguccaccccagcucccgggagugaaucugaaauguuauuugagcacugugcagaaacaaccuaacagagcaggcuuggcugcuguccucucgaggcugccugucagguuggcccuugguuggggucugugaacuuggauuuugggaggguucccaccaccuuaacugguaagaguaacucacugugccucuauggugugcaaacacugugguuucugcugaacaccugcuuuccuucuggagucuggaacuuugugugugcuaggcagaggaugccugcgugaccggcccccaacagaacccuaggcgcugagucucuaaugagcaccccugguagacaacacuucccacgggcucuuaacuugucucugggauauuaagagucuccuaugugaugucacuaaaagugacuuuuggaagcuggagccugguuucccccacauuuaaccccaugugccucuucgcuuugcuaauuuugcuuugugccuuuucacuguaguaagucacagcugaaaguaccacucuaagcugagucaugugaguccuccuggcacaucacugagccuggugguggccuugggaacacccaauacaagcagcaaaauccagacuguuuugcucaaacaaccuccaacccguuauuagugagaugaaagcacguguggcaagggccaacuacugaaguuccacaagaaagcuuaugucaaacaagcaagaugcuaggcucagauuauuuccauuucaaaguuuaaguucagaauuauuagguuaaaugccacucagagcaaauacaguacuucaacuuaauucaaggcuauaacaucaauuuuuaucuuuaagaugacugcaagccauuggcuaucuuaucuggcaaauauuuauaaaauauacaaucaagucccuuaugccucaaagcaaaaacgugucggaaccaaugauuacacaaaugcauuuuaaguauacaacaaauccuuaugaugcugaucaaguaaaaaccuagccccaugcucuggcagaggcagagaaggagaaugaugucuuccaagaaaguggggugacugcaggcuaagggcauacauuuccaccuuuuuguuuuuuaaagacacaaauccacggaagaaugugagagacaacagcaaaaaguuucagaagcugacaugcaaauggacaacugagcuagccaaccuaagccaacagugagaaaagccuagaacagccagcccuggaccccagaaucccccaaaggucgggaauaggcagcacagggugaggcacaggugaagagggcugguugaacacugggcaaagaggcaacucgguguccagccccucagcugcagcccucuggugaggcacagcacagguuugcaggacaugacgcaccacacaucuaaugguggugagaggaugagcucacagggugaaguucgccugucccuccaggcaggcagugagaagucuuccuuggggaugugaccagcccuaggggagacagagacacccaggggcacuuccaacauggaagcagcccaaccacaucauccuacagcagaaguucucagugcacuccuuggagaagcagcaacagcaccugggaacuugcuggaaguacaaauucuugggcccacuggaccuacuugaagcagaaacucuggaaucuguguuuuccccagcccucugggugauucugaugcuggcuacaguuuugagaaucaccacccucaacgcugcucacagccuugaacagcagccacacacccggauuuccagucggcuacuuaguggcucuuaaguaggcgcagacaacuaggacacagaggacaucuguggaaaaccuccaccaugagaggccaaaacaaacagagcaaacuaccuggaggaaacagaggcacugcagggagaggaacuaggcaucauuaaaauucuccaagaggcaaccaugaggcagcagcaacgugauuaaaaaaaaaaaaggaaucuucagaggacaaaaacagcucccaaaaaauaaaaauaauaucagaaguaaaaaauuauacagaaauuuuacaagauaugguugagaaauucuaacagaaaaugaaaccaaaagaaagagauaaaaagaagcaggaaacaaauaaugugaggacaccaguccaggaggcccgacccugacauacuuccaagagcuggcagggacuggagaagaggauucaaagcaaaaauucaucgugucccagagccaaagacacuggaugcaaacugucccacauccuguaaccccaggaucaaggcacuuccagugaacccccagagagcacgaggugcaaaaugaucacaaaggaucaagaaucagagucucuggauuucaagcaagaccuucaaaauaugccucccaugaauccuuuucuccuaaaccacuggaggaugcacuccaacaaaacaagagugcagcccaagaagaaguccauaaacaacaccuuauugagagcagggugggagccaaggguaucccuggguggcaaaugcaugaggugcagugagcugggaaugaagguuucuucagcagaugaaacugcagaaugccugguguaaccgucuuagaggagacugaggcagcuggcugagggcaugagguuucauuaaugcuaaguauauagacaauuaagcaaccaccacaaaacaagaacaauaacccaaacuauacauuaggggaaguaacagcaaagcccuuuugcucuauugggaagaugacaaauacuuaaaacugaaaacaugugaagcaguugcucacaagccucuuacauggagauauggaggaaauaucccacaguguggcuaacagcugacagguggaguugcuaggaaaggaagggagcccaagccugccccucccuuaacaaacccuauaggacuacuugacccuuuagcuguggacauguacaacacugacaaaaacagccagggaagcauguggccuguccucuccaaugaccuggaaaggccucugggcacacaaucagaugagugggucacugagaucccuucugucauauucuggucagcggugaugcuggacccguaccaaguuaggacagggacgagcugcuggcugggggccucggacaugucacaaaacuuccaggcuuuagauaugaaaugguaacugggaaacaucaucuuugaggguucagccccaggauguggaugcauuaucucaaagugggacuccguaaagcugaauuugacacugcaggagaaaggaaugaggccagggaggggcuugugaguguucccuagccuagauggagaugaaggacagguguccaugagcaaugccacucugcucuuaucaguucuccuauugcucaauucgaggacacaacacaggcaaguccuccaggagccaagacagcacaagcacaggguaaacaugagaugucacaggugaggguucacuguuaccugacccagcauaucacauccaacaaaacaaaaacacacauuccaguuuaaguaaaauggcaaaguauuuagacaaagccacaucuguaacaagcaaacagaugagucaaccacagacugaacaacaaaaugucaaguagaugaaagcccuagguagguacugccuggcugccaggcacagcaucucuguggugcaagugaccagugacaaucccagccccagggcaguggccugcacaacagaggcaggucuuucccugaugccagaggccugugugggcuggcuggccucccagcgugcaggaucacaggacccaccugcccuacagaggguaaggcacuugguaauggucaaugcaguugggaaacaguuacucaauaaaaacaaaaaccacaaagaaaacgaguugucaagaccuguggcaugggccgcugagguguguggcaaacacgagggcacacuaggcacucaugcaggggcccacauaucacaggaccacacugugccuuuaccuuuugacuguaucuucucacaguugggagaaauaaugacacauuucaguuuuuugagcuucagguguuugagaaccucccucaaccccaacacaagucgacguuuagucuuggccuugacuggaucuuucugguacauacggucuuggaaacggaccaguucuuugaguaggucgguaacacaagcauccacuucuuuacuaagcaucuggcugcaguaacugaaagaaacaucagacaucaggaauugugccacuggcugugacacugcagcacugcucccaucccaccccagggagaagagacguagacugcaucagacaaaaagucacguuucaacaaguacuacuaaccagaacuguggaauuccugaugauuuaauuuuaugaaagguaaauacuggggcaucuucccccauucccaacuacaagggacaaauuucucugggcccugcccaaccauaguuugccacagguccccaucucagccacuaccccgugcaucucccugucauaaagacaaauaccgggagacuauccuggaagaaaagugggcaggggagaaggcagagugagcacacaagguuaaaggaauccugcugccuaagacauuacacagagauuaaaccaugaaaaggggcccaaagaugaugcacggucacuucacuauccacucccgacugcaaaccuggacugagggccccucuuccaucauuaauacaagaaccucaguagaagcagaaucagacacaacgauuaggcucucccugaaugcguguaaccagguacccagcuucuuucaaccaugagguuuuuaaagcacaguguggcccagcaacaaggauuuaugggagauaucaaugccauacugaaccgaagcacuuccaucuuccccuagucccuggcaggcaggggcucacucacucccugaaucugcggcuguggaucuuagggaagguggugugauugggagcaaggugggaggccucugugucccucuggagcucugugccugguggcucuucagacuuguccucaaccgaaggaguggagaucaguucguccauccccucuggcccuucauggaggaaaaaggcaucaucagauaucugugaggcccagugcacacacugaggggcuggcccaaugcagucucaccgaugcaaccagaccccugcacacaaccaccacauucacagacaacaugcagagagguuuacagaaggcagaaaaaacagacgaggaugccuggggaaaacagaaaagcugguggaggcagucaugccuggaggugugccuccccucaauuuacuuauacauucauuuuuauuaugguaaaauauacaucaauauuaccauuuuaaccacuuuuaagugugcaguucaguggccaaauuuauuuuuugauuuugaagaaucucuuaucagggagcuuuaaaaaacaggauuuuaguucuaaguuuuuucucaaaugcuugagaccauuucuuuuugaaauaauccuuuagaaagagcugaacuccaacaucuaaacuaugagaaacucaagagguguguuuaguuuaaacacaccagaucugaugcagugauagcuuacuguccccaacuaguuacuucuaccgacuaucaaaaugcaauugcaguaacagaucaccaaaugaaggaaugaaaaaacauauaccacacccacaagaauggcaagguugaaaaacauagugccccgugggcugguagagauggggagcaccugcaacucucagccucccuggggcuguaacugguagaacagucagaaacccauugggcaggagcuacuaaagcaauucugcucccagguaaugccccacaggaacgagugcuuguguccuuuaagacacauacaacacuguccgcagcaacccuguuucuaauuacccaaacuggaaaaugccugaaugcccauccgcaacccuguacauucguccaaccgaauuuuacacaguaaugaaaauaaacggcaucuccauguugccagcaaggcugaaggaaaggggacaaagagagcagcacguaacacacaguugcacuagagccacagccacagccccuggugggguugccauggggcagggucuccugggggaggccucugacaagagggcacaagcaauugcugggcuguguuuugcuucuugaucugaaugcggcggucacugugaaaagucuucaagcuguacacugauauuugugcacuuuucugaauguauaacugaauaugaaguuuccuuaaaaacacacaauuguguucacgcccccacgucuccaauacuugcugguaagcagcugugcagcuagcgguguuaauucucaugaccacuucaaguuagaggaccauccagcaucacacagaucaaaccuggugggaagggaggauccucaccucugucccucacagaccccagaaccagagggacuagaaacacuccccccaucuguggggaccucccuucccuguaaagcugggagcucaaugcugacccacuuucaccacaaaaggaagaggagucagccaaguccuggagaguuugcucagcauagcucauccuuuucauaguugcucucguuuaaauuauucuuaaggcacaaagagaaguugguaccugacagcucugccugcucgggaaacuggucaucaccaccacucucuccaucuugugugucaucacugguaaaagcuggacucacagcauuuucuuggagacgcugcuuucucucuugccguucuuucaaaauaaucuuaaaaauuaaauaaacaauuaaaaugccuaaauacuuguacuuaaaagauaagcucuucugcaaauuaaacugcccaaguucaacuuuuuggcaaugugccucuuagugcccugagagcagccaagugcuccccagacuccagggagcucacccaacccuccccgcugguuuuggaggggcacguuccucccaagguaugcagagcagccacaggggagagcccugagcucuaaagacaauucugcagcucagcacuugccugagcaccuacaccacaggcugcuguaagaauucaccggagggaggcugggcgugauggcucaugccugcaaucccagcacuuugggaggugcaucaccugaggucaggaguuugagacuagccuggccaacauggugaugagaccucgucucuacuaaaaauacaaaaauuagcugggcaugauggcacacgccuguaaucccagcuacucgggaggcugaggcaggagaauugcuugaacccgggagguggagguugagguugcagugagccgagaucgcucuauugcacuccagccugggcgacaagagcaaaacuccgucucaaaaaaaaaaaaaaaaaaaaaaaagaauucaccggaggagccugugacuguccuucuggaaggugugcaagaagugugcauuauucacugacucucaacaucagaaauaucagcuaggguaggaugaagggggaucauaagaagaagaaaaaugcaacuccucccauuucugguuuucuguccauccauugcaaaguugaaaaaauaaaacauguuccuuuccucucagguagcuaaagcauuccccacaucacaugucccugacgugucacacugggagggugagggaucauuuguuggaguaucauuaacacguuuuacuacaacauauucaaguaauacaagucguaaaaucuaaaaaucuaagagcugggagaauaacuauggaaaugugagacuaaguuuucuagugccucacuucggcugaaacaccccacauaccuucuucagugagguuggcuucuuggccuuggggaucucccucugcuucccuuucuucaucaguggggcgcuggaguccaagggauugugcggggucuucauuugacucaugcggcggccucucuccccugaugcacauucuuuggaaaggacuggcacugcuccaacugaaacgcagugggacaaagcccucacggucaccucccagaugccccacccagcucuuggaucgcagcucgcccaggggcugccucaggguaucugaaggaguuugccaagucacccccagcuuguccccacaacccuucucaucuuugagaacaaucucuuacacauucuuuucauuggcaguaauuccaaaugaaacuuaguaucuuuuggaugagauucccaaaaaguaucaaguaauuuaggaacaccuaccuuccuauccauguaaucagaucucccauguuucucaguacagucuaauacagcauggaucucauuuucugacucaggacaguucuagguggucugcacucacugcugcuacugugaacacgucccucuccaccaccguuuccaguugacacugccuuuguggaagcuggcccuauugguuuccgcauguguaucuuguaucuagcuaccuuauaaggccacuauaagauucuaguaauauuucuaguuaauucucuugaguuuuccagacguguuuuccaaaaucccaucaugggcaguugguaauuccucuacauagucaguaaauuauugugauuacuacugaacauuucaauuuuauucuccuuuucuguucuauuucccaucucaauaguuauuucaaguaaucaguuaauucucauauaguuuuauccucacuuuuugaucuggaaaauuuccaaacauacgccaaagaaaaaagaaugguaaacaaacccccuguguccaucguccagcuucaacaaucaucaauauuucuccaaauguauuuuaccugcccuccuuuaauuuuggaacauguuuuuaaaauaauuggugcuuugucaaucaggcagucccacuaaaucucgccugucugacugucugauucacugcuucaacgcagaacguaaccugcacaggucaaccaagacaacuguaccugccucccaggcugcucuggccuuagugagcacagcugcuuccaucuuuggagccuuguuuccacaugggguuugaaacauacaugugacuaugugacuggcucaauuguuuuucucagcucuucguggaaaacccuguauggcucauaggugcucacucacccgguccccaaugacaccaccaaguucagcaucucaccugggcuccugcaaaaccugccacaagcccucuagcucuacaccuccugcaccccacugccaggcaacucuucacaaagcacugacaccgggccugaggaggguccuuccuacaacagaggaagaucaaccauucccucccacaaaaacaaccacgaaguucaacagaacugccaaacacagucauaucagcccucuggaaagugaccaaaggguuccaacaaaccgaagagugcuuacuccuuaagaugaguagccuucaggugggaacaguauagguguggacacuccugucugaggcuuuucccagagucucuccccgcucugcuuuggcucauucaacaggugccaaggcuaugaaaaccagcagcuucccugucacugccauaaggggcuugcugaauucaaagcguggucauucaaagcguggucauuuaaaguagugauuucagcaaauggggaaggcauggcagcauggccagucugaggcugccguuuugaacagucaagcaacagacagggccaggccaguggggacuuacacagaguccaggggaagacucgcuauagggaugagcuauggggcggucaacaagaauuuuacauucagcaaaacuaaccuccaaaaagugaaugcaaaauaaagacauuccagacaaagaccaugagaauuuguugcuaguauugcuugugucacuaauaccaaaggaaguccuccagaagaaauacuaccagaagugauacaagauggcaacugaauccagaggaauaaagaacaccuaaaaucauaaauaugaaacugguaaauacauauuuuuuccuuguuccuucucuucuuuaaaagauauggcuguauaaaguagcaguuccaacacugcaguguuugguuuauaaucuauuuagauguaccauaugacaauagcauaaagggggaggaagaaaauggagaccuacuggaguaaaguuucuucaauauauaaacuaacauguauauuguaaucccuacagcaacugcuaagaagguaguuuuucaaacuaaaguuaaaaaaaacaacaaagaaaucaaaaguguacucuaaaaacauuuaacaccaaaggcaguaaaggaggaagcgaggaacaaaugacgaaguugacaaacacaagcaauggggaaaggacucccuauucaauaaauggugcugggauaacuggcuagccauaugcagaaaauugaaacuggaccccuuccuuacaccacauacaaaaaucaacucaagauggauuaaagacuuaaacguaaaacccagaacuauaaaaacacugaaagacaacccaggcaauaccauuuuggacacaggaacugacaaagauuucaugacaaagacaucaaaagcugcaacaaaagcaaaaauugacaaaugggaucuaauuaaacuaaagagcuucugcauugcaaaacaaaccaucaucagagugaacagacagccuacagaaugggagaaauuucugcaaucuauccaucggacaaaggucuaauagccaacaucuacaaggaucuuaaacaaauuugcaagaaaaaaaaccccauuaaaaagugggcaaaggacaugaacagacacuuuucaagagacauacacguggccaacaagcauacgagaaaaaccucaacaucacuuaaucauuagagaaaugcaaaucaaaaccacaaugagauaccaucucacaucagucagaauggcuacaacgaagcuggcgagguugcggagaaaaagaaucgcuuauacacuguugcugggaguguaaauuaguucaaccgcuguggaaagcaguguggugauucagcagaccuaaaaacagaaauaccauuugacccagcaaucccauuacuggguauauacccaaaggaauauaaaucauucuacuauaaagacacaugcaugugaauguucaccgcaguacuauucacaauagcagagacaugaaaucaaccuaaaugcccagcaacaguacacuggauaaagaaaaugugguacauauacaccauggaauacuaugcagucauaaaagagaaugagaccacguccuuuguaggaacguggauggaguuggaggccauccuuagcaaacuaacgcaggaacagaaaaccaaauaccacauguucucacuuauaauugggagcuaaaugaugagaacacauggacacauggagggaacaacagacacuggggccuacuugagggugggaggaaggagaauaucagaaaaaauaacuauugguuaccaggcuuaguaccugcgugacaaaauaaucuguacaacaaacccccaugacacaaguuuaccuauauaacaaaccugcauguguaccccugaaucuaaaauaaaaguuuaaaaaaaagaagauccacagauuuaaaaaaaaaguagaguuuuuugaaauaauaaacuacuucaaaaggaagaaacauaucuaaaagccuaugguggaaaauuuucauguugcuuuuuaugacauauugugcguuuuaacugucuuggcucuuaagagaagaugugucagaggaaagaggcagccacaucagcacuacucaacacuguucccaguggugccccaugcacaggcaguaaaccauuuccauggaaugcagcuuccucacccagacaguaaagaucuucagaaacucaggacacuucuacagauaaggagauuuucagcuacacaaugucaucauaucaaguggaaagcucaucuuuuaauaagaucaauuuuuaaaaaucauccuauuuuaauaacuuaaaaauguuuuaauugugguaauaugacauaaaauguaccauuuuaacuguuuuuaagugcacaauucagcugcauaaauuauauucacaauguuguguaaccaucacuacuauccauuuucaagacuuuuuaaugcuccaaugaauacucuguccccauuaauaauaacucacuauuccuuuuccccucagccccagguauccucuaaucuaugcuuuuaugaauuugccuauuccagauauuucuuuuagguggaaucacacaguaguuguguuucugugucuagcuaauuuuauaugguauaauguuuucagguuucuuucauguuguaucauguauaagaauucauuccuuuuuuaagguugcauauuacauuguguagguauaccacauuuguuuacaccauuaugugguaaugaacauuugcgcuguuucuaccguuugguuauugugaauaaugccauaacaaaccccaguguaaaagugucuaagucugucuucuuuuggguaaaugcugaggagugaaaucgcugagucauguaguaacugcauugagcauuguuaaguagccaccagguugucuuccacaauggcugcaccauuuuacauucccaccggcagcguacgggguuccaauuuuuccacaucuucacugacaccuguuauuuucuguuuuuggauuauaaucaucccacuaggugggaaauaguauuucacuguacuuuugauuaauauuuauuucccugaugacuaaugauauugaguaucuuuucacgcacuuauugaccacuuguguacuucuggagaaaugucuuuuccaguccuuugcccauuuuuaaauuggauuguuugcuauucagcuggaguuccuaaauauuugaauauuaauccccuaucagauacaugauuugcaaauauuuucucccauucuguaagaugucuuuccgcuuucuugauaauguccuucgguaugcaaaaauuuuuaauuuuaaugaaguccaaaguuuauuguucuuuuguugcccaucuuuuuggugccauaucugaaaauccaaugucuaauaaaagaucaugaagauuuacccguuuucuuuuaagaguuuuauaguuuuagcucuuauauuuagcucauugauucauuuugaguucauuuggaucuauggugugagguaggagguaugacuauucuuuagcauguggaaaucuagauguucuaauaccauuuuaaagagacuguucuuuguucuauucauggacuuugcauacuuaugaaaaaucaauuggucacagauccaugaauuuauuucuggacucuuaauucuauuccacagguccuuaucuaugcuuauucuagcaucacacuguuuuaucuauaaauaacuuuugauaacaagagaaaaugguaacauaauaaucuagcugaaaaagacuuccaaucacuugccugagauggaaagacucucuuaccugagacuaccacugguuuggaggacugcuuugcaugcugagagugcugcuucuucuccagggcugucagcaugccccccaaguccaacugcacuggaagcuggcucuucuuuacauuauuuuuaaaauuauccugaaaguucaaaauucguaaguuuacuuauaaaacuauacaaacugugcuuuucuuuuuacaaaaaacugauguaaagauaaaaugaaaaagauugagacuauaaaaaagaauuuuuaaaaauucaaguaaugaaaggaaaaaaaaucaaucccacauuaucugccaguauuaccaugguuguuuaugucuuccuucuuucagaacauuggguuuauauuaaaucaccuacacuuuugucuauaucuccauugugaguagucaacaauacacaucuacaggcaagacacuagcacuuguauaaagucuuuggcuacaaagucugugugugaggcuacuugguuaguacuaucgccucauuagcccauucucucuccaaaugccuccguaaaccaacaaaugccaugaaauuauagugauacaaccaaaagucuacauaagcccaaaucauacucagcaaauaauauuaaaugcaggcucaaagucugauaugcucaaaacaaguguuauuuuugaaauuguugugauuuggguuuugagacuauauaaaaaguuguacaaggaagcccagugguauguccugaggcauggugucccauuugcuuuagugccuccgcuccauucuccugccaaguguucucuuagaggacaccaaaaacccuacuggcugagggcucccaucaggggaaaguaccaagugcaacaaaggacaggcaaggaggccugcuacauggaaggaagaugaguaaauuauaacauugaauugaaaguuaacucacacaaagguuuagaauuuuauuuuucaugaaugcgaaaacaacagcccccuuuaaaaggcaaaacgacaaugaauauccuagcaaauaaaugucuacaaguacacaaguuccccaucuaaauuaugacucacaagcucccuccugaaucuacgggguaggugguggaguagagaaggggaaucaccuccacuuuagcuucuauuuugacuucacagaguaaaacuguggugccucucuuauuuuucuucugucagacauuacugacuugcaaaaaaauucuuccguuucccaaauaaacugagucaacuuuuuccccuuaaaguuucauaaggcaguaugaucccccuccuuuccaacuuagcaacugcaguuaccaaaucuuauuauaaaauaauaaucuuauaaaauaagucuuauuaucaaauaauaaaaucuuauuauuuaagagcaauucuguuucaacaugcugggugcaguucucucaugaaggaaugaaucaaaacaaaaccaccugucaccauacagaaaugucuggaaagcaguuuuucucaagcauuuaguugagccagaagaguuaagccuaaagcaauuugugguuucaaucuaaaaauuaccuguggcugcugcuuagauugaaauuucggugucucuauucugucucuucuuucagaugcaacugccagguugggaaauuccucggcauccuaaguaaaccacacaccccuuuagcucuuuuguuaaugcaaacaugccaagugcaaccuuuuccuugcuuauauuuucauucuucaguaaggucccuuaaaagugauuuaaaaaaaaaagccgcgaaacucucacauaagagcuucugcuuuauuuaacuuagagcaaauuuaaaggccacaguucuaauaccccuguacccaaaaaaaagagugucaccaacaaucuugguacaccgagggaucuaaagaacugaccuuggaccaccuuggcaugagaguauucaaguaccuguucuucaaaggauuauguuuuucauuagagaaaccauccagauucaguagauuuacauguuaucucuggugaacccaggcuaauaaauggagccaaaggcaacaggccugcuaaaaaaccauuuuuuaaucacuuaaaaaugccuaugucauuuugucaauauuuuagguuccuuggaaaaagaugggaaacauggggcagaaauauaaauuauucacuugucuaaaccauaaugcucugccacgguagguuuucaaacauguaacccagcuauucucaaaugauguucuaagagccuugggaacccccaccccaagucugugggaaugccugggcuugacccuaagcugggcaccugggcagcaccucugagagagccuucggccugcacaagcagccaggccacuugcucugguacagcaauguaaagaaaacaaccaggcacacgagaaauuaaguuagaacccaggcuggcuccuuagaguacaugacauacuuggaguaucauggaacaauuaaagcaugcuuuuggaaauuccugaaaucuuccugacuugggcccucaaugguucuauacuauucuacauuucucucuauaaugaagcacuuuauaauaagacuucuggauagaaaaggaggcccugcaaaagccagcauccuaaagcaagaaaaaaaaaaaaaacagguaaagaagauaacugaggggaaauauuaguaauauggcacacaaacuauucaacucugauacaaguaguuuugucuccagaccauucauucauuuggauguucacugaguggcugcucugagacaacugggaagccaaaaugaagaggugagaagaguggcuacuguuuucuuuagcacuacaaaaaugaucauuaaaaagcccuggagauuuucacuuaggaaaccaauaugaacccaaguuucuuuuaagaaagacccacuuauuauaucacaccaugugaauaaaaaauauaaauguacuucaauccuuggaggcucuugaacugucaggacuucauauuuugauguagauuuuucuuucuuuuucuuauucuuucuugaggcuucauuuuguucaaggucacuaccuugugaugcuuuagacuagaacagaaaaucaaagcaaaaaauccuguuuuuagggcggucaauagaauguuuaauacuauguaucaacaaaauuaagauaucaaguccuauaaucacaugacaauuuuauucagaauuagguuccucauccccuguuuuuuaaaaagccagcauucacuagaauaguucugaaggaaaaaaaaguuuguucaaauaguuguaaugcccaauuccuuuugaaaacugguggauuuggacagaaccuaguuuucagcuugaggagaucaugguguucgugaccuuccugaucccagccuaaccucuccauauaauuccaggcaggccauuuccaucagcacgacccagucguuccucaucugcacaucacaccugucugcagagcagaaucaccccuggaaccuucagacaaacaccugggaccaucccaggacugcuaaaugugaccucaucauuccuacaggccccuaacccccugggccucuccucauccaggucagaugugcuuuggccacagggccuuugcacugaagccccuucacuagaauuuggcuaagcuggggcugcuccucaucuccaucuacccguugcuuucuacccuuggacugcccaugguuuucucuucagagcacugaucacucucugacauguccuacaucugucugcguguugucggccucccuccaucagaauggggaggcucuaaaagggcagggaacuuuuuguuuuaggcccugcuuuauacccagugcgaauuuacacuucagaaguaaaagucucagcagcuauuaaaaagaauaugcuuaucuacugacccacaggagcuguccaugauguuuuucuaagugaaaaagacagguugaaggguaauguguauaaaaugaucgcauuuuaagaaaacaaaaaacaaaacaaaacaaaaaaacagagaaaccccucucucuuuguucauauuuucaugagucugaggcaggacauaugccagauugcuaaugaagguuucucugaagguaggcaucaaaaguaugggagagaugaccuuuuccauaaguagaucacugaaguguuacacuuaucauuucuguaauaaaauuucacaauacagaaaguuucuaaaaaaaccauucugaucacuaucacuccagcuauguaaaaugcaaagcuauuuggguuagaagauaacaggagaugcugauuuucuucucaucuuuuagaauuuuucuaaaauaagcuuuucuuagaccuauaauuaagaaaauuuuuaaaaaagaucuugggaaaauaaaacaaaaucuguuaacucuuagaaugcuaacugcauauuaggaaaaccggcucugagagugacuuggcagcugcaacaaagaauuagacaguggggggccaggugcagcggcauaggccuguaaucccagcauuuggggaggccgaggcagauggaucaccugaggucaggaguucgagaccacccugaccaacauggugaaaccccgucucuacuaaaacaauacaaaaauuagccaggcaugguggcgggcaccuguaaucccagcuacuugggagacuaaggcaggagaauugcuugaacccaggaggcggagguugcagugagccgagaucacgccauugcacuccaaccugggcgacagagcaagacuccaucucaaaaaaaaaaaaaaaaaaaaaaagaauuagacagugggcuguuguccagccugcgccuggccacccagaggagccccagagacaggcaggaggcuucaccgagagucaaguucagugugugcacaaaaggaagggucucucccuuacacauacugcucucucucaaauacaugcacagagcaaugaggaacaagcacacgucuaccuucacaguaauugucaccacuauaaauacauagcuaccauuuauguggaaugggcuaauuacauuuuuggaaaucaaaaaguauccucauacucaaaaagacaggaaaccauuacgcuaaacaaggccacauuucaagcuaacauaauauauccguauacaaugaaaaucaacaaccauauuuagaccaauaaaaaaaaaaggcucuugaagaaacaguucuaggaaucaauaaaaauguaacuuaaaaguugggugugguggcucacgccuguaaucucagcacuuugggaggcugaggcaggaggacugcuugagcccaggaguucaagaccagccugggaaacacggcaaaacccugucucuauaaaaaauacaaauacuaguuggaugugguggugcaugccuguagucccaguugcuagaaaggcugagguggaaggauugcuugagccagggagaucaaagcugcagugaaaaaaaaaaaaaaaaaaaaaaaaaaagcacuuaaaauuacuuaagggaaaaaaaucuauucugaaugcuaucuuauaacaaguaaauaaauuccauuaaccaaaaauuagugacacguaccacaugaucacaaaauguagaauucaauuauuuugcuacuaguacucuuguacugguaaaagccauuuaaauucaacaaagacugggggaaaaacaagcagaaacuuuauacaccagagcauaaacuuaugccaacguuucuucuuuaaagaauucaaaauggcucacagauauuuuaagucgauaugucuaaaauguacauucucacucauaaaggaaagcuaucacuuguauuucaugacucaaaaccuauuuuuuauucaaaguguaaguacaauaaacucagacuagugacuacaguauagaaugaaacccaauuacaguuaggauuuggagggauuaaaaaaagacuauccuggccaggcacgguggcucacgccaguaaucccagcacuuugggaggccgagguggaugggucaccugaggucaggagugagauuagccuagccaauauggugaagccccaucucuacuaaaaauacaaaaauuagccaggcaugguggcaggcaccuguaaucccagcuauucgggaggcagaggcaggagaauugcuugagccugagaggcggagcuugcagugagccaagaucaugccacugcacuccaggcugggcaacagugagaccccaucuaaaaaacaaagacuauucaguggcacagaaaaucaacguaaucaaaacgugaugcacaucucuuuuucccuaaucuuuuuuuaugauaguaccauauauauaacauaaaacauaccaucuuaacuuuuuuuuuuuuuucagacgacgucucacuguguugcccaggcuggagugcacuggugcgaucuuggcucacuacaagcuccgccucccggguucaugccauucuccugucucagccucccgaguagcugggacuacaggcacccgccaccaugcccagguaauuuguuuguauuucuuaguagagaugggguuucacuguguuagccaggauggucuccaucuccugaccucgugaucugcccgccuuggccucccaaagugcugggauuacaggcguaagccaccgcacccggcccgucuuaacuauuuuuaaaugaauauuucaguggcauuaaguacacucacuguugugcaaccaucaucaccauccaucuucagaaacucauuuccccuagcaaaacugaaacucucuacccauuaauaaauaacuucucauuccccacucuacugagccccuggcaaccaccauccuacuuucugucucuagugacacguaccuuuuggguaggaugaauaauguguuuuucuuuguuguaggaaggauccgaagauaaagcuucagaagaugguauacuaacauuuuuaggaucugcugaugaagcaauggucuuuaaguuuaucauagaaguaacauuuuuaggggcugcugacaguucuguagauaaugucugucgaacaacauaacccauugguguccaagauaacucugcucaaagauaaccaaaauuguugaacaaucucaacaguaaaauagaaauuccuuaguuacucaaacaugcauuacaugagguaacugcucagagcaucauuaaauguaggcuaucauuuaaaacauccucuuggaaacuauaguagucacuaaacuuguuuuucuucuuggggcaugcaugcugcauuuuuuucccuuuuaacuuguaagguuaauuuuccuggaaacugguuuuuuaaccuggggguuggagguggguagacaaacaguaguuuuaguuaaaaaacaacaauccacaauaaauguccacguggcaagcacacagaauuaacgaacuaaagaucaaauuuuggcccuacuaaccuugaaguguaccuuuaacaucagaagucaaagaucacuagacuucagcuaucacaauaacugguaauuuauuucuuuuagaacagaggcauaaguacagcaacacuacuccuuuaggugcccaugaaacucuauauacagacaaaacaaagacaucuaucaggacacaggcaggugaacaccugucagcagccuguggcuacccccaaggguaaaacagacuguuccccucacuagagaacuacacauccucagagcagccugugaaguacagaccauuacucaaccacauacauaucgaacaugagaacacaaaagaaaacacccuaugaauaaauuuggaaucauuuuguaaaaaugucucuguuaggacaagcuacuguaaaaauaucaaagcaggguacauggaacucucucugaaaauauuacuucuuggccaggacaggacagaugagcaguccuuacaguguggcaggaggcucccaugacccuugcaggugucuauggaguuaaaaccguucuggaguacaaacacaucaguugccuucccuacucucccucucucacgagaacaccugggagucuuccaaaugcuguaugaggcaggaccgugaggcaggugaaugccauggcagaucuacagagccagauggcagagcugcacaaguggaaagcaaggcugcucucugcacuacagcuuuuuaauuuugaaaaacgguuuuccuaaaaauaugcuaucuuaaaaugcaauacgcuuaauuuauuguuauuuuuaagcaaauuuguuugaacuuugaauagggcaaauguugacagguaucacccaaauaaacaagagcucuuugggguucucaaucuuuaaaggucucaaaaacuuuugagaauaggcaauacuaaaggaaguaguuacugcugaguucauaaaauuucucacugaauuggauguguacuucauuuagaauucuugucucuuauuuuauacucuuuguguguggaugugggaucucaucuacuuaacuuucuaaacuaacacugauguuagguuacccacaauucauuagcugucuuaagucuuuacaacaaaaaucauuucaacugcacuggaguuaaaaaugaacuuaaaaaaucuaugacauuuuaaaaauuaacauuuuugcagccacuuuuaccucuuguacaugaaggagaauugguagcggcauuagcaguuacagauucauuuggguuauuuuucaccacuauuucacccuaaaaagcaaacacauuagaugucaucagagaaaugcaaauuaaaacaaggagauaacacuacauaucaaaauccagaacacuuugacaacagaaauccuuauccauugcugguaagaaugaaaaacguuacagccacuuugggagauauuuaauaguuuagcaauuccuuacaaaacuaaccauacucuuaccauaugauuuagccacugcacuccuugguaauuauccaaaggaggugaaaacuuauguccacacaaaaaccugcacauggauguuuauagcagcuuuacucauaacugccacaacuuggaagcagccaagaugugggcuacauacuauaugauuccaacuauaugacauucuagaaaagacaaaacuguggagacaauaaaaagauaguaguuagcaggggcugaggggaggaagggauaaacaggugaagcacagaagauuuuuagggcagugaaaccacucuguaccauacuacuaugguagacacacaucauuaugcauuuccccaaacucuuagaagacacaacaccaacagugaacccuaaugcaaacgaugcgcuuugggugaugaugacaugucaaugcaggucaucaauuguaacaaaugcauuacucuagcacaagauguugauaaugaaggaggcugugugugugugugugugugcaggcaaggggcauaugggaaaucuguacuuuccucucaacuuugcugugaaccuaaaacugcucucgaacauaaaaucuauuuuuuuaaaaaagccuaagcaguuacuuuccauuucaaaguaaucauuuaauuuuaaaauauagcuucccuugccauucuuaaaaucugcaaaauauaugcuaauuaaaauuuccaaauauauaaguacauaaagugaaaaguuaaauuacuuccuucaaccaaaucucacucccuagaggaaaacaccacccacaucuauagcuucauuaguauccuucuacuucuuugccuaugauauaaacauuuguguaucauauuuuuauacggauucccauaauggaaucacaccacacauaguauuguggcaacuuuuaaaaaaacuuuaacauacuacugacaagcuuuacaaguuggcacagaugcaccacacaauucuuaaagcugcaaugaucccauguaaaugcaaaagccaucauucacuaggcacacaccaaaguucaacaguccaucaaaaugucuacaaagacaacaaauguaagccugcaauguaugcccuguguuaugaagacagaaggcugucucacauauuaaacauaagacauauaaugacgcuauguguaugggggggucgaguauauuaaaaggcuccuccaagugacuaacaccagagguaaaaguaaauuaaaagauucaaaguugaauccauuaaguagauaauggauuuaaaauaauuuuuaaaauucauaugcuucacaaauuuauccauuugucaauucauaacaugaguccaggaauaaaaaauaauauuaaaacacagccuguucuuuuaguaaacauaacuuuuaugcucaccaaggccaauaaaaaauuagaaauagcuuaccuguucaagaaugguuaaauaaauuauaccuaucaguaugagagauccaaugcaaguugcuuucaaaaaauacuuaaugacauggaaaaaauacgaacaaaguuuuaaacaauucaaacguaagacuguacguauuuauaaucucaaggugaaggaaauucccacaauagacuauuuuuaaaagauuauguguuaagcaugcuuuucuuuugguuguacaauuucagacaaauauauauauuuuuugucauuuucagacauuacuaauaucaucaggaaaaaguuucuuuuagaaggaaaauaacuuuuuaaaaagcccacacauaauucaagaguguaugugacucucuuaauagagcaaucaguauguauaucuucuaucuuacuucauauguucaaacacauuaacagucacauguaacaagugaccuugauauaaagccccagucacacuccugcucacuccacgagcugacccugaggcuuacacagcauccuggacuacuucugcagggcacucaugagagcgguacgugaugaagaccggcagcgccguggcuauucagccaccgcacaaacccagccuggagccccuggagcaggccagauggaacuaugauuuuuagauagccaucaguuggccugacuucucccagcucuuugacaggaaagcaccaugcuacaacagugugaggguacaacuguaugaggguccugcaugcaaacugcuacacaauggccuaucuucugcacauuaccagcaacugucacugagccuucaggccuuaguguccaggcaccuaacagaaguccaagggcaggaaacaaauccuuucuaaauucaagagguaaagcgaaugggugaggccuguuuucuuuaucuuucuucuuucuacuugccuucguacuggcauguacuccacugcuccuucagcggaaauucaucagaagccauuuuaggaacuacuaaccagacacuauuucuuccuggaagucucaaaucaauccauuugagagaaaugccucaacuugguggacuaaaacucugagaucaaauguugaacaaagugaauuaaccugcuguaauaaguuuuccugaauuugcugcaucauuaacaagacaaagauguaauaaaagccuggaaaauucaaaaguuacacuaugcaguuuuaaauauuacuacaguuaaguccucaguaccauggacagguucuuggaaacugugacuuuaaacaaaacaacauaaaacaaaaccaauuccuuuuuucaucaacaucauaaugaaaugauggugaagaaaauguuacuggaggaccuacuauacagccuuucauuuaaaguugcaguuuccaagaaccuauugacaacauuaugugaggacuuaauguauuucaauuuuuauaaaagucuuuuuuuucuauauuggaaaaagugcuaucagcauguuagaaguagcguguugaaaaugggcugucaaagcggcuugacucuguuacaaccuuuuccuucugaggcaccacaauaccuuucagcuaccauauaaaaaggaguauacuagauugggcacgguggcucaagccuguaaucccagcacuuugggaggccaaggcagguggaucaccugaagucaggaguuggagaccagccagaccaauauggugaaaccccaucucuacuaaaaauacaaaaaaauuagccagauaugguggcauguaccuguagucccagcuacuccggaggcugaggcaggagaacugcuugaacccggaaggcggggauuguagugagccaagaagccaagaucgugccacugcacuucagccugggcaacacagugagacucccuccccacaaaaaaaaagguauacuaggugauucuuuuaaaacaauagcuacagccgggcacaguggcguggguggcucacgccuguaauccuagcacuuugggaggcccaggcaggcggauugccuuagcucaggaauucaagaccagccugggcaacauggugaaaucccgucucuacuaaaauacaaaaaaaaaauuagccagcguggcagugugcgcccguagucccagcuacucgagaggcugaggcaggagaauugcuugaacccgggaggcggagguugcagugagcugagaucgugccacugcacugcagccuggugacagagcgagacuccguuucaaaaacaaaacaaaacaaaacaaaacgcacaaauaaaacaauagcugcacuagauguuacagccucauuauaaacuguucaaacaaagaaggucauauaagugcacaaugaaaggcuucccccaauacauccuccccagcuccauggacaucaaagcccacagcaagauuuaauguguaauguuugaaaugagacaauuuaaaguguacaaaggaaaaagaaaaagagagaaacccucaccucaccuuugauaacacugcagcugguuuuacuacuucucuuagaagagaaaugucgguagagacagaguggacagguccccacuuggguugcuucuguaucucugacauauuguucucugcaccuugcaguucaggaaaguccagugugguaaauucaaacucagguuuggagguagauacauuuuuugcaaugauucuggauuuccugucuguucgcuuaugguaaccaucuguaauuacaaaauuaaaaguaagaguaaaaauuuaguuacuguuugaugaccaguaugcaagcaaaaauugcagaguacaaagacuauugcuauugaugcaacagguuguugucaaaacaccguaacucuuaccgguguuguucaccuuccuuuguaaaaguauaaaguuuaaaugaccauaaguaucaaucacucugguuggaccaucaugcagaaaaaccaaaaugcacuguacauuuaggaguauguauagucacgcgccacauaugauggucugaucagcaauggauuacguauacaacagccccauaagauuguaaugaagcugaaaaauuccuauugucuacugguaaugucauggugcgauuacucacguuuguggugaugccaguguaaacaaaccuacugagcuaacaggcauauaaaaguauaguacaugcgaugauguacuguacauaauacucgguaaugacaauaaacaacuaugucacuuguuuauguauuauacuuuuuaucuuuggaguauauacucccacuacuuacaaaagaaaaauuuggccagggcaagguggcucacgccuuaaucccagcacuucgggaggcugaggcaggcagaugcagccacgaguuccagaccagccuggccaacaugguaaaaccccaacucuauugaaaauacaaaaauuagcugggugugggggcgcaugcccccuagcuacuugggaggcugaggcacaagaauugcuugaacuugggaggcagagguugcagugagccaaaauagugccacugcacuccagccuguguaacacagugagacucugucucaaaaaaaaaaaaaaaacacaaaacgacaaaagaaaaacuuaaguauaaagcagcuucaggcaggucccucaggagggauuccagaauaaggcauuguuaucacaggagaugacagcuccacgcauguuacugucccugaagaccuuccagugggacaauauguggagguggaagacagugauacagaugauucugacccuguacaggccuaggcuaaugugugugguugugucuucguuuuuaauuaaaaaguguagaaaguuaaaaaaaaauuaauagaaaaaagcuuauagaguaaggauguaaagaaagaaaauauuuuuguccaagccaaguauuuuugguuuuucugcauguuuguguuuuauuacaaaagguaaguguuauuacaagagucagaaaguuagaaaaauuaaaaauguauaaaguaaaaaaguuacaguaagcuaagguuaauuauugaaaaaaauacuuuuauaaauuucauguagccuaaguguacaauguuuagaacgucuccaacaguguacaguaacacccuaggccuucacauucacccaccacucagucaucgaaucacccagagcaacuuccaguucugccagcuccauucaugguaagugcccuauacggguaaaacauuuuauaucuuuuuuuuuuuuuuggagacggagucucgcucugucucccaggcuggagugcagggacgcuugaucucggcucacugcaagcuccgccucccggguucaugccauucuccugccucagccucccgaguagcuggaacuacaggugcccgccaccacgccaggcuaauauuuuguauuuucaguugagacgggguuucaccguguuagccaggaugaucuugaucuccugaccucgugauccgcccgucucggacucccaaagugcugggauuacaggcgugagccaccgcuguaccuuuucuauauuuugauacacaaauacuuaccacuauguuacaacugccuacaauauucaguacaauaauauggucuaaagguuuauaaccuaggaacaacaggcuauaucauauagccuagcuaggugguuggcuauaccaucuaggucuguguaaguacacucuaaauguucccacaaugacgaaaucaccuaagggcacauuucucagaauguguccccaucaguaagugaggcaugacuauaauucuaaggcugaugaaauaguuaccuuaaccugauugugcagcugggcauuuuaauuauucuuuuuagacauuuuauuguauugcaaauuuaaagggacucuaaugaauuuucugugcuaguaaacuuuccaucuuucaguuugcuggaauaaacuagagggaagcagguagcauaaaacgcauaaccucuuccccaucuuucuccugaaaugcaauggauaagguaggcugcagcuacaugaagccacucauuuaauuauaagaccacaguuacuacaguuaauaaacgucccuuguaccagaugguuuaugagugaagucaaugaaaagagaaaaauguauauaccaaauaauacaaauuauaggcacuuaagaucccacaaugcaacagguaccaaauaauaaucccaucccugggaagaaauaccucuagaauugcucaggaagucugacgcccuaagcugugucagacccaggucucauuucuuggaguagucacaaugaacaagcccauagaaacagcuguauacauagcaggaauguuucuggggcacaaggaguaggcucgcauuauacuacauuguugguuauuuuuaccugauuucaaacuauucucagcguaaauggacaaaugaugugaaccucuagcugauuuuaucucagaugauauaguuccaucagcccuuucacugucaaacuuuugcugaucauacguuuuuuucucaucauagguuuucuucugcaggaaagauuaaaaagcaacaugaaauaaaaccaccacuauaaaaaagguuuaaagcagcaaaauauuaaguauucacaauucaaucauuuuuuaaaagguuaaauacaaaaaaauacaugauacuuaaauaugauguacaaauuuaccauuucuuuacauuuuaaacauuaaagcaaccaacuaaaggacacaacaaaacaacaucacuacucaccuuaaacagagcuuucauuucuugugggagagggcauguguucucauuucgaugcuucacuguuugaaaaccucgguaacaacuggguugguuauaaagauacugggagccaggcacugaguaaacauucuguguggagucaaggguauaaggagaauaggcauauggaugaagaguuaucucagaagauaaauacugagguggaaaaguugaagcuccaaaggccaugucuucaguauauauuuucugccuaaguaaaaaguguaaacuuuaguugcagauuucauacugcaaaccaagaagcuuuucuguaauaaacuaauucaaacugaacauuuaauauuucugagaccauucacucuagcacuggaauaaucccuaauuaaaagccaaauaaaaucucuggguguuucuuucucacccugcaaagaaagauguugacucuauuuuuucacuaaugagcuggaaguccguaagaaacaucaacagagccagaagaugcuccagcagcuuuucacccaauugcuaccaaguauuugggaaagccucucccagcaacccuggccaaaaugccccuaaagaccauucucucugcugcggggagacccaacagccugcaaugccuccaccaaggcuccugcaaaugguuuucuccagcccuucccugcuccaagcccaccaugacauccugcgcuuugcugacuaacagggucagagcgcaaagcagacaccgcacggcaccguggauguuaacuacacacuuuacuaacagauggacaccagcuuugaagguugcuauugccucaauuuaucccaagcugcuagacuaaaccaaaauauaauuuaacacuaauuuuucuuuuuuagccaauuugauacaaggcuacagguuucaaccuuuuucccaugaaagcugauacaaugacaaaaugcuaagcaacugauuuaaaauacaaauaguaaccuccuccuuccagcaaauguuucuguuaauuuccggagcuauuccaaaauguacuaguacacugaaaggcaaaaaauccaaaccuagucaugacacacccuuuaagaccuucaaacugcuacgcugucaggagauaugagcauaagcaccgcuuacuagaaaucauauuucuaaugcgcugcaaguaacagacuacacugaauaagaaagggagacuacaggcucuaccuauaauauaauaacguuuacugcuuucacuucuauccaguacuuaaucauauauucucucaucucacuguuuacuauuucaugauauguuaacuuagauuuucuaagaucuuuuacuuacagguaaguaacuuuaacaugaaauauuccuaauuaaaaaucaaauaaaccccuuuuuacugaccuuugucuguccaacaaaacaacuggccuagcacugcuccaaacauacagcacugaggacuagcucuuuguagaaaagaggcucaaagcuucaucccacugccuacauguuccugugaauucugugcuguauuuuguuuguaguugagaaaagcuaguggggggcaagugucacugaagguggauaaucuguucuucauaaaagaugaguugacagaaaaaaaaaugugaaaaagacugucccaaguccaauaaauagauaaaugaacagacaaaugaaauguagcuaaaaaggaaagcagggacagguuccauugguuuugacggcugcugucauccaggaaauuuucauccaggagucaggagaccuugguugggguccuagcucaaucacaauccaguuuucuauucuggguaagucauuuggguuucuguccccucacugguccuuccuccucuggaaaguugguauuuuccauuuccauccagugcaaacacaauuacaugcagaaaacaacacaaaauacaaaacaucaaagcaguaacucacagcaucuggcguggcuucaaauggcaugucugggaaauuccagaugccaggaguggcccagaugacccuaaacccacaguaacacaccuguuucucauucacuguccuaagcuaccccauccauacuaaaaucaaacugucugaguaauugugcaauaccugcuggucuccuggcuccacuucccuuugccccuuucccaccaacggcuuccaggucucccaggaccuccuucuugccucucccuccaggcacccguugggucuggcuugaccaucacaugacuugaaaagcucccuggccuggacuuugcucgccuggcucucaccugcccuccaaggcucuaucucugucucuuucccuagugcagucuccucuacacccuccuuaucucacccaucugacacauucugggucagaaccucuuaucuuucugcuuaggacuugacauaaauauaaacaauccagcaccuucccuaguccaggccuccaucuccaacuuucaggucauuuccacuuacuauuucacuuuuucccaauucagcacguauaaaucccaaauuuaacauccauuccccaaaacagccccauuuacaacuucuguucucauguaugauccuacaauuauuuccauguauucaaccgaauauuuuuguaacaucuuucccaccaaaaccuguacggacaaucauggggcucuuuuuuauuucaacaguucucucauguaguuucuuuacuauuuccagugccuagaaccuggucaaagccuucaagacccucuucuuuaaaaaucuuuccaaaauuuaggagugauuacaaugaccccauuuaagacacuaccaaaaguucccuauugccuacccagcaaaccuaaaacuuuucagcuguacuaugcaggcuuccaaucuacugacagcuuccccccaaaauuaucacuuuauuccucuacuaucucccaaacauaucaugcacauggucccuucagucaggcaacgacccaaaggggaugcaguuucuccuccacccaccgagccacgugcucagcuguacaauguuguauaccacuaguucuucucauagcugaucugcuuuaacucaaaagcaucaauugguacuaaaauuuucacaguauauuggcagauggugaaaaugcucaacuaccucuugucaauagcagcagcaauuuugaagaauagcacguuaauucugguucuggugcuaccuauuugaauuagcaugaacaaacauuccuagcuucaguuucccaugugcaaaauaacauuacaucugccugccaccucauggauuguaguaacuaugaaagaaguggaaguauacaauaauacccaaacaaaaggcacacauccucauacacagguugcacaggauuuuucacaaaggauguaacaugacaauggacauuacuuggaagaaacuuauuuuguuugcauaggcaaauuuguucauuacaucaguaaauaaucaguauuuuccaaacauggcaaauguuaucuaucagacuacuucuaauuucuuugucuuguccuauaacauaaauauggaagagucugguauguucauuuucaucuccaucacuucaaaacuauggaagacuuucaauaauuaauuccaaaugaauaaaugagcaucuuugagugcacugugaaagguacuggaggaggacaaauucuguaaaagguuacuauaccuucuuuaaggaaagaugagggaaggggacauacaaaguugacuuaggaugcuauguaguugaacaaguaagaaggaggaaauaguuguuucagaaacuucuauuccuuuugucacagcagcaagagaucuccauuuacauguaaucugacuauggcaaugcaauuuuuaaucuauauuagaacugcucagauaaucaauucucaaccaugugaagucucauuauuucauccccacuuuaaaggaucuuuuccuuucuaacucuuccucuucaacuuaaugccuuccuuauccuuguuuucuugccaggcgugaauacuuuuccuuggucauaaaccaaagcuaaaaaagaagaguuaagaaaacuauuuuuuuuuuuuugagagagagucuuguucuguugcccaggcugaagugcaguggcgcagucuuggcucacugcaaccuccaucuccuggguucaagcaauucucuaccucagccucccgaguaacugggauuacaggcaccugccaccacacccggcuaauuuuuguauuucuguaguagagaugggguuucaccauguuggucaggcucgucuugaacuccugaccucgugauccacccgccuuggccucccaaagugcugggauuacaggcaugagccaccacacccggccaagaaaacuaauuuuuaaauucagcacugcccauucuugagucucugauuagucuccacucauguuacugccaaaauguuccuuuagccaugugaauguuuuccaccacuauuuugaguaacuaaauaccaccuagcagauggcuuugagcucuugucacugagauauauuuuuguauuuuguuaugugagacacucaagguagggaacaacucaagugagacccaugccaaacuccccuuuacaguggaugaaauacaguggaaaaauaggguauuccuaccaaagaccaaauuccagcauauaaagguaguguuucaacuuucgucaaaaaaauacaacuuucaguauuuccuaaacacaaaagacaacucaaucauuuucuuauucauuacaauucucauucuugcaaauauaauucuagaauuuauauacaguacaaacuauuuucaauuacaucaugcaggcacaaauaaaaggaaacaaguuagaaucauaucaaagaagaaaaaagcauuaggauucuuagauuagaacuacaccugaugcaaaucuuaaaaacagaucuacaaauaaaucuacacaauuaugugaaagauuaauacuuuuuuugucuaaauucagcugcaagaggaagccauuuuguaaaccuagagaaugaauccugagaaggaaaaagaaaauguaaggaaaaauguaagccuucuuucaacucaaauuuagaagaacuuaagccugaaauguguaaaauucaucuccauauuaacagauauaaaguaaaaagguggaaagcaaaagucaacaauuuccaaaaaauuauccacacagaggcagcuaugguugcuaguccccuccccuucgcucaacaagauuuuaaaauguuaaccuuaaaaaggaggaguacguuuauuugguccuuucuuugcccuucccuccacauuucaucucccauuagauauaugauauauuuuuaaaccauaugaacaaaugaaccuugaaacgggauuuuuuuuuuuuuuuuuuuuuuuuugagacagagucucacucugucagccaggcuugaguguaguggugcuaucuuggcccacugcaaccucugccucccagguucaaaggauucugcugccccagucucccgaauaccugggauuacagguguccgccaccauaccugauuaauuuuuguauuuuuguggagacggaguuucaccauguuggucacacuggucuugaacuccugaccucaggugauccacccaccucggccucccaaagugcugggauuacaggcgugagccacagcgccuggccugaaacugcauuucuuauuaacaaaugcaaugcagucucuacuauuucuuugccgaaaauaacaaugaguaugaagaaaaaaaaggggaguuaaagcuucuguuuuuggcacaggauacaguuaaguugugcuacuggcucagacucuucuugguugaagagcauucucucaucaucugcagaacuuuagugcaguaacugcugaguauuugaaagucuaaucaccauuaaauccaaaauguaagccccuagguaagacuuuuagaaagauacauacucugucacuggugguuccugaacaaacggauaguauguggcugcagagcuggggaagacacaugcuucugaggacucuaaccaugccacauugagcccggcaaaucuggggacaaaugguuugacaucugcugauaacuugaugcccugaggaaaaauaugagguuuuggccacaaacauucagagaucaagcaaauauaaacaaacaaaaagacccaagagguguuccuaauagccccagaaauguucccgauguuguuuaaaaacuucugccucguaaagacaagaaccugcuugcuaacgauuucuccccaaugcuuuuuuuuuuguagaaaaggcaguaguucaaacauuaaaagugaaaaaugacaacgaauucaaguggaaauaaaacaacacagauuauauaguuuagaucuuggaauaaggguguuuuuaccacagauucacuuagaaauaauagaacugcacacaguacaacuacugcagucaaauacacguggacuguuuaacuacagcacccaaaacacacugcagacguuuauuuccauuacauuuucuugaaaaaguugcacaaaagcauaugcauuuuacucaugaaccacuaagucuugcuuuauugaaauaccaaaccuugcuuugcuagaaaauauuaucaccacgagccuuugaaauuucaauucacuaagauuucuuucuuuaguuuuuagugacguaguaagagauuuacuuucaccgagaauuuuaugggucuaaaaaugaugcaagcgaucgccagggcuccaucuagugguaaugcugaguacguagagcggagaaugacguucagaaaaacgcaggauccuuuaaaacaaucuauccguucccaagagcgcgggaagcucgccagaguccccccgccccgacugcggggagcgccgggcugggccgcagucacugcgcugggugacaucgcaccacagacgcggcgcuaacugugggcggggucuguagccgcugaccgccaccccaaggcggacccgaggcggggcgcgaagaucgcggccacccgguagggcgcucccgugccgucaccagcauccgacccacgcccgcuggaccagccccgucaccgcccggccgagcccccagugcgaggcaggcggacggacugaggcugccgagagagcccccgucggcccuuaccucgcuuucgggcucccgcggccccuccgacgccaugccgcgaggcgcggaggaggccgcgucacggaggccagcagcgggccgucggcuugccggacagacaaagcguuuccgcc

SEQ ID NO: 192417 - RNA, 118906 nt, Homo sapiens
gcuguaacacucaccgugaaggucugcagcuucacucccgagccagcgagaccacgaacccaccagaaggaagaaacucugaacacaucugaacaucagaagggacagacuccagacgcgccaccguaagagcuguaacacucaccgcgaggguccacggcuucauucuugaagucagugagaccaagaacccaccaauuccggacacaauaggggauacaggggcuuugaggggaucuugagggugaggcugcccaacgaggacggggcugagguguugaaguaacaaacacugaguuagaacucagagcaaaucggaaacagcugguggcugagcugggcgaaaagcuguaguuuuuaaaacaugguggccaaucucgccauugcugccacugagaugcagggugucuguccccuugcuguggaucuggguuacuuccugacugccuugauugguggaauguggugggugugaggcugagugacccccaauguggcuuccccauuguucaccaggaugcuggcucugggagcccugugaugccaaggaaggaguuggcccuuuggcagccaugcugugaggaaacccaagcuccacaggcagccaugggagcuccagugggcagcccugguauucaguccccuccacucagggcccugauaagugaggggacaggccuuccaaggacuguagcuguagcccuugguaauuaggugugucagcuuugguguccuuggacauuggagcagagaugagcugacugaagcuggggcccgcugaggcuccucacccacagaauugggaguguaguaacauguugcaggcugcugaguucaggguaacaugcaacacagcagcagugacaggaacaaaagcgguggcugcccaaggagggggaaggaagggccuuggggugggguggggugggguggaggaugagggggccauaggacucagguuuugggugggagaguggagugugaacaagaggcagaccccuaacaagggugcagugaggaugauucauuucaucucauuccgcacauuuucauagucuguguauugggggcuuucuugcuuucucuguaaaugaaccaugaaggaaacaaucccuuuucauaggcgcacaggggacauagggaugaaugucugguagcugccauaaaaaguaccacacacugggugguuuccaacaacagaaacuuauucucccaguucuggaggucagaaguaaaaaucaaggugucagcagggccacacuccccugaggcucuaggggggccuccguccugcuucuucccucuuguguggccccagugucccuuggcuugugacacauugcuccagucucugcuccaacaucacauggcgucugcgucugucuuucccucugaguguaucuauaagggcacuugucccuggauuuagggcccacucagauaacccagggagaucucauccugagauucuuacaucuagaaagacccuuuuugcaaacaagauugcaucucuucaaccuguuacagcacacaagaaggcaauugaaauacugcgcgggcugagcugguggcccuggugggcggagacagggcuggcaggcuuucaccuucuccaggauauauuucagcagggcuuuaucagcaggaaaauggaaaccacagcugcuuuuugccuuugugggaagcuguagaaauaagaguacaguggaaacucucugcuucguaaaauaacuucauguugacucagaggggaaacaggaaaggugccuucuaucuuuuuuaugcgaguuuuucucucuguugguggggccuuugcuuuuaaggaguguuucuacaagaauacuuguuggauauuuagugugaacaggaaguaagaugugcugacuaacuuuuccauuauuuuaauggcauuuuuauugcucagaaaaugaagacagaaagcaaagagugaacgcuuucauugugcuggguaaaugccauaaacaaccugccuuucugaauuuuuuucucugcgauuuucagaugcacacacaugcgugcaugcauaaguacacacacauccauagaggggguguuuccccaaagucgcggucaugccacgcagagguaugcaccuugcuuuauuugcucaccacugugucauagauguguauguucugcagugugcuacgaagccaugugugcccuugugugugcugugugucccuggggccuucaguggaggucucuccagucugccacacccuugacuguuuuccuugguguacauuacucuugucaaggcauugauuagcaggacaugugauggccccugugaaugguggagcccagaaaaugaaauuggcaguguuuuaguaggccguguguguuugugugugugugggggggugcaugcauguguguaugugaaugugugugagcauuuguguguguguguguguacgugcauguaccuugugcauauaugcaugugugugugagugccugccugcacaugugugcucauagguuccagaauagcagugcacagcaugcuggaagucugcauucugggagaguuucuuggauuuaggagucucuucucauuaggaggcuuacugaacuuauuuuacggaagucuuaguuguauuuuuagccaaaagauaaaacucgccccacucuccuccaugccuccagcuugucuaaagugaaauggccuggggagaauuugacaugguaguacagugaugugguguguuucucuggggucagauaugucggcucuccuaucccuggacaggucagcccaguaucccagccaaauauuguguaugugccuagauccuucacaggcaugacuuuuuguuggugccauguggucaugggggcuuccuuccgcagucagguucugcuccgaaguggggauuggaggcaucucuggagccuggcgugauaccuuugccaugucccugauugauugugucggucagggucccccacagaagugaaacuaaugggugugugcauguguaugcguguguagacauuacaaggaauuggcucaccugauuguggagaugccacgagucuaaaauauacagcaggcuggagacccagagaagaauugcagcucaauggaaggcugucuggaggcagaacuuucugcucuucuccuugggggaggucagccugugcuauucaugccuucagcugauuggaugaggaccacccucauuacagagggccauuugcuuuacucaaagccucugcuuuaaauguugaucucauuaaaaaaguaauaccuccacagaaguaucaagaauaaugauuggccagauaucuggguacuguggcacagccaaguugacaugugacaucagccaucacacuggucagugcuccccagugcacgggccccguggcaugcuauguuuuauaaaccagugugggcccuagguaaggugugugagcuugcucaagguguauuguaugaagguguugcccugcucccagaagccugccccagagcaggcagggcuuguuauucuugcccagagaucaucgggccagcaugagguggccgaagguuggcacuucuuacauucuaauggcaccaggagcgagguccggggccuugugcaagcugcgcucacaccucagccgaccuucugcuucuuaggaagguugcuucauuccggucaccacuggccccauauuuaagcaucaguaauaccuuaggugccucuggggaccauuccuguuguccuccuuccaaaaacugcuucauuuuccuucaaaaugugacauggcuuggacaugcuagaggcauuuauuagcagaaagccugggagcucugccuccaugauauuuucuuuuucugggaaaaaaaauauuugugcaagccauggucauaucauuguuucccgcucucugugagccugcugacauuggccucccgugugccuggcgugcucuuaucagaccugugugccauccugugaauucuaccguaaacagucacagcgaggcgggagaaacacagccuggugguccacggcaggcuuggucuggacuggaugggagcugccugauggaucaguaggggaaugcagaggggugccagcuccaggacugguaaagguggcucuucucuuucuuuuccaucaggugcaguguuggagugaaugaaugauugaugggugaacaagugagagaguggagcuggucacagagguaggagggacucaggucacuggccguguggugggaguggggagcugagcccaugccaaggcugugacccauggaccaguccuggugugguugggcuggcaggaguggguguuuguuccugggacugguggucagcauguguccccuucccugcuucucacuggcugaggcucaggaucugggggcccagcaggccccuucuggcucccagguggguggggacaugggucucagucccaccugcuuucaggcccuuggggcuuccugcccagccucugugacacugguucucacaaagccuggucauuccuggcagcccaggauggccuccagguuguggcuggucuguccuccagcugcagguucugcagguucuuucucauccugcaccucgacccuuuuccccaggagagccuccuccggggugggcccggagcuggggagaaagaggggucuggugaccacauggugccagcagggcagcugugaaacccucccuguagccccaggcacccuccucagguucuaaagccagagcugcugcucucagaagugcuuucugggacuuuucagggugggacaccaggggccucugcagcagggaccccuauugcaggggcugacagucacagaccugagagcagagucuccggucuugaacccagcuuggccuuucucuacggaaaggcuuggccaggaggaacgugguggugugggaagaauccgucuggcuuuuuucucuucuuugagggacauaugucugucaggcagaagcugacaugugucugucaagcuacaugugucuguagcuugggggagaguggcuuaauauuucauguuuuagcccuuguccucuuccagggugggcuugaaaacgauaaugaaguguacacacugaaaaaacaaaaaucacccacggguucugaagcucaguggaguucugcaggugaguuuuagugcuucuggucauacagagaaaaacucauguaaacgcaguuuacgcaggcuauuuaguugcugcuuucaucuguguauacaaaggaacauagcuaguaauuaagaacauggaggcauuuggaucuguuuauauuuuauuuguccacuguaaucuuugugauguucuuauuuggauucgaaugcuggugauugcuaaacucaagcacaaacacaggguuuaagcgaagguuaauuauggcuaaaaugcuugcgaugcacagggcuggguaaaugagucaggcuguguuuaucuucgggguuuauuggugccaggugucuagaagcagcaguuugaauuuggacaucuuuggagggagguuucuuggcaaccaaagggggaggugggaggacuugagcccagaacuuggugccaugcaucagcagaguggcuggaacuccuuugggcugggauggggaccgugaaggcagcccuugggggacccagagugcugcugugggcaugguacccgucuucucucuguccuacuucucugggggaugccuggggaggaccugagaaagggaacucaaauuucugucacugauugaccagccuggagucucuguagcccucugacugucugccuucacuucuuucuucuuuuuguuuuuuuguuuguuuuguuuuguuuuguuuuuugagauggagugcauugcccaggcuggagugcaguggugcagucucagcucacugcaaccucugcuuccaagguucaagcgauucuccugccucagccucccaaguagcugggauuacagucaugugccaccaugcccggcuaauuuuuguauuuuuaguagagacgguuucaccauguugggcaggcugguuucgaacuccugaccucaggugauccaccugccucggccucccaaaguacugggauuacaggcaugaggcaccaugcccggccguuguuuuugagacagggucucauucugucacccaggcugauucccugcaaccuugaacuucaguccucccaugucagccuccugaguagcugggaccacaggugugcaccaccaugccuggcuaguuuuuaaauuuuuagucuacuaaaaccucaucuagaccucuagaugaggucuugcuguguugccuaggauggucucaaacucugagacucaaggagucguccugccucggccuccuaaagugcugggauuacaggcgucagacccugugcccagccuuugcuccuuuuuaagguuugggucagcuccgaauggagcacugcuugcucaggccuaggauguuuuguuguuguuguuguuauagcacaacuuacauauuucaaaauguaguaucauuuacaauaucuuaggaaaaguggcagauaucuuacaguaucuuaagauaaguugaaugagcgcuuccuuuccaauacuuuauuuguugagacagggucuugcucuguugccuaggcgggagugcaguguuggcuuacugcaacuucaaccuccugggcucaagugauccucccaccucagccuccugaguagcugggaccacaggcgugugccaccaugccuggcuaauuuuuuuacauuuuuuauagagauggggucucacuauguugcccaggcuggucucaaaccccugggcucaagcacuccucucaccucagccucccaaaaugcugggauuacagaugugagccaccaugccuggcccucuccaguacuuugaggucuacaagauguaucuagaaaauuuacuacugugggaaaugaagacuacuuaaguugaaugggggaaaaggggaagggccugggguuuuuccuuuugauuaacuuguaacauuggccuucgcgcagcugaggaaguuucauauauuccauagacaucauuaagcaccgacaucauuaggcccaaagcucuugcaggacaucuuugaaugcuauaugaauucugccguuuugcuagcggugauuuggcucuuggguccaccaugucguuaggacuguuaacuccacucaaauuaauuuuugucacaaaucuuacaaaaggggggugcuucucaguguuuagguccacauucuauuuuaaggcuguauauuuggcuuucauaaauuguucuuggaugcccagugaucauuccuguccaucuuguaagugucuugucuccaucaucuucucaaucccagcuaacuuugccaucuccuccuccuuucuggccuucaucgaguucuuacgacagucagaaauugcgaaggacuuuuacuccccagcccuugguggcugccaucuuguguucuuuacccuccaccagugacuucacccuugggauguguuuuacuuacuuuucaguugccucuugugggaagcaaagagcaugacucuuuuaaagucagaaggauugugcaaauugacccaggaccucuguuucacauuuaaucacagaauuagaagccccuauuccugugugcaccuaagcgggcaugcacccgagcuggcaugcaccucagccuguaugcaucugagucagcaugcacccuagcuggcgugcaccucagccuauaugcaccugaguuggugugcaccugagcuggcaugcaccucagccuguaugcaccugagccagugugcacccugucuggcuugcaccucaaccuauaugcaccugaguuggcaugcaccugagcuggcaugcaccucagccuguaugcaccugagccagugugcacccugucuggcuugcaccucaaccuauaugcaccugaguuggcaugcaccugagcuggcaugcaccucagccuguaugcaccugagccagcgugcacccuaucuggcaugcaccucagccuauaugcaucugaguuggugugcaccugagcuggcaugcaccucagccuguaugcaccugagcuggcgugcaccugagcuggcaugcaucugagccggcaugcaccugagccaguguguaugauaaagauugugaacaucugacaugaagcacagcaagcuguugacagugauguuaucuggagagugugguggggagagacuuuagcuuuuugcuuuuugaacuucuuuuauuguuuuauuuuuauacaaauacaauuuucuaaaucuauucuuguggaagaacaugaguuuuuacaauugugguaaaauaaacauaaaauugaucauuuuaaccauguuuaaggguauaguuuaguggcauuaaguacauccauauuguugggcagccaucaccacccuccaucuccugagguuuuucaucaucccaaauggaaacucuguacccauuaaauaacuccccagcccugauuccccuuucugucgcugugacugacuacucuagggaccuccuauaaguggaaucacgcaguguuucuccuuuugugucuggcuaaaaauaaagguauuuuaaaagacauuucaaucaaauuggugcagucauuuuauuuuguuuuuccuuuuccuuuacuuuuaaaauuaauacacaguaagaaugauuaucucagugugcauuucugugaguuuuaagacaugugcagaugguguaaccacgaccacaguuagaauacagagaaauucuauccuccaagaaaacuucccauaccaucccuuuauauucagcucccucccaaucacuuauaacugcugagcuacucuuuguuccuauaguuuaccuuuucaagaaugucauauaauggaaccacgcaguacauagccuuuugagauugacuucuuucacucaccacugugccguugaggcucauuccagcuguugcagguaucaauaguuugguuuuuuuuuugucccucgguaaguccauuguguguuugaacagaacugcuguaaacauuuguguaugagcuuuucuaugaacaugcgguuucauuuccuuuugauaaauguccagaagugggauugcugggucauaugguccguguguguuuauucuuauaagaaacugcccaagucuuuucuaguguggcgguaccauauuacagucucaccagccacaucacuguguacccuuaccagcaccugguauuguuaaguuuuuucuuaagccauucuaauguauauauaaugugcucauugugguuuuaauugcauuuccuaguggcuaaugauguaaaacaucuuuucaugugcuaauuugccaucuguguauccucuuuggugaaguaucuguugaagucuugcucauauuuuaauugaguuguuuauuuucuugauauugaguuuugagacuucuuuauauauucuaaauacaaguucuuugucagauaugugauuugcaaauauuuucucucaaucuuuagcuugccuuuuaauucuuuuaacagcaucuuucacagagccaaacauuuuaauuuugaugcaguucacuuuaucaauuucccaaauguugauagaauccauagaaauaugaccacuuuuauguuguugaucuuggacccucuugacuuugcuuaaccucacuuauucuaagagcuuuuuuguacaaaaagaaauccuuggaauuuucuacauaggcagucaugcugucugugaauaguccauuuuauuucauucuuuucaguuugugugccuuuccuuucuuuuucuugcccuguuucuuuagccaagacuucuggugcaauguugagaaguagugagagcacauccuugccuugcuuccgacuuucggugaaagcaucugucugccaccaugaaauaugauguuagcugugaguuuuccauagaugcccuuugucaggcugagagaguucccuucuagguuuaguuugcugaaagcuuuuaucaugaauggauguugaauuuuuuaaaugcauuuucuguauaaauugauaugccugugugcuuuuucuucugugaguagguggcuugcauuuauugauuuuugaacacugagucaaucuuguguuuuggaaucaacucccuugggcuguggugcauuauuuuuacauauuacuggauucaguuugcuaauauuugguugaggauuuuugcaucuguguucaugagggguauuguccuauagucuucuuguaaugucuuuuucuggauuugcuaucaggguagugcuagccucauuuaaguugggaaauguuuuuuccuccucuauuuucuggaagagaguguauguaauuguuaguuuuacuggaaaauucuaccaaacauguaaggaaccuaucucugagccuuuucagaugucuuuuucagaagguauuuaacuacauauucuauuucuuuccuguuuauaguauugcucagguaucuauuucaucuugugugaauuuuggugguugguuguuauugagaaauuugaucauuuccucuaaguuguugacucuuugugcacggaguuguuugccauguuccuuuuuaaugucuauggggucuguagugauaacauuuccuucuuuccugauauugggaauugggaauguauuaacauaugaggaccucagggcuaguguuuuaaaugcagccucuguguggaaccagucuaaucaggacuguagucuguaguccuagguauuaccagauucuuauggggcuggauucccuuggauuacaugguaccccuuggggagcagcaaaugaggugccuuaggagggacauuaaggcuuuuaagcccugggguagccuuuggugccugagugguaaguuaauaggagcuaccccagugaccugcaggacuucagugucucuagaaguuucagauugcugcccccgagcauuacacaagcauuacacaccgggagaaucugggcagccuuauaccagagugagaagaaacccgcagccaccacuuagaggggggaugagauuuucaccacuuuuccaggguguuugaggugauuauucugaguggcguguugauagguacugauuuauuuauguuuuguuuauuuccaauaaaggccacaaauuagccuguuugaaaaacccaagaaaaauaaggccaaaaggagugguauguuuuuagagugauguuuaagcagagauugcuuugccgucacuuuuuauuuggugagucagggacugaagacaguugacgguguguccuucugaacgcucuguugucagcuuucaucuuaggucauaaaguagacauuuuuucauugauggacuuuggggaauuugguuccugacccugauauuguagcaucuuccuaugugagggaaaaggucacaguuuuguagugauucuucaagugagauuaguuuugcuucacuuaauuaaaaaaucugugucaugcugggguuuaaaauagagugauuuaugagcaauaaaaagaaaauagauuucugcaaauguggaggguuuggaaauaccuguugcagguggaguggagugggguucugugcaaucccuggagccauccuauggcgcugaguuuucucagugaucaaagucguuuggaugagcaggccuaacaccacgacuacccuagucuuucggugucuucucgcaaaugauucucuuuggacaggcugacucucuuucugcugcaggguuguguaacguaugcauaaacagcuggcuaagcaccuccagcccugggagagcccuuggggcugggagggcugcucuccaagccugaggcugugggacaugccacugccagcucucccugcuucugcugugggcauauccuugcagcaauuuauaagaaucaugaggcugggugcaguggcucacgucuguaaucccagcacuuugggaggcugaggcagguggaucacaaggucagaaguucaagaccagccugaccaacguggugaaauccugucucuacuaaaaauacaaaaauuagcugggcgugauggugcgcaccuacaaucccagcuacuugggaggcugaggcaggagaaucucuugaaccugagaggcagagguugcaguaagcugagauuguaccacugcacuccagccugggcaacagagugagauucugucucaaaaaaaaaaaaaaaaaaucaugcgcucccaggugugguucccccucccccacucccccggauuaaacaaauaacacauuuccuguaagaaguucagguaacucaaaggaggagaaugaaaucaacuccuccaccauguauguccuuauguaacugauggcccuagucuccuuuggggcugaauuguaggaaccggauggcugugaacucaaaggaugcugugguauagggaccucggagggagcaucagauguguguguuuucacaaggucauccagguucuacgguguaaggagccgggaagcuggggaugugaggacgugaggagaaagggugggcacgugcucauacaagugcaagggccguguacccauguccuuguguggccaccaggaaggaggcaggcaugauacacgagcugggacaggagugcccacaucuagucauggaaacuuuucagccugaacaacaagggggacaacccccguuaacuucacacauggggcugugaaugcugcagaugaauaauucaguuucuuucugggagguuggugacauuuucguuucugcucugguugcuuguaaaagaguaacagggcccuuuuugggccuugcauucuggagcugguggcucagaaacuucuaguuauagaguaacaagaccacuguggggagggagcagcauccuugaaggaggcuccgauaaugacaucaggcucguauuggucaucgucaugugcacuccgaggugaaugcuugugaccugguagccgccucccugcugcacacaaggacaacucacuggaaacacaguccauguaggcugcagaccauguuuccaugugcuggguuuggguaauaauuacuguguacuaauugcaguggaaaaguggaguuggcugugccuugagagugugcacaugcaggugagugaugcuucuggagcaugaccuugugcacacgggggcugugugcucccucgaugaugcacugcguauggucuagacagaaaggucacucacagaggucaugggcagcccucgguacauauggagagcagucaagcauguguucaccuggccugugaguguuagcgugucccagguguuguagguguggaugccuggggaaagccggaagggaaaggccccaggcagcccucugucuaagguuguggauucuuagagguguucgaggagcccagaaagaauuccagauuggcagaaagaaaaggcguuucugaaaaugagucugcaucacuacgugggaacucagagcggagugaucacccuauuuuuuguacaagucaggggaaauuauguuugugugugucauugagcauuucgugugccugaucccuuggugugugccccaggagcugcggcacugugcuacggaagccccuagccaggccagggcugcaaacugccuggcgugcacccugugugguccugccccuucauggugccuuggacaccucggcuucucacugugucacaugguggaccaucuccucaagccccagugcuccagugagcccaccuuccccccugccuccaagaaaugcaggagucacuccugacaccaucucuagacacaccuuauucugcagcaucaccuucccaucggcuaaagcugguuuccuccuaaaccuguggacuccaucuucuccucauuccaccuuggacuugggcauaggcagccuuugaauggagcacuggggccacccagggcucaccugucuuuguacagcucuguaagucauagauauccgaaggcaaugcaaauaauccuugucccuagacgugcaaauggguucagccuccuggagagacaauugacuccccauggaaaaggcugguauuguguccguuggaaauucaugucaauauucuuuuacucuguauuauuuuuuucuugaggugaaauucacauaacauaaaguuaaucauauuaaagugaauaguuccauggcaguuaguacauuugcaauguugugcaaccucuagcuccaagacauuuccagcaccccaaaaggaagcccccuaauuaucaauccaucauggcccaauccauccccauucccccagccaacuccaugucuuuuugugauucuuugacuuccccucugaagggauugugacaccuccuugguucucuugugagugaugauuuaauaauguuuuuaaugcauggucauuuuuuuuaagugacccguuagcagccaucaccccugggcugaguggccagcaaucucaccggauggauggugcugguuuccuggggacuuaggccccucuugucuguucuccgcgggaugcaccggacuaagggcucuuuuuaaagugagaaucuggucauggagggcaaggaggaacauucugugggcggaucuucccagucuugucugugggucugagccagcgugagaggcucuugggugauauguggaaaugugcccccuuccugggcugguccucuuugccccugacagguuggucagugaguauugguuaauuauugugugcucagugcuuuguaaagcaugcgagauguuuauagcuauagagaggacauggugucaaaaacagagaugcauccaaauaaagcaagcaagcuaauauaauuuagagccagcauaugcuugcauuagagaugucacugugggcugagcagagagcaggacccucgcccugggggugcucuccgcacccuccccccacaccccgugguaacucaggcuuauccagcccucuccaggaggcgggggaccccugcaacccugcccauuuccuaauggacccaaagaaugaggaugugguuuuugucuagcacucaccucucugaugguugaccucugugacugccugaguugcugucaguuuccccugggggugcuucacucuggggagaccaguggguuuugaacccuguccucagugucccuguccucuucuuuguucccaugaucuugcagggagaggaccuguugcugcccuuccuagcugggguguugcaccccacaucugaggggucucuccuuauugaugaacuccugucuuuuccuguccagauccugggcauuggggagguggccagaggcagccuggcugcgcccugcugcuggacuuguaauguguugccccccacccccaacuguggcugccuugccccugagguccucagccccaccccagcuguuuauaaucauccgaaacccaggucggaaggcaggauuuccagccauuccuuuuuucucacagguagcaucuuggugaaauaauucaauuuacaauuaaguauuuuuguuuuacaucuucaacaugauuagaacaaaguguccuuggucccugagagcguagugcaucugagagaagagaggaagaaacaggcucacagugcgguuuuguggcaguuuucuugggggugggggaaggugagucacacucuccauuuuugacugguguucugauucugaaauuuaagaaaagcacauagaaccccaaaagcacgugucuaagguggaaaguggagaaagugcccccaugacugcaaggguugaaguuaagccuuuggcucuaguuggcacgauuugguucuuuuuuuuuuuuugucugagacggagucuugcucugucacccaggcuggagugcaguggugcaaucucggcucaccgcaaccuccaccuccuggguucaagcaagccuccugccucagccucccaaguagcugggauuacaggugcccgccgccacacccugcuaauuuuuauauuuuuaguagagaugggguuucaccauguuggccaggcugaucuugaacuccugaccucgugauaugcccgccucagccucccaaagugcugggauuacaggcgugagccaccaugcccggcccaccauuugguucuuuaaacacaacauagagaccuuguguugugaauacacuuuggagacugguugacgcuaauuaguuuuguaccuccccaccucugcugcgaaaaugaaaaagcagcagcgaaaaagggcuggucaugaccuggaugagaaagagcaagucugggacuugaucaugaaaagcccccaaguagcccugcugaacagauuuagcaccugggaauggaccccugucuacgaagaggaccagauggaucaugcaaaagauggcuggugugagccucagguagauuuuuagcucagaaaugaaugggcuugguuaauaagcuggguuaaccauguuccacuguggcuuucccacugcaaaugcagggagcagcuauucaaagauucugaaaagaauauaguagcaggugguuuggagaggaagauuagaauugcaaguauuccucaacugggcaugagucuaccauuuuuccccaucugguauuccccagucugaacucaacacauuggaaaccuggaaguggguacugggaugcagagaagagagugccagaagccuucuagguuuggcuuaaggaguagaaaggaacauucuaguguucagaguacagacccuuuuguucuguuucccuuuucuguguucucuuacaugccucucuuucucccucgcuccccuccccucgcucgcuccccccuccuuucuuuccagcacagucuugcucuuuuucccagcuggagugcagugacaugaucacagcucucugcagccucaaacucccaggcucaugugauccuccugccucacccucccaaguagcugggacuacaggugcaugucaccacacccagcuaauuguuuuuuauuuguagagacaggcucucacuuuguugccuuggcuggucuugaacuccuggcuucaagugauccuuccgccuuggccuccuaaaguacugggauuacaggcacgagccccugcaucuggcugggacagcuuuaaauaggagguguuguuggcuuguuguuguuuugaguuguuugccguagacugguauuggggaauuuuuacuccuucaaauugaaaacauuccaucauuuugccaaaaacaaccccaccuauuuuguacagaaaacacagcucuccuuaaguggguaugccacagggaaaaacauuuccacauuuuaucagccgguugccugccguugcucacaucaauguuguuauaaaggaagagcauugguggccacuucccuuggagccugcuucucuguagaagcuagccuuaugggcuuuugugccauacguuaauguacagauaauaaucuuaguuacugugaauuauaauagcaccguauuuaaauucuggacugaguuagccagaugaucuauaccugugagaaaucaaguuucaagaauuugcagugcacucacaccaagcgauuucuggcauuucuuucugggugugcagaccacccugggcagagagggagugauuuuagcuucacgugcuucaguuagggauucagcaaagccugagaauuucccuucuuaacccaaaccacguuuaaugcaucacuaggaaaagcagguugguaaaacucauccuagccuuaaaauuacccauuuguuguucaagaaauauacaucaggccaggcacagugucucaugccuguaaucccagcacuuugggaggccgaggugggcagaucaugaggucaggaguucgagaccagccugaccaacauggugaaacccugucucuacuaaaaauacaaaaauuagccgggcguaguggcgcacgccuguaaucccagcuacucaggaggcugaggcaggagaaucacuugaacccgggagguggagguuccagugagccgagaucgcaccacugcacuccagccugggagggagagcgagacucugucuccaaaaaaaaaaaaaaaaaaagagaaaaaagaaauacacauuggcccuaggauucaggcuucccaggacucuggggguuuaugauguccaggacaccaugauuucuguucauaugcuacucuccuaguauaggagaaaaauguuuggagguuuauucuggcagccuuccuguggugcccacacuuguccugggagggcagugagucaccguugccuccucaguugucaggacucagaacugcagccauuugcucauagccauccaugugaaagacgcaaacauacaauuuggagcccgagugcugcuuuaucuauugacgugcuucucucugugggggcgcuuuucaguuucacagucaagaguauauggggugaaacguuuuguugggauuaccggucccaauuucugcucguugcugauagcuaagagguacccuuguaagguuccugauaucccuggcaugcugcuugcuagaaaagucauugacagcagggaggggcucacacuuccacaccaccuuaagccuuguaauuauuuuuucuggucauuuuguagggggagaguggcaucuugcuuuaaucugcauuuuucugaccuccagugagaugcacauuuucuuucguguguucaguugcaguuugcagugaucuuagaaaagagaccuuggggcuucaugagugugcugaggggcccagcagagcccccgagcaugacuguaggauuaggugauaggguugucugcccugggagcccuuucucucugcugcgggguguggggaacagcaggucgccuucuccguccuccccuucggcauaugugguggccacauaugaggcuaggugucauuuucagcuggcccugcuaagcccugccugucugcaggaggagggcagcuuacacaaaaugcccagugugcugaguuccacgcuggagggcauggguucuccugggccuguaggaugcccgugucugugaggggugugguucaccuucaguguugcuucuccccuuuuuccuugcucugcggccuccaggaccagcugugcaugugaggcugggguaucucugacauauucuugagccgucucaugagcagugggucugaaccgguggaaccucgguuaaacaugugaguaccggucuuccaggaggcagaaaucaaagcucucaccugugcauccauugcaugagugugugacacauuuuggaguuucaaguuguuuguaaucaguaagcaguugucaaauauaaaacaaauccagacuuaguaagaagaggcuuucuuaggaguaugcaaaggaaggaauggacugucacaguaggggccagggccuggccacaugcugaccaugagaucacaugugucugaaagguuaggccaaagggcuuuucuuuguagggugguguagaugaggcuucgaagaaccagaggugggauaugggaugaagguggcagggucaaaggaugccuuacccaaggccagcuguuucucaggaggggcugcacuggcucugugggacccaaggggccuggagaaggacagaagcgaagcaagguuugguuaugagcauuuuguugugagugaucgggagcaggcgggggaugcaucgugccacuggccaucaagaggcacagagcaggcguugguggguuucugugucuggccuuauccugggugggugggggcaucgugagccuuagcucaguccuguggggaaggggcuuuuuuuguagcaguuguuucuggaacgcagagggcaggggauuucuuaccuccugcuguuuucuaggagcacuugacauuguugcaguugucacccagaguuuuacacagaauaggguguguuauuuaguaacugaaugcuggccugggcucccucguguuagccacaugggcccucaaaucuuagccugggucuuguggcgugugggccuuucugaccagcugaggaccuuggucccugcuucuagguagguggcauuugagccagguggagacaggaaggaaggugccugccacacacaggggcagcccccaaggcuugcagggaggaugagggucagcccccuuugggacccagggcugagcagggacagcugcagggaagaggcucugggucugcagggggauucucaucucuccaggaggauaagacccucaggaauguuaauaagacucccccccaacacccuuguaggcuguuucucacauugacaugcucuugccuuaucaguaucucacucccugaaaugacuuucuccaguuguuucuuugcguccucaggagagccagggacuuuugaugcagcuuggcacacaaaagaagcaaaaagcauucacugacggaaugaaugagccacauccaaacccugacucccuuaagcugccccagggacuagaggcuguucacuggaacuacagcaacaucaccugagggcccauuagaaaugcauguucuuggacccccccagagcacuaccggacuggggcuccaacuggggcccagagaucuggcauucagauccuugccagggguucugcugcaggccgcaguaugagaaccacugaccacaggcacauggggucucuaggaggcugcgauggcucagaaccugccucugagcugcugaggaggaaggaggugauucuuuccccagcgugugagugggugggaaugcugggcugcagcucccuuggggagaggauaaggaccaugcacaguguguguaugaguaugcauauguguguaggcacauguguguagguagauguguauaugaguacaugugggugugugcaguauaucuguauaugagugugcguauagguacauauguuugugcauguguuuguguguauguguauccaugugggcauauguauccguguguguaugaguguguguuuagguguauaaguguguaugugaauauggcaugcauguuuguaugugcauauauguauaugugugugugugcaugaguguguauggaugugcguguuuggauguauauaugugcauguguauguaugugugucucuguagguuugugugugauuuuguaugugaauauacaugugugcuuacauggguaugugggugugguguaccugugugcauagguguauacgugugugcauguaagugugggugggugugugucugcuuggaugggugugugcauguaugcaugcaugugaugcauguuuguggcauguguguggcauguguguggcaggcagucuuuuaggugggcccaggaagggaacugugugaccagccauggguuggccuuccguaggauguaugcaccauguggaauuuguaguuuccacuaaagaaaaggggcggugcuaugugggcaacugugguauguaucgguugcagugugcaggguaaaaacagcccuaauacggaagcucagaaaugcagggaccaaguugccuucggauccccaggccacuccacagcacgaaaaaccuguuacuacucucuggacuguccucccaaaagccuguguuuccugcgcagccacucacaugcauacguaaggccaccguggaguggugggcuugcccuggcuccccuccacagccugccuuuuuauucugucuugggcaguucccuuuccacacaaggucaccuccucaggguuuguuuuuuguuguuuguuguuuguuuguuugagacccagucucgcucuaucgaccaggcuggagugcaguggcacgaucuuggcucacugcaaccuccggcuccuggguucuagugauucuccugucucagccucccaaguagcugggacuacaggcguguaccaccaugccuggcuaauuuuuuguauuuuuaguagagaugggguuucaccguguuagcuaggauggucucgaucuccuaacuagugauccacccaccuucggccucccaaagggcugggauuacaggcaugagccaccgugccuggccuguuuuuuguuuauuugcuuuuuugagacagggccucacucugaugcacaggcuggagugcaguggcacagucauagcucacugcuugacaaccugggcucaagcaauccucccaccucagcuucucgaguagccgggacuacaggcaugugucaccaugccuggcuaacuuuguuuuguagagauggggucucacuguguuguccaggcuggucuugaacuucugggcccaagcgauccucccaugucggccucccaaagugcugggauuacaggcgugaaccacugugcccagcugaccuccuuguucuuugugaugggugcauacacuucaguguuuggauagaccauuuauuugauucuggucagccacugauggacuuggaagguuuccauggcuuugcuacgaugcaggaagcacccucaugguguagcuuuguguccaauuggaaugugauucagcagcaucccgagcgucacagucaggugcacugggucugcuccccaccugucaggcgcugguuuccccaccccaucacaggcucugguugcuccaccccaucacaggcucugguugcucagcuuuguagguuacugcucaucagaaagaugaaagcgaccauccugcuucaguuuguuucuuucaucguuaaugacaucgaacagcuuuucccuucaguugccauuugcggcucugugccuugugggaggggacuuugcgaugcucacucccugcuccaggaggccagugaggaaggaaggagcccuuugcauuuucucagaguguugauucauguuucuccuuaaugcaggggcauuaguaagccuuccgcuacuucugacauuauuuaaaaaaaucccucccagcuggacgcgguggcucaugccuguaaucccagcacuuagggccaaggcgggcagaucacuuuaggucaggaguucaagaccagccugguuaacauggugaaaccccgucucuacuaaaaaagauacaaaaaucagccgggugugguggcaugugccuuuaagcucagcuacucaggaggcugaggcagcggcagcagaauugcuugaaccugggagguggagguuacagugagcugagaucgugccgcugcgcuccagccuggagacagacugucucaaaaagaaaaacucucccaaauucugguuccuguuuggauucuucuuuucuucucucucucuuccuugcccuccuucuccuccccuucuucuccugauuuugguuuuugaguauguaauuaauuuuaaaacuuaaaaaguguuggaauauugaaugcuagcacugacauugucuucauaugugauuuuaaauuagggacuguuuuggagcuuuguacuacaguguccuucuugacuacaccuucauugugggucacaggguuucuggguuaggccuuggcccacccuggcugccuccugcacuagagcucacgccuagugauugugugcugagccaaggagaggcucucugcuaaguuggugccuggccaggagcagaggggaggagagagauggguagggugaaggaaggugcagaugaugccucccucccaguucuugauaauccuugucuguuagcugugaugccuccucuggucucacguggccagguaagcuguauccuguaacugacaguucucuaggacgaugcucuugcagucccugggggacauuuuucgcacaggguugggguauggaauuguguguauguauauuguaagggaaucugguaguuuauccugcuaaaaugugcccuuuucuaacucuguuucagacucugcuaacaccagauaguggaaagaaaccaugugcugaaauguuugacgacacugaugguuugguaagugucggcgucucggcgucugccugagagccaugguuccuuuuggaacuggcuuuucagaaggucuugucccgguguuccauuccucagucagcagcgaugcccauucacugugugaccugccaggcaggugucuggaaagugagggaggaaggccugucucugaaagcucaggugguucugccuggagugguaagggucgguuuaggggauguggauauagaggaagucagaguggguggggcaggggaggcaaugagcgaggcaaugcugaguguggcuuguuugguggugagcccaguacccagccucagcaccagcuuccccggcaggaagggaagggccccaguugaggaggugccccugccuggacuguccccugaggacuggugcgccuaggaguucauauuggguuguugaagguggucuuucacccgacccuaggggucuucgggaucuggugggcaguugcuucucuucuguccacuaacucacaccccccaugccccguguucagggaggucuggcaaaggcaguggcuugggcuggggugagguggaccggggacagcccccugggcugccacaccuuugcucccaccccugccuuucaagugugcagaguggacgaaggggcugcuuguugucugaaauuucagagcaucaggccacacgggcccugucacagacagcaugugggugcgaguccgcaugucauggcagccccaaagggcacugggcccucccugucauggaugaggccauggaggcacagcgugaugaagugauauuguuguaggcuaugacccaggcuacccguuuucucuggcccuguccccacccccucccaacuguugggaucgggcugccugcccugcagggcugcugggccaugggcuggcccgucacuucauggguucaguuuccuucucuguaaaugugaagaggcagagccacccggggcagcuuccucgaggggcggggcuuccucacccgugcuaggcacacgccugggcagaguccugugccagggccccacugggucagcugggggcugggagugcuguggcauggcugugucucuucgccaccccgaggguggccugggcuggcaugggacauguccuugugcugugcaggauuguaggcucugggggacucacccugugcagaaugcugcccucacacccugccgucaccgugggacacccacugcgguuugacacucucacugggugugggaagugcccucgguagccccaggagggaccgucuucggccagcagccaccuaugcaggucucucguuuccggcuuguuuacgugcuuggauggaaccagaagagaagaggucaucagaagaagcugcucuguuugauuugguggagggcccaccuguccaaggcccccaagguccacuccugcuagaucugguguggaaauagaggagggagugaaaaucuggggggggcugaccaugucagccacaccaagcuaggggagccucagccacguccacaccaccuucuguggccacuccuggagacauggauuaaagguugaugcaggugugucuguguuagaaggcguuucaagaugugacuuuagcuguaagaggcaggauauguaaguccuugcauccccuuuagaaagccggguugugacuccuacugccucaggggugccuuggcccuccuggucuugcccaggcugggaucuuccuggaugcagcuuucacaucauagauagucugcauacacaagaccauuugcaaaggacauacugaagauuaagucauauauucuaucgagaccauccuggcuaacguggugaaacccugucucuacuaaaaauacaaaaaauuagccaggcgugguggcgggcgccuguagucccagcuacucaggaggcugaggcaggagaauggcgugaacccgggaggcugagcuugcagugagccaagaucgcgccacugcacuccagccugggcgacagagcaagacuccaucucaaaaaaaaaaaaaaaaaagacauauauucuacaacuuggguugaaguagaagcaaaaauaacuuuuaagggacuuuucccagcgugaaguggcccauauaaggugcuuugccagccuuuguguggggacaaagcaggcauugugguucccggugccacugugggccaggcccugugaugcugaguccuggagacagcacggccaccacaggaaccugaccgucagggcuguguguccacccagcgagggccgcgaccagaugguucugggaggccuggcuuagauuggucugggguacuggggucucuacugcaggccuguuggacguggcuggaaacacggccugggggccaucgccuuccagcagcuuccccuagaagcauaggauaagacaggcagcaaagggcucugcguccucagagaaaggagcacagguuggcuuggacaucugucugggggagccagagagccacaggauacaaugcugugucuugcgugugauuucuuagacccaaacucuuacacuugcaugugcuuauggggaguugagugcagaaagugaauuccuuugaguuuggugguuguuuugauaccgccugcauuuaagcucuuccuucuuaauuuacaacaacccuguagucuuuauaaagugcacugugugggugcugcccagccucccuagggucugagugugccccacugcuuggaggcagggcugcuucaccugcacugggauggagcccuguucauaggagcugggcuuuauuuuuagcagauacaguuccacgucucacagaguugagagcaggaagacuguagauuuaauuaaaugacacugaaaggggagguaauuacuucugcauguuucaggaggcccaggagggugucccagguccucugcugcagcccugugaggcuguuaccuggaaaacacccaagaucccaucccugaugggcacucaggguccugugcauuacucugacuaaugaugaacaaugugagcuuuccucucugaagccuggcuuuggagauaagccaugcagucuagagacagugcagcaggucacuucagaggaagcauggucaagccgugcaucccaaagcugcuuuaacaggacgggacaccuggcgugguggcucacgcauauaaucccagcacuuugggaggccgagguggguagaucaucugagguggggaguucaagaccaauguggccaaauuggugaaacccccaucucuacucaaaauacaaaaauuagccgggcgugguggcucaugccuguaaucccagccacucuggaggcugagauaggagaaucgcuugaagccaggaggcggagguugcagugagcugagaucgcaccauugcacuccagccuaggcgacagagugaaaaggcugggugcgguggcucacaccuguaaucccagcacuuugggaggccggggcuggcggaucacgaggucaggagauugagaccauccuggcuaacacggugaaaccucgucucuacuaaaaauacaaaaaauuagccgggcauuguggugggcgccuauagucccagcugcuugggaggcugaggcaggagaauggcgugaaccugggaggcagagcuugcagugagccgagauugcgccacugcacuccagccugggugacagagcgagacuccaucucaaaaaaaaaaaaaacaaaaaaaaccaagacaggacauagaggguacuagcaccauccagcugccucuggcacacaggaggggccgguggccaaggguucauuuauaguaaccagaagcuuccacacccucaacacacucagauccauagcaccuccuccuaucaguggcugugucggugguacugccuccuuaugccucauaggaucccugcuuaguauccuagcuggacaccacaccugauacagagcaccagaagugugcugaucagagccgagaugccuugagcaguuacaaagaguuugcccacagaaggcaagaugcacuaccuuguucaugaccugcgugcaugacaugcagaaggauuguauuuuggauguguauuggguuagauaaaauauauuacuaaagcaaacuuagucuuuuuuuuuuaaaugagcaaauccaaauuuauuuuaaugucauuucauuuucaauguguuuaaaaaccucauaaguuagugggagcccuaguuuccugggacagcaugccggagguacugaaauuugucaccuuucucuacaaagucccagcaauccaauccaaauccauagcuucagaaagccaggaguuuuaucuucagucagucuacuccucugguucuucguuuuucuuucaagggagggagaucacaauauuucaaacagggaacaaauccaguugagcuuccagcucagguuuguguaagauggagugagggaagaccccauugacuccagagaaaaggguaagguugagauggauuauuucuuuauagcuuugugaaaauggaagaaaaaagauugacaaaugaggauccauuucauagaugggaauugcuucauaagugaaggcuccagcuccuaaaaugggaggggccugacugacagccugaaucagaugaggagucggccacaccgaauaaaaacuaucugaaaaauaauccuccuaauuuugaagccagauaaaauacuuggggagaauggaaaaagaagaaaaagcccccaaauagauggaaaaaugcuaacaucagaaugguauaaaaaaauucggcugaguuuucaguggugguggcuaauuuagcccuguucuaucguaggguuacaaaccuugaccaagcagagaguagaagaaaaggcuaggaagaggggcuugaagacaaugaauuuugacuccugauuuuauuauuuaauuucuuuuguucaauuaaagucuucugugguugggaagccucgccucccaagaccagagucagauggagcugguuguuguuggaagggaguggguugcaaaacugggguggcggcagggacacccccacucugcuggcaguccuagguggagaagaacugcacuucacagagucuaggguguggugggaaggggaugaggcaggagcagcaagcuggggagaugggacccaccuugguccccagcuucauuuucuucuaauguuuccccacugguggcauucucugcagucuuggaggccuuuuuuuuuuuuuuuuuuuuuuuuuuuccuggguuuuucgacuugcagaacucuggaggagggucuuuagcucugcauccuggaccuucaucucagacuuauagaggucaggcuggaagggaccacugguuaucugcauggggccauugggcaggagcagaacuguaaauuuaaacugggcaacaaauucacccuccuucucauagagaacauuaaaugguugcagcauuucauguuuggcgcacuccaccacacccauccaagccuucuucucaucuucacaugcucuugaaguaaauggcauggcaucaaaacgccuuuucaugucacugaagaaggcaugucaaguuuucauuuucaguccauacuguuuggaggggucucauuuguacauagugguucucucuccugcauccuuggucuugcccuuuccugagcugaugagaacauccacagcauauacuucauguaccucaaauucagcuuuuucaugguccuucuucugcuugucugugggaaucuggguaaugguuuuuucuccaucgaugacaugcugcuucagcuggugugacagcauaccuucuauuggcaugcaguuaaauaagugggcaacuuuguuccaggcuucugucacuuguguguucugauuuccaggugugaccaggcauggggcagcuucagcacaacggugagcugccuuaauaacaucugcuuuccucccuguuacuuggguccccugagcuacaucagucagaaaaguacgagcuacauuagugaugaagccauucacauggaccccaaggucaauuuuuaccaagucaccuuccuugagaauauaauccuggucucucuucaaaggggagaagugacauacacaguuauuuaccaaaaugcuggugggaaaagcaauacguuucuucaucucuuuuucuuucuugaagauuuucccuguuucuugcauaaucacggcaucaccuuucucacacaggcucaguacugacacaccugagcuagaugcguccaccaaggaccgaaguaccccauuggcaaugucacccccccaucuuauaguuggucacgaccagguccucggcgauaguuugcuccugcugcucgucuuugccugacaucuuccugccaccaccacugcagccucguuuccccugagccgccccucugccucccuucccagccacaggcuguggucagagcucccucgauccucgaggagagggccagcgaaagccgcgaacuuagucuuuuagcgugacuucuaagagcaucugaaauuauaccuguggcucgccugguagguguaggaucuaaacugcucuuuggugcccuuggauuugacuuccucuccugcucaggccccgccucuguaguugggagcuagugacuuguaacaaccguaucaggcuuugagaguguuuuuagccagcuuuaagugcuauuauuuugcauuuuugcagacaauuacaaaauagccugcugggccuuagcaaauagccagguuucaccacugagauuguacaucugccgggcucccgggccugugcuuucagugagcauaccccuccccaaaaggccccgugcuauccgggcuugugucucccuuguuuucuguggguaagacuuacacaguguauuugccacugauuuuccaugucccagcuguacccugaaugcaucaaugggcgugcucagccugcaggucagugaugguuugugaugagccccauccugccuucccgugggaggaggguccccacguaacccuuucaggcccugaccuucacuugcuuuggccaccccuggggucccacugaggggcugcuaucuaugcagcugcaggacacacgcuggaguccugggaaaagccccucaggcacuuccacaucuggccgggcuauuuauaucccucaaaauggcccauuuuucuuugcagagagugaacaugugggcaaugcugucaugcccgccagugaagcccgugaaacaagcccuuucauugaauagcuuucugggugcgucugacacauucucaucuaugugcagaggccucgugguuuuacgccuucucugcugccguuguguggaucgcuguuccucagaguguaggcgggcuguggcccccacggcagccuguuccuggugcuggggcagcccggcuggucuggguaggcauaccuugccucccugucucuaucccacaucgcccaggggaggguggguccuccauggccugucaugcacaguucacugagcuccugcccugggucccuuaugccugggcaguggggcaucagcagaggaaauaguauuuacuguugggguagacagaccccaaaggagaucaauaggucagguaugacuggaguuacaagggggagaaauaaagcggaaaaagaugccaggggcaauggcuuacucuuguaaaucccagcacuuugauaggccgagaugggaggaucacuugaggccaggaguuugagaccagccugggcaacauagugagacccucaucucuauaaaaauauagaaaaucagccaggcauggugaaaugcaccuguagucccagcugcucaggaggcugaggugggagugugacuuaaggccagguauucaaggcugcagugagcuuguaccccagcgugggugacagagcaagacccuaugcaaauaaauacauaaaaauaaaauacaaauaaauaaauacauaaagcagagaaggagaugagacggguucuacaaggggagcugggcugauugauggagccaaggcuggcgccaugccugugccuggggaggagcaccguaugcauggggaacaaaggagcaaaggcccugagacagauaggagcaagucuuggguguccagggagcacugaaguggugguggggggcagugggcugaggcagagucaggaaggguagggguaggagaggagguggugggugggggaguuugagggguuggggaagaccccuggcuucuggggaaaaugggccauugugggggugucgggcacccgguuaggcugugagguggucugggagagcggugcuggugugggcacggugcagcaaugucgaugaggaguggcucccuucagcgcuuauuugaagguggacccagaggacuugcugccagcuuggaucuggggugggucauggugggggucggggagcacagaacacccuggauuuuggccugagccauuggaaagacuuaggcuccaagugggcuuccaccugggcugucucggaggcaucucagcuuuggggaggugaggagcgugguuuggggacacaggaagcuugaggugcuuauuaguggggaggaggcugugggguaccuaagccuggaguugaggaaacaucugaggacuagcccaaggguuaguccugacuggagccggggauauggaggucucccagggcaggcccccucagaaugcccuugcuccuuugcugucagguagagacaugucugaaccugcuccuguuccaugcuggccugcaagggucacaaggagagacaaacuuuugggugccuccaucgagauuggaaggaccgauaggcagcgggcgagggagggucgggguucggacuggcugcugggcugcggugggagagauggucugggccugggagaugagauggacagauccacaaggauaggacacauggcaggauuuggaagggaaggcaucuggagaauugagggucuccucuuaucuccugcagucuuugggggcagcaccuaucccacaggggcacgcccagcugagacuucgaguccuccgagcuggacacagugugggcagggagcccgccugaggccugggugcagcgugguguggggaguggaaggcacguccugaggggagucacuguccucccccgccagugugccuggcacauaaccccccuuucaugccucagucuccuccugcugcugccuuguuuuagaagguguggccaccaggguccaggauggcccacaccccugcugaggggaagugggaagcggcugauccuuugugcagggagccucggagcccuggagaaguccugggaggcagccuccccucucugcccuccuugguggcccgagagaggccccguggugcuuaucauggagacgggaugguguuucuuguuuucuuuagcccauguugggcuggguggggucauggccuuggagcaggcccuguucagagccacucagucagucucaggguuuuuuuuguucuuugguuuugccccuugugguaggccaaaugauggcccccgaaaauaccagguucuaacccuuggagccugagagggugacuuuauauagaguuagagucugcagcugggacuaaguugaggaucuugagguggggagaugauucuggacuaucuggugggccccaaaugcacucacaaguguucuucucagaggcagcagagggagaucgggcacagagggcacagaggcuagaguaguggugggugugggguggauuuuaucugccaauugggcugggccucgggugcccagauaaguggucaggugcuauucugggugucuguguggguguuccugggugagguugacaugagaaucgguagacuaaggaaagcuguugccugggaagcaggauggacagaccugcagggauagaacacauggcagggccuggaagggaggggguccgggacaugagggucucgucucaucuccugcugggggugcagugcuuguccugcauggcaccuccagcugagccugcagagaccucugagguggacgcagaggcugggagcauggguagggaacccgccugaggccuggguauggcgugcaaaguagaaggugggguaggagguggcccuccccagagugaguuggccucacccaaucugucgaaggccuuaauagaacaaaaagacccggcuucccaagucagaggggacuucggcugucugacugccugugaauggaagcuucacagggucuccagcuuguggaugacagauccauaaucacgugagccgagcacauaauaaaucucucucucucccugugcacauccuauugguucugcuucucuggagaacccugacuaaccaaagaaccacaaagcaaggaacgcugcugccaccagaaacuggaagaggccaggaagggagucuccccuggggccuccagagcgagcaugguccugcugacacccugauuuuggucagugaaacugaucucagaauucuguccugcagaacugugagggaauacacuucuguuguuguaagccacccaguuuguggucacuggugagagcugcugccugaaaaccauacaggcaguguaaacagugcuuccgugaauacccuggccaugcucuggagcugucauucagugcauggguuucagggagcagcacucacgguccaaagagcgugugucucuuccuuguaauagaucuugcaggauccguuucugaaaagauccaacaguucauccuuucccugugagcacagggagcucccuguuccagcaccuucuuucggcgguggcaugaaacacuauaaacugacuugucagucuucaagggcagagugacagcuuuguggccuugauggugucaccccagauccuggugagugucgcauccuuguuggauauucuguggccguuuggaucuucugugaaucgccuguuguguguugugacccuguucugucgggauguucagcccucuuuugccaaucuguaggagcucuggauuuguuauagauauugaucuucuuucuucugcuuggaaaacguuuauuccuaauucuuuucuuugccaguuucuuuuauuaauguaucauuugcuguccagauuaacucauuuuauggucgaauaugucucuuuucucuuagggcucguggguaccagcguuuguuaagaagauuacauggguugucugaggauuuucuggcaggaguuuucuuguuuuguguguuugaauuaaacucuugaacgugucuagaaugcuuuuaacaugaaauaauaugcuuggggugggggagggcaauuuuguuuccuuccagugugccagcacuaauuagucaauaauccguccuuugaccaaugaauugaaugacagcucuguggucuguuagggucucauguaaacuggguuccgucuggggauccuccaucccacucgcuggccugcuugucucuucacgugcccacaucccgucaguagcggcugcagagcaagugcugauagcugggaggaguccccucaugugcugugugugugaugacgugcuuugugagccgugauggcaggagugcuccuguguaugccuguauguguuugccuguguuucuccuuaugacuccugggcagagcaugauaaggguggguacacuguagcugugcuagaggggcagccagggaggaggccauggagguggggagggaggccaaggugaagcaggaaaacagagaccaccagguggacgcagaauuaugucuaugguagguagguauaauuucuaaaaggcaaggugucuaggacaauaaauguaaagcagguuuauuauggggggagcagugaaaagagaacccuucgugucagggacccacccacugcuuggauuuccuuugggcaugagugcccugacucugcccguggugggaggaugcaugggcaugcaguggggugaccgugucacugcagcuuaggugccugugccuggcccagggcugccugacucugggccccugaggaugcccaugcccaggcaccucuggcagcuggcaccucgcagucuccaaaugcucucugugccccaucuucuguggcacugcuuuagcagggcaggccacaccuaugcagggagcccaggaggucagggccugcaguuacccacuggugaccccagccccacccaugcuguggagggaggguagagaguuucaggugccagcccauacaggacucacagccaggacaggaggcagccagguccuggccaccagcucggaggcaggcaugggguggggugcagcugagcgcugcagggccagggccguccgccacccgccuaccccaggcagauccuccucuggcggcugcugcuggccggaccugcuucccggguggcuauuaugggcggguggaguccacgcugugcuuuacugggagggcucauuuucugucagacagcugaaggcuccacucugcagggacaacaggaccgugguacacccgcuucgaggucagugagaagguggacagggcagccaggccccgugggaagguggcuggagacugggcccaugggcauccugguggcccuguuuaagcuccuuguucagcccacauauggcuuguggcuggaguguguguccaguugagcacuggcauccguucuucuccagagcaccucgcgacccggccucuguccagggggguaguguggguggucauaaucccgccacugacagggaagucucacucuugaagcuguggagaagucccuaggggaccugauggggcugggcucuggacugugagucaccuccuggggagaagagccgccuuccuccugggaggcuucagucccaggucaggcagaggcugugcaggcaugcuguaggggugcagggggcccuccugcugcugagcacgguccuggugggcauccgagguugcucuagccccagugaaggcccuuaaaagucucacaggcugugugaugacaggcuugucccagcccaggcccggggcccagguuugcagacgacaccggcacaugcgugaaccaggguccccagcauugacucacaucugcccgggucugguguuuccucgcugggaaauggugagaaggauggggagggcugcagccaugccagacacugucuggugcugaucccucucugggacggaugcaguuaugaaccccaggaacccuccccuccccuugcauguauccugacagcucagggugagugggucugauucuuugcuagcuguuggggccuguggaagugaaacucauugucuuuuccauuuuuaccuugaacucuguguuucuagcaaguagaggaagaggaccccggccaggcagaugguuuauuuuuaugcaugguuucagauggcgcccaccccuccuccccuccuugcugcugaccaucucacucuuuugacauguugcugcugcugcaugguuuucuuacaauuuuuucuauuccacugcauuuuaacuaaugagguccguauucuuccugcaaagcugccauguuuaacagaggacucuuggagccuggcaagcuuggaaagagcagguagcucccuccucuucugacaggcgggccaguggggcuggaguggggggcuccagcagccccuaccacccucguggcagccguggugcccagagccgacccacugagccccucccagugcuuuggccagugaccuugaccugggccguacggcgcagcaaaccaugucucuggccugaagauguguccugggccaggggaaaagggaaggaaacagccccagcucacugggugcugaugauggggaggggugaucaggaacaugcugaacucaccagccuggccauugcuggucuacacauccaugaacugugcaagauuucaggcacguuaaauaacagagccuuacaguccaauggggaagagaaauguguaaacacagccauggggaugggugccuggugagggacugucaaacaugggcguggccaugagccccucuugccagccucuagcccucuguccacacgguggggccuggaguugcuggacuucccuuucacuuagaucagaagcugaaguuuaacagugugggcugggaugggagugugggagggggguuagggcccaggcaggaaagcuggacgcagagugguuagacagguauuggggcugaaaugacaaagaggguacugaggacacccagggacaaagcagccacagccuccaggcaggucccaggagcccugaggaggagccauggggugguggggaauugguccccucccugccugcugcuuccaggcugcccucacuuccuucccauggucuggggcauucugauccugacacagugauguggggguggcccaugaugugggaaugggggccuggccgguaccgacaucuccagccagagcucaggguugccucugccaucaucaccucggccacauccccuuuccuucugaucccagacacauugggcucugucuugccugcuguucugucugccuggaaagcuaauguuguuggugccaaauuccugaagaguccucccugauggcccguccaccacgcgaagcuguggaaauugcccgcugcugggaggaacagugccgcccggccgaguccugcgcguguguggaagcggaggccaaggguugguauucguaaggucugggaguuugguuuaaggcagaucuuucaauguggguggcuggucugauuuggacugggacauguuuacaauguguaauaagacuuuaagaucaguggacgcagcagagggcgugaagccagccugauggugguuugcugagggagcagcuugcccaggagaguggcuuguuguucuuagaaggacucccugggugagcaggucaaacaacuuucaggagcucugaucagucaaguugcaugcuguuuugcccucuuggguggaaauuugcugcaguaguccaguuaaaguguacuugugcauuucugacaccucacccuucagguccaacuuagccuccucaccaggccagcuugucuccuguaguucucuuggcacccuguguguuccuacucaggacuugucacagugugucaucacacacacgcaagcacaugcugugggacauugaugucuugcccacuggaaggguuccguaggguggagucagccccacuuugcucugcuggcacuuagcacggcauguggcacguagcaaguaguuaggaaauguuugcagaggaacaugaauaagucuugcacgaggugccggggagcucagaggaggaagcagccuccuuuuuuuccaggagaccaggggacgcuuuacccagaagggcccugcugcuguggagggugcagccuccuugggggcugaguguggagggcaagcggaggguagggcucaggggccagggugaugggugcgggugggagguggaucagacagcauugugaggguaaaggguugggauuuuaagcaaaaggcagcaaagagcuguugaaggcuuuuuggcagaggcaugucaagaccagauuuggaguuucgagauacucauguagcuauaccaugggggugggugaaagcgugggugggagaaggcacaggggcuggagaggaaugggagggaaggcguuguggucacugcuuccuggcaggggcggggagggagccucaacugggucuguggggcagaggagccagcaccacuccagggcucgucccggguggguguggauggagaugccacagccugcguggcucccagggugagggucaggcucacagggaggacaccaggccucuuaucguggcuccauucucuguggacugcccuuggugggacuaagagcaggcaggucuccauguguccuggacacggcuccugacccagcacguguguccacuuuugggcuguggugagggugauugaggggcagugugccaauguagaaugacuauauggcauguuugugggcuaaaguaagugaaugcuuaaauugacacuaagaugcggugagcuugaucgugggucggccgguuuccauucagcuaaaauucgugaagugggggcaucacugacuuuuuuuguaaagagaaaauaaccuguaaauaggcuuuuaaaaauagacacuuacucuugcuuuuuuuguaaaucagauugaccugucagugcacucugggguccggccagcugcgaugaucuuuagaccagucagccgccggcugagcugacaccuuuuagauggaaauggaauaaaugcugcaccacauuguucguguggguggugaaugcagguguuugaaaccauuagcuucuuugcauaauuaaaaaccuuaauuuuuugugaaaucuuuaaucauagaagaaaugcuucuuuccaguuugaguguuucucuuaauauuaccauugcuuuaagacaauuaccuucagggcucauuacuuuccuggacaguuuacaggccagaguggucuccacucagccacuagaucuuagaggauucuaagaaacccuauucguuaagccagguaacucauauauucugaaucuauaaacaugucugaaaauugugaaacauacuguagaguuuauagaaguucuuaaaauacauacauugugccggguacgguggcucaugccuguaaucccagcacuuugggaagccaaggugggcggaucaugagguuaggaguuugagaccagccuggccaacaugguggaaacaugucucuaauaaaaauacaaaaauuagccgggcguaguggugggugccuguaaucccagcuacucaggaggcggaggcaggaggaucgcuggaauccgggaggcagagguugcagugagcggagaucaagccauugcauuccagccugggcgauagagcgagacuccauguuaaaaaaaaaaaaaaaaaaaaaaaaaaaaaaaaaaaggcccggugcgguggcucacaccuauaauaccagcacuuugggaggccgaggcggguggaucacgaggucaggagacugagaccauccuggcuaacacggugaaaccccgucucuacuaaaaauacaaaaaauuagccgggcgugaugguaugcgccuguagucccagcuacucaggagacugaggcaggagaauggcgugaaccugggaggcagagcuugcagugagccgagauugcgccacugcauuccagccugggcgacagagcgagacuccgucuuaaaaaaaaaagaaaagaaaaaacauacauuguauuugauucuagucaaagaacauaaagaauacuucgauuuuuugccucaaauaucccuaacacuagaaauguuguuugucucaggaacgacagaauaaagugcuucauaauguggguuugacuggcauagcuuucagcccgugauguacuggauuaauauuuuaucuaauugcaugaccccagcucugucgugagcaggaguugcagucaccaggcucccgcggugaaugucguccugcucaccuucuuguugcauucugugaugcagccaucacgagcugccaugggaggugcuccacccugaaagcucucuccaggccagccugaguguggcauccacaugagcacaaguccagcaccagcugaggcccccagcccuucacucuucacccuuccugggucuccaguuucucaucuccaaacuuaaaacuugccuucauggccacaaaaggcucccaggagagaagcagggcgcuuggcuugaguauucucuacagugcaccuuuguugcuucccucuucccucuuccacacucagcccccagggaggcugcucccuccacagcaucugggugcccuacuggguaaaguguccucugguuccucucugcaucuugcugagauggcccugcccuucuaucccuaccccuguagguuauuagaaaucuuccagcgagaagggcgcagagccuggugccagauggcacugugcauguuagcagguuggauggcucauccuugggacugaguugcucaauuuaaggaauuuuagacuugguaucuggguucaagcaugucccuguccuggcuaugucccgagcugcggaccagggcagagcaccacaucuuuuauacagugucccugucuuguucaucuccgaggcucagagaccucauuuguguggcugucaccugugccugcucaagucacguugcuaccuuccuuuagcaccuggacacaucagccagaccucccucccugggaccccuugaccagaggcagcaccgggaaccugugccccuugccgcuggcacacaugggcaggugcccgugucacugagcccagucaugcgccaggccugugcccuccccucucagggcgcaccgcagcagugggagugccugucgcugccgccugcuaggguuggugcugggugggggugggugcagaggcugggaucuggaggccacaccugcagugucagagacucagggcgagcuucacaccugcccugcugcuuguccugugguuguuugcuuauucaagaccaagugugggcgaccaagauugggcaauacucacugcaucgcgcuuccuuacaggcugagggcaggugccugccgcugugggaggaaaaccuggccugcagaaaaauaaaaacugccagagcugcacgagccacacuucauugcacugugcaaugcccacuaggaucaggccacucaugggggugggcaugcuggcccgcagagcagccagggcccugcagccccuaacaaaagaggccacgugcuuccuguuuuagggucgucugcccagcugggagcaggccaucucgcugcagcacuguccagcagcucugugcaugcucaccucccaaguuugcccucauugcuaccucuugacugagcugucuucgugauuccugaguccaaggcuggacaugagagcucagagggccagagugacuugcccagggcuacaucugcuuccucgggacuucaccucuagccccauugucccguggccuuaggcagcucacccauccugccauggagcccccagaugacugaaguaguggccaggccugcaggguccucaggcacccaggagcuugcccucgccaggcgaccugcugcuccauggguggacaauggugugcauggcuugggugcugggccgcaaccccccacacccuccucuaaggcagccuuucuccuccuuccucagccuugggacugggcccugccccacgagccccugaauuagcccacacaggaaaacaaucaggcccacaucgcugaacagccccgcuguuuaaaaggaagagaaugggacaggguuguuccacagccugcggagaaggcucaccacgggaccuugucccugcgcugaagggugccuuguuguggcuggagcaguccuggccugagccccaacuaauaacagagcccuugaaaccccugcagucaggacagacgucccaggcgagcagaggcccugcgugaggauggggcggcggggccagaugguguccugaguauccauccucccugguggcugaggacacgcugaccagcguggggucaggagcauggccccuggaaaggugaggccagcugggcagggucaggggcuuggguuuucuuugucauuugguaaauggucuuguguucccauuucucaccccucacugggguugagugagaaugagcugaguaagugggcuuccuucuaaugugaggggaccaaaugaccagcugcccuucuggacaaccagaggaaaaacacacuugaguggaccuuacaggcuucacuccagagcuuugcacuucugugcuuugaagacaacagaagugcaggauguugucugagauguccgucauucuguagcuggccagagagcagccaaggcugaggcugugauuuggggguggggggcagcgggggcgcuuccuuggccuaggcuaucccugcuuucucuuacugggcagccaauucagcaugcauugggaugcggcacagcagauauggacacugggcaguguucaugcccuuccuuuauuuaaguuucauuuaucucgaaguuucucuguuuugcacagccuuuguaaggaaaggccggacaugcaaccugugggcguggcccugggaggggugcacccagaccagguuguccaggagcaggcagcaggcuggucggggccggguggggcguagguggagccuguaggacuugcucugcauaaagccguggguguggcugauguucaggaucuuugcugacacagagaccuggguggccuuguuugucccuggguucuguaaaucaaaguacaugcccggcacugugucuaguaugguccaggugugugaaagucagagagcccugggagucugccaucucugugaguuggggaaaggaggaggggccagaaacaaaccagaaacuccacagcucuugcuuaggagccuaaaggaaagaaacagggcaaagcagccagaaggcugggaacuggagggccaguccucggacuagaauuuacauaggaaugggggcugugaauggggaugcuuguaauccuuccagaauugggguaaaauuugcaucugaauggcucaucaagucaagauucccauggaauguacugguuuucugguuauuuuccagguccuguuaaugaucauuugcauguuuacucaaccagcauucuuaaaauuaauauuaccuuaugacugccuuuaucaugacucucuuaguggggauuucuguccuccacaugcccugggggaugugcagcccccgugcacuccccgccuuggccggccccuucccccaugcccagguagacucugagcucuuagaccagcaacucagcccucagauguguuugguugggacuucccaguauuaaaaauauauggauuaauuauguugcagcauucaaaggcuucaccuaaaaauucagguuuuuuucuuucaggagaaaaaaaucaagaacuauugcccacacuaggccauguuguagaaggcugggaggugcaguggccccuuuagacagggccuggcccagcugcccugccuccccucuacauucccugacagggcccuggagacuucacucaaagguccauggcugcacaugccaggggucugcaggaggaugaaugaugcccuaguaccuuggggcaucccucaucccuggaaccugugaauguuuccuuacaugguaaagagauuuugcagauaggauucacuuaagaaccuugagauaggaaaauucuccuggauuuuccagggugaucccuaaauguaaucacagaguuuucuuaugagagaggcaggagggcagagaggagagaaggugcuacgcuggugguggagggaagaaaaacuuucacucuacucucuuagaugcuguuucuagggccugcgaauuaaacugacgaaagacaguaacaggagaaaagacagacuaacauuuuuacauacaugaagcuucaugaaagaaagugaaaacccaaagaagcaauagauuugagggccugcauaccguuuugacaaaggucucaguggagauugagaaggcgcccaacgccauuguucugucuucccuucuagagguuucuaggguccuggcuggcuccuagaccgagaccccucccuccucuaccuacacgcgugcuggaugggggcagcaugcaucguggagacagguggaugggccucaccuggcuggcagcgggugacuggguagaccuugucgcacauuacugcugcuccggggcugaggucuggcuggucuuaaaacaugaacagcuggagacaaugugguaugcgugguccacgucacuuggcauuccuggugugcuccaugugucacagcaucucuccccagagcggggcaguccgugcaugccaagugcuaugugugagucaugcacagauuccugcccacgucugcaugggggcuucugcagcucaucauagcauccaugucacccaguccagaggggagugguggcgcucuggcuggagcugcccagugugacccacacuuagugcggagcuacugggguaugcugguaccagcauccagaggcuuugagagauacugucugagccccgggacaaucugcaccuagggccaugcucuuguguguaaugggacagcagagggcuuugugucucccuguugcccccggacccugugacccucuggacuucugcccugggugguauccacccuguacuugggcagaaccugauugcuucuaucagaagcccaugcucggcuacaugcaggggugggaggucccucccagaggggguuaagcgaaaugccaagaguuggaugcaucugaccuacugugccugugcacagucccucucuaggacacauaccgugggcucagaaggccguagcauguggcaccagcugucuuuacagucugcaguggcugcugguuggacagaggucaugggagccccucucugcugauuggagagcccucccugccgauuggagaccccuccccacuaucaaggacuccgucagugcugaccaugcugcaguggcccaccgaccgccuggccccccuggaagugagcaaguccccugguggccccacccucaguccgucugcugccggcugcugucucugcaguugcacucaugggggacucguggcagccucagggggucacugcuacauccaugccucuauagcaggggcaugcauacauccgugcuccagccugcuauagacagugaggugagaagucccugugaagagcuggcuuuugcccugugcccaggaugcaccagcagcacuuggcaaguccuagagccaguucugccacguucccaaccauugugcacacccgaagacgcucuuguguucucacuaugguaacagagguccccuucagguuguccuuauaaagguggggucacuuugaggacaugacuggcugcagaagagauuucuggcccuugugaauagugcugucgugaauaugaguguacacgucucuuugagacuucuuuguguacauacccagaguggaaucucaggaacacaugguuauucuaaaguuuuaagggaccgucaugauucccacaguggcuacacuguauugcauucccacagcaaagugcaagaguuccagcuucuccacauccucaccaacacuuguauuccauuuuuguuuguuuguuuuuugcuuuuuuuuugguaguggccacccugauuggugugaggcgguugggagguuguuuuugcuuuuuaaccucauuuucauauggguauuaaguaucauuugccugcagcaccaaaucuguuuuuaucauugagggccugcaaauccccacggggugugccccacugcacuggugaccagagauagagacagggcacucagaggaggaagagccaugcagccagugguuuuauugcugcccuuacgacagagugcuggagggcgccccucacacuagccucaggcaguuuuaggaccuuacuguggccgcccugaucauccugaauuuucagaucucagcucccaacuccccaggguccuguccccagaucuccaggcuuagucaggguuacaguuccacuaucuaguaaaaaugacccaauccauucugugguaguacacuuauauaauacuacuuauauuagugguuaacauuuauugugccaagcaguguuauaaauaauccaaguaccuuuuguggccaacucugucuuauggauggaagccaaggggcagaggguugaguggccauuccagggcugcauagcugguaagggugggcccagagggugcagcugggccaccaggcuccugugccauguaaauaugccucuccugggggaacagauggacuggucagggcuugucauggcagagcagcacagaagggaagguacacugagguauggacacagagagaugaggauagcauagaugaaccagagcucguauuggggccuugacuguauggaucccagucuggccaagggaggggcugggaacguguccuugaggaggcgggaaugugcucugggggcuuuagggccaccuucuuuuuugcugaggugaaaccaucaaaagagagaaucuugcuggguacaguggcucacaccuguaaucacagggcuuugggaggccaaggugggaggaucacuugagccuaggaauucaaagccagccugggcaacauagcaagaccccaucucuacaaaaaaauaaaaagauagcugagcaugauggcucacgccuguaguccuagcuacucaggaggcugaggugggaggaucacuugagcccaggagcucaaggcugcagugagcuaugauugcaccguugcauugcagccuuagugacagggugagacccugucuccaaaaaacaaaagagaaucuagggaaacugcucuuguuugggagaacaauacugaaaaaugccuccaguaaaaaaauuuggaagauacaggaaaauucaaagaagacauugaaagugccccuaaaauuccaccucccagaauuaguucuggcauuuuggugucccuccuccuggagguugcucuaccugcauuugcaggugguguucuagccagcccugggugugccccggguggcucacccgcaggagcaggagcaggagccgccaggguuaggagucagccugggagugagcuuggaacgugccagucaggccauucccugggugugaccuuuuaugacuggguuuuuuacaugaguaagcuugcacuuaagugcuguuuuaucuucuccucuuugcauuuaauagaauguuuaucuguauuugucaauaaacaucgacuuguguggauuguacugccggcauagcaugcuauaauauuauuguuaauuuaaccuguuucugaugggugccuauuuguuuuuugguauuuuucccucaagauggagucucgcucugucgcccaggcuggaaugcaguggcaugaucuuggcucacugcagccuccgccucccggguucaagcgauucuccugccucagccucuugaguagcugggauuacaggcgcgagccaccacacccagcuaauuuuuguauuuuuaguagagaugggguuuugccauguaggccauccugaucuugaacuccugaccucaggugaucugcccgccuuggccucccaaagugcugggauuacaggcuugggccaccacgcucggcccaucugauggugcauauuuggaugacagauuuuuacugauaaggcaccauggagauaaacaucccugggcagggcaucucucugagcuugcgggguugcugaggccuuggaaauacaccuguuagacucuguagacaucagaggccaguuucccccuccccaguaacuguggcugguccucuucccugccugggaagauguuggcuguuuguccuccgagccuggcugcugccccucugcaggcuccugcccuggguggguuuugcgucuggacaauagccaccccuagagaggcagucacagucaguugucucccucugaagcuuggagggcaucuaacucacccaguaagugggguccaggccccuugacacaguguguaugugguuggggagcugucuggaggguuugcucuuuggcugcuggggagcagggacagaugcuuggaguuucuggccccaagugggagaguauugcugaaaacuuccuccuaguucugaaauuuugugguguauguucugaccguccaguaauucccuucccugugugaaauauuuccagaacuuucugucauuugcagaugcuuugggcaugacuugccaucccagccugaggcccguccuccucagccaggcuugugaccgcucccacccacagagcugcccgucaggguuaagcagcagcuuuggaggcuuugauacagguuuuaggguuacagaguuuuuaaugagguuuucuuguuaugugcauuuucagagugcuacuauuuggcaaagcuugaccccaaacagaaacccacagcugcauucuucugagcacguaacuggccacuccauccaccauguagacuucaguuugcaaaccgcguaauuucuuucuugugcugcuuuuuaaagcuagcaaaaaauuauugcaccaugcgcucuggaaugggcuguuagcagcgugcacuucucuggaacagcaugcuucccgggcuucuggaggucggguacgucccucggccacugucacccggcugggacccaggaaccugcucuucaugaagugcucaccaggcuccaagcuugagaugaacuugagauucuguuaagaaaccgauuugaaugagcacagcucagcccaggugugcucaggaacuugcuuuggcccaccugaguuugucucugaugcagggcggggaacuuugcuuuccaugccuguagugucagacacugcccccuaccccccaacacugauaugacuuccggaaguuuccaagccuugcuuucuuagcugcaaaagagggauggugacaguguugcugggugaccugaauuacugucuucacagcccccucuccuggccccaagaaggcgcucacccugauggggaugucgaugcucuccuagaugucgucugcuuugggugaagcuaggauuagaggcuucuuggcauccagagucagccgagguggccgccggccugguacaacuccugguggugggucugggagggcugacugggcagggagguuaggagagccaggcuacaugccacuucuguccagugcccaugcccaggcugccccguggguaaccugcauuuggggaaggagcugggggcugugcuugacucuucgcacucuuggacgaaccgcuuagugggccugugacccaaggccaggagugagcguggaaggggagaccccccccacagggaccuagguccauccugucugucuucuggaccucuggagcagucaugcggagccugcaguggugugguuggcaggguccaggggcccugagggacccagggggcagagcccuagagaagcuuugcgcuggcugcugacaagguggagauggggaccuaguggcugcuuucuugcguauuucccuauggccagcccauacugggaucugguuuuuugcucuucugggggaugucugucacccugccccuggagguggguuggccgugugcaccaugguccuguagguggggccgggggccauugcccuggugcaggagaaagcagucuuggagacagugggccaggccgugugcagaguggcugggagcuggccugcgcugcaugaccuugagcaggcuccgugaccuugagcaggcuccaugccugugccucauucuccuccugccugugaugaaggggccgguuccucgugguucugaguuccugugacuggcuauuuguagcccugagauccacgcuggcugcaauggaggaugugugccuccccucugcugccgccuggcacccucucugguggcuggggcauggcacugggcucuuggcaggucauaugggucuugcccucguccuuccaguucagguuccccugcagggccagggacuguguuugggcagugcugggcagcaucgaaugugaggcccagaaggaagcugcaugggccauggcgggggccgccuggagcugguggccaguggugguccucaacuugugaccacugagaugguugggaagagccugcccagggaauuguucagugugggggccguaucccuccaugacaggucagcgguggucagacggacagcagcaggcccucagugacacacgcaggugagaagggccuggguguuggagccagcgucucaggucagcccuaagccacccacgccuacagggcagaguccaccccucagggccaggcgggcccuccacagguggucacccuaguggugagugcaucccuaggggaaacacaccuccuuccugggcccuacgagagacagaacaauggccagguagccccccuccuggagcucucagaccuggaaggugacuguguggggggcaaugagugacagugacucaccagcuccuccccacgugugacccgccacgucgcacacauucugaaucaucuggaaggugacacacugcucggaaaaugagaacccccacaugcuguagagcuggcugcuugcuggaaggacagacaccgggaugggacuuugcagggccguagccccguaggcuugggcacuuugaagucagccccacuaaaugccacuugcaggugcugcugaccgggggguggagaggggguuccagguuaauaggaccagguuccuuuuagcagugcagggaaacgugagugagaucuguucccauuugggugcugcagagugaauccugaaauauuggggguuugcuugacuccuucaguggggaauuccuaccugggcuccuuucacacugagaggacggcagggguuacuccccaggccccggcugucucagggaggcaggggcugugguuuucugauacaggcaucucaccagggucacaccgccuccuuaguccauaugcacuugacccucuucuggcaucuacggcuauuugggguuggauggaccugagugacugacuguaucauuuuaggcugccccccucuucugacuccccaggaagggaauugagggacugccuuacuugggcuggaagcaucuggaagagaggagaagaaauaucauuucccuugcacugcaagggaggauggauuuagugaguugaacguggggauugacuauaauucauuagaguagaguguaucuaccucugacccaauacugggcuugugacauucagcuagagggucauuuggugauuuggaaauagaaauugauugaaauucuggccauccauaugggcaguaauugucuuaguggcaaagggggaacucgcuggggacagaccuagggcacagguguggccugcaguguuugcuccuuaccaucguagccggguguugugguugucacauugucuauuuuuagcacuucugugaugcuugucaccugcccacagugaccacuuggucuacuguugaugggaagugaguugguuugguuugaauaugguuaagauguaggagagucuuaaaauaauuaugagcuuaguugaaguugcuuccucugauacugagguugagggagguucuuguggccucugaggggcuuugggggcugguagaucaggucgaggcugcgugcaccuggugucugcgcacgacgguaagacagcauuuaaggucaguacugagacgggaacugacagccccagaugaugaaauggcgaacauccuuuuguuucccgccuggagugaggcaaagcuggggccuucgcagagcucuggcuggagcuugugguucucugguggguuugccacgcuguugcuaaggcuggcaaaagccauguccuggggaggaggcccggauagugagggagagccuccuguugacuagguucccuguugacucuauucugguuacgagcuguggucaugguggucuaacuuuguaauuguaguguauauauuuaaagaaucacuaaagaugaaagcaaggaaaguggcauuuugugguuuugagacuuaaaaaagaaauucccacuuggacuggggccuguccugaggcuccugggccuauccccucaugccgugccugcaccguggcagaacgagcaggccucuggcgccuuugcagcugggcugagucugagggcagcaggggaggaggaucccggccuggaggagguccaguccccuggagaaacugcaugcgcucccccugcggacacuugguggggacuagggaugccucugagugcagggcaucuccccaggcugccuguaguccugaaccaguucaggguucuggaugguucuggcagauucugugaugccuucacugcuggcaguuggcaaagagaaggagccauuguuucugaagggccugucucugcccuggugucccuggaggaggaagcuguuggcucagggcagguggagccucagcacagcuggagagcacugugccagucaugguccuggggucacugcaggacccgggagggcaucucaccucucccaguggcucuagacgguuguugcauuuuucugagccuguuuuuccucuucccagcagugcuguaaaaccugucuccaguggggcacacugggggaggggguggauguacagccaguggggccacagggucaggcuuucaggacuccugccccugaugucaaagcagcgggcuuguaggcuguccuugcccaggccucuugaacacugggauucagucagaugucagauacgaggguuagugaggagccugccagggagcuaugaacaugggaggugugagcagccccuucccagaugucagggccacgugcugcuuccaggugacucacagccugacccucgcagaacccaguagaacagucacuuccucacccuugccuuauggcggguguuaguuauucuuccugcuuacauuuucccccaggagaccccgugaaugaagaccagcugaggggaggcaucuguucccagagggcaggucugagguugcccuggccuucgagcugagccacaguggacagccaggauuucagugggugggugucaaggauggacucaggacauaccuaggggagguggcaaggccuggguaacacugggcaaggcaggaaaucugguggaugcaggccaguucucgguccuggcugccaguuacaugggcugcucuaaaaccagacagacccuggccucacuagggagcugcuaaaucagaauaucuggggggcugggucuagauaggugguguauucuugguguuccacagaaagaggggaaaaugcacaccuagcaaguuguagggcuuccuuuggggacacuagauugggggcugagaccugccucugcaagcccuggagagaaacaggaggcuuuggagcaagagaauagugugaugcgagcugccuuguaagaaauaagcaugccuuguaaguccccucuguguguagggggacugaaggccgggggcacaggggccguaagaagguggagcucuuagaauguggugucauucccuuacagguagcgggagccagguggaggccucacaggagggauggugguaugaaccgugggugugagggaagugggggacauugggcagaggugggggagggcaggaagagggugcccaggagaccaaagccaggcaggacacagugaggaaggcaauuaguaggguucgagaaggguccuggucagagaaaggagacacucaggaauuaagggugcaagguucugaaaaaaaagagcucgaaggaauuuggagucgggacggaagcaucuuggauuuaaaucauuucagacucauugagcugagguaaguaguaaaagcuaauguuguggucgugggcuuuagaaagaaacuucaauuuaggaauaaaucacagaguaaaccaucaugguuuaauggagauugacguugaucuaggaaaaccuauuugccccugcacugcucguuucugugggauucugauuggaccuuuccgcaccuuggugugggccgccauuguggggauagugccauuuuguugguuguuuguaacauuguguuuaacguccaugccuuacaguccucauuugugcagucucaucucuggugguagggcugugucuuacccucucccagggaaguagcuguggggaggaggaggugcugagggaguaguggagggaggggaguugcugagggaguagcuggggaaggugaaguacugagggaguagcugagaaaggggaggugcugagggaguagcugagggaggagagguacugagggaguagggagggaggggaggugcugaggaaguagcugaggggguggaggugcugagggaguggaggugcugagggaguagcugagggaagggagguacugagggaguaguggagggagaggaggugcugagggaauagcugagggaggggaggugcugagggaguggaggugcugagggaguagcugagggaggggaggugcugagggauuaguggagggaggggaggcacugagggaguagcugagggaggggaggugcugagguaauagccgggggaggugaaguacugagggaguagcagagggaggggaggugcuaaggaaguaucugagggauaggaaggggcagaggccuguucugggucacacagcugggauguggcagcaugggaaucugaaccaggcaagcuggccucacagccggcacugcagcuaucacaauaugcuuccuccauaguugggggagaaacuaagaagcaauuaagguuucuaauagacuugaaagaagcauaaaaaauguuugagcuggccggacacaguggcucaugccuauaaucccagcacuuugagaggccgagguggacggaucaccgagguugggaguuugagaccagccugaccaacauggagaaacccuguguguacgaaaaauacaaaauuagccaggcaugguggcacaugccuguaaucccaacuacuugggaggcugaggcaggagaaucacuugaacccggaagguggagauugcagugagccgagaucacgccauugcacuccagccugggcaacaagagugaaacuccaucucaauuuaaaaaaaaaaaaaaaaaguuugagcuaggugacuuguauuuuauagcaaauauaguauuacuuugcaaaaaugacuucagcucaacuaacugaaaguuuuagaagagagucaaaugaaaauaaaucauggaaguuaugugugauuauuucccaguuaaaggaagcaaaccugucagccugaucaguagaagcccugagccucuguuuaagaaaggcaagagaagaacacauugcugacacauugcugacagucucuaaaaugguuauacagguuguaacgacuacuaaagaucccagcacuugugucuucuguacuaacuuuauuaagagauuucaucaaaauggagauuuucaagaacagcagacagacaugauggaaccauggaaucucccccgugcccaucucccagugcccucuguguggugccuagaccucuguaacaucacugugaacauuccagacagaaaagauucuuggccggguacugcuggugguuaaagaaaaaugaauuguaaguggagaguuggaaaggaucggaaugucccacauuaugauauuuaauuauggaauauugcacagccgugacaggcugcugagggcaccacguaauaaacggcacggggaugcgcacgcauggugcucggggcagggacacacaggaccuggacgugacccacgcgggcccucuuccucuaccagccuguaggcuccagccucucucuuggacuucaggucuccucuugcauggcucccagccugccugucccacuucccauguuacagagccagcagggccccccaaccguccugugcgguugcuguggccugcccuccccaagccagaaagcaggggcugggggucuacagucuauaucugacucucaccuucaccccacacccuccaguagugacuguugagugaaugagucagaguuucuuagaaugaggaauucaccaaaaugccagaaagaccagaacuguaugucaugucugucugcuguucuuaaaaauuuccauuuugaugaaaucuuccucuuaguaaaguuaguacaggagacacccgagcugggaucuuacuuuaaccagcguuauaaccuguguaaccuuuuuagagaucgucagcaauguguucucuugccuuucuugaauuuuucaaauuuucuacaauuacuguauuuuacuuuugauaucagauuuaaaauauuuuaguuagaaaaccacaugauuaaggaaggaauucgaauaguucuaaagaaucaaaaucaugaaaaaugaagcacacuccuuuugcagaucaaauucucucuauaggcauugcugccagcagguucuugauuaaauugugaucucuugaaucauccuucugaugagccugugugcacacccacacacacacacacacgcacacacacggucacacaccaugugccugcacagacggaaacauacuacucacauuuuugggaaccuuacuuuuuacugaacagcgcccuuucauacaauugcagcuuuauucuuuuuaacaguugcauaguauuccauccucuggaaugugcaauaauuuguauagaaaacguucuaugcuguaucuguguguacccaugcacauagacgcacacacacugguggacuucugggugucuuuggaguuuaccuauugaauagccucguuccagucauauugcacacaugggguauauccauacugaauucuugguagaggacuguuggaucagagauucuggauguagcuucuuggcagguguugcccagcagggugcggaaacauguccuccgggcccugucuguguacuuuguagccagccuuucucaugggugcccugcucagcagaguguaaugguauuguguuguaauaugcaugccuaccccaucgaggugugugcugcagugccaauuucagcagaaggucccccauugcucucugccuccggaacuuccuuaccugcuucugggccaggaugaggagauugagcagaaggggcucacggcccucuccccguccacagccacagcagugcugccugucacaguguuccuaagcccugcuuccaggagucuauguggaccuggggaagccccgaucccccgugugugcaggaggaggcugguggagcccacagucccuggcaguagggguuguuagaugugcuaauagcugcacccugcuuguuauaucucucugagucuucuuagcuaggcagauauaacuggcuucauuucacaagugguaagaaugauaguuaaugccucccagugcuuaaacagcaucgggcaccuaggaaagcacuaggaagcauuaacugauuagucauggauccucauaaccaaaugagacaggcaguauuaguaugcccacuuuuuggauaaggaaacagaggcccagagaggcucaguaacuucccucaggaacacacaacuuggagaagccaggacuggaacccagguuccucugauugcagagccccuugcucuugcuucaucccacuugucuucucugugugcugaagaacaccaggucccugcuuagggaguacgcccagaaggcgaggucaugucugcaggauggaggccagaugaaggcgcugccaguggcucuguccuucugccaucagcgaccacuaaauaccuguucgcaaggccugggcguuggagccccacacucuccugcacuagagggggugcaccaggagaggaugugaaggccaugagagggaaaugcuucucucuccuaauuaauuucauugcuuuuugaugaacaggccauuggauucuuuuuaccugugcugucaggaguugggagauaugaguuaaaacagcaugaugaguaauuacaugagaaguguggguuugcauuuuuaagccagguaacucauaacugugggguugcacgcugagaaagaagaaacaaaccguguauguguagggugaaggcaacgcgggguuggggccugggcaauucacuaagaaaggaaguguguucccacucaggaaccuuggggcuggcagcuguuuuuggaggcuagauaugaacccccagcugggaggcaggacacaaggaugcugguguucagguggaguuguuggaggcaauugagaugagaacccagaccugcugacauuuguuguuggaugccacaaaauuaccgugaauaugauacgugucuuaaaccacaggaugagcaguucugggucuuuauuaaagugacaaaggcuuauuucauuucuaaaaaauagaaguuuuucagguguuuuuuuguuuuuuuugagacggagucuuuuucugucacccaggucagagugcaauggcgcgaucuuggcucacuccaaccuccaccuccugaguucaagcgauucuccugccucagccucccaaguagcugggaugacaggugcgcaccaccacacccagcuaauuuuuguauuuuuuuuugauagagacgggguuuugccuuguuggucaagcuggucuugaacuccugaccucaagugauccacccgccucggccuccuaaaguguugggauuacaggcgugagccacagugccuggccaguuuuuuaguuuuaaaauccgugauauucacauuauuuaccuaagccucuuauuuauguaugaaucucugccuuuguugccuucaacuguuuuuuggcacagucucugggcggccacuguccccucucccucccgugugacaggaaggccucguggaaacaagugauguggcacuuugcaggugcccacaguagcguggacuuucccucuuugcuuguccagcaguugugcccaaaugcucagcccugccccaggaguuucaacaggaaaugucggugucagguccuggguggauguggccuuuuccaggauucucauagcugcucaugugaaccuacuuuugcuuauaaaauuggccguaagagccauccacugcuggagggaagaccccaguaucagucucuggaagcuccacuacgguggggccugaugaaucgugaucguuucugaucacugcccucgcgguucauuugcuaaccucaggugccugcucaggguucagaggaugugucggccccgagggguggggggaccggauguugugugccuggauggccgugucuaagguucugcuuccuggggagggguguacagggcgucuguagaggagggagccguccagugaggggccugggugggagggacgggggcuccuguagaggagggagagccgccuccuucccagcuggcuucaaaaaaagagccgugaucauauaagcucugaaagcaaaaggcaaacaaaaaagaaacccuccucaccacagaauaugcuggagucugauuccaagguuuaacaauuacguggcuccuguguuaauagaaucauggagggaucagcgucggcuccugagcgucugcaguccugcacguggcucugguuuugcgauucugauucucuugaucuaauuguuggugcugcuacugcaccccacgaucccugucuugagacugaucucccacacugcaaaggagugacagccaugcuauggaaccuugccacaccacgguggacaccguucuguuuggcugaaaaccagccauccaaaaauaaaggaagaugaacagcucuuuagugcuuguaauuaugccauauguguuucugcuuuuuccuucuuugccucaugaagaugaauuuuaaaggauacauaucuggagcuaauagacaauuagauaguacuuuuuugguucacagacucugcuaacuggaauggcuuauugugcaagaaaguacaccuggucggguccuggggcucaucucuagcaccagguaacgggcugggcugcccuuccccucuguucgugggugggugguugcacagcuccucccuccugucugccccagugcugucuuccccagcacaugcaagccaagcugauccugcgucuaaggaagucuagaagguuuaaacucacaauaauuuguuuucagugccuuucuaggaguguugcugaguuuaaguggaugcacaguuuaagggcuuaaauagccuuguuucccauuauuuucacagcaaagauuucugaagacgucuuucuagaaaugacuggaaaguuucaagaggcauaagauacagguaaaaccacuuuauucaugaucuguaauuucaguugagcagaguugauaauguguagaggccucaguuggaucuggcaggugguugguugcuuggucccuuggucccugauauccuguggggcaaagcuucagacuuggcugccaucccuugggcccggcauggggaggugggugcugggcacccacagugauugucugucucuguucuugcucugccacugcuugucccagcucccccuauucuucccugcucucucggccucuccucccacugggucuugggauuguggcagcuccgcggcugauggccccuggugccugcaccagaaagcuuacucucuucuuuuggagggugcaggaagguggcugguaaggugugguguaauaagagggcucuccaggucacccuccucagauuugggccauuuuguguuuaaucuuaauuuugguccguuccaagccaugcauuuucaguuucagaggagaaggaaauaaccagcuuaauuugugaaaacaaaagucaaaccccaucuuuccuucaucauuuucauauuacucaaguaucaugaaugagcccccacaagguuuuuuauucugcuggcuuuuaaagaguccugcugccagcuuagaccuucaugguuccuaugcaugggaccgugaugagagcacaucuugccaauuagauagggcggcuuuaauuagcacagcaucacugccagggagacagcacuuucugugcuuauuggcuagauauauuaucugguccauuggggugggagcucuguuuucuuacauuuguuaaaucacuuuauuuauuaggaauuggcacuugucuuacaaguauuuuuugcugguuucuuuuuccucccuuaagucauuugucuuugaguuuuguuuuuugucagucucuucauaaaaaauauuuuggaaucuuuaguuauaagguaauugaaagcagggacaauuuuauccauucugugcuguauuaagcaguaagagaauuccauugugagagcccaggaggacuggcuccuucuguuauuuuuuacuuugcugucacaaaaagcacgaaguauauauggggaaaggaagccacuucucauuuuuuuauguaaauaaaaaaaaggucaaagguauggcaagaaauagucaccuaaaccaagaaauggauuagcaugugaaaaaucgcauuaugcacagcuccauacacuaaugugguggguuucaauuuuuggucuacugacuuggguguagcaugggugaaacauaaucucuucaugaauuaaauuuuuuuacagaagcaauauaaaaguaugauucauuuuuuaaaaaacaaagaaaacuugaguuccugguuguucuccuccuccuccuccuuauaagcgaccacuguuaacaguuggcugucuguccacguucaugugugugcauuugugucugguaucugugugucccuguguguaggaguguauguucuugugagucugugccugguguuugugcaugucccuguguguccguggcuguguguguauguguuguguguagacugacgcauccucuguugacacaggugggucgcgccucgcguguuguugcucuacacaugucuucggugugaugggcucacaggcaguucguguagaccagcuuuagucuuuguaaugguguugucuuccuugccugacuguuaaccagccccucauugaggagcauccccuuugguugcacauuuuacugucacgucauggcaggguggucuucccacgugucgcuuugcacgccuguagcugugcacacauaguuugcugcccaagaguugccaggggaucagagugugcagacaucuggauaguucagaauuguacccagaaguccuuuaccccacaccuucccagcacuaacuagcagcagacuuuuaaauuucagcuugcuuuguggacaauaauggguauuuuauuuuaauuuacauuugguuuguggaguuaagcacccuuggaauuauuuuugaagguaggacaguuuuauaagagguggaaaauuaagaauacaaauaaaguccacuuaaagcaaaacuuuucuauauaaugucuuuuauguaauuuugcccucccugcaagccaagcucugggggaccgaagcaccaguuuuagugucauaucaaaggcgcuaccaguguaaauggugaccgaccuuuggcauucuggaagcaucucugcuggcuggguucuguccggugcugagcucugcugggugccagcagccccugaauugccacugucucagucagcucaggcugcucaaacaaaaugucauagacugggugacauaaaaacagacauuuauuuauccauuccggaggcugggaagucgaagaucaaggcgcuggcagauuuggugucuggugaaggcccuccuccugguucauagacagcgucuucucacaugguugaggggugagggagcucucugggacuccuuuuauaggggcacuacuuccaugaagacucugcccuccugacccagucaccucccaaaggcucccucuccagaaaccaucacauuggugguuaggauuucaacaucugaauuuggggguaauccagacauucagaccauaguaucaccuuugaaagacaugacaccaggcaucccuuuagggccgcaggguuaacacaguccucccugaggggcuggccagccacuucccagaacaaccccacacugugccugggagccaguguccaguagggagaccguuggcccccuuagagauggcagcaggucaacauuaggccaguggaagaugauuauuuuugcuagcacuaaccugcuugggcccaaggaugcaugcacacaccacacacccuccagaaaagacaguauugucuguauccaagucugaagaguagagugaugucacacaaauggcaugacagucugcaucucuaccaugcuggcugcugcuuagagggguccccacccuuccucugaagggcccuguucgugccgccacucugcgugcauccucauagcgcuuguccugccgacauugcugauagauggaugccuguguucuucacucccaccgcccucugucucucucccuggguuucccauucuguacaugcugcacccagggguuugggaagugggugaggguuagagcaugucugagauauccuggcuguggcucgcuugccccugcagggauguggcuugagggugaaguagacugguccuggcagcugcccugcugggugaguccggcccaacacagguccagggcuaggcaugucccugcagagcuggaguguuggucuccagggauccauuuuaauucuaggaaaacugaaguuggaacaauaaacuguuuauuaugcuugugaccuagacagcuccugaaacccauuccugauuccugaugggauaaggccauuuuauccucaguuugcaaggcagugacaucagcauccuaacuggaggugggagagggguuucugggggcagaggacaucccaggguggggauacuagguggccagguacuggcagggcaugguuggugagggcuguggugucuucuguuucccagcaccuggcugccugcuuccagcugggagggaagauguggugagugcguguccuccacuguccugguuguagggccuggagagacucuaagcuuuaccugccccaucugggcaaaccccugagauaagaaauaagccagaacacgcucccccaggcaguaguuugcaugcagugaggucagggguccagguaaugacugccuauguuagauuggccaguccacagcugucaccagagauccccuuucaguuucccugggaugccagccagggcauuuuaaugccaguguugcauccuguugcuggcagaagcacugacaccuuccaugugguagugacugguguccccucuguaaucuacccuagcugccagacagcugaucccaggaaggagccgagacacgggugacuggacaguccccagauggcauuuugguucaugguuccugccuuacaggacacuugccagcagucacuauucacaucuaagaugcaacacuagaucagaauguauguucugcaacagagugacacaugcacagaugcacauauacacacaugcacacacagaugcgcacauacaugucugcguacacauacacagaugcgcacacagaugcaugcacguaugugcacauauagcugugcacacauacauguauaugcauacacagauacauauguauggauauauguacacaggcagacaugcacaggugcacacauacauuauacacacacauacacagaugcccaugcauacacauauguauacacaugcagagauccaagcagaugcacaugcacucacacagguguacauauguaugcacacagacauacacaugcaugugcagacaugcagacauacacauguacacaacacaccuguacagauguguacaaauguacaaacauggauaggugcacauaucuaugcggguucaugugcacacauacagaaauacagaugcacaugcgugcacauacacagaugcauacacacagauguacauguguccacauauauauauacauacacgcagacauguaugcacagugguugcuggguacucccauuuucucugcugugaucuccugccuugauuugaagaccccugggggugggagagcugccuucugacaaguacugacaggcaaaagaguguggggcucagagcccccuuggaguuccauucugcugacauuuaaagugggcucgugcacccucaugaacagccccaauuacguguaaguaaugagagugacauuucacaacccugucuuucuaaugggcuccugugucaagucauucuuucugaaugcaaagggcagcaauuucacacugucagggcaaaaugcacaugcauacagcucagcucccagcgggauaccuuugcuucucagaaauggcgaagaaagccagcaaaauggccuuuuucuccuuuuguuuuaauuuaacuauuuagagugagguccuuaauguaacacccaucaaugauuauggagccacuguucugaaagaacucgcagggccggcagaucugugugaguuguggugugugcuuugcuuaaagcaacuuuaaaauuauaugaaacaaugcauucuuguugaaaaaggaaaaaaaaacccuccagugucacaaagaaaaugugcagcccccucccccucccugggaggagcaguauguggcauggggucuguccugaccuuuggcuacucauguggacuguuuuaaaggccauuugagaagagcagcagggccugauuuaugccaucgagaaucuggugucugcugaugagaucaauacacugcagaccuggauauaaauccgugccaggaagccugguggucaaucauuguucucagggcagggccuggaagccaggugggggugcccgugcccugcugagcucuacauggcagugucuggauugguccaagguaaaagcaauuaagaaaaagguuucuuuucaacauaaccaguuugaguaaccgcauaaacagcaccaguccugacaguccuucguaaccauuuaaagccacacaggagaaccugcuggcuuccaccugggcaccugcugacacuccuggaaauaccuucucucagccacauucguuuggggauggcuuugccaucccuggguuuggucguggauacuauuacaagauuuguuuucaaucucucuucacuggcgauuuuguuuuguggaacuuucuacucuuggcuccuuaccuuuguccucuccgggucuggcccuagucuucucacugggauguuuguguuucuccuguucuaccucaacuaagucagggaggcguuuuuagguccuuaggccaagugcuaugaaaacaauaccacagagggggauggagugugggggucaggggaggcaaagggugacugugggauggagccagccaccagcagcuccuggggguagaacagucuggaagagggagcagcaagugccaaggcugcaaggcagccugagacggguggggugcaucggagggagggggcaggaguggaguggaagaggcuggccacauuaggugcuggcauucugcauuaaauccugugccacugcccagcacuucggcuuugcggugaacaauccuauuuuuacagcguguuugagcccccagaucuggcugcccuagggacccaggcucugcacagagucagcucacucuucccguccuugggagccucccuucagggggucaugucuucugcuucuggauccacugggcugcuuuccccaggcugugaggaaccagaacauggaugucuuuuuaagguuaauucauuuuaugagaguaauuaaugcagguaauuuuaaagugaaguaguucuucuuuaacuugagagaggaagcagcacuugcuugucuugucccuuugucccuucccugcugcccugagacacugaguuucaacuauuuucacuauuuugguauuuuccuucaaauuagauaugccuacauuuccugacuuucccaucuuagauguuguguuaugauggaagacaggauuguguucucugacucuuguccccucccuuucccucucuuucuucccccagaccuccaguggaguuaguuguaauuuuuguaaugggggcuaugcaacugggcagugauaaguacacucugguuacauuuccauucaugggucacucuugcuucccugggguuaauaacuucauuuucuaaucuguguaucuguucuaauucaucuucagacucuuugccagagccuuaaaaugcauuucugagaacaaagccacagaugcaaucaguaauccacugugccuucuccugccccgccccauuggagccucugccugcuccccagcuccccgcucucucugccucuccuccacucgcuuccuaagaaagaagaccugggaagcagcucccuuguuuugguggagcaaauccugcaguagcuuucugagaaagaagcugagggagguaaaacauuugagaacuuguagguuugaagcaguguucuguacugcacucauacugauugauaauuugacuagauggggaauucuagguaugaagucaucuucccugggauucaaaggcguugcuuugcugccuccaguggggcacucagagguaauuucuuuguggccuguuucuuucuggaagccucauguaacccuccuuucaggaugaugugucuggugugggcggguuccuuucauucacugugcuccugggcgcuguuauuccgaaagcucagguccuucuguucuaguuauuuucuuuuuauuacugcuuuaauaauuccucauuuuuuuucccggagcuccugccaguucaugugggacuccugaauggaucguccaguugucuguuccccuuuuuuucaucucugcuacguguguaacuucuaggaaaccucuuuaguuuacuuuccagccuuucauuucuuucaccacauuuuacuuuuaagcuugcuuccauuuuccagguuguguuucuuugugacuucuuccaggcccuggcucaacucuggucugaaauucaaaucagucagcucugguggugugugacaggguuggugguaaacacagccacuguuaaaaauuaaauauguggacuuaaaaugaaacaaauuauauuuaaaaagguaaaauacucagaacucauuccuuucuaguaucgugugcauucuacuguuaucugugugguugcaguuacucgccucuuguaucugagauggcagugccaugugcugggugcugcugugcaccucuccccaguucagcggcaucauucugggagcucgaaagcagcauuuacaccacagaaaucagcgugugcugcaagcugggcaccccccaccuuaccccaccgcccacccccacugcccaccccguggagagccaguuguuacagcuugccagcacaccguugguuacugcucaccuauuaauagauuccaaagucaccucccuccuccauuuuuauccuuaaaguucauauccuuuuagagucauuucauuggguuuccagagagaguugaaauaaaucucuguguucucccaucuccuggcucuggacucuuagccuggccugaccccagcaugcuuauugggauacgcagaggacugauugcaguugggggaucuagauaggaauuagaucccauguaaaccauaucucuccaacagugauccagcaucuuugguauuugacccgaaaugaacugggccuugugggucuugcgucucugcuccuagcccuccggugugggcacuuacuuccuuaauguguccaggccaugaacccucacagaggcugcuuuugugacuggcaaggaacuccuaggccuguuccuuguuguuacugauuuuaauagacuuuauuuuuuagaucaacuuuagguucauagaaaaauugagaaggugguacagagauuucccauaugcuccuuccccacacaugcacagcccccucauuuucagaauccccccacagaguggugccuuugcuacagucggugaacccacauagguaccuuaucacccgacaucuguaucuggacauuaggauugccaguugguguuguacauucuguaggcucggacaaaugcauacugacauguguccaccgugguaguaucccugccagccuaguuucccugcccuaaaaacccucucucuccccagccccugggaaccacugaucuuuuuacugucuucaugguuuugccuuucccagaauguccuauaguugggaucaugcaguauguacuucuacagauuggcuucuuucucuuuaaugauaagcuuuuaaaguuccucugugucuuuucauggccuaauggcuuauuuauuuuuaaugcugaguaacguuccccugucuggauguagcgguuuguauacccacucgccugccccugggcugucuccacggcuggcuuccugugugguuggcacgccuuaccucugcaggcuccgcauccgucuucagagcgccuucucccaucccauggcagcucauugcuguuucuuuuguguguauggaccuuugcccagcugggggacaugccacgagagagguuguuucugcuuuauccuugcugugcacagcuuggcacuggcugggaccugggucuggguguggcuuggaggagccaaugucaguucauuggguuucacugggcugggacugcagcacauggaccaggccacugguguccuugcugcaugcaugacaagaacccuuuccaaggcccugccugccgcaggccugccuccuccuccuccucuaguggcgcgggagccagugugaagucucucacaaugcgagugugcaguccucuucugcuuuaagggauggggcagccuggccacguugucacuucuggcucucacuggcuguaugauguuugucacauggaacgggagaaaggacgcauccuuaaaaugccaggggaucauugcuccaaaaggagggguagcugguuuuuaaugggagcuuuucucuugagggacuguggauagcuugucaccacuguuaccauccuuucuuaugucugucauugcaugcaaugaggacugagaagagcaagggcagcaggacccuggaggggcaugggauguuugugggugccaggcccugggcugguugcuuccacgcagccccacuccagggcguggguucuguggggccaggacuuguuuguuccaggcuuagcaggagcuccauucguauuugucagagcaauaaacauuauuauuaucagaugcuaauugauuaguuauauaguaauaugauuuagcagauaauucucacaacuuuguaggccaaguaggucaacuucuguuuugcaaacaaaaagugacaccauuauggcaaggagcugcaaaugugccuggaauucagaagaucugaaccuauaauuuauugagucuucuucauugggagccuauguagaaaccauuacugguuugggagcucaaaguggagcagcuuuugggagccacuccuaauuaccaaucaguuauacagaggaaaagccucucagaugaaugagacugugcagugggauuuagaccggcaacuucagaacagacacaucuggaaauguucuaagugguguugacaggcaggagagacagccguuacacagccaugcagaggggccgagcccuguguguucagguguagccaggacagugcaguggagggaguguggaugaggagcaguuggauggagguagaguaggguuguccauggccuugcuggccaugaugaaaaugugggccuuauucugagugaugagaagguguugaaacauuucacauggggaaaggauaugaucuggauuuaugauaagagcaugacuuuggccacugcuacuuuguggcaguggacuggagggagguugugucaguuuggaaugguauuuguugguaacaaaaaucugcaagcaaguaauuuaaagauuuuaauaauuuuauuagcaagucugcauagacucauagccuagggucucauaggcucuuguggguuucacuuggccauucuuagaaugagacuuuuaucuucauguugacagcauggcugccagagcuccagccaucacauucuaguuccaggcagcagcaggaagagaaggacugagggaauugcuagcugaaucagccuccuuuaaagagcuuuccuggaauugccaucuaauaaauuccacauacaguuuuuuuggccagaacucucaccagagaagcugggagauauagugagcugggcacacugccaacccaaguaaccucggaauuuuguuagcgagggugcaggaacauggaugcuggggcaggaagccagugaucucuaccauggaagcaagaggccaggaugagaggugagcauugcucagaugagugauggugguggagauggacaggaggagacaagccccagauguguuugaggcugagcagcagcaccaucuauggauugggggugggggugggguuagagguagauggggucggccccugacugcuggugcuuuuuuuuagguggggacauggacuguaggaauuggcuggaagcagagugagguucuguuucggcugugucuggcuggguguggaaggcggcauguggaggugguagggaggagugggguucuagagucuggagcucaggggugugguuguuccaugacccucacaggacuccuggauagaagggggagcaagggacucagggaucccagguugcuguuuugagugaacuguuuacagaaguguaaugugaaagugcccaaucacugggugcccagcucaggacauucucauagagugaacccaggggugcagcuggccccagaucaaggugcuagacgcccuugggccaguccuguggcggguuacgcuguggggcccagcaaagguacaccaggacaguagccaugcagucaucagagaauguuggggacaugagagauggggccaggaggccugugcaugccucucccaccaccagccccacaauuucacuaagcagcauuaagccuguucuuuuacuaagggcuguuucuuacugggcaaaucagagugaguuaccaccauuucuauggugcacagacuucuuuaagugagacuggaagagcuagcagggucccauuuggggcaggaggucagacacuccugcguggugaggccucacgugcguguguuucuacagguguacauccgugcauguguguguguacauaugugugcgcauauguugugugugugcaugugugugcacucacauguacaucuuagcucucucugcagccucugguuuuucuggccguuuccucgcugagcguuacaaaggcagagucucuaagggaaacugaaacccgaguucucuuccuucauuuucaucucauuaccagcuggacacagcagccacacaggaaggaagcugggcagccagccggccaugugugucugccgggugccccacaccagguccucuccaugugucuguccuguguucugggcugguagcuggaggagcgggaagcacugacuccugaagacccuggcuucgcuuuccuguguccguugggcuguccacuucuaagacucucuuugucccccgcugccuuccguauuccucagcagauggacccgggugaggauccagggcaagcagaggggcuacagagcagugagaagcaggucaucacucaccauggguccugccuuuucuuucucauguccuuccagcauuucuucugaggcccugaagaaguaucaagugggcuuugacauugcgguggugagagcgaccccuccucaccuggagaacugggaaauguggauucucagggaccgcgcuguucacgagcuccaggcugugcugcuggcccugguccuggggcgcugagccgcaucugcaauagcacaccugcccggccaccugcugccgugagccuuugcugcugaagccccuggggucgccucuaccugaugaggaugugcacccccauuagggggcugcucauggcccuugcagugauguuugggacagcgauggcauuugcacccauaccccggaucaccugggagcacagaggugagugacgaaaccugcaggggugcugauggccugggauggggaccucacugccugggaugcugagguggguggcuggggacgggacagggaccccacuuccuggaaugcugaggcggguggcugggaacgggacagggacuccacuuccugagaugcugaggugaguggcugaggacgggauggggaccccacuuccugggaugcugaggcggguggcuggggaugggauggggaccccacuuccuggaaugcugaggcggguggcuggggacaggauggggacuccacuuccugggaugcugaggcggguggcugaggaugggauggggaccccacuuccugggaugcugaggugaguggcugaggacgggacggggaccccacuuccugggaugcugagguggguggcuggcgaugggauggggaccccaauuccugggaugcugaggcgggugacuggggaugggauggggacuccacuuccugggaugcugaggcggguggcugaggaugggauggggaccccacuuccugggaugcugaggugaguggcugagaacgggacagggaccccacuuccugggaugcugagguggguggcugagaaugggacagggaccccacuuccugggaugcugcgguggguggcuggggacgggauggggaccccacuuccugggaugcugaggugaguggcugaggucgggauggggacuccacuuccugggaugcugaggcggguggcuggggacgggauggggacuccacuuccugggaugcugaggcggguggcuggggacgggacaggaacuccacuuccugggaugcucaggcagguggcugaggaugcuggcaugugaucuguuggauucucugcucugagaacuuuugucugagcagacaggccuacucagcugaucuaagggagaggcugugacaacuguagauacucagcaaggcucgugcagaccuccugauuugguuucugaaucuggggaccccugacaggaagcuucccucccucguaccuaguaauguucgcggcgugcugccaaagcacccgccccacugagcgucugcuccaggcgccugagaagaacagugaggcaucauaagaaugcucguccuacgugcagcugagccucaugccagcuacuuuccuuuccugcuguuuaguuuuuuuuuaguuauuucuucucuuggaggaugugucuggggacccggguuucugacucaguggauugagagcuuacacccuggguccugagcaagguguugcuugcagguggcugagagcugucagcaauauaggccauuguugugcugagagagaggaccugcugccugugugcaucucucuuccacaugggaaaauuagaacagaaaguaugaacaccugacucucuuuguuuuuucucgaagucagggucuggcucuguugcccaggcuagagugcagugggacaaucauagcuuacugcagccucaaucuccuggacacaagcagucgucccaccuuggccucccaaagugcugggguuacaggcgcccgccaccacaccuggcccaccugacucuuaaauaaagcagacucuugguaauauguaaaaagccaaggucaaaaugcucaaauuguugucaggacaguugaagaaacagguccuaaaaaaaauaaugcugauacauuuauauuauucuuaagcagcuauugcucaaaucuucauuuuccuaaguagcuauugauacaguaaccuaauaagcaaagagacgucacuuguuucucugucuauaaguuugugguggugaucacugagaauugcauucguugauggauauauucuccaaaagaaauuuugugaagauuuugaaguaaaacauucuuuuccugaauaagaaaauccuaagucauuguauuccuguacaccuaaucuguggaugacaaggcauguagaccagaguugggugggcagagggugggagccaucacaggaagcaucuggcagagcaggguuugggauucugggaucugagggagcaggaagggauguccgacucacagcuucaaagugagcacacuggcuccgggcuugagcucuagggcugugagugguucccaugagcacaccugauggcuacacugugggucuggcguugacugaggccaccuccacuguagcagugccuguugcagcaacacauggcccucgagacaugacugcacccagacgugcucauugucacugagacagggaccuaggaugugcucagguuuaaaaaugcuuccaucgcucuuuucuuccucccacucugacccugcccuugcaucccacagaggugcaccuggugcaguuucaugagccagacaucuacaacuacucagccuugcugcugagcgaggacaaggacaccuuguacauaggugcccgggaggcggucuucgcugugaacgcacucaacaucuccgagaagcagcaugagguacguccugggcuccccugcauguccacauagcccagcuugagugggcagccucuccuggccccacuguggggcugggggcugacuuaccuggagccuccauucuguagcugugaccaugcagccccaucuuuggguguccaccagcaguucacccggggaccacccucuuugcuuuuuuuuuuuuugaacuuuuuauuaugaaaaaaucucaaacauaccuaugagcagagacagcuaugccaugagcccugugcccacugcagcuuaugcaaggccggguguucagucuugccuacaguacccuccaccuccuggggcauugaggcagaucccgacaccacauucuucaucuggguaucucuuacuggaaagggccccuugucgugcaaauaaucaaaaauagcuucuccaaaauuuauaucaucauacauucagccaguguucauauuucaccgacucuuguggaugaugcuuguuuaguugguucaaacguuuaguuugaaucagguugcaaccacgcugucccaauccauugcagcuggucacccuguccauucagucuccgcuucuaggagccagccucgguuuccuuccugagaaagcuacucugcacagcccaucccaugucccacucuucacauugcuccugauuccucggugucuuuaaacauuuuaaaaaaucaaaccgaauuuaaaauuugauuguagcucacugcagccucaaacuccugggcucaagugauccucuugccucagccuccugaguagcugggacuguaaguaugugccaccacacccagccccacucauggugucuuuagcaugcaccucugucuucacauccccagcugggugucagauccaggcucaucccucucagggcugugaggcgggcuucuccauggaggcagguguuccuccuccucagucucgguggccuuugaccagcgaagucuagaugcucuucucaucaaagauugcaaaacgcaauguucugauucuaccucuccuucucuacuuguuagcuggaaaucguauaaaaggggaagugcccaucaccagcuauuuugguccguagaggucccauuuccuuugggaaaugcagaaucgaugcuuggaaucuuugccuuuauuuaccaguuuucagaauaaugaguuaaugagucaguuuccccucugaagggcaagagugaguuuuuugauugauuuuuagugucacaaugaagucauagauuuaaagauauuugcucuucuuugacccaucacagugaaacaccuaccucaugcucaaaucgucgcauccauggucaacagcagccuguuuggguuggcuccugagaccucgcggugugggguuaguuuucuugcucucuggaaucuguuccagguucacgcuggacauuuucugcccagaucucuuuuuguuuucaucuccagggucuagcuuauuucucaauuucuguuugacacauaaaugagcucugagcauuaugcucugaaaacaaguauuuggcugggugcuguggcucacgcauguuauccuaacacugugggaggucgagguaggcggauuacuugagcucaagaguuugagaccagccugggcaacauggcgaaacccuuucucuacaaaaacugcaaaaaauagccaggugugguggcucaggucuugggagucugaggugcuuggaagucugaagugggaggaucacuugagcccaggaggucgaggcugcagugagcugagaucaugccacugcaguccagccugggcaacagagcgagacccugucucaaaaaaacaaaaacaaaguauucagcacugugaggcacucugagcagaaagaugugguggucucaccucacucagcucuuacucuucgcgugucuguuaaauucucuuccucugagcgccuuccugaccacacaggcucacacucggucuugggggaauuguggacaguguguuugugcuggccccacagguguucagugagagccagacauugcucuguuaaugacaccaugguggucccucgggguuggggagaggcuuggggaccucuuauacuuaaaagaaaaaaauaaagagacccccgccaagcaucagugaaaaucccugcaaacgugaucaagagucuguugaaguguacguucccuuguccuuaugcauuucaugcgaguugacgaaaucaucuguacuuuaaaugcugaaggaaguggcuauuuuaaaugagacucuguuccgcuuuugugugccccuaucaggacuuccauuucuaugaaaugacacucccuuaguacugugucugcagccugggugcuguucaggaacucacagaguuaguuagaaaccuaaagugggguuccucuccucauacucucccuccuagaagcccugugugcuuccuaaccucugaguccugacaccugcuacaagccuuuugguggagaaaaauacauuguuacugguuucuuuugcaucaguuauggaacaucacagagagagggggcauuuuggggaaggugaggcagagauagauauagaaaccuucccuuuugucuuauguugcuuucuauucugugggggcuuuggagggcaaggggcuaaggcccccacccccuggaaguuucugaucacgaauugucccugguuugaaagaagaggugguaggaacauggaucuuacuaagauggugccugagcugagcuggugguguuaguucaucacuuccuccugcugccaacaugcaaguuuaaggaaucguaaaucucccuuucuacugauacagugaauauuguggcuuuuuuuuuuaaacuggacuguagagucacuuuuuuuuuuuuuuuuuuuuuuuuuugagacggagucuuacucuguugcccaggcacacgaggcuggagugcaguggugcgaucucggcuuacugcaaccuucgccucccggguucaagagauucuccugccucagccucucgaguagcugggauuacaggcgcccgccaccacucccagauaauuuuuguauuuuuaguaaagauggaguuucaccauguuggccaggcuggucuggaacuccugaccucaggugauccgccugccucagccucccaaagugcugggaucacaggugugagccacugcgcccggccuguagagucacuuugaauggauggaaaaaagcccacuuugauguuugaaaauacuuaugguuuagguuuuugaaaaauaauuuaauuuucuccacuuucacgaguuugauuuuugcugcuguuuuauggugagugauggaacuuuuggagcuggucuuccagacuccacugguuucaggauaaggaucacagugaggauguucaugaaggccccaggcugcuccccugcucucugaaccucccuugcagucugagaauugaucaucucaggagaaaccucuaggcucuaaacucuaucaugugcuuuuaaaauugugcauuuuuauacuaguaucucuuuaaaagaauaugcacugauauggacucuaucccaacagguguauuggaaggucucagaagacaaaaaagcaaaaugugcagaaaaggggaaaucaaaacagguaaauuucuuuugcaagcuacaaagaaucccauucaaguauuucuugguuguuuuaaucuacugaaugccagcaugccugcagugcaggccagccuuuucuccaggcucuguucauucugcugggcuugguuuuguugugaugcgucuuggagcucaucccucuauuccugaguaucaggauuggguuucucaaagcaggugccaaacauauuuggccuuugagaaauacuuuuuuaaaguuuauaugaauugaauguauucagauggccugaaacuuugacuacagaacacuggugaauagugaagcccacuggugaauagugcagaaauucaggguuuguucugccuccuugcacccagaggccuuaggcuuggaggaguugcuagucaugcaguuuuucucaaccccuucguuggacuugcgacagagaugccccauuuauucggccugcugugcucaaccucuugcaggagggagcacaugagugagcaagugugggaucuggccagcuguuuugggugccagcaggagcaggcuuugugugagcccugaggguggcacccagguuggggugccugugacccccgcagccccagagggugcguuacagugcucucuuaucucuguucuccauggacagugguguguuauaagcucagugggccccuuuucucauugugugggacagcuguccucugccagugagggcaaagggccaguaugacagccuuuuuuggguacacacacucaggguccugagcucuuguccggcauccaagaagaaugagguugcauggacacuuaaaggaugguggagucagagaauuuuguuuaguguuggaaguggcucucagcggagaugggagcuugagagggaacaggacgagcaaauaaucuucccugaagucuggccagcucuggccggcucuucuccaaaguuaagccauuucuccaaaauccagccaucccucugaagucaagucaccucucucuaguccagcaccuucucuucucuaucaacugagucugggcucuuauaggcacaggaugagggcagggugggcuguggguaguuucggaaaaggcaacaucugauuguaaaaagauguucagaaagaaccaaucgggagacggcgggcaaacagggauagaaguucucacucugggcugcggguuuuaggcuuuuuggcucacaugugggguuuugccagggaccugccccugucugccuagacuuucucuggcuccuuucucuaucacugggacuuuuggauucuuggcacacguccgucccuuuggucccucaggccccucagugugguacucauucagggagcccugggccgaauacucauucccgucugcagcucuagguuacccucaucacccucugagccaucaugucccuaccuggcacugggcauucuuccucaaugguggucaagacaagcugaguuaaaggcaaaagaagaaagaaaacccaaagaagucuaugcuaaacuuucuuagcaaaaugcuaaacacuugcacugaagucuuugucucuaaauccaaaguuagauuaggaaaugagaggaaaagcaggcggugcaguguagcuccgguuuccgggggugugcagguggguuggggugaauagugaauuacuuccaaccagucuaaaaaagagaacucuccuaaucugggauaauuucagacuauagcacauguaacgcaaguacuuuuagccuaaaauaguggguucugaaaugguaucuuuguuuuccugcuugggccuuucugaugccaagccgggcuccaggcucuccuagugcagccacucccaugggggcuggacugggacccuggguuggguagaccuagugucgcuguuccuaguucugugcaaguuggaggcaggguggggucuccagaaacagagaggaaauucuguaggguggacacuucuccaggccuggcaacagaacaagugguccacguacuuagcaagaguaaaauauauugcuuucaacagugggugucccaguaagauuugagguaagcauucauugaguuuuuuuucagucaccacaucuuugcugaguaucaauuagggacugaaacaaaauccuguuuggcaccugaacagcauguggacacugcagagacacaauuacucaggccaguuucagcuuuagguuugccuaggggugggguuggggucucagugaaccuuccacuguacgagaacaggccagugugugaagaggaguugcagagggucuagaugacaagacaaggcugagaaugcacacaugccucguuggccuggggccaccugugagcugguguuggugaaugugggucugugccccugagaugaacggcgugagcaguuugaauaguggagggcaucugggcuggacgguugcuaauggugcauuucucuucccugcagacagagugccucaacuacauccgggugcugcagccacucagcgccacuucccuuuacgugugugggaccaacgcauuccagccggccugugaccaccugguaaggcugaugggcaccucccugugcucacgccagccuggucagcaguuaaaguagaagggggcucaaagcagacguaaagcugucuccacccuaaaaaaaaauaggauuuucucagagccagcugcagaaaacgggggcagcuuguggccccucugaaagucuugcacagcugcugucaggggcacacagcccacuuggcuccucuaaguuucgguguccauggccaagggugaggccuggggugcagcucaaggugcugggagcccuuggugcuagugcagagcaugccauggaggggcgugcuggaaaguacagacagccugaacauggcauuggggaugugcugggaaggacagguagccugaacaugcuauggggugaggggacgugcuggaaaggacagacagccuggcagcucugggcaucugggucagguggaaaagucaggacuugcuccuggcuuguguguucuugguuggugcaucugugcucuggcugugggacccacccuucuggucggcuguggugugcagcuugcucacugaaccacuccuggguccacccacucaggggcagcaggucaagugugcugagcaccuugagaagcaaguccggccucugucccucaccggcucacauccuugacugcccagccugguauccggcaccucccccugugugacgguccuuucuauccagauaaucugaugagcaaugugaugaucaucagagagggagaaguagcauuuuaaauaaguccaugugaacauggaaaaugaagcacauuuucuacuguguaucccuggauuuuaaugaguccugauaaauguaaaauaugccacagugaaaagcaucauuugcuagaacccuaaauuaauuggaauuaaaauauuuuccaaucuugagucagagauaaaugacaagacaacguauggccucauuagagacuugaugaggaagccugguauuugcacacagacgucuggggugagauucauaguaggggucuacccagcugccuguaccacagaugcuggcaacgaaaccugauagggggugggggugcuuuggggauaguaagacccucaguccucaaagacagucguuuguauuuacuuuugugcagaaaguacgguuggaccagaaacauuuugcacaacaaaggauuuuucuggcuaaacucaaucagaagcuuaaaguucugucauuuaaacuuacauucuguagauagguuagcuguugagguuagaggauacuguauuugguuuaaauuuagaccuauaauuuuuccuaauuuuuuuuuuuuuuugagacggaguuucacucuuguugcccaggcuggaguacagugaugcgaucucggcucacugcaaccuccaucuccuggguucaagcgauucuccugccucagccucccgaguagcuggauuacaggcaugugccaccacgucuggcuaauuuuguauuuuuaguagagaugggguuucuccauguuggucaggcuggucuugaacuccugaccugaggugauccacccgccuuggccucccaaagugcugguauuacaggcaugagccaccacgccccgucaauuuuuccuaauauuuuuaauaaaaguuuucacagcugcagaaaagauguaucacuuguauauccuggcaaccuagauugcacaauugggagugugugugugcacgugucugugugccugugcaugucuauguguccacaugugugucuguguacauaugugugcuugcugaacuaugacccgugacucccaaaugccuucacaggcaucuccuaagaauaguaacauuuuccuauguaacuucaguuuuaucauuauaucuaagaaaacguucaaucauuccccagcaucauccagucuccaguccccguucagauuuccccaacagccccgaaaccuccuuucaagguaugcuaaauggucacauccagugggguucacauucccuaaccuaacaggugaagagcugugugcugcuuuaacuggccuuucaagggugucagcugcggccuuccacguggucugagccuuccugcucugcuuccgagagcguguuuccagccagccuccugcagcagaggugcugggugcccuugccccgccgugggcccugccugucuucagcaugcccaggcuguuggcugcaaaguggcauccccacgcguguucugugugcucucugguucccggcaggcucagccccucucucgucugugcuguccagauggguuucuucugucacuugcuggauuuugccuguuuuucuccuggaugcccuuucucacucguuuguccacacuucucacauguucagggauggagacaccucaucugccauucuguaggcauuucccccaguuugucacauauuuaaccuugccguauuauuuccccauguggaacuuuccaguucucucugugguuggaucugugcauuguuuuccucauguggcugugggcacucuggccagguaaagagaggacccccagauggaaacgccagccccugcucuguuuuaguacagugcgguucuguuuuuaguauucagaugguugauccaucuggaguguguuuugguggguggagcgacguagagauucugccuguuuauguuuuucugcuuccuauuuauugggucaccuagcugcuuagaaugccgucuuuauugauguuaaaauucugcucaugggcuuccgauuacauacugagcacguccuguguuggguuuauccugguggcuuuccagcccuagagccaucagcguugccauuuccauuuugcagaugaguaaauugagggucugagaucuugagaagcuuggccagggcaacggagcaagggcaccaaggugcugaugucuagaccugagcugagcaacacaagcccuggcccuagugggcgggacuccuguagcuccacaccuaucugcucggcccuguuggucuuccgagaagagcaaauuuguaaaaugaagugguacagagacacauuguuacuauagaaauucagccaucugaugaugugcucucuuuuuauucaauuguagaacuuaacauccuuuaaguuucuggggaaaaaugaagauggcaaaggaagaugucccuuugacccagcacacagcuacacauccgucaugguuggugaguccugccccuccaguuccuucaccgugaagauuacaguggcauguuaauuaccaaacaggauauuuggaucuucucugaagugcugucuuccuuggcuuuguuuaaauaggagcuauccuuacaaaaggcacaugugacugcauagacccuuuaacuuuugaauucauuguuugcaaggauaauagccgccaugguaaacgucacuuuguauccauugcuggcucaugucauuuggauaauccccgcgugcugagcagaugcuccuguuugagaguaagguuuugacugagccacaugcugucugcaguggucucucaccucugagcaaguggucauagccugguguguacccacuguugcaucugccagcauuuuccuggaugugggaauuccuugcucauguuuacuuauugccccaugacucuuaaaaugcagcugaacauggagcaugaaauuauccccaucaaagugagagcacaccugugguccuagcuacucgggaggcucaggcgggaggacaggaguuugagaccagccugggaaacagcaagaacucaucucaagccaggcucaguggcucaugccucgaucacuugaggucaggaguucaagaccagcuggucaacaggguuaaaccccaucucuaccaaaaaauguaaaaauuagccagacaugguggcgcgcaccuguaguccaagcugcuugggagguugaggcaggagaauugcuugaacugggagguggagguggcagugagccaagaucgcaccacugcacuccagccugggugacagagugagacucugucucaaaacaaaacaaaaaaaccucaucucgaaaaagaaagaacuagaagacacaggacaccccaaaaguugaggagacugucuuucccuuuccccaggcagggacuuaauuggguuauaaaggaaaacaccguguugaauguuugucccaguguuggugccauagccugagagguugguucccuuuuccucuuuucuucugggccccugcagauggagaacuuuauucggggacgucguauaauuuuuugggaagugaacccaucaucucccgaaauucuucccacaguccucugaggacagaauaugcaaucccuuggcugaacgguaaggaagagcagugcaccuuagugggaggugcgugucuccucaugagugcacaccuguugaucucuccuuuucugucucugagcccugggggcccccgagcuuguguuagccccuguuugugggggauacuucccaaacuguccagcaauggccagagucccagggcaccuuguuggguguuuucacugguaacagaguacuguuuuaagacagcuccccacuaaccccccaaaaauggauuugggagacucucauaaaauugagaaucugauaguagaugguaaacuaagacuaaucagauggggacaugguauaauuuccagaaugauauuaaaguguggcaccaacacuggugugggaccugccuccgggcccagccucuagugcccggucagaugggcucugggugccuuguugcugccagcagcacauguccgauguccgucuucaaugugcaggaagaagcugguggcuguucaugggggcuuuucuugugggugccagccaguagagccuuggguuuugaaccucuugaccuuagggcagaucccaagaccccagauucagggacagucggccauuccucaggguggggcaggaucuggugguuagaguuuguuuaugugaagcauguguuguuuaaaccagcaaaugcaugccuuacguaggucucugaugcugguaccaucuggcucccugccuuccagucaggaggcccagccucaguucuuggggugaaccugggugggaugcacugcagaaccacugucgggggcaccucucugaggccgaggagguggggguagggcaccaucugggcucagggcugucaucauccucagauccuggaguuucuguuuggauuguggcaugugcacacuccagacauccuugcagggaagcccucaggcccccaagguaguguuggccggccucgugaccucaugggugcaggcagucccccagcucuguguucugggauaaucacuguccucucucugcagagccuaguuucguguuugcugacgugauccgaaaaagcccagacagccccgacggcgaggaugacagggucuacuucuucuucacggaggugucuguggaguaugaguuuguguucagggugcugaucccacggauagcaagagugugcaaggugagugccaggcacucuggcuucgcuuggccccugccauggcaauagugugccuggaugauggguggcuccugaccuucgucucaaaugucacuuucccuagcacuuuauucccuugggccucagaugcagcucucaauggaucuuauuucuggggguuguggggacugagggagugcuggcccccaugugugacccauuagccuccucuucucaggagguucuuucuuuuaaugcacccucuucaaaccucuagcuuauaaaaagcaaggcuuuguggaauguauucaccagagucuguuggaauuucaccauuuggcucuuaaucuaccuaagagugaaacauuaaccgacagcuuaagauuaagaagagagaaccaauacagaaguuugucaaaacacaaaucuuuaaguacauuaaaaggggagggugccuuuaaaaugacacacuguaggcacagugcucagcacaagagaauggccuaugggcuugauuacaggaaaucucaagguugcucaguggcaguuuccaggagguggauugucaggccucaggggagcugggggaaaccacaugaaacacagccgccaugucccuggccaggagcucaucucggagcagguagccauucgucucucauggaaauugguagauaguucuugcguggcccuuucucauguagucaugaccaucaggacaucagagaagcaggguuccuuucaugccuauggcgcacaaaagugggugccuuugacaccguucccuuaacagccccuugcauaaggaagaagguugggugaugugcacaccugaguauccaccuggugcuuugcucccugcccaggccuuccguagccagggcucacugaccagauccuccagcugccccgcagccccgcagccguggcugccaugcuccugucuugcagaccaggaaaccauccuaucaacaguaucaguguugggggcaagccagugccccuugagauggggagggugcugcagggccagagcuccuggcaggcgugcacagugcucagaaugcugucagagcagcacuggccaggggacucgagcccuccccugccaucgggaagccaaggaucagacuugccuugaccuugacuuauuacccagcacugaggguuugcagcaggaucagugagcagauucagcgaugcacagagcagccaccuccacccccgacaaguuucuacaagucuuaggcacacugcugucauccccucugaucccuuuuuuuuccccauacuuguuugaacuccuggacuagggugguuugagcuuaggccccacagcuccugccuaccacgcaggcacacaugaacccuucaccugcugcccgugaccugaaagccacaugagaccccugacgaaaaaugugcuagaaauuauucuuugcuaaaacaucaaggaggaaaaugaaguccuuuuaucaaaaagagaauuugggcuccuguaaucacacagcagagaugaagggggaacauuuucccuguguccaaaauaaguaaggcugcuucuauuucauauucuucugcacucagguuuugugguuucaguauuucucuccagaccacacacagucauguguaguuuauaauugugucuuggucaucggaucccugaaaagcguuuauaaagaacuuagguucaaagcacuuuagcagauacuuuggguagaaaggaagugaaggaucuauuccuuuaaagggaggaagguucacacauuugcccaagacaggcugcagggccgguggcuguccccuggaaggaggcugccgccacuugccccacccagagcauguucauugaugggcccuaugucaggaaagucacacaaugccaggggccuuggcaguuggaagugugugagcacggcagcaccucugcgguugcaggacugaaugcugggcacaggcaggcauggacgaucaaaugagcuuucagugagagggcuuuuguccguuuuguuuuguguguuaacccaggagcguucugggauccaagcuggaaccuggacguggugcugcgggccacucacauaauugcggcaucugucuccuguugcccgagcuuuguuucagucaggcacagccgcgcugugcugggccauggaggggugcaccucugaccuuagugcuugcucacaggggauccacucucggcccaccacgucuucuuguugggguuuuagggggaccagggcggccugaggaccuugcagaagaaauggaccuccuuccugaaagcccgacucaucugcucccggccagacagcggcuuggucuucaaugugcugcgggaugucuucgugcucagguccccgggccugaaggugccuguguucuaugcacucuucaccccacagcuguaagugcccuggguggagucccccuccuugcucccuugaugccgccagguggucccgucaccucuuuccccuccccaggaacaacguggggcugucggcagugugcgccuacaaccuguccacagccgaggaggucuucucccacgggaaguacaugcagagcaccacaguggagcagucccacaccaagugggugcgcuauaauggcccgguacccaagccgcggccuggagcggugagcuggggcacugggggcgggccgugcuuucccuucaaggcccagggcauggaauccaguacaggcacuggggccugcucaugggcuggguaccuggccacgccaaggcucucugcauugggacagggacggccgaugagcacagcucauccuucuucccuuuugcauguuacguaacagccauugcuacacuauugcacaaacaagaaggcuggggcagcuguuuugcacaauuaacauugcauaacaauuaggucuguuucauuuucaguuucuuacagagaaacacaugauuccuuggcaaaggccucugcacuguccacuagucaacaggagucacauuuuuuccuccuaaauauagugaacuuuauguagaaauugggaauuuccaggccgauuccuucccucacauggggaaaugggugugacaggcaugugcacagcccucuguggggcugugaccuacaugggguguccuggcccucagaguucacugcagcaccagcucccucccaagggcagcugucccugacaccaucauggcuccuucuaugcauagcuucguaaaauguguucacucauggucacagauuuugguuuacacacaucagggagcuagaacaggaaaaaagaaucccucaggcucuuaugcuauuuuaaauuguccugguuuuagccauguuuagcauucuuuucaugagaaagcugcaaaucaguguucuguuuuuuaauuucaaaagcucaauaaguguuuuucacuuacaaauagauaaaaauuccuucccugaguauguaucgugaaugcaauucugucuugcagauguguuuuauaacuguguccucugcuggcuggggagaggccaccuuuccucauaguaaaguuauucacugcuacccucauuucaaggcaugcauugugugguuuccagguuuugcagcccccccugcguuggcugcuuguguggaagcacccguugcguggugggacacgagcacguuaacagcggggauuuucucccugcagugcaucgacagcgaggcacgggccgccaacuacaccagcuccuugaauuugccagacaagacgcugcaguucguuaaagaccacccuuugauggaugacucgguaaccccaauagacaacaggcccagguuaaucaagaaagaugugaacuacacccagaucgugguggaccggacccaggcccuggaugggacugucuaugaugucauguuugucagcacagguggguuccgagggcuuggcaggcuugacagugacagcacaucuguguccucugguaggaaaacugggaaauccaauuauucuuucgugaguaguuccauugccucccucgaggugaccugggagguuugugggagcguaagaagauuucugagaagucaccacaccagguggcuuucagaucugggaccaccaggcuacuggagguacuuguuaaaaauaaaaaugcaaguccuggccuguggcugggcugggcuggggcagaggaguacuggccgccgaggaguuggggcagugcccacgcagggggcaggugugagccaccugggaggaggcgucagccuggcguuuccugacugcuggcagaggaccacgucccugcuuccuggccgaggagccagguuuuagaugugcccuggcauguggacucugaaauaagcacuucuggaacagggacaggggccaggagccacgguggcuggcagcgcauuguggccugcccuuggagccucccagccaaccucacaugcccccuguccucaccgccugccuagggcacuuaccagugacaccccgagggcugguggagcaugggagcccccucauguggcacuuagccucaaguguaaugucgacuguuggugaggauucuuggggucaaccauggaacaguuuauuuuccuuggaaaaaaacuggaauaacccauaacacuuggguuuccaguugucuguuuugccaaagccuuuuccuuuuuuuguuucuaaugcgaaaucaucauuguuuucuaaguaucuguggagggaaugacuugagagugaagagugugaaguuugccgcuguggucacuguccuugguuucugugucuggguuagugucacugaccuguagcuuuggcccugcagaccggggagcucugcacaaagccaucagccucgagcacgcuguucacaucaucgaggagacccagcucuuccaggacuuugagccaguccagacccugcugcugucuucaaagaagguaaagugacgcaggcagcuggaccgggggcuucuccgcucgguggcuuugauucuaggugacaggagaguuggcaagcuggagucgggcuccugggcaggccccucugucugucugcccugggugagccaaccuucagaguuugacacagagccauuccgugagcugugggaucugaauuggggaaggcaggaaggcagaccuggggagacgggacuuucucuucgaaguugcuggaaugucauugaguuguuggugcagcuuuacaggcuguggagaggugggcacugcuccaugaagacaccuuuuuaugcccugagcuuggggggugugcagacugcaucugugggauaugauagugauacagcugacucgucaccguggaaaauccacaagagaagugguucgucucaucuguaaagcugucuccaccuguggcugagacucuggucuggccugcaauacucccaagcagcccuuggcaggggugggugggcgggcauccacgcuggccuuuagggggcugccucccuggcccuggcuccuaacgggaccuccaaccaccuugugggauccaggcccagucaguccucuccucccucagcugggagcaacaggcagaggaagagggccccugucuggccggguaagauaccuacccuuggcaggugcguauuugcaaacaccccuccaggucuucuguccucuucccuccccuguauccacaaagcuugggagccuggguccuuuuacguggucaccuccccucugcuaauggagaguucucccucagaucugaaaggaaaagagaaugaaauagccugagcaaguuauaagccacuggguacuggcaucuguucaccagccucucggucuccaggacacaaagggagcccuggagauuugaagggucgacgcuuuagccacuguggggccucaccccagccucguuguugaaagaaggggacccagaagcucuucuggggccaucgugcuguucaguggccucagccagacugggcaggcaccuacaacaucucuaaaauguggacuucucauuagaaugaagauugggccccugguguggacauucgugagaaugacacucuguuccaagggucacuuagggacccaggcugguggaggcuuccagggcacaugggcacugauccucaaaggcagaaggggguaggaagaggagggccgcacagaggggguuacgggucagugcccacccgccaucucccagaacucggucacauggccacaccagggcagcuggccacacagggagccucgcgcccaggaggaggagccaguggguuuggggaagcgcuugcugguccuacuggaccacccgacccgccugucucuguaggagccuccauucguggggacguggcuuaguugccuggacaagcggaaauacauccugccugccgugggguccugugccuucuccuugggccucaguaggcuccagguggggguggaaggcccagcuccauggccauggcagcaggaaguggcuguucagugguaaaaagacugugccgccugaccccaucaggcucucucacggugaucagcaaauggagaaacggccaguaccacgcccucccccuguccuacagcuggggaggugcgcugugccuccacccucaccuccucuccccugaugacaagcaugggguuuugcuuuuuauuuugguaaauacacaucagaugaaauuugccgucuuaaccauuuuucauugugcacgucaguggcauuaagaacauucacguuguuuugcagccauuaccacugucugucugcagggugcuuuucaucuucccaaacagaagcuuuuuaccugugaaauacaaacucuucauuuuccccuccuccagcccugggcagccgccauucugcuuucuguuucugucuggguaccucauaugaguggaaucacacaguauuuauccauuuguaacuggcuuauuucacuuaacauaaaguccucaagguuccucccugcuguagcaggggucaggguuuuccaaggcuacauacuccucugucguaugugaauaccgcauuuugugagucccgcauuuugugugugcguucaucccuugauggacacgguugcucccaccuucuggcuucugugaacagugcugcugugaacgugggugugcagauaccucaaguccuugcuuuccauuccuugggcgcacacagcagaugcgguuugcucggcccucucugagcccaccgaguaggcugugucuguauuuucaccaggacuccuugggaugcugagcuacagcuagcguggcagagggcaaggaaggcacuuagacagcucaguugccucugaucacguccaccgucacuccaaccugcccucggggucugacgcgcacacacagcagcagagacagagaugggagcaugagagcugccugcaaggggacaauccucaggcccagggaaggcggagacagggggcgucgaggggcaggagugcacaggacaggcuugcucucagcgggccucacucaugcugccaggugccuggucaggcuuuuuuucuuugccuuuaaaaauuuugucuugaaauaauuuuaaauuuacagaagaguuuugaugauugcacagaaggaucuugagcgcccccaccuagcuccacauguccgaugucucacauagccagugugcauuuaucugagccaaggugcugucauggugcagugcguuaccugaaccccagacccuggacccuccuaccucccgcccaccacauuccuggcucagcaccucagguugcacuggacacugcaucuccucggcuucugcucuguuccugccucccugaccucagcacuccuggagaggaguagucugguguuuuguggugugucugguguauucuugugauuaucuuggggucgugguuuuagggggagcaccaaagagggcgcuuucuggggauggggcaucuguaugacucgcaccagcgugaugaccuuggucauucuguccaagucaccaccgucuuuuuccaugucgagugugucggggcauguaguccacacugggggugggggagagugagccccaccucccaggggagucaugugggaaacccccacagucauucaugcuuauuugcagggacagacuuggaggcuacagaaaugcccuguucucccacccacugacauccacaucgaccaguggguccugccugcagcaguuacagcuggcuguccugacgaccaguuccuccuucccuguccccucuucccuuccacagucaucccuuggucucuguguggcgucguuuaguuuuuacagcuuaguuucauuugggcugcagcccagccccauccgggagaagcggaagcuggggcugagucucccgcagggugcaggagguggucuggauccccuugggacaggccuugccccccagagcccaccccacccuccacagcuacccucaagccucucuuuggggugaggagucaggcgggccccacuuggccacccagggcacccugcucugcacugcaugguguucacgccaccucgcaggugccccccgcgggacccaacaggaccagcugucccuuggaaguuacccagcuuggcuuugcugccagagaauguuuccgccaccuccacaagccgcgcgaugcccgaacugugaucugggaugucauccucaauccuucccacaaacguggcucacacauggccucaucugcccaggucucugcugcugcugcugcugugaggccagcggcgggccagguucccucugcuguguauuaucacaguuuccauccuugggggcuuucccuuucucucgugggucuguguccgcacagcuggauguguggccuggggcuuccuguauuggcaucagggccugugaucuuccaaccacacucugaaguugacuccgagcguauccucugaggaugaaggucguguuucaucugacuguaaaccacuaagucauguguaaauuugggaaucuuguauuguuaaccaaaagguguccccaggcuguugaggcagaugcccugggcagaggcuagagagcgcgcuccacgggccaccuccaggucuguugcacgcccccgagcuucaggugggugcacugcauguggggcacccuccuuccagcugaguuccguucaaaagcagucagcagcccuggaugccugugugcugggcacugcuggugccaggugggcugaugggauggaccugaagcuggugucacugggaaccaagugucccagaaggugggagagucucaccugcccucugcuguggguguggcugcucuggagcucggagguugacuucccgucugugagcucuucccuuuuacauauagauaagugaaaagcaaaaggcauuguuccuuuuuuauguuuuguaucacgaucuccucauccuuugcaugucguccguuuggcaucccuguuauguuaggccucugcuggauccagacccucacgagaggcuccccgcccacaggugcucacauucuggcucgggggacgagguugggcuucgagguggugugcuucagccucuggcugcagccccuucucaccuauagugaggccgggaagaugaccgggagugccaggcucaugcauccucugcugcagggaggagaucuggagguggggacugaacagccuccccacuggcuaagagaaacacgugcagagaagcgcuuugcuggagggcaggcaccugugggugcccagacaggggagagagggauuuggaccuaaggcccagugagcccugacauagcacguggauucugcaggaaggucacagaccugccuuguuugccucugguucugaguaccucuccuccuuacugcaauguccccugaagguacacucuggcugcuucccacacacuggugcagaagcagaggccaugcuccuggaugccugcuugccugaugcuaguucuucucugucucauacacgcagggcaacagguuugucuaugcuggcucuaacucgggcgugguccaggccccgcuggccuucugugggaagcacggcaccugcgaggacugugugcuggcgcgggaccccuacugcgccuggagcccgcccacagcgaccugcguggcucugcaccagaccgagagccccagcagguauggggcgggaugcgcugccuggggaugucccccaugugugugggugaauaacacgugccgguuguuuugcagggguuugauucaggagaugagcggcgaugcuucugugugcccgggugagugacuccucgacgucccauuuccuuugggaguggcgaggucuuguagccauuucacggugcuucaguucuguggcauuuguguguguuuuguuuuucuuucuccacucggaacagaggucaaguguucuguagcagacucguggucuucucugucuuuuuuucuugccgaaagaguacuugaagccacuuagaguguaucugcuuacugggaagcagucuccuuccaaaaccauccuguuuucuuucugcuuagcuuggggcucauuaagcaaaaccuaagccuguuauaaauggggagaaaggagcccaugagugauuaauccucaggcaguguaagggcuggggugguguuuccccuggggcucccaccugggauucacccgccuguggaugucugaaauagcaccacacccagagggagggguggcaucaggccagaugccccuuccccagcagccaccuuccagggugcuaaaggcagacuugacccucaguucugugucuuccugacccugacaagacagcugucaucagacuaagaaagguuuaggcagcugggcauggugguacacgccuguagucccagcuacuagggaggcugaggcaggaggauugcuugugcccagggguucaaggcucagugagcuuaucaugccacugcacuccagccuggggugacaaagugagacccagacucuaaaaagaaaacaaaagcuggccgggcacaguggcucaugccuguaaucccagcauuuugggagucugaggcaagaggaucacuugagcucaggaguucgagacuacccugggcaacguggugagacccugucucuacaaaaaauacaaaaauuagccaggccuggagguggucaccuguagucccagcuacucuggagacugaggugggaagaucccuugagcuggggggguugaagcugcagugagcugugauugcaccacugcacuccagccugggcaacagagccagacccuguuucaaaaaaaagaaaaaaaagaaaaguuuaggcaggaggagagugcugagaugcacugaaaggccagucuuccuugcagccauuagcagaagcgucucgugucugauucaaagagcugacacuaggcacagaacuggccucugcucagcuuccccagccugacgcguuuucuucugggacacgggugagaaaugggauuucugcugcucagagcugccuccaauuucuuuguccccaugggcugucauccagggcucaucuuugcuuuuuggucacgcaugucuuuaucuccuuaguuguucuggaagauuccauguugcuacagugggugaaacucuugcgucaucuuguggguauuuuaaagaaguuguuaaauagcaaauggggauuguugacgcugugcacguuuauuuugauguuccagauaaaaguaaaggaaguuaccggcagcauuuuuucaagcacgguggcacagcggaacugaaaugcucccaaaaauccaaccuggcccgggucuuuuggaaguuccagaauggcguguugaaggccgagagccccaaguacggucuuaugggcagaaaaaacuugcucaucuucaacuugucagaaggagacagugggguguaccagugccugucagaggagaggguuaagaacaaaacggucuuccaaguggucgccaagcacguccuggaagugaaggugguuccaaagcccguaguggcccccaccuugucaguuguucagacagaagguaguaggauugccaccaaaguguugguggcauccacccaagggucuucucccccaaccccagccgugcaggccaccuccuccggggccaucacccuuccucccaagccugcgcccaccggcacauccugcgaaccaaagaucgucaucaacacggucccccagcuccacucggagaaaaccauguaucuuaaguccagcgacaaccgccuccucaugucccucuuccucuucuucuuuguucucuuccucugccucuuuuucuacaacugcuauaagggauaccugcccagacagugcuugaaauuccgcucggcccuacuaauugggaagaagaagcccaagucagauuucugugaccgugagcagagccugaaggagacguuaguagagccagggagcuucucccagcagaauggggagcaccccaagccagcccuggacaccggcuaugagaccgagcaagacaccaucaccagcaaaguccccacggauagggaggacucacagaggaucgacgaccuuucugccagggacaagcccuuugacgucaagugugagcugaaguucgcugacucagacgcagauggagacugaggccggcugugcauccccgcuggugccucggcugcgacguguccaggcguggagaguuuuguguuucuccuguucaguauccgagucucgugcagugcugcguagguuagcccgcaucgugcagacaaccucaguccucuugucuauuuucucuuggguugagccugugacuugguuucucuuuguccuuuuggaaaaaugacaagcauugcaucccagucuuguguuccgaagucagucggaguacuugaagaaggcccacgggcggcacggaguuccugagcccuuucuguagugggggaaagguggcuggaccucuguuggcugagaagagcaucccuucagcuuccccuccccguagcagccacuaaaagauuauuuaauuccagauuggaaaugacauuuuaguuuaucagauugguaacuuaucgccuguuguccagauuggcacgaaccuuuucuuccacuuaauuauuuuuuuaggauuuugcuuugauuguguuuaugucaugggucauuuuuuuuuaguuacagaagcaguuguguuaauauuuagaagaagauguauaucuuccagauuuuguuauauauuuggcauaaaauacggcuuacguugcuuaagauucucagggauaaacuuccuuuugcuaaaugcauucuuucugcuuuuagaaauguagacauaaacacuccccggagcccacucaccuuuuuucuuuuucuuuuuuuuuuuuuaacuuuauuccuugagggaagcauuguuuuuggagagauuuucuuucuguacuucguuuuacuuuucuuuuuuuuuaacuuuuacucucucgaagaagaggaccuucccacauccacgagguggguuuugagcaagggaagguagccuggaugagcugaguggagccaggcuggcccagagcugagaugggagugcgguacaaucuggagcccacagcugucggucagaaccuccugugagacagauggaaccuucacaagggcgccuuugguucucugaacaucuccuuucucuucuugcuucaauugcuuacccacugccugcccagacuuucuauccagccucacugagcugcccacuacuggaagggaacugggccucgguggccggggccgcgagcugugaccacagcacccucaagcauacggcgcuguuccugccacuguccugaagaugugaaugggugguacgauuucaacacugguuaauuucacacuccaucuccccgcuuuguaaauacccaucgggaagagacuuuuuuuccauggugaagagcaauaaacucuggauguuugugcgcguguguggacagucuuaucuuccagcaugauaggauuugaccauuuugguguaaacauuuguguuuuauaagauuuaccuuguuuuuauuuuucuacuuugaauuguauacauuuggaaaguacccaaauaaaugagaagcuucuauccuugauuuggggaagacauuccuuagcggaggcugugcagccucccgccccugcauggcccaggcgggacagcugggcucgcucuuuucuguccguuuccugcuguguuuugcccucucuggccugugacgugcuccuggcgacuucuuccucagugcccucucuuuucuguccucucugucucacagccucgucuccuaagccccucccuccuccuggcuccucuucccuguccugucugggccaugugggggacaggaggcuuuccucucccuggacccccuggccagccucgggugcggggcccgacagcagcucgagggucuccuugcugccgcccuuccugagugaccaggcacagcacgugcacgcccuggggaacuucuaccucuucugccaggccacaggugaguugggcccucucuguccccugugcccuguccaucugucuccucccacagguggggggcgggcgggggcauccuccacaucccuccacauguuccuuuaccuuccuuaucuguccuggcugcgucccucggguugagccguuucacgcuuucauuguggguccaucccgagggaaacuguagacagugugaagccacuucuaguguacaggggucaaccaguguuuucuguaaagggcuagauauuuaggccuugugggcugcaggcugugucacagccacuaagcucugcuguuguauuguaaaaccagccauagucaauacacaacgaguggucagggcugugugccaguaaaacuuuauuuauaaaaaugcacggugggccagauuugccccaaaggccccaguuucccaaccugugguauauaggauugcuucucccuuaaaaaaaaaaaaaauuucaagagacagggucucccucugucaccaaggcuggagugcagugacacaaucauagcucacugcagccccugccuccugggcuuaagccauccuccugccucagccuccagagccagagugcuucuauuucugcuaacaauuuggagguugauauacgugguauuuggaaauuuuaaaaaauuaagagcuuccagaaugggaguuguuuuaaugacuugcuucgugguauuuaaaagcggaaaagauuggcgggcauaaucccccugcuuugggaggccaaggcaggaggauugcuugaagccaggaguuucacagcagcuugagcaacauagcgagaccugaucucuacccaaaaaugugaaaaaaacuaaccaggcuugguggcacgugccuugaggauuguuugagcccaggaguuugagguuacaguaagguaugauggugccacugcacuccagccuagaucacagaacaagacccugucucaaaaaucaucaucauuauaaaaacagaaaagauugagagucuaguguacuccucugggaccuggaggcauuugcccuggauuggaaaauacucggaugggauaucugcucuugaaagauaguagauguccagaaccacacuucaaagauguauccugugcuucaggcagugcgugguagcccugguggccccuguguugucaucugacugaucaguagauacagaaagaaaggaaguggccuguuagagccugccccgggggagggaugaaguuaaugaagaggaaaagcaaacccaauugcucucuuuuuaaacauguuaaacacacugucaguagcuccugagaguuuuaaggugcugcccucuccuguuaaacaagcucugagagccccagguggcccaugucugcugaggccagaaugucccuuggcagccagcacuggacaggagaagcugccggugagcauggagcacuguggagacggagcuuugcuaggcuggcuugugugguuccugcccuccacugggugcuacggaccaaggcugugcugagcccccuguggccgcucucacagcugaauggugcuccucggccagcuaguuugccuuggugcaggcaucccagaggacuucaugucuccauggagacuguguccugucgcagcacugggguccuucaggcagacucaggaagcuccuccucgguggggaggcugggaagcgggcgggucucuaugaacuggccguggacccagggcuccuuugcgggcagaugcaggcaggcuguauggucaggcaauguugguugguuauuuauuuauuuauuuuugaggcagagucuugcucuguugcccaggcuggagugcaguggcacgaucuuggcucacugcaagcuucgccucccaggaucaagcgauccuccugcaucagccccccuaguagcugggauuacaggcacaccucaccaugcccagcuaauuuuuguauuuuuaguagagacaggguuucgccaucuuggccaggcuggucucaaacuacugaccucaggggauccaccugccuuggccucccaaagugcugggauuacaggcaugagccaccaugcccggcugcuguuacauuuuuaaaugugaggcuccagguguacccccuguagcuaggcaggcauacacacaagccccuggggucagcagggaaugaaagaugggugcccagggagaagggacaucacuguuacagcaacagaaaccaccccagauauuucaaccacagggcauuuaacacagggaauugguuacaaaggugauagaagggcugggaacagugggaaggugagguuuccauuaucagccaugggcaggaagagugaagugucaaacacucagucucacuugcugugccaccgaggcuguggccgugugaucugcagccucucccugcccgccacacugccuucacugcuggagguccuacuugaagccacaaaaauguuucuuccuuccaacuuccugucuccugucaaugacucccauggccagaccuaacagaaagcuggcggucacagauggauauggggaauguagcugugggcuugcagcaguguggccaggaguaguguguagaggguaggggagcugagggaggagggcaguccuuugccagugcucaggauggacugaacagauugagaacugaggcccccagcccuccgccacccccuuuucacguggucuuuacuuucucuccagaggcauuuggccccaucugggacauucucguucacuuguuccacugaggccacagccugcgaaggcugugagaccuccccagggagcaccagcuuaggagagaguggcuucagccuuuucaagggugggccgaggccagggcaucaugggcaugccgugaacucagaggggcuguggcugugaauuucccgaguaggcuccaggguucuguuggggucuguagaugcuuccugcgacagaggccacagugugacuugcaagucccagagacuuuccugaggagagugagugccauuuucugccuugugggccaggaaugagccauuccaggugaggcccagagccuggagauugcaauacagugcacucaaggcacaggccuaccgcuucugccuguguccucccccagccacccagggcagggcugcuuuggaacuuggcuggguuuuucuuugcuauaauggcuguuuucgugguagcugucacagugguuugggggcugucugauuaaagggcuagcaaagugucuuuagaauaugaaacuuaagaggacauucguggcaucuucaguuccccaugcugcguccuggugccuguagcucugcugggugacccugugucuuggggagcgucucaccccccagagagggcugacugauggaaggucagcuggucaggguugcacuuggggacugggucugccccagagcugguggaggcccaugugucacccaggagauguccccaccugccccaacacuuggccagugcucagaaaguggccccagggacuuggccauccaggagaggugagggcccucugaggccaaagcgcuuccugaaaggggaucggggugggucugcacaggggaaaacauagccuguggugugugcagaggcugccagggcacaagggcccaacguggggugcgguggaggugauguggccacgugggcggaguagggcggagaggccuguguccuggggaugcgagagcuugaggccugguggugggguggaggcccacccuuguccugcacccaggggccucagugcccauccaagggagggacagggccacaccugugggccugugucaggagcuggggugggagauuggccaccagugccacucuccaccuagacacauuucaucccuucuccaccacaguucucgccucuaggaaguggaauuaucaguggaagaugauacggaaagauccacugauggcccuggcacaggccagccuugucccuggggcaggaugggacgguccugagaaggcccugggacacccuaggggugucauagugggaacuaugccuuugcagugcccaggugagacagcacauggugucaccccaagcaugguacccugggcucagugacaagaggggugggcaggucaggacugcacugccuuggggcccgugcccugggagccgcuagcccuaugauccugaguccugggggacugagugcaucggcagggccuggagcagcugggaguggccgacugccucagugugcacuguggccgcacaggagggacagcggccuugagaguguucagagcuguugcacagccauccugcaccgcguuggcccugggauggacugcugucuaagcuuugucaugcggcuagcaaugcacauuuacuauagucagucacccugguaccagccgugaaggacgggcagggacacacacaccacaccccagacacacacacacccccgacacaccacaccccagacaccacaucccagacacacaccacaccacacccccccacacacaccucagacaccacacccccgacccacaccacaccccauacacacccccgacacacaccacaccccacacacccaccacagcccagacacaccacaccccagacacacaccacaccccccagacacacaccacaccccccacacacaccacacccaucacaccccccacacacacacccgacacacaccacgccccccaacacacacaccccacacaccacacccaucacaccccccacacacacacccgacacacaccacgcccccaacacaccacacccgacacacacaccccaacacacaccacaccccagacacacaccacaccccagacacacaccacaccccagacacacaccacaccccacacacaccacaccccacacacaccacaccccacacacaccacaccccacacaccacacacauaccacaccccagacaccacacacaucacacccccccacacacaccucagacaccacacccccaacacacaccacaccccagacacacacaccccccacacacacaccccaaacacaccccgacacacaccacaccccccacacacacaccacacccgacacacaccacaccccagacacacaccacaccccagacacaucccacacacaucacaccccacacacacaccccagacacacaccacaccccagacacaucccacacacaucacaccccacacacacacccgacacacaccacaccccagacacacaccacaccccagacacacacccccccccacacaccacaccccaaacacacccccacacacacaccacaccccagacacacacacacuacaccccagacacaucccacacacaucacaccccacacacacaccccagacacacaccacaccccacacacacaccccagacacacaccacaccccagacacacaccacaccccagacacacaugccacaccccagacacacacaccccaacacacaccacacuccagacacacaccaaccccacacacaccacaccccagacacacacaccgucacacaccacaccccacacacaugccacagcccaccccacauacgcacccuaccccagacacacaccacaccccacacaccacaccccagauacacaccacaccccccccacacacaccuuauacaccccagacauaacacacaccccacaccccagacauacacaccacacccccccacacacaccuuauacaccccagacauaacacacaccccacaccccagacauacacauaccccugacacacaccacaccccaccccagauaccacacaccccacaccccgacauaccccugacacagcucaccccagauacacacccuaccccagauacacaccauaccccagacacacaacacccccccaacacacaccaucccagucacaugccacacaucccagacacacaccccacacgccacaucccacacacacacgcccgacacaccgcaccccagacacacaccacacccacacacaugccacaccccacacauacaccccaccccacacacacaucacaccccucacaaccacaccccacacacacaccacaccccacaaacuacauagacuaugcuagccacauaccacacaccagacacacacaccacacaugagcaugacguauaccgcacacaugccaugcacuguacccccccacacacaucccagacacacauaccacacacacuacacagaccacacagcagacauaccacacaccagcaccacacccccucacaccacaugccacacacaccacaugccagcaucacacacacaccauaccuccuucauacacaccacacacacaaaccagacacacaccuacauaccacacaccacacaccagccacacaccacaaacacaccacacacaccacacgccacgcauauaucagauacaccacauacguacagauacaccacaauauacaccacacgacacauguaccacaacacacacacacgacauaacacgcacacacaucacaaacacaaucauguccaccacacaacacacacaccaugugcaugcacacaauaaaugcacagcacaaaacaucacauacaccaaaucacacacaccacacacacaucaaacaccauacacacagaccaugcauacucacugcacaugugcacacauaccaacacacaccacacacacacacuguacacacaccuaaaaccacccccauacacaccauaccaaacacaaccacucacacaugcaccacacacagcacagcauacaacacacaucacacacacaccaaucauaccacuguuacacacacaccaccacacauacugcacacaccaaagcacauacacaccacauagacacaugcacgcuacccacaccacaccaaucacauccacacauacacaaccauacacacacacacacacauuguugacuuaggaucguuucaacucacaguggguuuauugggaugcagccccguggcaaguggagcagcauguguauugacaaggggaggaaagccgucuggagcuggugaaguaaaguuagcaugcagccgagcucugcucgucugaacugaugaacccaaguuccucauggaucacucagaauacagaugggugaaaaaauaaccccaccacccgugugccagcacauagcgcaucuggcauacaaacguaaggaucaauagcgaugaauggcgauggguugugucuacaugcagauacaaaucaugcacuuguacauuagugugcacacacagaaacagaucgauauaauuuuuuaaccaaagugcagucuuuacccugucagggcccugccuucaccucugccaggacuaucuuccaugucaaguuuagacccgugucauuuucaaagcuaauaaugguucccccauacuuuaggcagcauuuagauauuuggauuugggauggccuuuuauguuuuaacuacaguguuagaaaucagagcccuuggaaccacugggaucagagggcagcagcagaaggcgcccuugguccucuuugaggggcccagggcucuggagagggcccccguuccuagcagccacaguggccuguuggcacgcauguguguguuccagcugcucugugacauuucccuuuguuucagacucuugaaaggccacggccgucgugggaauuaguugaccuuguguguugggccacccuugcuggacaggacaagguggugcuaucaacucccugugcucugagguccuucgcauguuagaugaggcagcuucaccagaaacuauccaugucucuucuguuaucugggauaauuccacgugccuuuacaacacagcugucugguuaccuggggucuggaaaugcccucggugccucaguggugccuucccacaggccccccauggagccaggcgaugccuacagaugccucagugguacuuucucaggucccuuugcagagaagagguucaggauuccugcccacauugauaaggcggcuuggccaguaaguggcaggcaugaacaggugcauuccagaagcgcuggggcugguccagugcccugaguggucuagagcauaccagagugaaacguuaggcugcgucggccuggugacugucagggagaugaggacucagagaagggagcugucagaauugcuaccuauguggcaggggucucacucucuccucccuccucuuggggccccuggcuacucugugacuucaacagaggacagaaaggaugaccaacaaggccucagggcauacccccagcugcacuguccuuguccccagaaggguccccagagucugggagggaggaggggccauggccaggauuagaaaagaccgugccccaaggagagagcacagagaugggccagggaagcagugggauccucgggaaaagaggcugggagcagguguccgggugaggcccgggcagcggguacaggcagggacaagccaggagucccaucauggaagacaugauggccagcggccagcacugugugcagagaauggccccucuggggaugugcccgcugccccauuaguugcaggaaggccaccuggaugugaguuugggagaugggcuggccccgaggcagccagcccugaggucagagugggccacaugcauggggaugccgggaggacacagaggagugcugcaggagauggcagugggggcacuuuccaggaugggcccgagcaacucagucacuggguggaugucucaccaccccuccaggccuuccucagggcgaggccacugcccagagggcaccugguuugucgcagaguagaaucagcuccauauuuuguaaucacauccacgaagcucugaagccauggugguccuggcaccagcuggcuccguuagaggcuuggggugggagugagcaggugggaggugccccagugacaggcugagugcuggagcccaggcugccaacagccuccccagacuccugaguugauguaauaaacccagcccuggugaauaaaccuggcccuugcuuauaccaaggugaucagucuucucacgacaguccuagcuguaggagaaagaucauuaccuacggcaucugccacagcaguuaauuugccuucaacuuaagcuaguugcagugacaggaagggccagggggaaauaucuguccucaggaccucuacccuagauccuuguaagccacaacaacuucccuucuuugagggcgcgaccagugucaccuggcucgccacugggaagagccaaggcacauccagguugguggcugcugagccccacagcaucagaccagccucuuguccccaccccacagaggccaagggggugaucugggaguagcaccccagccuggccgcucucuugagguaacaggguuggaugguuagggagcuuggagcacuggcccaagcaagaaaacagugguguuuucaggaggcccugcugggagauggaagacagcuccccacugggggccuaggauuccaggagcuccccagcaguccuccgugggacauacguggguuugcaccugcugcccugucccgcugagggugcggugcugaugggguggcccugcacacugaugguaacucucacuuucccucucucucaugcauucagaaagagauggauaguuuaaaaacgaauacauggaacguaaguacuucuuuaacaucuuuaaugucuuaugaugaucaagcauguauuuaaauaguauuuacugaugccuguuagcagugguaagcacgugucuguuucugcucacaccccaagaguguagagcuuugaggguuuugcagucaguggucccaugauggggcguugggugauuaauccaauccagcuuaggccacccagauucuuagucucaagggcuuggucaugagaaccuuccagaggcuccugugacucagugacuccaguccccugggugguucuuggugcaggucacaugagggaggagaccgggcuuuuauagaacucacuucacugucuguucaaagaaaaguguuacuugaucauaacagcucaaaaaaaucuguuucuuaaaaugagauuuuaccuggaugcccaucagcugggaaagggaauaucuauuccccaguugaugggcaccuagauguacauagagacauauguuuguacaucuauguaauauguacuuauauuuguagauagauacauggaauuaucuguggccagaguccaaaacauuuugagugggaaaaaacaaauuauagaguguuaaguuuuguuuuuuuuuaaauucugcacaaaaaccaaaccuguucacaagggcuuguccaccaggccagggccagaugggccgccaggcaaaacaguuuuggagcaccuucugaauuuccuugaguuuacagaauguuuccuucaaaguaacacuuuuauaaaaaauuauuauuauaaaagcaaugcuuguuuguuauaaguuuggaaacuccagggaaguauaaagaaaaaauuuaaacaaucccaaauuuaaccauccagagguaguuaccaccagcaucccagccauuuuugggccaugacuaucuacguucacacauguauacauggguguguacauauaugcacacauuccuagauauuguuucacuuauuuuucuguguugcugaauauucuucgauggcacuucgaaugagugacuuguggcccccuucuuggacauuucccaacuccucacugauagaaacagggcuucacugggcccauccuugccucgggacucauuccuaggacugcccagcuaaagggucugagcuuggucaaguccuugggaggagcauucucuggugauccuggacaguggggaauuguugaccaagagaccggacaaagaugagcagaugccacagucaguaaagcagggaaaaugcauuacuaaagucagcuucauuaaacuggcgaucucuucuuuucaaaaguccagcaugugccacagaaauggaaagcucucuggccacuacuguccugcccagggaggggagcguggguccacccacaccauuuaauaccuguaacuggaugcaccucugccccuacaccugagaacaaggccaguuuuugugugugcagguacuuuggacucuuuuggcucuggaauuuguuuuaccugcucaguguucugaacuccuuccuuuucacuacuaagcauucuccaugaagccacacuucauuuugucauugugagguugauggacaucuagggcaaaucuaacuucuaaagaccaauucuuacgaggugucauggucaagcagaggccauggccggcacuggucuagguggcccauggcccauuugggggccuuggugggccucgaggaagggcaggugcuggucagggagccgggucgcuaggcagcaggugggugucaccccaguccacgcugcuggggugccuggccugaugcaggcugugccugagggagacagaagcagcagaguaggcuggccggccuccccagccccaccacaagcaggagcuucagagacagaaggagcaccugcacccccucaccugcccuccagggccuggccuggcccucccagcucaacuccagggucuguacgcucuggggcuggagcuuagugggacuguggccccccucagcccuuucugcauuugaguggaagccagugugcgaagcagaucaaaauggaugugcuuguuuuuccuucaguaagaacagggaguugagccugucccaacauggccagcagccccuggagggccaacagacuucacgagcaaggaaggccgggaggugaccugcugaccagaacuuacuugugccccucccccccgcccaaaacccccaacauucugguuuucacagccccaccccagccaccuggaacaaauagugucuaggaguagcccucaggguuggccgcgcagacuucuugcccugggaugaggcuggccuccccaggcgaggcagccugggccacaggggaacgucucugccucgcccacccuccugaucucuccaucagacaagcugaggccagccaggcuccacccuggcagguugcaacagauggucugagugugugugaaguaacuggccucucuacuuucuucaauaaguaauuaagaucaaaagcccagagaaaaacaacagagguuugcggcagaaguggccaaugucgggcccagaguccaugcucaaggcuggaagcccauccuggaugugcugcacucggcaguccuaguguaauucugcagggccuggccccugccagggucugagcucuccagccuguggcaucuacuccccuccaagcccaccccagugucucaauuggagagacaggcccucaugguccccacucuggcccagcccccucugcacacagcuggccgagcucugggccucuccaugcuguggcccuggugauggcagagccuugggaugucucuguccauguggucacaggacauguguguggcagcagggccaugguggggugggaugcuguuccaaggcccagaaccauucuguaagaaaccagcacagcgcugcaagaaaggggguccuaggggacacaggccacacaggugugcuuugaaaaauggcaauuaaggucaaagagcaggaaguccacaggacgggccaaggccaaggcucccgcuggccauggggaagccaccuccagggcagucccagggacugaauuggaaguugucccaagucacuucagguccaacugggacagcagagguaaccccccugcacccucauggggcagcuucuuuggguccuaaauguggacucagagguggaaacggucuguguccccagguccugcagacauucgcuuugucugggagaagaaugggcgagcucuggagaccugugucccugugcagacccaugcacugcccgauggcagggcccaugcacucagcuggcugcaggacgccaucagggaaagcgcugaguaucgcugcucuguccucuccucagcagggaacaagacuucgaaggugcagguugcugugaugagaccugguaagugauucccaugcccacuguuacccuuuuaugagguaauuuuucacuauuuacaauggcagugaaaaaaacagcuggaaagcaugcuugcacgguggcauucuggguuuggguuuuauuggcuuuccauugagaaagguggccagugggcaucaagggugccauaaaggcccacagagcuuugaccuggggacccugcuuguuuuccagaagugacccaccaggagagguggaccagagagcucucugccuggagggcuguggcuggggagcacgaccggaugaugcagagcuggaggaaggcguggguaaguggccgcagccgggcaaagaaaggagggcuggagccaggggcagggcaccugccacauccaguggaucuuucaagggccccauucagcauggaccccacuuguucccucuuagccccggagcaguuuccuuuaugaaaucugcaacacuggggggggaaaucccacgucuuguugcugagacugcaggagaucaaggggcaucuggccccagcccuuaaaagagacugaagggaggcgagacugggagggacucacagguggggcugucuaguuagaugggcccccacgaccaccccauucucuguacagagcacucagccagccacuccuuugaggagggcaggaaaccuggacagauggggaacccuccagguagcuccuggcuggaugccucaccugaggcaccuguuggaggggucagggggaguggcuuccugagcuaagcccuggcaggaacugggcuacagcauggaagcugcaggcaguggggcagaggcucccuagaggcucccugucuccccacggagacaaaguuguccagccccggcuccuaaauagccgauacagaaggcaaaggcagggauucaucacugugugcuaccaccugcgguggggucugcagcacucaaaugagugcauuaaaguguguggguuacguggcugccagcaguacacccccgaacuguugccaccaaaggcugggcauuuacagcugauccucuguacuucagcacacacaggcucccucucuccagcccuccugccucucagcacaaucugggaguggagugaaugcgcugcugcucugccuuccugucacauaugggagaaccacuccuggcauuuggaucuuuagacuccaaggaggggaaccacaacagggggcugaggccuugagugcucugccugggaugggcuaugagacagacugggcugcagagcaggaaaggcccauccguuccaccaaggauucaaagaccacauuguucuuucaggaaagcuguagcaaggacacccuguagccaccaggaaggagucccugacaccgaccucaaccccaacaagacccugcugccacugaccacagccacccccggagaaggccuggucccccacaacugugaacugucuugcccaagccugcucugaacacagccauugggccaccaccugaugggcagaggcgggacaguggagaagccuggaacccaagugggccugugacaggaacuaagacuuaaaaaauuaggugcuuaccugggacaguaaguucugucuggcacaagcagguaaccaggauggcuaacaggcuuugauagcugcucgugaacuaaaacagcagggugugugcagguuccuccucuacggucaggcagcaggcucugaaggcugauccuacaccgucccagugacuccccuugacagagugcccccacccccuaauagccaacaggguuagcauggccagcacagaucgcugcuuuuauugaugcaaaucaagccugcugcuucuccucccugcagacuuagccaaggaacuccaagaugcaugacugggacaagaaaaggugagacuccacauggaaaugccuugcccuaaaccuugaaugacugugagaugcgaucugggagugcaucugucaagucuuuguguuuucuucacuaaccucagaauacugggcucuauuuuaucaagcgcugcaguuuaugccucugucccgucaaugcucagcuucugcaacaggacaccaaacuugaugcagaaagccaaauaggucaauuaugcaaaucuccuggugccauauuaaauuucuugacgauggaaugagucucaugaguguuuuguucuaccugcuuucaagucucuaauuauuaaagcuguaucucugaagacugugucacugugugugugaacuuguccuaaagcuacucagccuuuaaucuuacacacacgucucuucuugucuguugaaugacaguuuucaugucuaucauaaaaccaaagccucuguuaaaagucaagccgcaccccucuggugauccuagcaaauacugagugucuucccagcagugugacaaugaccuguuuugcauccccucuuucuggagcuggacaaauucucuaccagccuuugugugggaucagcauacaucgccugcuaauuccuucaggauccaucacaacagguguccugaagaugcuggagacacccugguugucuccacacguucccccuccgcaccccaagucgagaggcccagcugccugugaggugugugcuugcccauccagccaaggaugccagucuugcucacggaaccaucacauacucauaaccugaaguuuuccuguaaaauauccaucagcucacugugguucuugcuuuggguguggcuucaaccacuacaaacugaugagugaaaugcuaugggcuuuaggcuuauauucuuggugcuguuuucugucucuucuccugaagucuggauuucaagcacuuucacacuuaacaaaauaauuacauacuugaaguuuucguaauguggaguguucuacugggaaauggaguuaugaggaugaauuucugagucuuucuuugcucugcuggaaaaaauaaaaauagaguuguacauug

SEQ ID NO: 192418 - RNA, 84264 nt, Homo sapiens
gcgcuugugacccgccuuccggaaggaagcggcuaacuauggcgaccgccacggagcaguggguucugguggagaugguacaggcgcuuuacgaggugggcuccgcgccauuagcgguccgcgaccacacccgggcccggggagggugggaggacgcguguggauuuguggccugagaccucggcgggacuggcucggucacgcccagacucggugccucuugcuggaaggacugccgggagcuucuagucccagcgguugaguguagggaggaacgggcgggggcgggggcugggacugagggucucgguuugaauucuuaugcuccggguccccuggaagcuccggaaaggaacacguguaaggggacgcaggagacaggucugcaaaaaccagaguuuagacggacgauaaaacggaguggugaaaaugaguggaacaccuucgucugggaagguccuaaggaagucagcucuuuggaacuacgguacaguucguuggggaauaaaauuguaauaaauuggaguuuguuuuugucgaaaagaaaucaagugacuuaggauuugugaauaaaaaauaguuugucauucuucugcguacaucaguuuucugucuuauaaagauacaacuaguuuagucgauuuuuauuuauuuauuuuuguuuuuuuuuuuugagacgguguuucgcacuuguugcucaagcuggagugcaagggcgugaucucggcucacuacaaccuccgccucccggguuuaagcgauucuccugccucagcuucccagguagcugagauuacaggcaugugccaccaugcccggccaauuuuguauuuuuauuagagacgggguuucugcauguuggucaggcuggucucgaacucccgaccucaggugauccgcccgccuuggccucccaaagugcugggauuauaggcuugagccacugcaccuggccguagacuuuuaaaggaagaauaguuaagaguuuuuugaagccuaguuauuucagauacauaagauaauaagaaaccagaaugucaaucuuaguguucauucauuuaauaacugagaguccccgugcugucuugcagagcuauucauugggcacugaagaacuuauuuuauuuuauuuuauuuuuuaaagacaggguuucacucugucgcccaggcuagagugcaguggugcgaucagcucacugcugcguugaccucccagacucaagcgauccucccaccucagacucccgaguagcugggaccacauaccaccaugcccaacuaaucuuuuuuuuuuuuuaauagagacgggggcuugcuguguugcccagccuggccucgaacuccuggccucaaguaauccuccugcuuuggccucccaaagugcugggauuacaggcaugagcuaccacacccagcugcaacugaauuuuuaauuuaacuuaaauagccacguguaacuuagugacuguccacauuggaccacacagaucuagaugcuagggauagugcggugaacaaauaggcagaagucccugugcuuaaagagcuuacauucauuucaagugaauuucacuuuacuuuugaugauuuaauaucaccaaacuuaauaucaccgucuacugguagggguaaugacagugucuuccauugcaggacauacugggaauuuuaucuugaaacagcagagacagcagauguggcucugucuuaugcucauguauuaagugaugcccaguauuagguuaacuguagugaccuaaaaugagccacuaaaauugaaugaucuuuuuuauaaaugauuuuuuaaagaaauggauuauuuucuguuaaauguuguuugcucccuuuuugaagacugacaguaguguaacuucucauuccccgaaacuguccaacagugagacuugggagaacuccuguauguaacauuuccugggaaggaaaagaagugguguuugugauuuuuauuaauucacuagagagagaguuucucagcuuuucuuagggugauuucuuuuuggagugggcucuuaacuaguggcuggggcagauguuugcuugcuagaauccaacuauugagaaaacuaaaaggguauuuagacuuauucauaaaugaauuguauuuagggggaugagcaaauuuuaaaauucaucauaaacuucuuacucccaaauccuaugcguguugaauguagaauuugaguagucuuguauaguguacccaaaaaagaaccacugaaauuaaauaauccgaugguuaauauugggauucuguguuagauuuuauuuauuuauuuauuugagacggaguuuugcuccuguugcccaggcuggagugcaguggugugaucucggcucaccacaaccuccaccuccuggguucaagcgauucuccugccucagccucccaaguagcugggauuacagguaugcgccaccagacccagcuaauuuuguauuuuuaauagagacaggguuucuccauguuggucaggcuggucucaaacucccgcccucaggugaucugcccaccuuggccucccaaagugcugggauuacaaguaugagccaccacgccuggccuagauuuuauuuuuuuaauuuuaauuuuuauucccaaagaaguuuuaaaagcuaaaaauauuagggguuuuucaugugagggagaaauugccugcuauuagaaauggggaaaggaaugaauagaaauuaagggagcuucgaaaguaaauuguuaagaauaggcuaaaagucacaggaggcaguauaugcagguguaguaaauuuuaugugcagguguuagaaguguauguuucauaucuuacuuguuuuugacucacucuuaggcuccugcuuaccaucuuauuuuggaagggauucugauccucuggauaaucagacuucuuuucucuaagacuuacaaauuacaagaacgaucugaucuuacagucaagguacgaaauuaaaucucuguuuuaauuauuggguaugugauuauaguugcuaugucuuuccagaaaggauuugugguggcucaaccauguguguuaaagcauuuucuguaauguaaggaaaucaaggggaaugaauuauuaggguaggcaaaauauggggaaaucuagaaauaaagucaguacccaaaugaagaccauauuauggucuuggauacuuugcuaggaguaaacagcagucuugcaaauagaugguuagagggaagcaugggcaacuacuggaguuugaauauucauaaguguugugugaguugcugcagaauagcacaacuauuucugaaguaugggauaaagauuccccuguggucuucuuaaaggagagucagaguagaaaagaauccuacucauacccaucucaaauugaauuuuuauguguaugguaaaucaaaaaagaauucugagcauagaaguuaaauuuucauaaauugucaagucacccacaaaacuacauggaaaagaaccucuagcucuagugauaaggaaagaggcgagggugguuagugcacaaaacucacaagugauuguuuuuauucuagccacaacgagacaugguauuucuagcaguguauucacugugacuuuugcauugcagcagacaauuuugauauugccgaaguugaaguaaagugacugcgccugaaaagcuucaggggguuugaauaaggauagcuauaauaacaagugcuauguggcuuacggaggaaugagugauaagugauuuuaaaucaguuugucuuagacaaauagagcuuguuauaacuauuccucauaaggauaguaugaggaagggguaggauauauauucuauuagggggcugaggaugaggguaagucauaugauaccguagccuccuaacuacugagcuggcaauagagacuucuaugugggcuuuagggagucauaggugaaguucguauagggguauuuuuacuauaaaagccauaauacaugcuagucauauaagguuguuagaucagaaguuuaauaguucuugauuaguaaacauuauuauuaggauauuuagugaaccugagcuauuucagguguggaugaguguaauaaguaagggaagggauccuacuaguguguaaaauaaguaugagcuugcauuaggcauucugguugguuaccucagcagguaauaaugauuaggguagggaugaguguagcuucgaaaagaauguaaaguaugacuaguucuguggcuguaaaugcuguaauuuaaaaaaguuguaggaaaauuaauuuggaaauacggaguuuuuuuccauaagggugauucauuagauaggugauguuggccugcuaggauuauaagagguaguagucaggcuguuuggauuagaagaggugauguuaaugcgucagaagaaaaaguuaaugagaaguuagaugaauuauuguuugguugauuaaaaaauaauaggguaaugaggcugaugaauaggcuaugaguagcuauauucagacuauagaguuuuuggagaguuauauuguaacaguauaauuguuggaauaauaauuuuuggcauuggaguaaauuuagauuuuguacauagucuaggccuuaugcguuggagauugagacuaggaaagcaaggccuacugcggcuuugcaggcagcaaauacuaagaggauaauggguauuaugaauccuagagugaaaugcauguuuaaaauuaugaguguauuuaugauaaauauugauaguaugaugccuucuaggcauaauagagaugguauuaggugggaucgauagauuaguacucccagcagugcuaugguauaugcuaauauaauguuaauauaaauaaauggcauuugguaaauauggucuaucauaaucuaaugagucgaaaucauuuaauuuaaacuauuuaccaguucaacucaaucuaauccuuuuuggguucauucauaaauuaggccuaggauuagaaugguaauuaguagaaggguuguacugauuauuaguauaagguuauuuguuugaagggcucauggcagggguaggaauaggacgauuucuaaucgaauaggagaaaugugauggcuacuagaaagaauuuuauggagaagaggagguggguagagguuaauggaucaaaucuacauucauaaaggcuggauuuuucuauguaaguauuaaguuaugcaagucaaaauguaauuacuacuaauaauagaguuaauaaagugucaguuauuagggcuagugcuagguuaauuacucuuuuucagacuuugucgaaacuaguugauuggaagucagugguacugcuuauacuaaaagaguaguaggacccucaccaguagauagagacacaugggaauagucauacgacaucuacaaagugucaauaucaaguggcgucuuuaaagccaaaauggugguuggauguaaaaugaauuuuuuuuuuuugagacagaguuucgcucuuguugcccaggcuggagugcaauggcgcaaucuugccucaccgcagccuccgccucccagguucaagcgauucuccugccucagccuucccgaguagcugggauuauaggcaugugccaccacgcccagcaaauuuuguauuuguauuagagacgggguuucuccauguuggucaggcuggucucgaacucccgaccucaggugaugugcccaccucggccucccaaagugcugggauuacagggaugagccaccaugcccggccuaaaaugaaauuuuaauuggcagagaaggcagauggugagaauuguugauccaauaguaacaugaaguccaugaaagccugugacuauaaagaauguugagcuguagauuccaucagagauaauaaagggggccucgaaauauucugagauuuguggaagggugaaauagacuccuaagaggauugugguaaguagugcuugaauuguuuguuuuugguuaccuucuguuaggcugugaugggcucaagucacugaaacuccugaugcaaguaauauagacguauuuaggagaggugcuucugaaggguucaggggaagaauagcuguugggggucaauguccuccuaauucugggguuggugcuaaacuggagugauagcaugcccagaaaaaaccggcgaagaaggauacuucugagauaauaggagcauccuguaucggaggccuuuuuggacaauugcugugugguggccuuggaauguacuuucucggacaauaucacgucaucauugauauauagucaguguguugguuaguaggccuaaaguuaaaagagugguagaauuaaagugaaauccuaugguuaggccagauguuauuaggagagccgagagagcuccuguuaguggucaagggcuagguacaacucuaugguaggcaugugucuggugggucauuauguauuaugcgaacaaagacguacuaauagugugaagacauaagcuugaauaagagugacagcgaacuugagaauaguuaguagaauuagaauaauaagaaauacugaaguugcagagacacuaauaauugauaauauuagcacugcacuguauuuuaauucuuuuucuccuguaggaaaaagaagaacugauugaagaguggcaaccagaaccucuuguuccuccugucccaaaagaccauccugcucucaacuacaacaucguuucaggguaaauugauuuugcuaccugaaguacuuguauuuggcuucuuguaguaaccugcagucuauagugcuuuauauguaguaguccuuuuuuuaucugaaacaaaacauuuugaaguucccaggaguaacagcuuuagcuccugauuuuaaaaaauuuauucuagggaugauacaggcauuuuuuaaaaucuccaauuuaagcauuaauguuugcccuuuuuuccaagaaugcacacauguuaauauuuccaauggucgaacacuuaaaaugaaaagcaacagacuucugcuuuuuacccaucugguuauuuucugauuuuaaauuugucgcacguuacccucauaauucuagauacuguauaguaugcuuaacuaccauuuguugauucaucaacuacagacaacaccuguugauccccacaauaugaauuauggagcuuccgcucacuuaugccucuuuccuccuugcuuccagugucucaucuauuuuuuacuuuucauucucuuggcuaucuuugcuauauuguauguauuuucauuaauuaagaaauacaguaagaauauagaaaguuaucagauauagauauagauaucagacaccuauauaccuaccacccagaauuaauugguguuaacauuuugcuauuuuuaauucaaacuuacuuuuacagguaaauacaauauuacaaaugcaucuuaagaaauuccuucacauccaucacuuacucuugccucucauacggauaacuacugucuugaaguuggugauuguguuuucuuugccuauauuuauaauuuuaccauauaugccuguugccauaaaaauacuugguuuauuuuaaaaugugauacaagauauuuuccugaguaguauuguucugauucugaucugaucaaacaggagcuucuauucuuuacuucuguagaucucuucagucuuauaaaacuuuuauauauucugaaaucaaaccuaccaaucuuuuuuuuuugagacagagucucgcucugucgcccagucuggaguguaguggcgcaaucucggcucacugcaagcuucgccucccggguucacgccauuauccugccucagccucccgaggagcugggacuacaggcgcaugcugccaugcccggcuaauuuuuuguauuuuuaguagagauggaguuucacuguguuagccaggauggucucgauuuccugacuuugugauccgccggccucggccucccaaagugcugggauuacaggcgugagccgccgcaccuggcccaaauuuaccaaucuuuuauaguuuggucuuuugaagucuuagggaaucguuuccuacccuaaagaucuaauuugauuguuuuccauaugauggucaguugucucagcauuauuaguugaauaauccaguauuuaccuacugcuuggaaauuucccuucuuugguaagccagauucccuucuaaagggucuauuucuggcuuuuauuuuuauucauuggauauauucguaucuccuuauaccagagacucauucauguauaccacagcuuuauaauaaacguugauuagaauguuuuucuaucuccguguucuucaaaauugucuagacuauucuugacccuucuucacugugaguuuagguuuaggugaucauauuuaaccaaaaaaaugcauuuggguuuuuuauuagaaguguguugaauuuauggauuaauuuaggaggcuugguaucuugcugauacuuaaucucacuacccauuuacaugguauauauugcuugcauacuugggucuuuuguuuucuauaguaaaguugcuggaagaggaggaggggaggaaagaggaggagaggaaugcacacauauggguguaggaggcucccuucugaagggaggcuggaaggagaaagauguggggcuaggauguguggggcaugggucagaggucagaggcacugaaacugcagcugaaugagagcagccuccuuucucauuagguggaacccccaaaaugggggcaaggucagugggaagagccagggaagaguuaggaauuauggauaucaaauuuuacucaauucuuggugugagagaagguggagggacaggcaaaaugaggggcccaacagcacgugggccgagucagaguaagacgaggagcugggauccgugaaguguagguggccaggggcagggagucucagcagguguggagacagcaggggcaggcugggugccacugcaguuugccaugucuuacuuuuuuuuuuuuuuuuuuuugagacggagucuugcuuugucaccaggcuggagugcaguggugcgaucucggcucacugcaaccuccacuuccuggguucaagccauucuccugccucagccucucgaguagcugagacuacaggcacaagccaccaugccugccuaauuuuuguauuuucaguagagacggaguuucaccauguuggccagaaugaucucaaucuccuuuuuuuuaauuaaaaaguaaacuuuaaugucgaaaaugcagacuuggggagggcagaaagaucacacacaaggcugucacuucacacuuggaagguugcacagcagcgggcagagacgcuccucacuucccagauggugagggggccgggcagaggcgcuccucacuucccagacggugcaggggcugggcagaggcgcuccucccuuacaaacggugagggggccgggcagaggugcuccucacuugccagacaggguggcggcugggcagaagugcuccucacuucccagaugggacggcggccaggcagaggugcuucucauuucccagauggugaggaggccgggcagaggcacuccucacuucgcagacaggacggcggcaaggcagaggcgcuccucauuucccagacggugaggaggccgggcagaggcacuccucacuucgcagacaggacggcggcaaggcagaggcgcuccuuacuucccagacagggcggcggcugggcagaggcacuccucacuucccgggcugugaggcggccaggcagaggcacucgucacuucccagagagggugggggccuggcagaggcgcuccucacugcccagacggugcgguggccaggcagaggcgcuccucacuucccagaugguggggcggcugggcagaggcgcuccucacuucccagaugguggagcagccgggcagaggcgcuccucacuucccagaugguacaggcagagaugcuccucaggucucaaucucuugaccuccugauccacccgccugggccucccaaagugcuggauuacaggcgugggccaccacgccugcccugcugucucuucuuucuccuccuaagcagcucucuuagucuccugaauuuugauguucuacuuaacaaccucauguucuuacgcauguugcccugcuggaggcguccuucucuuugggaagccugacccaccaacagugccucaggagauagacauggaagcuuagccggugggggccccucaucucucucccaccucaguugcaggggaggggucgguugcagcugcagcgguggccccgacaguuuucuuuugcgggaccuguggccggcagcucuggguggagaagaccuacuugauccaagagcugcaggauccuugggcugcauguccucccccaccaucagcaagccuggagagcugggcagguggucuuuacccagcaccuucaaggccgccuucucuggccacagggagcagcccggaacuggggcagggagcacuguuggaagugggucaggcuucccaaagggaaggaugccuccaacagggcugugugaacuggcgacuccauggcccuuggaguagaaacucacugcaugcaccugggccuugucagucugguuguuuucugucaagcucuugagguggacauuucccuccaagggccugggauuguaccaggaggaagugagguuucccugagucuccaggggccuagagguggaagcugcuuccccauugcuacaggggccccuuuuauuguccuccugccccugggucucuaccuggucuuucaccuccguugcuucuuugggcucuucugcccucaccuccaucuucgggagccuggcugggaucaccugcucaucuaaugaaggaaguugaagguuaaacuugccucugagacaagagauccucacggggcugagguguccaaacauccuggaguugcgagcagacagcacggguuucuuccuugaggggggggcuccagaccacaggaggcaggacccucuguggggugcccguguuccgagggauaagacacagccucacaggggcgccaucccaccugacuggaaaagaaggcccaagaugucgcugacgguugaagaggagugggaaacggccccagauucccggggcaggcacaggugcaggagccgcggggugagcccggccagcugggaaggccucacggacaagacgagcagguugccgguggcguggccaggaccugcgguggaaccaggaacaaaauaugcuuagugaguugcccauuuugagcgaguugugcacagacgaaacuaagggucagaagcggagaggauacuccgaagucacccacuucucuguggccgggugcacacugggcaucugggaguuuaugacaucacuauggggcuggugacagagccagggugugaaggagugcuuaggagcccagcgagggugccuacaagaggagucaaagggcaaagggugagacccuuccaccagucccccuggacucuagccucagggacguccugcuccugggggcagguguguggcccuggaugggccccccuguggggcuguugggggugcggggcugauccgccagagccauggcgccuggcccaggugcuggcuggcacccaguggcccugucuuggacggcccugucccccggguuacagggccagaaccuggaagcagagcacaggaccagccagauccugccaggcucccccggggccuuuccagugccucugugccgccuggagcaaggcccgccuucuccauggcugccguggccucaagggccaccagccuugcuucgcagguuuccaaagagaggacgcggugcccugaccugacuggaugcgccucuuaccacaugccucccuggcaggcagggucuccgcuuuuuacaaauuugccugagaccauuccucaggucauucagguggucauggcccagccaggcuuugaaccugggcugugcgauuccacagcuggcguucuggccugugugccucaugaucauggauacagcaucuauucuuauuuuuuccuguaguucugggguacuuagcaccguggcauaucuguaauaagcacgugcacaccucgaaggaggucuucacuucagcauagaaguugaccauggcaugcucugggcuccagucuucuacaaagauguagggcaggaacuaccaguugucagcacagcaccaucccacauugcucuucuaauggagccuuucaccccagauguucuuucucgucugaugggaaggauccacguauguaaagauuauguucuagaucagcuuuggucuguccuaaaagaaauuugccaguggauuauuccauauggauaaaagucaguuucucuggucuuccuggaaugugucuagaaagcaaauacauuauuuacgaguucauaguagaucaauauauuggauuaaaauaugacaaacauaauuuggucauugugagcaugccagcucggucaacuauucaccacacaugaugcccuaaauauaacucuagguuuucuuaugcccaagagagggacauacucuugggugucuggacuagggaaacauguaugaaaaaccauuuggccacucuacaucuuguuauuggagaaucaaaacuaucuauauucaaagauauuauuaaaagguaagaaguuaacuucugucauuuuguuaauuguuuucugguuguuuuguagaucuuuuguuucuuuuuuuauuguuugcuuuaugguuuggugaguuucuguacugauaagcuuugauuccuuuauuucauugacauaucugguguaauuuuuuucucugguuacucuggagcuuacauuuaaaaauguauaguuaugauagacuauuuaaagcugauaaaaauuuugaucacacacgaaccugcuauacuacccccacaucccuugucagugcacaaaauuuguacuuuuuugccuuaauuuauauuguucuguauuggguguuuauuaauaacucauuguagauauaaauauuuuugacuauuuugauguucagcuuucucaagggugauuugaaagauucuaaagcauuaauuucaguaauguagaauucucaguuugaauaugaauuuacuuuuaacaguuagguggauaguguccuguuuuugcauuaguauucuuucacuugcgauugaagcacuuguuaagcauuucuugucaggcuggucuuauggugaugaauuccauaagcauuugcuugucugggaaagacuuuauuucuuuaauuucugauggguagcugugcucaguacaguacucuuugcugacugauuucucauuagcacuuugaauauaucauccucaucuuuccuagccuucaagguuucugcugugaaaacugauagucuaauggagacuugcuuauuugugaucugaugcuucuuucuugcuaauuuuagaaguuuuucuuuguguuugacuuuugacaaauugauuauaaugugccuuagaaaaggccuuuuuggguugaauaugucccuuuaagcuucacggaacuggauguccguaucucucccaagaauugggagauuuucagcuauuguuuuguuaaauaaguuuucugugucuuugucucuuuucucuguuucucuucuauauuuucaaaaucuguuaucuuaguaucauggcacaagucucauagacuuucuuugauucuuuuuacucuuuuuuucuccuuuuuucccucagucuggguuauuucagaaguccugucugcaaguucagaaauucuuuuguuugaucuagugugccauugaagcugucagugguacuuuuuaauuuaauucauucaauucuucauuccuaagguuucuguugguuuguuuucuuuuuucuuuucucuuuuuuuuuuuuuuuuuuuuugagacggagucuugcucugucgcccaggcuggagugcaguggcacgaucucggcucacugcaagcuccgccucccagguucacgccauucuccugccucagccuccggaguagcugggacuacaggcacccgccaccacgcccggcuaauuguuuguauuuuuaguagagacaggguuucauccuguuagccaggauggucuagaucuccugaccucgugauccgcccaccucggccuuccaaagugcugggauuacaggugugagccaccacgccuggccuguuuguuuucuuuaaugguaucuaugucuuuguugaauuucucauucaggcuauggcuuguuuuuuuuuauuauucgauuaaguuuucucucuguauucuuuuguaucucauugaauuuucuuaagaucaauauuucaaauuccuuuuaaggcaauuugaaaauuuccauuuauuuaggguaacuuugugaagaauuauugugcaacuuugguggugucaaguuucauugcauuuucaugcuuuuuaucuccuauguuuauauuuaugagacuguugacacggucaccuguucuaauuguauagaguggcuuauguagagaaagauuuucaccuggagaugugucuuagggugucaguuggaugggcugcaucugcuuuaguucuaggaggacacaguaguguaauaucugugcuuuucucuugccuguuuuuuuuuuuuuucuuuugcuaguauccauuuuggugauaccugugagugucuuggugaccuaggcuguaggagcaugugcaguuuguuuuucugcucaggacugggggcugggggagaaggcggcggugucaggaagcugcaugccuaucuagugacuguguuacugagucacagggguugguacaccaguuugagaugggacuccccuggaaacacucgccuagcuguggauuacuggggcuggucugcagguuugagauggggaucaccuagaaacaccagggccaguuggugagcgcacugauggcacaauaaaucaguaaucgguccacaguuagaguguugcagucacuaggauguggaaggcaaaccucuuugagaguuuguuucuaggauauagacagcaguagcugcuuuccuggagaaggcuguuguaaugacaggguagccccugggauggaaggaggcagugaccacuaguucauggaacagaauauacucagcuauggcuuggcuuucuagauggugcuauaugugggcuccuucucuggggcaguauagcccugugggcaucaagcagcuuccuaaacuaggcugcuagagaugggguuucaccauguuggucaggcuggucucaaacuccugaccucuggugaucugcccgccucggccucccaaagugcugggaucacaggcgugagcccccauaccugaccuaccuuuuuuuuuuuuuuguuaagaaacuugcuuauguuguucuuuauuuucuucuugacuuuuuuuuccccagguuuccuuacagucaugcgucacuuaaugacguagauacguucugagaaauguguuaggcaauuccauugucaugcaaacaucauagaguggacuuacacagaccuagauguguaguguguaccuauaaccugguacgcaccuagacuauaugguauagccuauugcuccuaggucacaaacuauacagcauguuacucuacugaauacucuaggcaguuguaguaaaaugguauuuguguaucuaaauauauuuaaguauagagaagguacaauagggccaggcaugauggcucaugccugcaaucucagcacuuugggaggcugaggugggcaggucacuugagcccaggaauuugagaccagccugggcaacaugacaaaaccccuucucuaccaaagaauccaaaaaauuaggugggugugguaauauaggccuauagucccagcuacuugggaggaugaggugggaagauggcuugagccugggagguggagguugcagugaaacaagauugugccacugugcuccauccugggcaacagagccagacccugucuuaaaaaaaaaaaaaaaaaguacaguaaaaauacaguauuuuacucuuauaggaccacuguuguauaugugguccauuuugucaauugagauguuaaauggcacgcgacuguauauccauuaauuguaggcgauuugagacuggcucucugaaaacacaucuacacucacugugcccaggccuggaauagcuccugucaugccuuuguguggauuaggggaagguacucuuccuccagcaagugcagcagccuggugcagaccuugggcuguggugccgaucccugggugccccuaacaggaccccagcucaugcagcaaccuugcucugcccuuucuucuggcagaguucagauauaggauaauguguccuuagauaauuuagugguuauauuuuuaugacuucauuaguauuauucauuaguugggccaauguuaugaggcuauauuuucuuuauuggauacuuuuguuuuccccagaguuaaucauuuuuguuugguuacuugauugguucuacaguggucuuuauguuguuugccucuaggagcauaaaacuccauucagaauguucacacguuaguuaucuauuagauucacuuucuuuguucuuucuccugcuccacuccugacugguuguuauaugcagcugcuacacaggguggcccuggagugucccaucaccauuagcuugagaauuuccuuucucuguucugcauuggcuauuuccugucucuugguuuacaguagauuauagauagauuucagagaagggucauggaaggugaauuuuuuuuuuugaaaccuacacaucuuaaaauuuuuuauuuuuacccuuuugcacuguacugauuguuuuaucaguuuuauugaucuguuagacacuuccucaauaucuggugauuguuaacaucccuucuuuuuuuucaauaugcacaauauuuuuauugucaucaagaacauuauguaaauuguuugcagaaacuacaagaaaauugaagguuguuuuguugauagugaaaggcaauggaagggcacuguggaucaauaaggcugaggggcgagacaaagagggcaaaaaucuuuacugagcucucgggcgagguucacugguccgcagggggagggccagggaagucgcgcugugccaaaggugcagagcgcuuuuauggaugcugggugaggagugggcgggguaggggcgggauagguugaguuucgugcuucugagugugacacgcccuagugggcaugcgcguugguccggguggcgggaacaggaaaggugaacccggaaaugcugagucaggguacccgauguggcugucaggauggcgggaauaagcgaaaaugccaagucaggguagccaagauggcugccgagauggcgggaaccggugaauccgggaaugcugagucaggguagccaagaugguuaccgaucgccaucuuggagucuucaccggaguccaaucagauuacauucaguguuacuuuucuucaauuuaugcaauaccuauuuacauucaauacugaguugacacaagaguaagcgaauuaacuuagauuuuuuuccuuuagacagaagccuuauugauauauaaucuauuuaccauaaaauuuaccauuuugaaguguaagguuuuuuuccuuuaaacagcagcuguauugauacguaaucuauauaccauaaaaucugucauuuugaaguguauaauuaagugguuuuuagcauauucccagaguuauacaacuaucaccaccaucuaauuccaaaauauuuuuaucaccccaaaagaaaucccaaagccauuagcaguuacuucccacuccuuccucugcccaggccuuagcaaccauuuaucuacuuuauggacuugccuauucuggacauuucacauuaaaaggaauaaacaauacuuagccuuuguuucuggguucuuucacuuaacauaauguuuucaggacucauccacauuguagcauguauccguacuucauuuuaucaccaaauaauauuucaguguauggauacacacauuuuguuuauacauuaaucaguugaugcacaauuggguuuuuucccucguaagaguauaugaaaaaauaaaaaauaauaaaacugcuaugaaauaauguguacacauuuuugcaugggcauaauguuuuaauuuuucuuggauauauaccuaggaguaggauugcugugucaugugauaacucuguguuuaacauuuugaggaacccccaaacuguuuuccaaagugguugcaucauuuuauauucccacuagcuacauaugagguuuacaauuucuucacauccuuagcaaugcuuauuauuuucuauuuuauuguagccauccuaguaggugggaagugggaucuuaugguuuuaauuugcauuucccagauaacuaaugauguugagcaccuuuucaucggcuuauuggccauuuguauauuuucuuuggagaaaugucuacuuuaaucacuuagcuguuuucaauuggggguucuuucuaucauuaaaacuguaaaaguucuuuauauauuuugaauccuagucccuugucagauauaugauuugcagauuuuuuuuuucauucugugggauuuuauuuuacuucuuugauagugaucuuugaaauucaaaaguuuauuuuaaugaugucugacuucccuguuuuuccuuuuguugcuuguacuuuuuugucaucuguaaaaacuuuggcuuaaucuaagguuaugaagauuuacucuuuccugucuucuaacaguuuauaguuuuugcccuuacauuuaguguguaauucaaguuaauuuuuguauauggugugagguagaggccuaucuuuaucuuuuuccagguggaugucaaguuguccuagcaccguuuguugaaaagacuauuucccuucugaguugucuuguugaaaaucaguugaccauaaauguaaggauggucuauuuucaagaaugacacaugaaaauggucauugagagcccuguuaaaaugggcuuggcuuuuucuucaguuuuacugagguauaauugcuaaauaaaaauuguauauauucaagauguauaauaagaugauuuuauauuuauauauauauacacacacacacauugugaaauaaugaccacaaucaaauuaacauauccaucaccacauuuaguuaccauuuguguuuuagaggggugaggauggggugggcuuuuugacugaggggcuugcacuaggauaaucagacagggaccuguucguuuauuugaggggacccccaaacuuaguauuuauaguuuuuauucucuuggcuuuguguuucccaggagaggaguccucuagucuauuacuuugcagguaaaaagcugcuuuccaccauuugggagcugaguugaaggcaagaggcccagggucuuaccauucauuauguaacucacaccuaauuuuugucuucagaacggcaccccugccuucacucauucuuaggacuuccaguuuauacacagccucuccagagagcacuucuucaggguggaggaggggagugacugccuguugucuaggcacccagccaguccuccuguugucggccuuucccguuuuccaguguuuaauggaagcuggugccccaguuugggagcauguuucaggcguugcugcuuggcuuuucacugcuggccuaggcuugccuuucucuuugaucucuuugacuuaucaaauacaacuuauccauuugcuuuccaguuucccacauuuugucaccuuucuccuuguucuggucuggguggguuuagaccuuuaaacuuuguaggcauuuugcauuugcuuucugagugugcuuucagaagagaucaaggguugagguguuuuuuaauguuagcugauauuaagugguaugaagaaauaucaaagcagggucaguaaagagagguagaguugcugcauauauuucuuguucauuucuuuugacugcuacauauucuucuguguauacagccaccaaauuuuacuucuccauuuuccucaugauagacaccuaaaccgcccccauuucccacugcugcaaagaauccucugauuaauauucccucaugaaccuaauauucccuugaauuucucuggggguauagaaccaggaauaggauacugauauaugccugccuaauuuuccuguaggacuuuucugugucaucuaugguccccugagauaguauauaggaauucaaguuuucccuacaucucuguuuagcaauacuguuugcuuuggauuucucuuaauguuugagccuuugagcaucacuucaucuacuuuuuagcuacuggagucuucugcuucuuugaaugccucuucauaucuuuuaccuguuuuuuuacuggauucccagucuuucuuuugauuagcgaagguucuguauaccuuguagauuuuaauccuuagucaauuuuugaguuaguacucuguuacauugauucuaagacacauacuguuuuucccuaguuuaaaaucuuugaaguggggaugaaucuuaaagcugcugagagucacugaugagucauugucagccaggaagguaguuugugacaugguugucauugcuuauguaccagugaacuucgugguggcgggcuuacugucagcacuccaguugaaguguaugcccugcuggucaaugaggcaacugauagccggagaaauggccagaccugcagagcagaggcagaggaugacaaaaggcuuugaagaucucuuugucagacuuccuguugccuuuggguaguaucagcuuacuuucuagaaacaugugauuuaauuggaaggacgauaaaacuaugagguuaguucaauaggaaaguugcagcaucagaacuugagaaugggugacaguuaacaugucagauaaucucagaaaucauaguggagcaugcugguaagaaaugccaagacacugccaagagcaaggagaacaugguaugaaaacuugugguaucagugacuuagaggagagggacagaacucaguuaaagagguuuuaggaaugucuugacuuacauuuuccuuuucauaaguacaaauguaguguaacaaaaaucugggucuaagaauguauaauagaccuuugcauuaagcauaaacuaaaaagcugcacaugacaagaaaacaucauuguauuuuaauugacacuguuucucuuccuuagugauggauaaaauacaauugaugacaucuuagauucagugaaauacaauaaaccucuucucuaucacccgucuguuaacuuugucuuugguaucuuucguugaaccaaauuucuuaauuuugacuuggucagaugcauccaucuuggccuuacgguuuguauucuuaaagacuugguuaagaaaucauuuccuacccugaggucccaaagacauucuuccacauuuuguuaucuuuucuaaaauaccuuuuagauuuuuaauauggcuggaauucacuuuauaccuggcuguucaacuuuauccguagagaaaaauuugugugaaaccuagugguuugugggguaacugcugucauuuuccagguauuuguauguacacaguucucaugaauucuagauucuuucauuggucucugccuaccugcaaauauuacaguauuugcuuccuucugguaaagcaccucccgguuucuaaauucaguuagccauuccugaacuuguauccuucuguguaauuauugaaguuuauagagcuccauuagaaauccugguggaauuuuaguugugauugcauugaguuuguaguuuaucuuggcaaaauguaauaucuuuaaaauguugagccaucccuucagcugaccaucguauaucuuaucauuuauuacugucuuuauauuuuucuugauacuguaaauacuuuguauuuuguuaccuuuauuuacuauuaauuccaaugguuuguugauuucguugaguuuuuuauguaaggugaucauaucaccugcugauaacagugugacucuucucagacgugugugugugugugcacacuuguuuauucacauuuuuggacuuacaguuuuacugguauggccuuuaguaauaugcugaauaguaaaaagauaccaagcauccuuguuuuguucauauucauaaaaguaauggcucucuuguuucccaguuaauaucuguagguuuuagguauuauagucuuaucaauucgagaccauuuccuccgaucuaguuuucuaagaguuuuauaaauagauguugaacuucaucaaauguuauuucugcaucuaagaucauugcaugacuuuucuuuauuauguuguauuuucugaaauuuuuacuucuuauuuaacuucuauuaauauaucucuuagguguacucuguucuuuuucuaacuuaguugaacacuuaauuuacauuuuuaaucuuuucuaguauugauugacauucucuuuacaaaacacccugaguguaauucaggauucaggcuuaaaaaaagguuuugaaagauaauaaaguacguauuccuuauuacagaaccacucucaugcagucuagggcagcauccccagaauaguuucauuccauugaguaaauaaaagcaguaaagaguuucauauauguuuaggacagguuuugcuacugaaugaacuugcugcaaacuuucaaaauugagugugaggcauaaugaacuuuucuguguuuaagccuauaaauucccuucuaaguacuauuccagcuguaggcuauacuuuuuuuggggggagggaggauggagucuugcccuguugucaggcuggagugcaguggcgcaaucucggcucacugcaaccuuugccucccagguucaagccauucuccugccucagccuccccaguagcuggaacuacaggugugugccaccacgcccagcuaauuuauuauuauuauuuuuuaauagagacaggguuucaccauguuggccaggauggucucaaucucuugaccucgggugauccacccgccuuaaccucccaaagugcugguauuacaggcaugagucacugcacccggccuguaggcuauacuucuaauguguguuauucagaccuaaauauuuuuuaauuuucuuuuuuuucuuugacuaaagcauaauguuuuccuugaguuuuugucuucucaguaauuuauaauuuauugcuaugugauuaaaaaacauguucuggaugauagcuuuucugaaugauuuggcugcucuuguugacacuugcuuuaugucuuacuuuauuguaaauuuugcaaauguuccacggcuuuaucacaaaaauuuauauuauauauuccuuuuauucaaggugucuuguguccauuacaucaagcacuuuaauuauuauucaaauaguugacagucuuagccguuuucugucugguauguaaaugaaugagaaagaaagagacaguauaaagaucaguauuacccaccguauggauucauucucugucucuguuucguuuuuaaauuguuuaguuugaaggugugaaauguaugugggcucagcauuuuuacaucguuuugaaugucccuuaucucuaacaaaaauuauguuuuaccuuaaaguccauuugucugauagcaguguagcuacaccagcuaucauuuaguuauucugugauuaauaggacucuguuuucaauuuuacuguaucauuguguguaguucuuuuguacauaauuggauuuuaauccuaguaucauuuuuuaacugaggaguuuaaucuguuuacauuuauuuugauuacuaacuuauuuguauaguaaacacuaauaucugcugaaauaugaggugauucacaauuuucccaguagcauuuaaaagaguuucuuggccaauuugauauguaaauuuaaagggauguauaagaaauggccaaaaauaauguuauuugauuuauuaauguaauugcacauauauauuuaaaaugucauugugcaaauaauauauucaaaaauacugcucuuuccuuuaccccaugcagcaguuuuauucuaauucuuccuaggcaucuuggauaccauauucaucauuagaagcauugaaaaauuuauguuuaaagucugucauuuucacgucugucugaauacuuggaugcauaacuuuuugaaucuguguauguugcuaucccucaaaauuuuacccaagucucauucaguauuugugguucuacacuugaccccuuacaggguugcuuuuuguuguggucuuuaaaagguuugcuuacuugguuguauacuguuucauugugaagucccgcucccaggaauauguauuaugugugggaaauaaguacaauaucugugucaaauuauuuuaccucccuuuauaaaaaacaaacugauuucuucaaaacaccuaaagguagcauuguuagagaucauucugguugaaguuguaacuaauuaguaguggguacagcugcauauaauaggaaacccaaacuuagauggcuuagggaaaguagaaguuuauuugcccucacaaguggggagcaagguagcuagcgccacagaugauuagggacccagguuaccauccuguguucuguccuugaggugugugacuuccauucauaagucaccuuaagggaggaugucaggcagaugggcagaaaagagucuccuucugggccugucagcuugguuacggcaaugcuggccacaccuaguugcaggagcagcugacagaaguggucuuuuguuccagggcaguggccuuaauuuuuucauuucuuuuuuuuuucccuugccuuuagucugcuugaucagguuuucuugauuagacuucccuuauucuuuucuucuccucaugcuuaacauaaguaauuccuguccaauuuuuuuuuguuuguuuuuugagacagggucucacucuguugcccaggcuggaaugcaguggcaccgucucagcucacugcagugucucucucccaggugcaagggauucuccugccuccgccucuggaguagcugggauuacaggcaugcaccaccacacccggcuaauauuuuuuguauuuuuaguagagacaggguuucaccauguuggccaggcuggucucggacuccugaccucaagugaucccccugcuuuggugucccaaagugcugggauugcgggcaugagccaccuugccccaaauguuaauuaaucuuccucucuuccuuacugagcaguacagggacuuacuagacuccuacuucaguuguuccccauccccacucccccuuucuugaugucugauauuugaccuccacuuauuuuguauccuccaggauuauuauauuugagaaucaccuucuuuaccuauuuaccacuuucuuauugccagucuuuagguauuucuuucuuuauccgugcagcuucuuugcgcuuaaaauuucuuuuucuaaaauauauucucuauuagauuguuauguagagauucagagaagguaaucuguaucucuuaaugagaaauguuuuuauuuuaccuccuuggaugacaguuaguggguaacagguucuaaguggaucauuauuugcccugcagccuuggagaauuucuucaucauggccuggccuguguuauggggagacugugucagucuaauuauuguucaucuucuguuuuuucuaguggcuuucacaauuauuuuucucuaaaauucuacaguuucacugucaugugucuucuuguaauuuauucauauuuauccuacuugggauucauuuuuguacuucagucuguggauuucugucucccaugaauucugggaauuuuuuagcuuuuaucuguucaaacauugucucucacuuuuuuccuccaguuuuucccuguagagcuaauguuuaguguacuuuuaaccuucauauccucuacguucaguauguacucuuucauauuuuugcaucucuugguaaucucagcucugucuuucauuuuucugcagugucugaugggguauuuaaucuaucuuuuagauuucuaauuuuauuggcucuuagauuuuauuucuggaaguuauauuugacuauuuagcaaguuagccuguccuuuuuuguuuuuguuuuugagauagaauuuuguucuuccugagcaggcuggagugcaguggcacaaucucgacucacugcaaccucugccuccuggguucaagcgauucuccugcuuuagccuccccaguagcugguauuauaggcaugcgccaccaugccuagcuuauuuuuuuguauuauuacuagagauggggucucaccauguuggucaggcuggucuugaacuccugaccucagguaaucugcucgccucggccucccaaagugcugggauuacaggugugagccaccacgcccagcccagccuguccuuuucuuaguaacuuuuuaaccuuuccuuauguuuaugcucuugggagcacuuucuaguguccagcgucucgcguucuugggcaguggcccuucugcaugucuuguauccugacucucacucauggugggguugugguuuuugauugggaaaguuguuuucucucuuuugaguccucucaggucucgauuguggagaugucuuucugguugguuuuacuugcuucugcagcauacccuauaagauuuuagguuccaggauuccuguaucaagugcccauuaugaccuauuccugcuagccugcauggggcacaggucugagacuuccauuucucaccggaaacuuuguuccuucgcuacuccaagugcuggacagaaauaguaucccuacaucacaucaugcugccuucugauagcuuuugagcugugguuaaguguuuuggauauacuuguucuuaaucauuuguuuucuguguauuacaguuuuuauagaauggucucaacguuuauggcaccuuugguacauggguggucuaucucgguauuuguuuguuguuuguuuuuuguuuuuaaucuuuuugugacugccaauaccugacuaugaaaucagggaggacuuaggaaacuuaaggaaaccuugagaaguaagaaccugaauaacaugauaaaaucagaaucacaguugaggaggugaguggcacuggauuugaaagagaagcccggagggcagccaagauagccgaauaggaacagcuccggucuacagcucccagcgugagcgacgcagaagacgggugauuucugcauuuccaucugagguacuggguucaucucacuagggagugccagacagugggcgcaggacagugggugcagcgcaccaugugcgagcugaagcagggugaggcauugccuuacuugggaagcgcaaggggucagggaguucccuuuccuagucaaagaaaggggugacagacggcaccugaaaaauugggucacucccacccuaauacugcgcuuuuccgacacgcuuaaaaaacggcccaccaggagauuauaucccucaccuggcucggaggguccuacgcccacacagucucgcugauugcuagcacagcaaucugagaucaaacugcaaggcggcagcgaggccgggagaggggcgcccgccauugcccaggcuugcuuagguaaacaaagcagccgggaagcucgaacuggguggagcccaccacagcucaaggaggucugccugccucuguaggcuccaccucugggggcagggcacagacaaacaaaaagacagcaguaaccucugcagacuuaaaugucccugucuaacagcuuugaagagagcagugguucucccagcacgcagcuggagaucugagaacgggcagacugccuccucaagugggucccugaccccugaccccugagcagccuaacugggaggcaccccccaguaggggcagacugacaccucacacggcuggguacuccucugagacaaaacuuccagaggaacgaucagacagcagcauucccgguucacgaaaauccgcuguucugcagccacugcugcugauagccaggcaaauagggucuggaguggaccucuagcaaacuccaacagaccugcagcugaggguccugucuguuagaaggaaaacuaacaaacagaaaggacaugcacaccaaaaacccaucuguacaucaccaucaucaaagaccaaaaguagauaaaaccacaaagauggggaaaaaacagagcagaaaaacuggaaacucuaaaaagcagagagccucuccuccuccaaaggaacgcaguuccucacaagcaauggaacaaagcuggauggagaaugacuuugacgaguugagagaagaaggcuucagacgaucaaacuacucugagcuacaggaggaaauucaaaccaaaggcaaagaaguuaaaaacuuugaaaaaaauuuagacgaauguauaacuagaauaaccaauacagagaagugcuuaaaggagcugauggagcugaaagccaaggcucgagaacuaugugaagaaugcagaagccucaggagcugaugcgaucaacuggaagaaaggguaucagcgauggaagaugaaaugaaugaaaugaagugagaagggaaguuuagagaaaaaagaauaaaaagaaacaaacaaagccuccaagaaauaugggacuaugugaaaagaccaaaucuacgucugauuggugcaccugaaagugacggggagaauggaaccaaguuggaaaacacucugcaggauauuauccaggagaacuuccccaaucuagcaaggcaggccaacauucagauucaggaaauacagagaacaccacaaagauacuccuugagaagagcaacuccaagacacauaauugucagauucaccaaaguugaaaugaaggaaaaaauguuaagggcagccagagagaaagguuggguuacccacaaagggaagcccaucagacuaacagcugaucucucagcagaaacucuacaagccagaagagaguggggaccaauauucaacauucuuaaagaaaagaauuuucaacccagaauuucauauccagccaaacuaagcuucguaagugaaggagaaauaaaauacuuuacagacaagcaaaugcugagagauuuugucaccaccaggccugcccuaaaagagcuccugaaggaagcauuaaacauggaaaggaacaaccgguaccagucacugcaaaaucaugccaaaauguaaagaccauccagacuaggaagaaacugcaucaacuaacgagcaaaauaaccagcuaacaucauaaugacaggaucaaauucacacauaacaauauuaacuuuaaauguaaauggacuaaaugcuccaauuaaaagacacagacuggcaaauuggauaaagagucaagacccaucagugugcugcauucaggaaacccaucucacgugcagagacacacauaggcucaaaauaaaaggauggaggaagaucuaccaagcaaauggaaaacaaaaaaaggcagggguugcaauccuagucucugauaaaacagacuuuaaaccaacaaagaccaaaagagacaaagaaggccauuacauaaugguaaagggaucaauucaacaagaagagcuaacuauccuaaauauauaugcacccaauacaggagcacccagaaucauaaagcaaguccugagugaccuacaaagagacuuagacucccacacauuaauaaugggagacuuuaacaccccacugucaacauuagacagaucaacgagacagaaagucaacaaggauacccaggaauugaacugagcucugcaccaaggggaccuaacagacaucuacagaacucuccaccccaaaucaacagaauauacauuuuuuucagcaccacaccacaccuauuccaaaauugaccacauaguuggaaguaaagcucuccucagcaaauguaaaagaacagaaauuauaacaaacugucucucagaccacagugcaaucaaacuagaacucaggauuaagaaacucacucaaaaccgcucaacuacauggaaacugaacaaccugcuccugaaugacuacuggguacauaacgaaaugaaggcagaaauaaagauguucuuugaaaccaacgagaacaaagacacuacauaccaggaucucugggacacauucaaagcaguguguagagggaaauuuauagcacuaaaugcccacaagagaaagcaggaaagauccaaaauugacacccuaacaucacaauuaaaagaacuagaaaagcaagagcaaacacauucaaaagcuagcagaaggcaagaaauaacuaagaucagagcagaacugaaggaaauagagacacaaaaaacccuucaaaaaauuaaugaauccaggagcugguuuuuugaaaggaucaacaaaauugauagaccgcuagcaagacuaauaaagaaaaaaagagagaagaaucaaauagaugcaauaaaaaaugauaaaggggauaucaccacugaucccacagaaauacaaacuaccaucagagaauacuacaaacaccucuacgcaaauaaacuagaaaaucuagaagaaauggauaaauuccucgacacauacacccuuccaagacuaaaccaggaagaaguugaaucucugaauagaccaauaacaagcucugaaauuguggcaauaaucaauagcuuaccaaccaaaaagaguccaggaccagauggauucacagccgaauucuaccagagguacaaggaagaacugguaccauuccuucugaaacuauuccaaucaauagaaaaagagagaauccucccuaacucauuuuaugaggccagcaucauccugauaccaaagcugggcagagacacaaccaaaaaagagaauuuuagaccaauauccuugaugaacauugaugcaaaaauccucaauaaaauacuggcaaaccgaauccagcagcacaucaaaaagcuuguccaccaugaucaagugggcuucaucccugggaugcaaggcugguucaauauaugcaaaucaauaaauguaauccagcauauaaacagaaccaaagacaaaaacuacaugauuaucucaauagaugcagaaaaggccuuugacaaaauucaacaaccuucaugcugaaaacucucaauaaauuagguauugaugggacguaucucaaaauaauaagagcuaucuaugacagacccacagccaauaucaugcugaaugggcaaaaacuggaagcauucccuuugaaaacuggcacaagacagggaugcccucucucaccacuccuauucaacauaguguuggaaguucuggccagggcaauuaggcaggagaaggaaauaaaggguauucaauuaggaaaagaggaagucaaauugucccuguuugcagaugacaugauuguauaucuagaaaaccccauugucucagcccaaaaucuccuuaagcugauaagcaacuucagcaaagucucaggauacaaaaucaauguacaaaaaucacaagcauucuuauacaccaauaacagacaaacagagagccaaaucaugagugaacucccauucacaauuccuucaaagagaaugaaauaccuaggaauccaacuuacaagggacaugaaggaccccuucaaggagaacuacaaaccacugcucaaggaaauaaaagaggauacaaacaaauggaagaacauuccaugcucauggguaggaagaaucaauauugugaaaauggccauacuuccccagguaauuuauagauucaaugccauccccaucaagcuaccaaugacuuucuucacagaauuggaaaaaacuacuuuaaaguucauauggaaccaaaaaagagcccacaucgccaagucaauccuaagccaaaagaacaaagcuggaggcaucaugcuaccugacuucaaacuauacuacaaggcuacaguaaccaaaacagcaugguacugguacuaaaacagagauauagaucaauggaacagaacagagcccucagaaauaacgccacauaucuacaacuaucugaucuuugacaaaccugagaaaaucaagcauuggggaaaggauucccuauuuaauaaauggugcugggaaaacuggcuagccauauguagaaagcugaaacuggaucccuuccuuacaccuuauacaaaaauuaauucaagauggauuaaagacuuaaacguuagaccuaaaaccauaaaaacccuagaagaaaaccuaggcauuacuauucaggacauaggcaugggcaaggacuucaugucuaaaacaccaaaaguaauggcaacaaaagccaaaauugacaaaugggaucuaauuaaacuaaagagcuucugcacagcaaaagaaacuaccaucagagugaagaggcaaccuacaaaaugggagaaaauuuucacaaccuacucaucugacaaagggcuaauauccagaaucuacaaugaacucaaacaaauuuacaagaaaaaaacaaacaaucccaucaaaaagugggcaaaggacaugaacagacacuucucaaaagaagacauguaugcagccaaaaaacacaugaaaaaaugcucaccaucacuggccaugagagaaaugcaaaucaaaaccauaaugagauaccaucucacaccaguuagaauggcagucauucaaaagucaggaaacaacaggugcuggagaggauguggagaaauaggaacacuuuuacacuguuggugggacuguaaacuaguucaaccauuguggaagucaguguggcgauuccucagggaucuagaacuagaaauaccauuugacccagccaucccauuacuggguauauacccaaaugaguauaaaucaugcugcuauaaagacacaugcacacguauguuuauuggggcacuauucacaauagcaaagacuuggaaccaacccaaauguccgacaaugauagacuggauuaagaaaauguggcacauauacaccauggaauacuaugcagccauaaaaaaugaugaguucauguccuuuguagggacauggaugaaauuggaaaucaucauucucaguaaacuaucgcaaggacaaaaaaccaaacaccgcauguucucacucauaggugggaauugaacacugagaacacauggacacaggaaggggaacaucacacucuggggacuguugugggguggggggagggggagggauagcauuaggagauauaccuaaugcuaaaugacaaguuaaugggugcagcacaccagcaugucacauguauagauauguaacuaaccugcacauugugcacauguacccuaaaacuuagaguauaauaauaauaaaauaaaauaaaauagagaagcccuugaagccuuagggaagaagaaagaaaauauuuggagagcaccucuuaugagccaggcacuuucauaauagcaauuucccugagagguagacucuccccuacuuuaaugaugaagaaacugagaaucacagaggucagugaugucccuaagcuucugaaucgucaauagccauaauacagaggggaucucucugacagacucuauaacccaugguuuuuucacugagucuucuugccuuuuuuauaaguuaguucgcuuucaugaauuuacuucaaguugucauucuuuucuuuuccugguuucccagcaucuguguuuucucaaggaugaccaaugcuguuaaaagguaucaaugagaauaguguuucuccauuuuuucuggcuacagugcauuuuauagagcaacccaguacauggaccaguacagauacauagucccaucacucacccugugccaugguucugauauuuucuuuuccguucuauuuuguuuuacuguuuccucugguuaaaauaggcugauugugaccaacuaacuuggucucacagcccuuuaacaguuugcaacccauaauuugagcccaugauuuugaaacauggcucauggcucgaauauagaucagcagagggcuuaacggaaguaccuucaggagcccauucuccugucccagccgggcucauauccggcuccaguguagcugccacccacauucuccccgcuccccaggagugugaggauuccucuucaacagcauuccagcguuaacuuuagacauugggaacauaucccacuuacucuuuaguggcuuccuauacaugacauuucuuuuuaagccguuuaacuaugcaagaucauaacucacucugccuauucuugccuuugaucuuauuuuauauuuucuuccuguuuggcuuauuccagauuuuucugagauacuuuauuuagcagcuucauucuuaagcgaguuuuaaaaccaaagcauuuaagauuugccauucauucaucuuggaauucuagcuuauuuuucuuuuuuauuuucauaguacagguauuuuauuaaaaauaaaauuaauggaaaaauaucuuauuuuuaauguaccaugcucuaauauuacuucuuaaaaacaagaaaucaaagaccaguaugcaaauaggguaggaugacaacacuauguuguugugccuaccaccaagguaauaugauagcauguaacaugaauguguaauugacauguaccacucuaucucuucccuagcccuccaagccacaaaacuguggugaauggaaaagaauguauaaacuucgccucauuuaauuuucuuggauuguuggauaacccuaggguuaaggugaguagcacauauugcugaaguggacagauaacauuacugauuuaagaaacuagacauaaaagacaaaggcaggcugggcgugguggaucacuucaggucaggaguuuaagaccagccuggccaacauggugaaaccccaucucuaccaaaaaauacaaaaauuagcagggcaugguggcacaugccuguagucccagcuacuugggaggcugaggugggagaauuucuugggcccaggagguggagguugcagugagccaagauggugccacugcacuccagccugggcaacagggcgagacucuaucuccaaaaaaaagaaaaaaaaucauaguauuggaaagcgcuaugcaaguuuuucccauuacuuuuugucugacagaguugugagcgggaccuagacagagagaggcaagagucucuuauguggcucaguguuaggcagcaaccacagaacugaacaggccagaccuagagaauaguuggagaagggucuaggaaauugcucucucuccuauugggauugugggcuaacaggcauuuuccaggaaagacuuggcccacaaaugcagaaaaguuaaccagguuuugagaaucaggcuaguauaacuuuuccauauuuuaagucauauacucagucuuuacaccugucucuucuuuauauucuguuagaguuggaggaggaaggaaggagcucuguggguuaaagaauaggaaauguuuguuuugaacucuuaaagauaaauuauuaaaguauaauucuuguacuucaauaaaggcagcagcuuuagcaucucuaaagaaguauggcguggggacuuguggacccagaggauuuuauggcacauuugguaaguuuuuguuguguucucuuugagacuacugcuuucaauaguuaagauucaauuuuaggcugggcaugguggcucacaccuguacucccagcacuuuggggaggcugaggugggaggauuccuugagcccaggaauuugauaccagcaugggcaauauagggagacccugucucuacaaaaaauaauaaaauuagccgggcauggugggcucauccucgugugcauguguggggauugcagcgugaggaacgagugcagagcagcaguacucuuuaugcaggggagauggccucauacuucugcccacaguccacugaugagagcggaaccccugccaugacuagccacgcagggggcugagaaacagcucuaggaagaaaguggagagcagauugccugggguggagggaggggggauaaacaguguaguuuuuuaucuuucuagaaugaagaugaaggaucauugauuuccuuguguauggauaauccgggaacaggccaacuaaauauuugaugaauguaugauuucaaauacagugaauucccugggagucaucaaagaagaccggcauuuuaugguuguuuuuauuaaguguauauucuuugcuccugaaaauguuauuaaauaauuguuuaggccgggcaugguggcucaugccuguaaucccagcacuuucaaaggcugaggcaggcagaucaccugaggucaggaguucaaaaccagccuggccaacaugcugaaaccucgucucuacuaaaaauacaaaaauuagcugggcguggugguggauaccuguaaucccagcuacgugggaggcugaggugggagaauugcuucaaccugggaggcagagguugcagugagccgagaucaugccacugcacuccagccugggcaacagagcaagacugucucaaaaauaaauaaauaaauaaaauuguuuaaaugaauuuauugcuggaaauagcauuuuggcuuauaaaaugacacaguguggggaaaguagagcaagggaaauaucuuccaucuuccauccuuguuuccauuucuggaucuuuuuguguuuuuuuacuuuaacaguuaaguuuuuuacuuuugugauuuuuuaauguaagggagcaccuuauguuaucccuaagcuaguuuggugauuacauuauuugucuuggaaacagauaaggagaaguaguguccaggaauccuacagcuggaagugaucuuuaaaaucuuuaguucuaacccuaaaauuagaaauuggccagguuuaguggcucaugccuguaauccuaacacuuugggaggccaagaagggaagauugcuugagccuaggcauaugagacuagccugggcaauguagugagaccccguguuuacaagaaauaaaaauaaaccuggcacuagcgugaaccuguagucccagcuacacagguggcggaggcaggaggaucccuugauccuaggagguugaggcuguaaugagccguguucacaccacugcaauucagccuggaugacagagugagaccaucucaaaaauaguaauaauaauaauauaaaccaaguauccugacuuccauucuugauggcaaguuugaagaaauaagcucauaucagagccucccacuuuccucuagucuaaugcaaauggguuguuugcuugguuuuugauugguagggaauuauuuucuuggcagguauuagaaaacuagaaaaggcacauuuuaugggguuguugauuguaaucugaugaaagcuuucugugacugcuugcugagguaaaggaauuguuuuuguagguagguacggaggagagcagcagcuuguugguauuagauaucagggaguuuuugcuguauuuuucuaggaaguaaagaaguuguuugggaggguaaagguggggaucauugaaagagguucagagguguagggagaugggggagguugcugagucagcuggcagggcagggacagcuguguaguaggaggaagagaaggaaauacauagccaacaaucucuggcuaaggaaggauuggagauggugaggagggagugggugagguugaugguuugcuggagauaauuagauggagggguagaggguggcaagggaaugggagugagacaaagaguaaguauaaaagaaaagaacuucaucaggguggaagaauuggagaguaccuugccacagaaggucaucuguccauucugagagaguuaaggguggcagcuugagggugacaccacgagauaucagcuacaauggucuggaguaaaagcgugaacugguaguauagacaaaagcagggcauuuagaaguacgugagaaugguuaguagggacauaaguagacagaguuuaaauacuggggugacuguguaaaggccuacuguaaauaaaagguauacaggguuauuguucuuuuucaggaauguggguaaguuuaagggaagugggggagaguacuugcgacuucaggaggaggcagaggagcuaggcuggucgucugaugggcacaguuuuauccuggagcgaugaacccaguggggaggauucugcagacgacugugguugggguacuauagacgaccagguaagguccuguccaccgagguucuagaguuugaggggucagguucuuaacaagaacugaccguccggcuagggugucuuuauauggcuggguaucuggaguagguaaaaggaaauuggcagcuuaguggauuuccugucuagccuguugaaggacuggaagauaaucaccaagagggguggugucugaaauaagguugggacccagcagaaaggugcggccguguaagaguucaaauggacuguacccgguggguucccaggguguggcucgaauucggaggagugcaagggguaggagagugguccagucuuuuuuaagcuggaggguaaguuuaguaagguguguuuuuaaaagguccuuggcuuuuucuacuuuuccagagaacugagggugauauggggcaugaagauuccauugaauaccgagggcuugggaaacugcuugagugauuuggcugaugaagaccagcccauuaucagacuguauggaaguagggagaccaaaccggggaauuaugucuguuagaagaaggaaauaacugcaguggccuuuucagccuucagaccccgugggaaaagccucaacccaucugaugaaggugucgacccaaaccaggagguauuugaguuuccagacacggggcauaagaguagagucaauuugccaaucuugagcagggauaaauugucgugcuugaugcauaaggaaaggaggagguuuaagaaagccuugaugggguaguagaguggcauuauagcccauugagaggugauuguuuugaggauggauuuccaggcuggaaaagaaaugagagguucuaaaagguggguuaaagauuuauauccuacauggaaguggucaucaaaggaggagaggauagaguaagcuugagaggcagggagaaggagcuuuccaugaucuaaaaaccaguugccuugagugggaagugacugguaguuuaagguuucagaaggagaguaauaggagugauagaugagaaggagaaauauuggccacugggagcagauacuggggaguuugcuguuucuuuggcuguuuuauuggcauagguguuuccuugggcaaugggaucagagguuuuuugguguccuuugcaguggauuacucuggcuuuggcuggaaggagggcagcuuuaaggagggcuuuauuaagggggcauugauaauagaggauccuuguguagugagaaaaccucuuucugcccaguugacaggguggcgguggaggaugugaagggcguauuuagagucaauuagauauuaacaugcaguccuuugccaagaguuagggcaugaguuagugcuauuaauucagcuuguugagagguuguaaauggggagagugcagcaguuucagugauagaugagugagacacaauggccuauccagcuuuuccugguguuaaucaacugguuuuugaagaacugccaucaauaaaccaaguguggucugggucagggacaggaaaaagggaaauauggggaaaaggagaggaggcuauguggauuaaggaaauacaguuguguggauuaggauuuguaguggguaguaagugagaggccggguugaaguccuguccaaaggcaaugguccccaugagauuuucaauaaagagugaauagagcuggaggagguggggagccgagaguauguuuuauaugugaagaggaaacuaagucuuggagguugugagugcuauaaaaggugaguggggcauagccugugauuuugagagacucuaagaguauaagggcuguggcugcuguggcaugcaggcaugacggccagcccaggacuguaagauuaagcuguuugaauacaaaggcuacuggucacaggccugguuccugaguaagaauuccuacagcgcagcccugcguuuuugcuguguggagaggaaggaggguugggaggagucgggaagcgcuugaguagggguugccucuagggccuuuuuuagaguaaaaggaggggcgagggaaggauuuaggaucuguggguucagcuaaguuuccuuuugugaguuuauagagugguuugguuaggauggcaaaaccugguauccaaaggcagaaguauccaacaacgucuaagaaggagaggaguaguuguuuggugguggggauuggaauuuggagauuagcugaauacggucugcuggaagugcacaccuauguugguggaggauuauaccaagauaaguagaaauuugagcuuuggagggggauacucuguaccccuuggaguagagguguugaagaagcaggauagugucuugcugggaggauugguaagaggggcugcaaagaagaaggucauccacauauugaaugagaugggaaacaaauggacgaaaagaaagcaggucacgggagagggccuggcuaaaguagugugggcugucucugaaaccuuagggcaggacgguccaggugaguuguugggacuggugggugucagggucaguccaaguaaaggcaaaaaggggcugggaagagggauguaaggggaugguaaagaaggcaucuuugaggucaauaacagaauaaugaguuguggaaggcgguauugaggauaggagaguauaaggguuaggcaugacaggaugaauggggaggacaaucugauugaugaaacgaaggucuuggacuagccuguaggauuuaucugguuuuugaauagguaggaugggagaguuguaaggggaguugguagggacuaagaggccaugcuguaguagacagguaauaacaggcuuuaggccccuuaaagucuguugugggaugggguauuggcauugagcaggauaaggguggccauguuucaaugggaugauaaggggugaaugaucaguugcaggcgaaggaguggagguaucccauacuuuaggguuaagguggggagaugaaaggagagguugcgagggagguuuggaauuggauaaaaggguagcucugagauguggcuguaguccaggaauagucagggaggaggauaauuuaguuaaaauaucuuggucuaauaaggggacugggcagguggggauaacuaggaaggagcgcauaaaggaguguugccugauuugguaccagaguuggggaguuuuaagggguuuagaagcuuggccgucaauaugcacaacaguugugggggcaagggaaacaggcccuugaaaagaagguaacguggaguggguagcccccguaucgauuaagaaggggacggacuuacccuccacuguaagaguuacccgaagcuuggcgucugugaugguccagggggccuccgagauauucgggcaacgucagucuucagccgccaagccgaggagaucugggaaggagucggucauuucggguuuguacuccaggagcuccaggauuggugaugagagucagacagucugacuuccagugagggcccacacaggggcauggcuuagaaggaaucccgggccgugggcauuccuuggcccaguggccagguuuuugacauuugaagcaaggucccagaggggcaguuaaacgcugcgguuuguacgccuugaaguuuuugcagguaggcggugcugcugggguuuguuuuaagguggaggcaagcauuugucauucugaaaggcgcgcugccgccuggcagccucuucccuauuauugaacaccuugaaggcaggguugauuaauuccuguuauaggguuugagggccagacucuaauuuuugaaguuucuuucuaauauuaggagcugacuggguaauaaaaugcauguuaagaauaaggcggccuucugucccuucaggguuuggugcuguauaucgccugaggguggcagcuagaugggccauaaacugagcuggguuuucaccuuuguucucaguggucuccuuuaguuugucauaauucacggcuuuauaugcagcuuucugaagcccuugaacuaaacaagagaucauguaguccugccuggcuaugccuugggccccugccugguagguccuuuggggccuucacggguacugcccuagugccuggccuuggaggccaggcucaaggcgccagcagucaucagcauaagauugagcuaggguccaaagugaagaugacauuuaagucauuccaagugggauuauaggacuguguuaaguauuggaauucuuguauauauuugaguagggucugacggaaaagagccugaaugcugacugauuugggaaaggucagauauagagaaagggaugugaaccuggacuuuuccuucggcuccugccaccucucaaaggggaaauugcugggcaggggcaugggggucggcuucagggucaaauuguaagccagagcaggugugaggagggaugguaaugggagggacguaaagggguggcuuguggguagaacucgguucugagggggaauuagggccagguucggauagguggguuggggggagaaagauugaagggguuaacagguaaagaggagucagcauccccaguggaagaaggagagguagauggaagggagauaaggaaaauuugggauggaccacauugggagcagagacuagggagagaucauaguaaaaaaugccuggauguaggguaccucagaccauuugcccauuuugcaaccgaaguugucuaagucccgcaaaauagagaaauugaaagugcuguuuucuguccgcugagagccauugucuaauuuauauuggggccaggccguguuacagaaaaaaaaaauuagacguuuaggcuuuagauugggugaaagcuaagagguuugagguuuuugaggacagaagccaguggggaagauggagggugggagguugcccauguuagaacugggaaaguuugaggggaaagaaagagacaaggaaaagagcaaccacuagcauccucagugggcauccccaauggaggucccggguuguguggcuggcgaauggccaaggcuggcaucccuggcauucaccaaacacugagggaagacugucuucccaagaagaguccgugaccaacguuggauuuuggaaacauggauaagaggaagguuccuugucucaauuuugaggagagaaaaagagggagagagaugaggagagaccgaggcagcuuacccgauccguagacagaggugggaguguucgcgggggcuggucugagguccugaggucgagggaagucucuuugauggaagagcguggggaggauaggggagaggucucccagagagaguuccccuaucccgggcuuucggcaccgaauguuaugcaugcguccaauugaagagacaaccugaacaggcuaagugugagcaacaaggcuguuuauucacucgcgugcaagugagcuaaguaugaaaagggagucagcagaggguggugggauuggagaugguuuuauagguuagggguaggcaauggaaaguuacaguuaggggcuggauuuugcagguaggggaagaaugucacaagguacauuaucacaagguuacagagcacagugucaugugucaugagguugauugaucaguuaggguagagccuguuacaaugguagaaugccccaaggcuggcuaaucagcuaagacagguacuagccguuuuucuucuuuugugguuuuccuguugucccagauuuucuggcugcaggacaccuucuggauguguacgugugggucacaggggucacgauggcuugaccauggcgcagcuuggucaggggaccuuacaauuuggucauaaaauuccuagaucugccacuuccucuuaccagucaugggaucaugguuuucucagguguaagugggaacaaucauugcuugcauggcuuuagaacacuuugcuaaggaucacauaagauaccgcaugugaaaacaugaaaaacauuuggcucuguauguuccagugaguaccuaagggcuaucacuuauacucuuaagaagaaaaauugugcaugucucuagggauauuuuuguguguguguuguugugguugagacggaguuucacucuuguugcccaagcuggagugcgauggcgugaucuuggcucacugcaaccuccgccuccuggguucaggcgauucuccugccucagccucccagguagcugggauuacaggcaugcgccaccaugcccaacuaauuuuuuuuuuuuuuuuuuuuuuuaguagagauaggguuucuccguuuuggucaggcuggucccaaacuccugaccucaggugauccuccugccucggccucccgaagugcugggauuacaggugugagccgccacaccuggccucuagggauuuuuuuuuuuuuaaggacaguauguaugcaaaaauaugaaggccuuaagagaaaauguaguuuguuucuaaacguccuaaagucagcuauuuuaugguguucucucuggaaaacaaccaggaaggccguaaucucuccuccuuguaagugagaagcugaacaaguggcucuuauuggaagauagucuuaacaauucagaauucacauagcuuuauuagaagauugccuaagugugaccagguuuuugcuuuuaaaauaaaaccuuuucuuuuauucuacaaguauuaauguaauuaaacaaacucuuaaauagcauauugcuuguuccaugccaggcaguguucuaaguguuuuaucagcauuaacuugugcagucauccuacuaacccuugaggaagguaggacuauccccccuauuugacagaggaaggcaccaaggcugcccagggcugaacccccagaccuaacuacaaucugagcucugugaugaccgagauagugaggccuccugucccugagguucuggugagggagccagacaggcagauaagcaagugcaagaaagugcugagggcugugaggugugcggaggcauucuaggacaccucccucuauggucacuucucugccguguuuaauacuaacagugaauuguagaauauaguacuuuaguuuuauuccaugcaaaucuacagcuccaguuagugaaauggaucauacacacagaagauauggacaucaaaaguugaagaaaagugagugcccuuguaguuuuccugcuugcugccuucuccucccuuagguugagaguuucuucguugcacaaaggagcaucaagagaaacaaguucuucaguuacccauauuuaccugucacaaaaccugcuuugcaaggcugacaucagcuaaaacccagugucuucugauagaaggaaaagacuagucuuuuugaacuuuugggacuaugcuagaaccaguaagucauugauuuauuguugagagauucuucuucccacuuauggcaacuguauauaaacaguuacgaguauaccuaaugaugggaagauuuguaacaugcugauuuucaucaacuggguaacucacucuaaaguccugaaacaggguuauacucaguuuuacauucucaucauucauugaugaaaggagucauuuagagcuaagaagucuacagaaugauuuaaaaucccuuuugugguuagcaaaaauaauuuguauacauagcauguuuuucuuuuugaaauggagauaccaaaugaaagcaaaccacuguugccugaguuguccuucuggcugaacugugaagguuuguggcagauacuuucaauuagaagcaccauuauacuuugaaggaggccuccuaccugggaacgugagagguggcaaagugauggcgcucagagaacaguaaugaggaugagaaggaagacauacccaagaguaacccaugcucagcuacuuggcuguuuuccucuuucuugcuagauuuugccugaaaccuuuucugauagcaucucuccuagagggcggcugucagauacagggaaucacggccuuggauuucaugugaucguagugucagaggucuuauacucgaagaucaccugggauacguucuucuaaacucuguguguuguuguaaaguccuacguuuauuuaauguugguguaaugaaaaguguccuuuuuauaaaauaacuauaaccaauugguaauggaaaucaaaugauauugacuguguuaacguacaaauaggaagaagcaugccucauauuuuaucacuauuugauaggaauggaauuaauaguucauuuuaacaguuuuguaacguucuuuaggaagucuguaaauauacugccuccugccaggccgucagcccucucugcugccccuagcucaggaaugcccagaccgccugccauugccugugcuuggguucucaucaguagacacaucacggcucacucauccugggucucaaaauccaacucuguggccucugauuucccuccuuucucccauagcgcucuaagacuggaggggccuggcuucuucgagcgcucuccacacagggccuguggugaaacucuguuaucuaguccuccaggguuggguccugccauaguuaaaagagcuaagggaauuuuuuaaaaucccuuucccuccuugauaaugucucauuuuaaggcuguuuuaaaguuuuaagauucuaagcuggccaguggccuauuuauucuaagcaucacugguccuccguccgagggcaugaagccucaugguucagucugagagguaaaaggcuguaaggagccaugauuuaagaggaaaauaaaacaugucagucuaauaauuauaauuuauccucacuauuaugucaacauccuccuuacagugcaucuauaaaaggacuauauuuccuuuuguacuauaaauuugaauucuucauuacacuuacaagaaauucagacagaaucccagccccagaaagugaugggaggugccacuacuaaaugcugacacagauuguuagaggagugguuacuggaguucuaguaagugucaccuucuugaugcaaaguauacaggguucuuuuugcuaaaaugcaaacagacauuaauaaguuaacaucaaacauuggugagaccucaaugguuuuggucaaggacaguuaaugcagggaaacuugguaggccuugaagucuuacaguagagugauaucaaagcauaaccagaaguuggaacugccccaguaacacauuuugcagauagaugcguagcugauuuaguucauguauuuuagaaguuguaugggccuagaauuauuuuaauagaucuuguauaaucuaucauuuaaaaacaauuccauuuuggccauaaggugaaaguauugauaauuauacugcuuguguucuuuuauuuguucuuuaguagagaaaaagaauuauaaggcaguuuaaccauuuaacuuuuuuaacugaaauagauguucauuuggauuuggaagaccgccuggcaaaauuuaugaagacagaagaagccauuauauacucauauggauuugccaccauagccagugcuauuccugcuuacucuaaaagaggggacauuguuuuuguguaaguaaacuuuacguaguuuucuaauagcaguuccuuugaaauaauacugacugucuuagagaaauacuucauuagaaguuaucugcauaaaauaaugcugcuuuuuguuuuucaagaaauagucaccucaccaaagguuucaaaauuugugaaaccuucacuuaaaagaugcuuaacggugucuauagucauuuaucugccaugguaauuauuuauugauguccagaugaggacagcuaucugccuucuuugugcagcucuguggcugugugguauccuagucuguggucaccaccucacguugucagucagacugcccggcaaagucucuccaugucucaucacccauucaccccgucaccuggucucagcugaucuugcuuccuaccuuauuaaggauagaggagccgugacuuggacacuucuuugacuacccacaaguggaucuucacacucgcgugccugugcugaaugcaugcuaccgagguuuacugugaagggcaggguacagccaagcaagggcuggcaggccccaggcagcugguuaaaccagucagaagcaucugcugccccaagccaagcccugucguccuaugaguggacuaaaauuuggucucaaauugacuuuaauuuccucuucucuguuuuuuuuuuuuuugugugugagauggagucucacuuugucaccacggcuggagugcaauggcgcaaucuuggcucacugcaaccuccgccucccaaguucaagcaauucuccugccucagucuccugaguagcugggauuacaggcaugcgccaccaugccuggcuaauuuuuuguauuuucaguagagacaggguuuuaccguguuggccaggcuggucucaaacuccugaccucaggugauccaccugccucggccucccaaagugcuaggauuacaggcgugagccaccgcaccuggccuuuuuuuauuuuuauuuuuuaauuuuuuuuauuuugagauggaguuucacucuugucgcccaggcugaagugcaguggagugaucuuggcucacagcaagcuccgccucccggguucaagcaauucucuuaccucagccucucaaguagcuaggaccacaggcacccaccaccaaaccuagcuaauuuuuuguauuuuuaguagagaugggguuucaccauguuggccaggcuggucuugaacuccugggauuacaggcgugagccacugugccuggccuccucuuuuccuuuuuaacaucacagccagaguaaucuuuuuaaaauguaaauccuauuuugucacauuuuauuuaauacaauuuagagcuucuauuguuccuaaaauaaagacccaaguccuuuguaugaucuugugagcucugcaucacuuuuucaggcugauuuuguaccauuuucccugagguguuuaagcuguagccuugccagcccuguaugcuaguguccucucaccuuggggcccacgcacaugcucuuucugacuagaacacuguuccuccucccuucuccuacuuaaccuucucauccuucacauacgucaccucugcagggaggccgucccacaccucagagcaggucaagaccccugcugcauguggacaaaaucuuacagccagagagaauuuauuguucuuguuuauccaugcucacacgagcacucaaacugccugucaaggucacccugcuucucaagccucccucccacacacagacacacacacucucucacacgcacccugcucugcucauuugcuucauacuuacuguacuuuucuuuuguagagcuuguaacaguuuauaauuuuauaucugugugguuauuugcuucuguuucuugcugggagcccauuacuuagaauaguauuuaucauuuaguaauggucaauaaacaguaguucaguaaaugaaugaaaggaagcuggagcucagaauaggggccagauaacuguguugcagagccuggcaucccucaagcccugcacuggccucuugcuuaccacucaccguuggaacgcuugugcagcgacagaaccuucuaucauaauuacuacagagcugacucuaccuggggcuucugcaguacaugugacccauuccucacuauagcccuacagcagucuaggagcacuacagcaaauguccugggucuaaguaguauacuaaugugaccauaaaaaugaauauuuuuauuaauuuuuggcaaauaguuuaaaaaauaaugugaaagacucaucacuaacugaagcgccauugacuuaaacaguguuucuagguuuuuaguaaaagcagaguuacagacagcugcagugucauucagugucacuuuauacacaagcaccccacuauaaauucuuuuaaaguccagaaaaaguugaugguuacuggugaacuccuaugcuuccuuugauaaauacuacauuguguuuuuuuuuuuaacugcuaggaaacauaggcuaaauucacuuccauguguuaugcccagugucuuaaaauuuccauuuccagugaguugcuaaccuguuuauucugcuacguaauuuuaaauacucuaccugaaauguguuugaauguaggagugcuagagguaaacaugguguuugguaaauugguuuugauaaauuugucaggcauagacacugugugaugcuucauuuccuuccuuucaguaaacaguguuaaugcuuugccaauaguggggcucagcacaguggucauucauggacuuaagucuguccuaucacuccacuaaguauguguucaugcugcuucacagaucuuuuuaaaauuaaacuuuuuacauucagauaauuguagauucaaaagcacuuguaagaaauaauauagaaauccuuuguacuuuuuacuaagucucuuccagugaggaccucuugcaaaacgaacaguuucacagccaggauauugacuuugucauugucaagaugcagaacauuucugucgccacagggauccuucauguugccacauccacauuccucccaucugcccacuccuuaacuccuggcaaccacuaaucuguucuguuuguuaauuuuguuauuuuaagaauuuuauacaaauggaaucauccaguaggcaacacuuugggguuggcuuuuuucauuuagcguaauucucugaugguucauccaaguuguugcuuguauccagaguugguuccuuuugauugaugaguauuacuccauggcaugaagguaccacuguuauugaaguuaccuuuuaaagacaucugaguuguugccagcuuugugcuguuauaaaaaaaaagcugcucuaaacauucauguacauucaugcuaugugagcauaaguuuuuauuucuguggaauacaugccaaggaaugcaguugcuauguuuauaguauugcauaguuuuuaaaggaacuccuaaacuauuuuccaaagugucuauaccauuuuauguucccaucagcaagauaugaaugaucaagguucuccacaucuucagaagcauuugguguuaucacuacuuuuuuagccagucugauagguguauagaaaaauuuauauuuuucugauggcuaaugauguugaacauccauucaugugcauauuugccaucucuucagugaaaugucuuuucauguccauuuucuaguuguaugauuuguuuuuauacuaaugaguuuugagaguucuuuauacauucuagaucauaguucuuuaucagauaugugguuugcaaauacaaauuuugauguccacguauucauugcuaaaauauagaaaugaaguggauuuuuugugugcugagcuuguauccugcaaccuugccaaacucacuuaauuagcucuaggaacuguuuuucuagauugcuuaggauuuuccauguagacagucgucaugucaucuguaaauaguuuuauuuauuuucuaaucuacuuacuuuuuauucccuuuuauugccuuauugcacuggcaagaacuuccaggacuguguuaaaaguaguaagagaagacauucuugcccuauuccugauauuagaaagcguuuacucuuucaccaauaaguauaauguuacgugcagauuucuuacagaugcucuuuauuacauucacuuuccugcaccucaucuuuuuuuucugagcauuuucauugcaaaucaaugugaauuugguuggucaacuacuuuuucuguauugguugauaugaucaugugauuuuucuuuuuuagucucuuaaugugguggauaacauugauuuauuuucaaauauugaaccagccuugcauaccugaaauaaauaccacuugguuaugggguauaauuuuuuuuuuauaaaaagcuaaauucgauuugccagucuuuuguuaaggauuuugaaucuguguucaugagggagauuguccuauaauacacuuuuuuugauacuuacuuugguuuugguagcagaauaacacuucacagaaucaauugggaagcguucuaucuucuauuuuguggagcuauuuguauagaauuacuuuuaauuauuuaauuguuugguagaauucucccaugaaaccaucugggccuggagagauuucuuuuuugcaaguaucuuaauucugaauucaguuuccuuaguaguuaucaggcuauucaaauuaucugucauauugagugaauugagguaguuuguguuuuucaaggaauugguccauuucuuaaaaguugucagauguacauguguggugcuguucaugguauucccguauuauucugaugucugcagaguccacaguuauauaccuuguuucacuccugguauugguaauuugugccuuuucuccuguuuucuuugucagucuuguuagaggucugucaauuuuauugaucuuuugaaagaaucagcucuuuguuucauuguuuuucucuauuguauuuuuauugucaguuccauugauugauuucuccuauuauuuccugccuucugcugacguuugguuuauuuuguucuuuuucuugauuuggagguaagagcuuaaauuauuaauuugaaacuuuuucucuuuucuugaauguucauuuagugcaaugaauugcccucucaacacuacuuuaguugugucucacaaauuuugauguguuguguuuucauuuguauuuaguucauuuuuguuuuguuuuaagaaauagggugucauuauuuugcucugguuggccuugaacuccugggcucaauggauucuuuugcuucagccuccuggguaguugggacuacaaaaacacaccacuaugcccagcuuacacuuucccuuugaccuauggauuauuuagaaguguauuguuuacuuuucagguguuuggggacuuuaaauuuguuguaguuugguuuauggcuaauacgguagucuauuuuggaauaucuuauaugggcacuuaaaaaauguguauucugcugcuguuugguggaguguucuauaaaugucaagucuuuuugguugaugguguuuuuggguucuucugucuuggugauuuucugucuaguucuucuaucaguuguugaaggauaaugaaguuuccaacuguaauuguggguuugucuauuucuuucaguuuuaucagugguugcaucucaaauuuagcuuuuuuguuuaguucauauuuaggauuacuaaguuuucuugaugaauugacccuuuuagcguuucauaauguucuucucugucucugauaauuuuccacuuuuuguguaugugcugccaaagcaaacacucugauaauuuucuuucuuccaaaguuuacuuugucagauacccuuuuuauuauuuuuuauauuacauaguuguguguauaaaucuguauuuuuuacuaccuauauuauuauauuuguagugaguuucuuacagacagcauauaguugggucauguuauuuaauuuauucuaccugccugucuuuaaaucauguauuuguacauuuacauuuaauguaauuauugacauaguagaguuuaagucuguuaaaacaaagucugccauuuugcuuuuuguuucuuguuuguucacucuacuuuguguuucucuauuuucucuuuucugccuuucugugggcuaauugaacauguuuuuagaauuuacuuuuucuuuguauagcuuuuuuuagucauuacucugaguguuacauuacacauauauuauaauagacuacuggugucauuguaccaauucaaguguagaaacuuuuaccuuccuuuacauuccuuuauuugccucauuuacauuauaauuguuuuaaauauuuccuguacauacagugagaaccacaucaguguuuuaauuuuugcuuuaacuguccaaaauaauuuagaagacuccagaggagaaaaaaagccuaguguauuugcccauauuuuuuacuuacugugcuccuuccuccuuccugauaaucuaacaguauucuuuuauggcuuuuuuccuauuuagaaggcuuccuuuggccauuucuuuaggguaggucugcuagugacaaauauucuucauuuuucuuaacugagaaugucuugauuucaccuucauuccuaaaggauauuuuugcugguuauaggauucuggguugacaguuauuuucuuucggcauuagaaacacauugugaugcuuuuuuucuggugucugguuucugaugaaaaaucucccgucauucaaauuguuuuucucuauguauaaggugucauuuuucucuggcugcuuucaagauuuuuuuugucauuuguuuucagaagucaucuaugaugugccuuggcaacuauuuguuugcauuaguccguauggauuuugcucagcuucuuuaaucuguagauuuaaaccacuugacaaauuugggaaguuuuuagccauuauuuauuugaauacuuuuuuagcuccccaccucuuucucuucuucuggaauuccaaugacacaaauguuacgucuuuuauuauaaucccaugggucccugagacucuguucauuucuuucuagucuauuuucuuccuguugugcucagugaaugauuucuuuuuucuuuguuuuuuuuuuuuuugagacagagucucgcucugucacccaggcuggaaugcaguggcgccaucuugacucacugcaagcuccgccucucggguucacaccauucuccugccucagccucccgaguaacccggacuacaggcacccaccaccacgccaagcuaauuuuuuuuuuuuuuuuuuuuaaguagagaugggguuucaccauguuagccaggauggucucgaucuccugaccucgugauccacccgccuuggccucccaaagugcugggauuacaggcaugggccacugcgcccggcugucagugaauaauuucuauugcuugucucaguucacugauccuuccucugccuccauucugcugcugagcccauccacuaagcuucuuauuuuaguaauuuaguuuuucaguucugauaucucuguaggacucuucuuuguaucuuccauuucaucacugaggcuuuuuauuauuucauuugcuucaggugucuucaugguggcucauuaaaauauuuuuaucguggcugcucuaaaauuguuguaagauaaucuugauaucucugucaucucacuauuggcauuuguuguuucauucuacuugauaucuucugguucuugauauaagggauauuugauggaaaccuagacacuuucauauugugccgcuguaguccaugucuaguuuaagccaucucuuuuauuuggcuuucucugacaugauuccaacaggggaaggggcuaggggacugcugccucauacugccaggaggaggaacaauucaggggcccuacucggccuccauugacaucguuggggguuucuuuguugcugcugggugaugcuaauaguccugacucuccacucgcccuccugugacacugcccaggaggagauggggagggugcccacuacucccaagugcagguggaaguuagggcucuccauguguucuuugcugacaccacaguggggguggaggggguccacuuguuaccaacugauaggaauaaaaggcucagcuuccuacuuggccuucccugacaacacccuaggaggugugucgccuuguuacagccucucgagggucaaagucuaaguucccuucucagccuuugcugacauagauggggcuggguaccccucauuuuuuucugugguguuuggcuacaguagaauagucauugucuaaaaguuuucugucuagcugggcugccaguauuacuucucagggcaaaauaauggcagaguaaugugucagucauaucagagaugccacugauggugaggcacaccaguauuuuauguuucuuagaaagagaaaaguaugugaauaaacugauaugucauccauaguaagaugcaugcuaauuucagagagauuaauauauagugagagugugcuucuuggaauagauuaaauaugguaguuaugugaaaaggacucauggaugaagagcaaacaaugauguauaaauauucaaacauguuuuauuuauuugcuaugcucauguuaacaaucagugauuggucagcuuacaaaaacaagcauuccuuuuugagaauguugacaagacccuuuaaacccaauuugguggaucucuuuuccuugcagagauagagcugccugcuuugcuauucagaaaggauuacaggcaucccguagugacauuaaguuauuuaagcauaaugacauggcugaccucgagcgacuacuaaaagaacaagagaucgaagaucaaaagguaugauucuuuugaagaaaauuauacaguucuuuuguacuuucuaaccagcuaaauuauauaugaaaugguaauuugucaugaaaacuugccuguggaucacauuuggauauuaagguguuccugcuuauuaaauguacuugguguuggagagccaagucugauuguaauugccuugucauugccguaauuacauauagcaaauuggagggagguaauccaagcagcuuucugagagaucaagagaggcugaaaaacagcaugugcuuagugaggcagggagaugucuacucauagcugggcauaaugacaccaaaacuuacuaggccuuuaaugacauguaccuagugaauucagaauaggcuuauucauaccagaauaaaucauguaucaauuacaugaggaaagaauggcagcaagcuuauuauauuaauauaugaacaaagugaagcccuuucuccccaccccaccuguauccugcucugagcagcuacugccugugggaaaugacugccccuaacauggucuccuuccagcuugcagcccuguuuucagcuguuuccucucgagaaccuaacauaacccaggugauggugguuuggaaguagcuccuugguguucugauuagggugaaacagaggaaguguguucagagcaucauuguuaaaauuacaauuuauuuuccccugaugacauggguaaguaaaguagcucaggucugugguucugagcaggacaccaugaugugugucuucaucucagacacaguuucaaguggacuuugccagugcaacucagucauaacuagaauaaaugauaaaaaugcucaucacauuucuuaauuuuguguauuuuguguuaauuuucaauuuuccaaauauuugcauuauucauuuaggauucugucaucuuuguuuaggugucagccuaagugcaucacuucaugaauauacacauucucaugaugaauaugcaugaucuugccauuuuauacuaacucugcucuaggcuaacauuucacauuuacacaauuuagaaaaaucuauaggcaaaaucugaaaacagcccauuccacugauuaauuucuuuuacaaaguauaaaaagauguuucuuaugaugaugcaguaauagaaagcuagucuguuuucaguacuagaacugcagucugcugccauuuguuuugccuaguauuguauaaauuuggaaaacaucagauucaaguuuuguaugugcucuuuuucuacaagaucuguaagccauagaacuuuuuuuuaaaugagcaacaagaaguaaaauuaaauaucuugaaacuuauuucuacuuuauaauuuuuacuuuuuuacuaauuuauauuuuucuugcugagagcaggcuuucuaaguaacucuacauuuugguuuuuagaaauauucauuuucaguuucauuuucacauaaauaaucuggucguuaacacuuugaauguuuucuuuguccauuuuccaagcgccaugguucaugaauuguuuuuuauccccuuuccuacaggguucccauaauggucaguggauaugaacaguaguucauaaaaggaauacacauaacuaugaacaagugaaaaauagccuggccucacuaauaauuaaggagauuaggcuaggaguuuugccuguuaaauuagggcauguuuuuaauaguaauagucagugcuaacacagauguggugagacaaagaguguuccuaugacacuggaaggaguuuaaauuggcacugccuuucuggaaggcaaaugggcagauacauuccaggauccaaguaauuccaugcccuuugacccauuccuguggugcugucuuuaaaaacuuacgagaaaugaugucacauuuugaaggauauucauauugugauaugaaaaagcaaaugaaggaaacaacuaaauccaacauuagggaaauaaguaguuuaugguauacucacaggcagaacgucuccauuaaaaucauguaauccgaaauaauuuagaaaugcucacagcauaauguuuuuaaaaucagguccuaaaacuacaguaaaauccugauucugaacaaaguaauuuauauguuuauacaagaaagacaaaaauuaucaccgugugguaugauuagcugauuuauuuaauuguuuuuuguacuuuuccauuucccaagaauccuacauugaauauuuuuaaaucuaagaaaauguuuuuccuuaaagacaggcagagguagcaugcccuguguagaaauuaggguggcaucucuucauccaucacuucuaacauauugcuagcuccccagcuuucaguugugaguugacagaguaaagaugauugagcaacaucagugauauguacuuuuuauuccucaacaaacuuuuuuuuuagugcuacugcuguggguuguaaaauaccccuuaaagcauugcucugauacuuucuaauucugaucauuucuaauuguccauuggagcagaaacuuagaggcaagagaucucugaguaagaagguaauggcaaacucuaucuguggaucucaguauuuuuugcagucccacacaccugaaccauguacaguuucauacaugugggagauuuauuagugacuugcucugagcagagugugugaagguguguguuuuuugaaaagaucucugccgggcgugguggcucaaagcuguaaucccagcaguuugagaggccgaggucaguaaucaagaggucaggaguucaagaccagccuggccaacauggugaaaccccaucucuacuaaaaauacaaaaaucagcugagcgugguggcgggugccuguaaucccagcuacucgggaggcugaggcagagaauugcuugaacccuggaggcggagguugcagcgagcagagauggcgccacugcacucccaccugggugacagugagacuccaucucaaaaaaaagaaaaggagaccucucuaccccaccaccugggaacaucauuggacaagcucauagucaaauuuuacuugauccgauaauacaucaguggggagugaggagggaacaggguugccccuuuuuuugggaggugaaggaaaacgguuugaguuuuuuaacuuuuuguuauggaaaaaugccaacauauaagaaggaaacacagugguauagugaagcccccuguacccuucucccagcuuuguuaucagcauuacaucauucuugugccaucuguuccucaccccaucuucaugaugaugaccuucauuauaguuguuuuggguaaaauugacagacauugaaucacaugaaugcagccauacaauuuugaccagugauuauacccauguaacccaggaaugucagccccauuaugauguaaaacauucccauuucuuuagaaagucccuuaggccccuucccaguuggagguuuggaggguuuuguuuguguuuuaauauucucagagggccuaauuaguuuguguguguggcgggucaccuagcuaaugcugugagcugaaaaacgucugagagaagauaguacuguuguucaucucaaaauaacccaucacaaacacugagcuuucaauucauucagaauauuuuuuuaggaauaaaucuuguaaggugaaagugcuggggaauauguaacagaucuugucuucagaguuacugaaauguaagaugucugcuuuuucucuuuuaaagaauccucgcaaggcucguguaacucggcguuucauuguaguagaaggauuguauaugaauacuggaacuauuuguccucuuccagaauugguaagcaaccauguucagcuguaauuuuaauauuuggacuauuugacagaugugccuuuuguuuaugaccgcuuuuaguguauaacgucugcguugcuuugcgcauuaggccucauaagcauauuuugcucagaucagggaagaagaacaacacugaaugccagugcuggccuucaaagaguaaucaagacugcucuguugcccaggcuggagugcaguggugugaacacagcucacugcagccuuacccuccugggcucaagugauccuuccaccuuagcuuucugaguuagcugggacuacaggcacaugccaccacaccuggcugauuuuucccuuuuuuguggaguaggggucucacugcguuacccaggcuguucucaaacucuugggcucaagcgauccuccugccucagccugccaaagugcugguauuacagguaugagccaccacaccuggccaaaacuuagcuuuagcuuuuuuuuucucccccgcaagacagucuugcccugucgucaggcuggagugcaguggcgccaucuuggcucacugcaaccuccuccccgagguucaagcaguucuccugccucagccucccgaguagcuggaacuauaggcgugcgcagacacccccagcuaauuuuuguauuuuuaguagagacgggguuucaccaugucggcuaggauggucucaaucucuugaccucaugaucugcccgccugggccucccaaaaugcugggauuacaggcaugagccacugagucggccauacguagcuuuuaagauccagcuuuauuuaggugaaaucaacguauaaaauacaccuacuuuaaggguaaaguuugauaaguuuugacagauguauauacaucuguaucacugcagccauccaccaccacagucaagauacggaauauuuuuauguaagacaauguuuauccagaaagaaaacuuuauccagaaagcuuccugaugccucuugguagugaguacccauguuggccccagacagccauuaaucuacuuucuauuccuguagauuaguuuuaccuuuuguagaauugcauaugaaugaaagcauagcuugcuuuuuuguuuuuuuguguuuuguuuuuuguuugagauggaguuucacuuauguugcccaggcuggagugcaauggcacgaucucggcucaccgcaaccucuggcuccuggguucaagugauucuccugccucagccucccagguagcugggauuacaagcaugugccaccaugcccggcuaauuuuguauuuuuaguagagacaagguuucuucauguuggucaggcuggucuugaacucccaaccucaggugauccacccuccuuggccucccaaagugcugagauuacaggcgugagccaccacgcauggccaaaacuuagcuuuuuaauagugaaagcagcauaacuguuuuuagaaaccaugaccauugagauuuccuuuauugaggugaaauucacauaacacaaaauuaaccaauuuaaauuguacaggacagugacauuuauuacauuuaccaugugugcaaccaucaacuuuaggucaaaaaccuuuucaugacucacgaagaagaccucaaacccauuaaacagucacuccccauuuucuucucccucuagcucccagcaacuaccaaucugcuuucugucucuauggauuuaccuuuucugguuauuuccuauaaauggcaucauauaauauaugaccuuuucuuucuggcuucauucacuugauguuuuuaaaguucauuaacauuguauaccauguaucaguauuucauaccuuuuuaaugcugaguuauaguccauugcauggauaauaccacguuuuguuuuauauguucauccacagauggauauuuggguucuuucuaccuuuuugcuauugcaaauagugcuguugugaacauuuguguacagguauuuguuugaauuccuguuuucaguucuuuuauguauauaucuagcaggguaauugcuggauuauaugguaauucuguguuuaacuuaauaaggaacugacauacuguuuucaacagcgauugcaccauuuuacauuccuaucagcuauauaccaggguuacaguuucucuacaucuuugucagcacuuauauuuuccaggguuuuuuguugguuuguuuuagccacccuagugagcaugagguaguaucucacugugguuuugauccuguuucccccaaauggcuaaugaugcugagccucuuuucuuguuuuuuuuuuuguuuguuuguuuguuuggccaugcguauaccuuuggagacauaucuauucaggugcuuugcccauuuuuuaaauuggguuguuuuuuuguuuuuaaaagaauuccuuguauauucuggauacuagauguuuaucagauacaugauuugcaaauauuuucuccuauuuuguggggguuuguuucauuuauuugauacuguccuuugacacacaguuuuuaaaaauuuugaugauguccaguuuauguguuuuguuguugcuugugcuuuuguguuuuauuuuaaaaucuuuguuuaaucuggccgggcacgguggcucacgccuguaaucccagcacuuugggaggccgaggcaggugaaucauuugaggucaggaguucgagaccagccuggccaacaugguaaaaccccgucucuacuaaaaauacaaaaaaauuagccggguguggugguacacgccuguaaucccagcuacucgggaggcugaggcaggagaauugcuugaaccugggauguggagguugcagugagccgagaucacgccagugcacuccagccugggcaacagagcgagacucugucucaaaaaaaaaaaaauaauaauaauaaucuuuguuuaauccaaaauuaucaagauuuauugcuauguuucccccuaagaguuuauaguuuucagucuuacauuuaggucuguaguucauuugaguucauuuuugcguaugcguugaugaagagguccaauuuuauucuuucacaagugguuauccaguuuugccugcaucauuuguuuaauguuuccccauugacuggucuuggcacccuuguugaaauuaauugaccauagauguauggguuuauuucuagacucuauucuguuucauucuucuauauaucuguccuaugccaguaccacacugugucaauuauuguagcuuuguagugaguuuugaaaucaggacaugugaguucaacuuuguucuuuuucaaaauuauuuuagcuauuuggggucucuugaaauuccauuugaauuuuaggauuagcuuuuccauuucuguaaaaaguauuguugggauuuugguggggauugcauugaauauguagucacauugggaaguauuaccaucuuaaugauauuaagucuuccaguccaugaacuugggauuuuuccaucuauuuagauauuuccuucagcaauguuuugugauuuuuaguauauacguccugcaccucuuugguuaaauuuaucacuaaguauuugauuuuuuuauucuacuauaaauggaauuguuuccuuaauuuccuuuuuagauuguuuacugcuauuuauagaaauacaacagauauuuguguauugcuuuugcauaauguaacuucugcugaauuuauuagcucaaauaauacuuuuguggaucuuauucuauguauaagauuacaccaucugugaauagagauaauuuuacuuguuucuuuucaauuuggaugcccuuuaucuuucuugccugauugcccuggcuaggaccucgacuacaguguugacuacagguggcgaaaaugagcaucuuugucuuguuccugaucuuauaaggaaagcuuucagucuucuaccauugaguaugaugguagcugugaguuuuuuauaauaaccuuuuaucagguugaggaaguuccuucccauuuuuaauuuauugaguguuuuaucaugagagguuguuggauuuugucaaauuuuuuuucugcauuuauugggaugaucaugugggguuuuucccccuacauucuucuaauguguauguaauacauauuugauuuuuccauguugaaccaccauugcauucggccauugagauuuuaaucuaggagucuauuaauugaauaaggauucaaaauaaggguuccauauguuguuuuuaaauguuuucacuauuucugaggaaaucuaaauauauuuuaaguaucaauagaagagauguauuuguuuucuucuuuuuguuuuuguaagagugucaaugguugauagaauaaugggagggagguagugaaccagaagauacuaggacguauauuauagggcuacaguaaugaagcagugcuaauggacagauacgaaacuaaagaugaaguguaggaacagcucaaguguagauaagcacugaagcugggcaugguggcucacaccuuuaaucccaacacuuuggguggcggagguaggagaaucacuugagcccaggaggucaaggcugcagugagccaugauccuaccacugcacucuagccuggguggcagagcaagacucugucucaaaaaaaaaaaaaaaaaaaucaguauugugcugucuuuuguuaagugaaucauuuuagaccaucuaaaggacaauugauucucaucauucacccuacuuauauucuauaaaguugccaugaacacuggaauaagaaauacuaaacuauugcugcuagggcaaauaauaggguuagguuccucugagccucugguuacaacauuuucaucaaccaguugacacaaaacuugcuuuauguguauuuuuguuuaaaggugucuuauuuaaugucuguugauucauugcacuaccacucaugccugaacaaagcuucucuaacacacaaauuuucuccauaagggacaucacagcacuaggaguaauagacggcacuuuagcaugacacuugggggcgacucuaaauagcaaaaucaccaacaaaaagcacagaaguccaaaaaaguggcaguaaauaggccaugaaaaggguaguuguucacaggaucagagcugaaacagucgccuguucacccucaccugggaaaacacgugucagguaauucaaauucuucacugcucugcacaugcacauauccgugaugacaggaaaaaaguauugauauggagguugcaaauaaguuuuaauaaguagaugaauuugcacauauagaauucacaaguauugagagucagcuguacauacuuuuuaaucuuaauuuuuuucuccauaauauguucuauauggugcuaaucauuaguauuuuaacguuuauauaacacuuagguuaaguuaaaauacaaauacaaagcaagaaucuuccuggaggaaagccuuucauuuggaguccuaggagagcauggccgaggagucacugaacacuauggaaucaauguaaguuccccuuuuuuaagaacguuuccccucuuauaggagacauguaguuccauucugcuaggccuauauuuuuauaggcacaagacaguguuccuuaucaguuugaagggucacgaaacuuuggugucugucaccucagugagcccaggaugagucuagucagccagaccagggaaccccaucuuccuucugcacuuauaaacucggaguggguagucaugguuugugcucuguuugcaaaguuucauucgaauagacuuuuagugucucuucucuagaaaugguuaaauuuugccuuccaauuauuucuuaaaaucauuaggaauuuccugaguggucuuuucagaaguauucaugacggcagagaaaggauacuguuucugguguuuaaaaaucuguauucuauauaauguguuugugggagguagauacaguuacgcgugcgugcgugugugugugcaugugugugugugucagaaacaccacuggcaugcauucagcaaaaccucuuaaagucccaaacagaaugaggugucauguuuccuuuucugagggaaauggacccagacugcccgcagugccuaguggguuuugcuccuggagccucagggcagaggaagucagccagucuugaacagcugucuuaccaaccaccaugggaagaguuacagaaagcuuuuucuccaaaacaugcgcauaagagcugugcaaccuguguuacagaguugaacuauaaaacguaaaauugccuuacauuaucgacaucccgcuaaccauauagucccagagaaaaauguaaagcagagugaauaucccgggagguuggauggaagcaccuccuccaaggcagacugacauucagcaguuacaugcaccgaggagguaaauggaauaaauggaaagauaaauggaaguguaauucaagcagauuuagcaguacacuacagccuuuuuuaaggcaugaaaauuuuuauggaggaaaaaacuugaacuucacuguuguaguuuugugaaugcuuccagcaguugucacuuugggaaauacugugaggaaauacucacaagcgccugagaguagagagcagaauguacgggcuuuauuuggauccugauucaaacaaaugcuguuaaaagaaaauuuggugagacaaucagagauaucugaacacugaauauuugaauauauuuaacaucaaauuuaaacuuaacauuuaaaaauuguuaaugucuuaaguaugauacuaguuuugugauuauguuuugagagaguuuuuaucuuuuagaaauacacagugcaauguuuauagaugaaaccccaugaagucugggacucacuacaaagaaaugaugagggugguaggggauauaggugaagcaagguuguccuugaguugauaauguuugaaucugggugauggggauucuuuguucuguucuacuuuguucaggcuugaaauuuuucauaaugaaagguuuaaacaugcuuuuuaaaaagggcaggagugcagaguuucucaaaacucugcuggaucuaugaaacacuaaggaaaacacuagcuguguucugacaauccauuaacauggccaucaguaaguaaugauugaaugccuacugugugcccagaauggaacuuggugcugagggcuggacccaaagaugaggaccgaaggaguucugaguggucagaaagauguaggacucaaagcccauuaggucauuuuagagcacauuagguucuucugcuguccaguuggucaaagauuccaucgccaugacguuuggauaaauugacuuaugaaaugcugagaggcaaacugaauacaagaauaaagugcucaaaacuucgauagacuuuuuauuuaucucagugcaucccaugaggaaggccagcuagaccacuguuuuagcgaggaaauagucuuauuuuguaccugugacuacuuuuaauaucgaacagcuuuggguuuuauuuucuuauaauuuauuugucuuugcugugaguuaauuugucauguauaaugaaaugguaaaaauguauaaaaugagacaguuucagaugggccaugagacuacaguucauucagcgauagauguuauaugguuuauuuuuuauuuucauguagauagguaguuugaauccagauauuaacagacaguuuaaugcuguuaaauuuugucucuaggcuugaaguuggccuuuuuuuucuuuaaacuguggaauaacugucacuccuccuuuuccggcagauugaugauauugaucuuaucagugccaacauggagaaugcacuugcuucuauuggagguuucugcuguggcaggucuuuuguaauugaccaucagguggguucuuuuuaaaaacaggagcuaaaacugaaacuaauuucuccauuggucaccucaaaauauaauuuugaaauacgaaauuuuacuuaguuuaucacacaauuuuuauuuaaaugucaauuuuuaaagaaucacucaaaauauuucuauuuagaaaugaucucacauuuaacaaaaagucuuguugcuguuacacguauaauguuuauuuauggcuggaucuuaccccccucaccacauguacacacuguucaguaguuguucuagagaacuggugccuuucaaauguuuaccuagaaaggacagagaauguguauaugucuucauuuguuucuucucagcgacuuuccggccagggauacugcuuuucagcuucguuaccuccccuguuagcugcugcagcaauugaggcccucaacaucauggaagagaauccagguauaacccuuuaaaaacccaaggaaucaaagagauuucagguuacguuaguuguguuacugauuuacuuacuggagaaauuauuugccagacaaaacugguuugcaguuacauuauauggcauucauaggaagaauggcagugaagaagcuauuccugccccaaggacuuggggucagagcuuuucuccugugcuuggggccagagccagagccaaagcaaggcuagcucagauaguggguggagaugcugggaggacgaggggcucucagccaguucugggccuaaacguuccauugguguaaauaagccagucuuuauuugguuaauaguuuuuugagaaaucagcugaagcaugcugcuuuuuuaucugugcaauuuuauaaauauugugaguuuucaccuuuagccuuugaaucaucaguugguacugaggccaagccggguuuaccagcaaagaacuuacucagugggaaaaauaaaaagucuacuaagaauuuaaaauguggccuuuggcuaugacagugccaccuuugcaaagcuuaaaacggaaagggagcagcaggcccuacccgguacaguauuucugaaucuucaucacugauacuaauucagagaaccagaaaaugugugucucugugcucauucauaugcuugcuucucagauggccuggcacgccuaccuucugaucagauacuuuaguuuugggauuuuccuugaauaaaaaaggaaaauaucaagaaaagauuguaaaaauuacuuuacuauaguugauuuuuuaccaaauuguuuaggauaaagaaauaagcaauaaauuuguacccuuugauucuuagccagauuaggaucuugaugagaacaagaggcauugauuguucuugaaagcaucauuccagguuuguugaaagugggauacugaggugagaaggggccaguuagcacgcaccagagacaaagcuugggccuucaggggaguauggguucuuggcucuguuaguauguagaaggauuuguagcauuuuaaauugaugaacuugaucugggucuucaaaaauauuuuuagguuaguacuaucauaaguuucaaauagacucucaaacguauuuuuuucaucuagguauuuuugcaguguugaaggaaaagugcggacaaauucauaaagcuuuacaagggugaguuuuauauauuuucaaccaacauaaaguuuaucugcaccacacuuaacaacuaauggaaaguuuuaaauuucuaggcuugggucaguuugaccagauugcagcuaagaaaccaaaaacuuaguucacucacauugguuuauuuguguaaaaccagaucaucuguuuuaaagaaucgugacuuuguuuuucugaaaaugaaacaaacucauuaauaaaauauuacagcaguacagaagauagaaagaugaaaauaacaacccaacaucuuaccaccagaaauaaccaggguaaacacugaagcaucucuccaugucugcacacacagggaugccauuauauauuauguaauuagaugacuggguucauaccaucuguguuacuuuuuaauaaauuacuaaguuuuaacacaagaaaaagaaacaagugaaauuuuaucaguguuuuuuuuuuuuuuuuuuuuuuuuuuuuacuacacaagagucacuuuuuuuuuuuuuauuauacuuuaaguuuuaggguacauaugcacauugugagguuaguuacauauguauacaugugccaugcuggugugcugcacccacuaacuugucaucuagaagagucacucuuuaagauuccucuguaguuaaaaaaaaaaaaaaauggagguuggugauaucuccaggcacauuucuggucuuauauaaagugauuucacauugcccgaggucuuucuuuuugccuuuccuaagguuaaacaugcuuucuuggucaugaaaguccuaucuguguuccggauauggaaacuggagacuuaacugaaagaaaaggacaauugauaaaugaguacaucacagcuguuccagauaaagaaggggcagagacauuaaaguucugggugugucugugugauaguaacagcaguucuugcaugauuuaugguagagagauauauuuguauugguuccaguuccauugguuugugaaauauuaauaugccaacacagccuagcauauuggagucacuggaaaugcaucagugcuagccuuacaugccuuucacucuaugguguuaaccugccuuuuucuaagucuaaucuccacuuaccccagcuguaucacacuuuuucuuuccaaaauuccuaauccucugucuucacuccccucacuuuuagcuaacagccuggccuuaugcugucacuugggacucugucauauuuccugacaaaucuacacaccuguggguaucugaaccagucuucccuccuguagaccaguaaauguugcuccaacuaccacaggcccuuuuuuuaaggacugagugccuuugcuugucccugcuacuuugucaucagccuguccccuuucuuguguuauuugauuagcagucauguccacuuuaaauuccucuugccugucaccugacguuucccucugcaacuccccaugucuuugcuccucucaguagcuaucaucuccacgucuucacuuacacuggcagcucugagaccuggcuucugcuacugcccuucgccuggacuguuuuuguggaggucuccacugacugcugaauccaguggaccaucuucagagcucaucuucuugauguccccauaguuuucagcacaggugaccacucuuuccuucuuuggacucugcuacacugcacgccuggauuuccuuuuacaucuuugaauggcuccaucucggucuccucugaaggcuuucuuucaacaccuugcucuucaaggcuuugucugugcuucucuuuucuucucauuaccuucuugaagaauugccuucucccacaccuggagcuccacaucguuucaugacaccuguauagagacagcucccagcuucguaucaccacccuggaccacugcagcugcaggucucacacccaguugccuacucaguauccacaguuggaagacuccauggcaccucacaguaaacacacauucauaagggucgcaggggcaaaccgugcugguaucuagaugguuacagagaacaguaaacaaaauagcaaagaggccaaugugacaggaggaaaggagugggaaaucugguggaagaugagggcugggucaugggccauccgcacacagggacuugugagccgugaugaggacauuggcacacagaggaagcccuggcaugguuuugagcaaaaaagugaaacagccuaucugauacccuagcaaaauuacuuuugcauggugugaaaaaauacauugaacagcaguaagaacagaagcagggagaccaguuaggagauugacgcaggugaaaggugauagugacucugaccauguugggagccaugaccugcgaagugucuggauucuggguaucuucugaagggagagcacacuggaucuagcagaaguucauaugcagggugagugagaaagagaagacuccagguagagcucaggggguuuggucagaguaaauagguagaguugcuaaugagugagagggacagaacuguggagaaauaccuucuggggaaggucagcagugguuauguuaagcccaaagugcccaucagacauggagugcagagcagcagcuggauauacaagucugaagugugagggagaguacugagcuagagauaaauguuugagucuugggguauggauauuauaugaagcauuucagugugaagaggucagaaacuagcaaagacuagucugagaaagaguggccagugaggaagaggcaggcuggaagagccuagaguccuggaaaccagggaagaaauugcuuauguaggaggucagccugugacaugccgcugcugacaggccagaccagauaacagaacacugauccuuugacuucguuauguagagguauuaugacuuggugaguaguuucaggggagugugggguaaaaugccugcuugaaggagguuccagacagguggacacggccuagaugacuguuuugaggaguuuuucucugaagagggacuaagaaacaagaugguggcuggagaaagaaauuggucaagagaagaauauuucaguuuaagauuacugagaucaauuucugaauaacaucuggcuaaguauaaaacauccuuucuccuacugguugacaguacuguaucauauaccagguucccauuuguaccuagaucuguuuuuaaacugucucuuccauuccauugguauauuugcucauuccucagacucuuuugauuuugucuguuuuuaucacuguuuuggaauacagguuuaucacuagugucuguuuuuaucacuguuuuggaauauggguuucuccaaaauuauugcuagaaucuuaauuggaacugcauuaaauuuucugaugaauguggagggaaaugucauccaugaacaugagcucucuauuuaaaucucccuuuguguccuuuaauggaauuccuauaaagcccuuguaccuuuauggaaccuuuaaagggaauuuucagacauccuauagauuuuguugcuguuaugaaugggguugucuuuucuguuauauuuucuacuugauuauugcugauucauaagaauauuauuauuuucucuaaacugaccuuauauccaggagucuuucuaaacucuuaguauuuccaguaauuguuucauuguguuaugaugaugugcauggaaguccuguuaucugcaauaaugguguucucucuuuccuuccuaaugcuuuugcgucuuaguucauuuucuuauuuuauugcuuuggucugagucccuaauuuguauugaacaguggcaauaauagcaaacauuccuuccuuauucccaguauagaagcacuucuucauuaaguauaaaacaucaugcuauggguuuuuggugaguagcuuuuauugaauuauuccuaguuuuguuuuguuuugugguuuuuuuaagagacaggauugugcuauguugcccaggcuggagugcaguggcuauucacagauauagucaacacacuauagccucaaacuccuggacucaaccaauccuccugccuucaccuuccaacuaguugggacuacaggcauguaccucugcaccuggcuaaaugauuccuaaauuugaaggccuuuuuuuaaaaucauaaauagacguugaacuuuauccauuuuuuuuacaucuauuaagguaaaucauaaauuugucuuauggcugaauuacauugaaauauuuucugauguuaaaccauccuugcauucuugagaaaaccguuacuucauuauaauaucuuuuucuacacuguuagauuuauuuagcuaauauuuuaauuugacuuuuuauaucuguuuauaauuuaaauggaucuauaaccuuguaccaacuuuacguaacauaggagucaguguuaggguagcuucgguagaugauuuggcuauuuuccacucuuucugcuucauggaagcacugaguaaaacaaggcuugaucguuucuucagaaguugagaguaggucucccacuuuacagccaucuaggcuuggggccuuugguuugggaauaguuguugauuaucucucauauaucuauauuauuuuaacuuuuuauuuauguaaauuugguuuuguguguuuucaucauaguguguuuucuuauuuuuaugcacugucucauugcacuguguucuuacucuucuucagcuucuuacauuuagcuuuugguuuuauuucguauuuuccaauaaauauauuaaagauaaauauuuucaaaggcaguaucuucaauguuuaguucugaguaauuuuuuuguucaauuuuucucuaauuucucacuucucucaucucugagauugaguuugggaaaggaagucaacauccuaugcugguuugccucuguuuucauuguaauagagauaguuauuggugucagguucucccuauagacuguaagcacacaguggagaccguggcuaccuuggugauugcucugucccugggagcuagcccagugcucguuuauccacugggauaagaugauauguuuggcaaagucuuuuguuaaggaauaguauaauagacucugaaacacggcuucgcugaacucaagcuauaacuguguccguuugguuuuaauuaaacucaucugacauucagcaucuaggcaaccagagacagggcauuuuguuuaauuccuucucucacuagcaugugaaaugagaccauuugaucaaaaagcacaaguuagaucuggaccucaggugccuuguauuucuuuucuuuuuuuuuuuuuuucuuuugagacagagucuugcucugucacucaggcuggagcacaguggcgcgaucucagcucacugcaaccuccacuucccagauucaagcgauuuuccugucucagccuccugaguagcugggauuacaggcacgugccaccacaccuggcuaauuuuuguauuuuuaguagagacgggguuucaccacauuggucaggcuggucuugaacuccugaccucgugauccccccaaccuuggcaucccaaagugcugggauuauaggugugagccaucgcgccuuguauuucuugaggaaaauugaggccauuugauucauaugaaaugcuauuuggaaagcaguuuuuuuuguuguuuuuuuuguuuuuugcuuuuguuuuuguuuuuguuuugagacagagucuugcuuuuguugcccaggcuggagugcaguggcacgaucucagcucauugcaaccucugccucccagguucaagcgauuguacuaccucagccucccgaguagcugggauuauagguguccaccaccacaccuggcuaauuuuuauauuuuuaguagagacaggguuucaccauguuggccaggcuggucucaaacuccugaccucaggugaucuaccugccuuggccucccaaagugcugggauuacaggcgugaggcaccacaccugacugaaagcaauuuuuuaauacugugagaauacaugaccuuuaaaaaaaaaaagauacuugauauaugcguuuaacauggucagaauuuacacaggaaauggguuuucaaaguguauugcuuaguuucuacauuaguaaagaacuaaucuagaagguucccccacauuccacaugcucaagauuccaugauucagaccuguagccugcuuuauugagagaucuagcaugauauauuuauauuuaaagaaaggagacgcuaauuaauaauguuccaagggugauuggaaggccaggucagaugaguuuccagaauucacauuauuguaacacacaguagucauucuguaaaggcuuguugaguccuaaacugggaagaugccauugugcuaccuaguacuuuuuauugucauuucauucugagggaaaaacaaaucguuuuaggugaaacaaacuaaaugaaaggaaucuaaaauguuuagcucaguuucaaauagacauauaucacauuuguguccuaggagguaggucaaaagucaaauaauauuuguuguuauaggauaaaauagacuuuaaaugaaccugacuagauaguagccgagaucgugccacugcacugcagccagccugagugacagagcgagaugccaucucaaaaauaauaauaauaauaauaguaguaugacauagcaucucauggcagcuguaguaaaaauacaggauuaaauuuaauuuaauuuaaaaauacaggauuuggccccuaaagaucuaucuuucuccuugagaagcuacagauuuuugugcuauuaauccuaaguaaaaagaaaauaauuuuaauccaaguaaaaucuaaaacuuaacaugcaaauaaggacguuuuucuaucuaaacauauugcuguuagucaaaauauaagguauguuugguauuuguugaguuuuucuuugagacagaguuuugcucugucacccaagcuggaguguaguggcacaaucucagcucacugcaaccuugaccuccugaguucaagcgauccucccaccugagcuucccaacuagcugggacuacaggcgcaagccaccacacucggccaauuuuuuguuuuuuguuuuuguuuuuguuuuauuuguagagaugggguauaauguuguuaauguuagaaaucaucccuguaauuuaugagagacaaaaacugaagacauagauaauaagcaaggaagcauaacauaaacuguagugaguagcuugugaaggauccagacaggaugaaaaauagcaaaugauggagcagagccuucccuaaagugggugaugaagaaggccccagcagcaggcagugcuggagcugggcccuggcacaugcagccaacacagggaagaacaaacauugggggcgagggagcacauggcaagggaaugacaggccaagguggggcccagagggccuguaaggaggcacagacucccuggugggaggcuggggccaugagacccgguccugcacucaggaagccacauugcaggcagacuuuuuuagaugaggaagcacugcccagagugccucguuucccuuucuuuguuggaauuggaaugaugcuucccaucagucgcaagcuucuguacguucacugugccuugacauuguggacuucuaacauuauuucuccgugagcgaucuucaagccuggaagggacuuacagcuguguguguguuucccuucuucagcauuucuggauuaaaaguggugggggagucccuuucuccagccuuucaccuacaacuggaagagagcacugggucucgcgagcaagaugucagacugcuucaggaaauuguagaucaaguaaguauccguugacuugaggcauccccccacaccacuucugcccuugccccaagcaauuuuuuaauguuaaauuuuuaagaaaagucucuuugcccugagagagaagaggguagaaaggaagaugcuggugacccgcucuugacauggaauccuaauccuccagguccuuccuagcuucuggccaugguaacaggcagcaggcccucccauugggucaauguguggcucccuccaaagauauuguguuuuguaccacuuugcauuuaaauauacuuggccucuccucugaaaaauuagccuugcagaaaacucacuugcucaccauuuuacaaagccaggcuuuccuauguguaguugggggaggcauugugugugggcauagcacacauuccuggacggcuggcuguccccgcagcacagcucagggacaguccacucacagucacccugaagucaggaugcucuuguaaacggaaaggaagaccgcuuuuuauaacauaccuaauuuggggagauuuauuuaaauuucuuuaucuuccaaaaguuauuuuacuacuaauugucuaagaaacacaucaccagggaaaacugcuugccccuuuucauccaguagcacuaccccuccagagugcuuccugcccugggcacgcggguuuacagugguucagagccaacagaaguuucuuuaaaagggggaggaagagcagcggaauaaccugggcaggaaggacucaggacgggcagugggaugccacccaccuugcaccccucuuccaaguccugggaugcuggacaucugcuuucagaagaaucuggacuuuuaugugggcugcugcugcuccuuugagaagaaucugacauauaccuaguauguauuugagaaugaaaaugggcaugauucugcuuccuuguccagaggcuguagcuaugagcaaugcuacuagguuucuggggucauaauggcagcuaccaccugucaugugccuuuccuaggccaggcccuguccugagccucauccgccuagacagccucucaggcaggcucuucuaggccacauggcugugcaguauacagaccgggugugcaggcagccucugcugccuagcuggcuucagcuguccuaugucccaaauguuugagccacguaaucuggaauaacagauuuguggagaacuucauaaaauuuguggucuucuagagucaauuacauuaaaaaauaaauaaaaagccccaggaucugagcuuccuaaggaaacaugucagauuaugaaugaucaggcuggagcuacuuaucuugugaggugaggaaaugcagcugauguccccucaggcacaacucuguggacaugaagacucucuagacagggaaaaacaucccacugccugcuuuacugccucauuguuuguauuguaacguuccuuaaauacagacaaacacaaaacuaaguaugacaucuuugugauuagaguucucauacaaauggaaaacuaaaacgcauuuauacauuaaauacaaacuaaauggacaagccaguaaaauucccauucauuucauuaccuucaugaggcaggugaauuuguuuuuuucaauggacuugccccagcgggacagcugagagcuguguucacagagcaggcucaugagcugcaugcgcugguguugggucugaguaauggcuccgccguucucacugagucucuucucgaacugcaucaggacaguuguccacacaugcuucauguugagggacaguugccuccuucagaugccaguguauucauugcauaguaaauccaccucuguucucuuuucauuagauagcaacagcuaaagucuuacuacugcuuuguaccaaagagacgcagaggaggacgugcgaaugaagcaacucgguguuaaaauaccaugcuuacaggaauuagccacguaaugaaagaggaaacgaaaagucuguggacagcucacagaucccaaacuccugucugugggccugguuugauacuggcucucuuaaggaaauccucuugagaguugagugagaagagaacaaucugggguagggaacagaauacuaucuagaaacuucauugauagaaaaaauacauauaucuucccgcuucugugcaucaucacagcuuccauuuuuaaaaucuuccgaaucuuuuguuccacuccccucaucuuuucaauauuugaaggaaagaaaagaaccaugcugcuguaacucuuauuuaagcuuuguagaucugagaggcuuugccaaguuuauguugaguugcucaacaggacacuguuuuuacaaacugagcuauuguuuauaaugucucuuaaccagccagggcuagaaacagagccaguccagauguuugcaggaguucacuuuuccaaguacacuuccagagccuagagucagcgggaggcuguugucauugccuaguaugguuuuuccaucucuuccucgcagccuacgacgugaccccucuucaggcagauacuuuuacugccagagacauggaauaauuguucuuuccuuuacacugcccuuugcucuguugcuauuuuuuuuuaauauaacucacauaccacauaccauaaaauucacccuauugaaguauaucguuaaguggcuuuuaguaucauacauucagcagguugugcaaccauuacuaucucauuccaaaacuuuuucaucacuccagaaagaaaccccuguagccuauuaccuugcucugguguuugugcuuucuuuauuuuaguagagauuguuuucauuuuuucuuaauguugacagaugguuaauauauaggaaagcuggguaaaacuuuguuaacgccagauucugcagugcccaguggcaccaugcccagaugccacauguggacaucguuuuugcuaauaucugaagugcagugguuuuucucugacgcaguucuacugguggugguggucauaaguccagccugcaggacuuugcucgcaccacuuccucaugugcuaacucugcuuugucuaaaugguagucacuagcuagcuauggcuguuugaauuuaaacuaaguggaaauaagaaaaggugcaacugugaccucucaguagcaccagccauaucuccgugugcucagcaggcacacagggcucauggcgacugcugggcacuacacaacagagguauuugucauugcagaaaguucuguggacagugcugccaagguggugguguaguauuuuggugauaucuucuagcaauuauaauuggaaaagugaauuaaagcuaccguugcaggauuucagcguucccccaguuuaauuaccaccaugucugaaguccagguugcagaugucuucuuuuucuuccuacagugcaugaacagaaguauugcauuaacucaggcgcgcuacuuggagaaagaagagaagugucucccuccucccaggucaguugacguuaaaauaugaccuuauuuuuuuccccuacucugagcucuaugaaauacguuaucuuuugaaaaauuuugaaagacuaucauaggcuauggaagaauaucugucauuaaaauauaguacauuaccugucuucugcucuuaaacuagaaguuucuaaaauuuuaacugaaaagcucccaaggacucacugaguacccucucaguuaacucagagaaaugucugggagcccagcaaugaacuugggcaaacugaguuuccaucagcucauaucugccacaucugaaagguggcacaugccacaccaggaguuccugccacaaggaccguccugcagggaagaucggcaguguggggugggggugggcaugcgccucugcugcuccuucagucagcaacacucaguaacauuugagaaaaaacaagcaacaguggggaaaauguacagcaucaagaaaaaacaccaaaagugaaagacuaaugucuuacuuuuaaggagacuggauucuguucacaaagcauauacgagguaguccaaggaguuggccaucccaccacagcacugggccaggcagucacagcagggggcauggacauggucaguucugcccuggggcauugcucaggcuuuugagagcaggcgaugucuacaccaaaacuagagaagugugugugucgggcauccugugggcaucguggcuuuccaucagaugagguggugugugcuuugcucaggguuuucaguggcuuggagaccuccagguucaucugggaguacagagugcaagccgcagaagagcuggagagaaggguccugaggccaggugccaagucagggaggcugcaggagagcccacuggggaguuugaaugcucugccggcccacagugccagaccaggauuuggaagaucacucugguagcagcucaaagcaccuuaaggagccugcccuuuucagccaggugcaguggcccacaccuguaaccucaacaccugggagaccgaggugggcagaucacuugagcccaggaguacaagaccagccugggcaacauggugaaaccccaucucuguaaaaauuagccaggcauaguggugcacgccuguggucccagcuacuugggaggcugaggugggaaaaucaccugguuccaggaggucaaggcugcagugagcugagaucacuccauugcacuccagccugggcugcccccuucauuuuuuauugcacucauccaaagguguaauccuacauccuacguuuacuuguuaguaagaccguaggugcaugaggacgggagccgugcugguuuugugcccucaggacuccaugcacagcauaguacagcucaauaaauaugugucaaaugcaugaaacagauguuuacagaugaacucugggggacagagguagcauuguccuuucaagcuauuauuucuuugauuuccugaaaacuugaaaauuucugccaugccuuagaguauuacagagcuuucacauugcuauugacauaaauacgaacaaucaaacugucguugauuugagaaggauggaauuccugcuuugugccuggcacugccugaagcaguacaugauggacaggaugcuauuucccagcuucugaggcagagcccacggaaacucacucugacugggugugcacuggugugguguaggccgaggccuucaggcugcagauucccugccgcagcaacccaccugccacaguagugagaaagugacugugggcagcagguacaugaauagacaggccuauugggaggacugccaggagagguuuguuuacaaaaauaggcaguggauuuggcucucaggccauauaugguugacugugagugcaguuccucaccucacauagauaauucuuuuuucuguuuguuuguuuuugguuuuuuuuuuuuuuugagacagagucucacucuguugcccaggcuggagugcaauggcgcgaucucggcucacugcuagcuccgccucccagguucacgccauucuccugccucagccucccaaguagcugggacuacaggcacccgccaccacacuggcuaauuuuuugguauuuuuagcagagaugggguuucacuguguuagccaggauggucucgaucuccugaccucgugauccaccugccuuggccuccaaagugcugggauuacaggcgugagccacugcgccuggcccacaaagauaauucuuuguguccuuuacuguucucagcauucggguuguggucacgguggaacaaacagaggaagaacuggagagagcugcguccaccaucaaggagguagcccaggccguccugcucuaggcagagucccgggaccauggccuccugccacacaacacgcagagaggacucaagacucccgcuggccauggaguggccugaaagagagcaagaacauguggaucuuugauaggauuguuaccaaauggugucaguauggaccaauugugugaccaugagaaggaugcuuauuuuuuuuaaaaagaaaacacaucuaaaagcccaggaacugauuuuuuuaagaggaaaacuaaugacaguguauaacugauguuuaaauugugcauuuaguacuauuuaaauguuuucuuauacuaguauuuuauauucuuuuguugucguuuaaaacuggagcuucagugucucuucccucccucuaauaguaaugguucaguaagcacuccuuaacuccuuaguauuucauagaaaaaugacugcaacauuaaagcuaagaggaacacuucaacauaugugguacaaauuuauauugaagaucuaaauaaaccacguauuuuccagucuucguugugugaagcuaaaugguggcuaaaaggaacacuuuuugugugauuauuauaaacuuugcauuguauuugaaucuuagaacuuuuguacacacuaaauauugaugucacaccauuucuaaucugagcauccuuagccagagaauauucauuauacuuccuaagugagcaauaauuuaaaucagaagcuauuuuauuuuaauguaauuaaccuuucuuuacauuucuuauguguucaccucuaaucuguuuuaggaagagaguugguuauuauguugaucccauaauauaaaucauauccuuuauauuuuagaauaucucaaauguauuccuuuuuuguaugguggguuugccuagggacguguaacuacaggcuuuuacuaagccaaggaaaaagagaauuuuucuuuucaucuuacaaauuccagauaucuacaaaagaugugaaagcacuaaaaauaccauuuuuaagcaguacuuuaccuguuuuuucuuuagcaaaccagguuaugugguguaaagguuuguuauacgugccacaauauagcauauaaauauuaugccaucauuccuucucuuguuaaagguagaagaauaaaauugugauuuuuauaaccugugcuuauuacucaaauggucuucaacaucuuuuuaaacaacacauacuuuuugaauguucaguuucuauuuugcuugagguauuuuguacauaugugccuugugauugcugcugcuuuaaaggauaaaguacucuuugggggaugagucugguuuguuuuguuuuauuuuuuaaugaaauaaaccuauauuccugauu

SEQ ID NO: 192419 - RNA, 9012 nt, Homo sapiens
uuuagaagguuaguguugguucuuuuauucgauuaaacaggaauacacauauaucuaccaaagaauagguaagggagaaauaagaacacuaaaaaaacucggaaucguuaagugugaagcauauuuggaguuaaaagaaccaaauauuacuaaguaagcagacgcgggcacgcgcugcauaccgggauuuguagucccuuccggggcgggguacagcgcgccugcgcagaggggccgucgcucuuccgggcgcaugcgugcggcagcggcgccaggacugacugcgccguggaggcugcugcaguguugugaguuggaagcuggggagcucggcauggcgguccccgcugcagccauggggcccucggcguugggccagagcggccccggcucgauggccccguggugcucagugagcagcggcccgucgcgcuacgugcuugggaugcaggagcuguuccggggccacagcaagacgcgcgaguuccuggcgcacagcgccaaggugcacucgguggccuggaguugcgacgggcgucgccuagccucgggguccuucgacaagacggccagcgucuucuugcuggagaaggaccgguuggugagcugccggggcucggcucaggcuagggagaggggccguggugaagugaggugcgguagugggagagcgaaugggggcgaacggagccgcgggggugaaaggagaguggguuugagggaaggggaaagggggaguguggagaugaggagggaguagggagaagguggagugugggggugacggggucgugaggggugaggagaggaagacugggggcgugugaagaguguggaaguaaggagguuggcgauggcgggugaaggugaggagaggguggaugggacagggcugcgaugggagccuuacugguuuggagucgaauccugugcugauaagaaguggcuaggggcugugguggugguggugguggugguggugguacguugguggugguacguuggugguacguuggugguagaguaaggguggaaaaccaggaaggaggagaaggccagggagggcacaaaaguaagggcauagguguggaagcugagaaaaacaguucagaaggccugcggagaagagaagggagaaagggcuuggaggaacuggauucugaauuacccagaucuuuacuggucccagcauacuuugguuugaauaagcuuauaaaguuacaugcggaggcaguuacaucuaugugaagucacaucuggauucuguucuuucaggucaaagaaaacaauuaucggggacauggggauaguguggaccagcuuuguuggcauccaaguaauccugaccuauuuguuacggcguccggagauaaaaccauucgcaucugggaugugaggacuacaaaaugcauugccacugugaacacuaaaggugacuauucagagagagggcaauaggaagauaagcuguuuggauucauucaacaaccauuuuccgaauaucuuuucugugcuuggcacucagcuguguaugagacauccugagcugaauaagaguuuccagcuccaaggaccuccccugcggggagaagacauauauauacaaauaacauagcaagauaugguucauuuuauaauggagaggucugcaagguggauacccagaauagaaaugaaaacaaaagucugccuaggggagccagggaaggccucaccaaauuugagcaaacuuuuaggguagccauaggaguugaguggucagggugcuguggguggggaaugggacauuuccaggagggaacggcaugugcaaaggcauggagaauuuggaaaauucugaugaguuagaaugguugaaacuuggauggucuuggugaucugggagaaaguugugcaguacauuuauaggcucuguuguaaguauugaggccgauauuguaugggacucugaguuuucauugaucguaagauguuccauuaggaaagaaaguugguaaauaacugugauacacccaaaauuuugaaaugcuuucugauacauuuuaagauacaguguagauacuaaaaugugagaaaauaugcguuuuagaauggaaaaaguuggugagauuuuuaauugauguguucagugugggccacuggacuuuguugacaagacuuaucucuggaggcggaauggugugguuuuuccccaaguauacagcugcugauccaugagugauucaggugaugcgugggugaacauuaaaaaccaguuuugcaaauaucuuaaugucuacuagaagaacuagcacauagaauuuauuauucaguugaagcuaaauuuauuuuauuuuuauuuauuuuauuuuauuuuuauuuuugagacagggucuugcccuguuacccaggauggaguacaguggcacaauauuggcucccugcagccuccaccugggcucaagccauccucucaccucaaccuccugaguagcugggacuacaggcacaugccaccaugccuggcuaauuuuuuguagagacggguuuugccauauugcccaggcugaucuugaacuccuggacucaagugaucugccuaccuuggccucccaaagugcuggaauuacaggcuugagccuccacagcuggcugcuaaauuuauuuaaguaaacuuuuuugaaucaauuuuaagaaaaaucuugaauaaagaaaaguauaguguuuaauggauaggacaaaaauugugauguuggcaugcgaauggcuggaguugagaaaugcugguguaagagaaaagggggcuuuggggucaaaucuggguuuaaaaucuuggcuuggccgggcacgguggcucacgccuguaaucccagcacuuugggaggccgaggcgggcggaucacgaggucaggagaucgagaccauccuggcuaacacggugaaaccccgucucuacuaaaaauacaaaaaaauuagccuggugugguggcaggcgccuguagucccagcuacucgggaggcugaggcgagagaauggcgugaacccaggagguggagcuugcagugagccgagauugcgccacuucauagcucugugacuucauagcuuugacacuuuggcuugucgucuuaucuccuauuuccuucaucuauaaaaucuuauagauuuuauaaauggagauaauaaaguguauguuagaggaguauugugaagaccaaauggggaaauguguagaugaaaguucuggacuuauuguugaaucauaagugguagcucccuuccauugucuaggacuuuaaugaguaagcccggaagaaagcucuggucuucuuucuaggauagugcaauaaacuuguggaagauuaugagcaaacagauuaucuugcugauuaugucuggguucccaggggagaacauuaauaucugcuggaguccugaugggcagaccauugcuguaggcaacaaggaugauguggugaccuuuauugaugccaagacacaccguuccaaagcagaagagcaguucaaguucgaggucaacgaaaucuccuggaacaaugacaauaauauguucuuccugacaaauggcaaugguuguaucaacauccucaggugagggggucuagcuuaggggacugucaugucuuugugcugggugcugugucagauauggagaugaauuagaugugagccuauccugaaggagcuuaaaacacaaauaguaagagagaauccuaaccugucuuaaguacauuugagcuguauauuuuauauacuuuauauuuuacugaguccuuacagaaauucuagggguugaugauuugcuucucauuugacagaugaggaucugagggugagagguuacaucaguagucagcuagugugugcuagaacuggaugcaccuugaauuauggcuaauucguacucccuuuuuuuuuguuuuucgagacagaguuuugcucuuguugcccaggcugcagugcaauggugugaucuuggcucaccgcaaccucugccuccgagguuaagcgauucuccugccucagccucccaaguagcugggauuagaggcaugugccaccacaccuggcuaauuuuguauuuuuuguaguuuaggguuucuccauguuggucaggcuggucuccaacucccgaccucaggugauuagcccgaccucuggcuaauucguacucuuaaaguuucaacugaaauaucacuuugccuucagggaagcucccccgcuaccccaagguuagagguagguuagaggcguauuuuauauacuuucuguaggaagcacuuuucuuucuauauuguaauugcauguuuauuugccugugucuccuguuagacugugaauuccuugaugguagggaugguguuugccuuguuuaguguugagucccuaaugucuaguccuguaccugcuccacguaguaggaucuuaguaaauauuuguucuguaaaugaaugaaacuguggagcugaaauucaggucuguucaauucuagccuuccacuaucccaggugaacaaugcaagaccaagugagauagguucugugagugggaggccaggaguuugcugugaaauuccacggaaagaacagacauacuauaugggggguugaaggagggagcuugugagcuugaucuugaaagaugagcagaauuuuaagaauaagcaaaagggaaccacauaacugacaaagcaggugugagugagcaugacuuacuuggagagugguuaggucaggguuguugggggagugguggcagauaagggaaauaagagagggcaugauaaugggaagaugaagucuaauuugggaccagauuauaaaaggccuuuauuuuaugcuuaguaucuuggguuuuauuuuguaggcaauggggauucuauaacuuuuuaagaaaaaucuuuuuauuauaaaacacagauauugaaaaccacauaaaauaaauguauagcuuaaugaacucuuauaggcuuaacucuugugcaaccccgcccaaguugagaaguaguucuuuccagccaucccagaaguccauccaggugauuuguccuaauuacaacuuccuuccacaaaagcaaacacuauccugacuuuuauaguguuucuucauaguuuaucuaccacaugugcagccccuagauacccuaguuuugcucauuaaaaaaaaaaaaaauugauaugucuuuuguaucucuuaaauuacucaaaagaaacuuccgaaaacguagcuguugaaaaaccagacuguuaaccuguggagauucucccaguuuggcuuuugcugauuccauaugcuguuuauguguuggacuguuguguaaagagaugcugcuucucaucugcgauuugguuacccaguaguguaguucauguagggaaggcaggauaaaauuuugauucuguuugucagauaaugauuuuguuuccugcuaccuccaaagaugagcaguuagguguuuuuuuuuuaaagaaucauuacgggcugauguuuuuaaacauaguugguguguuuccaucucuuguaauuguuacgccuguugaagcucaaauuaucccaucuuuggccaauaagaaccucuucaaguugguuccugagaccuuuuuugacauaaucccaucgucuucuguuuuuuugcucucugguuugauaagauguuccaaguucaucuugugcauuucuugccccagaccuuuaaucagaacauucuccaagaagccuuaacauucuggcugggugcgguggcucacgccuguaaucccagcacuuuggcacuuugggaggccgaggcgaguggaucacuugagaccuggcaaucauagagaaacccugucucuacucaaaauacaaaaauuaucugggcguggugacgcacguguauauucccagcugcuuggcagacugaggcaggagaaucgcuugaacccgggaggcggagguuguaguaaguuuagauugcaccacugcacuccagcauucuggacgacugagugagauuccaccucaaaaaaaaaaaaaaaaaaggagccuuacauucuuuuacugagaaaugauacugaaguuaggaauguucauuacugcuggguuggccuaggaauuacguguguguguguguguguguguauauauauauauauuuaaagauaaaauaccuuaugaauucauguugauaacuugcaaucaaaauugaggacuccagggauuuuacuaaaccucuucuauauuacaaauauauuucuuuccucccaaauugaguauucugguucucaagggcacaggggaucauagaauuagaauauccgaugguuacuuauuaccuaucucccaugguaaacauauagaugucucagaacaacaauauuacugcugcuaccaccaaugugaugacuugaaacaaaaaauguuuuugguuuuugcauauacucuuuccauucuucccccauuaaaaaaauaguacuauauguuguaagcaugugcagauguuacauauuauacccucucuuuaaaccauguauaguuuuugcaagaaacuguauauucaguguugagcaccaguccuuauaagucucuagucauuuuuuuaauugaagcucauucucuaguuaagauuccucgggaagcguucaugggaacauuauuccuggaguuuuuauuacaacuuauuuacguacuucuaaaacuuacagauuuuauaaaacguuauugugcuuauuguuuguaucauuauauuugaaauucaguuuugcuggauguaaaaauccuuggcucguuuucucgcuuguguaucuuucuuaaauaugguacuccauuuucuuuuggcauuaaguguugcugucagaaagcccaauaaucuaauuuucuuuuucuuuaaaguccacuaguuuugcuagucucugucucgauguugguaacuuugguucuguagucucagguauguguugugcuuuuuaaauaauguaguucaaaaucuuuuuuuauuucaggaauguuaucuugaaugacaguucuuggugguggucuauuaucuuugcuuuucuucuucaucaucuccuauuauuguuucagcaccacaguccucuucugcaguuugaucgcugucuuuuuucucagcuacccagaacugaagccugugcaguccaucaacgcccauccuuccaacugcaucuguaucaaguuugaccccauggggaaguacuuugccacaggaagugcagaugcuuuggucagccucugggauguggaugaguuaguguguguucggugcuuuuccagguaagugacucuaucagcacuucccuuguuggguacauuaauuuuauuucaucuugagugacauuguucccuccucuuacuugguaauucucuugucucuucuguccacucuguaucauaggcuggauuggccuguaagaacccucaguuucagccaugaugggaaaaugcuggcgucagcaucggaagaucauuuuauugacauugcugaaguggagacagguaacuucaugagaaucuaccgucuuucaccuuuggcagucaggacuucucuugugaucucaucucugcaugugacuacuucaccagcaugaucaugaaugaauuugucuccuuuagacaaguauguuucuguuuugacugucacugccagguggugaggaagcaaagaguuaagaaauaaacaggcaggucugaggaaagugauuuagaaaaauauuuugauuuauuuaaacuuuaaacuacagaguagaaggaagaaaaaagcaccacuuggggucccacucucuaaauaccaccuguuuuaaauguugugauauauuucucuuuaucuuuugccuguauaugaacuugaaaaaauauuauuuaaaauuugaggaauuauaaaguuuuugcuuuaaaaacaacagaagcuggaaauagaaaaaugggaggagaguauucauuuugcaaaagaauuuccucagauuuguuuuuuaauguugcuuuauuguuuuuggaaaucuuugacacucuucguaaaaagauuaaaacuguauagaaaacuucgaagaggaaaguaaagaacuugaaauuccacuauguaaagaaugcaugccccuguuagucacguuguggugaacauuguccagcauccagccaugcagauccuucauguaacugcaugucccugugacgcggagacacuuuccugcucagugaccugcucuugaguuaacccaccugugcucagaaccggcucuguccuccacuggcuugugggcucucugugccuggggguucucuguaaaaugagguaauaguuguaucuaucucaugggauuaguagguggauuaaaccaguuaauacugguaaguacuuaaugaauguguccuucguuuugaacguauugauugguuucucucuauuguuuucuguaggggacaaacuaugggagguacagugugagucuccgaccuucacaguggcguggcaccccaaaaggccucugcuggcauuugccugugaugacaaagacggcaaauaugacagcagccgggaagccggaacugugaagcuguuugggcuuccuaaugauucuugagaggagguuguagggagaggaggccccggcagaggucuuccuucaugugguuaguuuggucuguucucucggaguuggugggcacccuaaauauuuguaaguugguauaaauuguaaacgucucuggucaggcugcgcauuucauucuuuugcuuugucuguguauuagcucuuuccauucuuugcccccagcaugaguuaacucgcguggacucugcagugcgaguagugaccccaccauaccuuguccucuggaccuccugucuucucugcuucugggugcaugguagacuuuguggcauuugauacaacuuggacaauaccuaguuuggagggaggggaauggaagggcauggaaguuuuuuuaaauaauuaaaaauauauauauauaauuuugagaauugagcauuuaauaaacugacuuuuguuauuauggaa

SEQ ID NO: 192420 - RNA, 15744 nt, Homo sapiens
uugagaaaguaguaaggauuuuuauugucaaaacgagaucauaauagaagacacaaauaaauuaauuguucucauaauuuuagacuccagggccucucuauggaaaggccagcuucuuauacagacaagguacuauccaaaacaaaaagcagguauuugagacaguguucaagacaacaagugaacuuguacacagugaagagaaauaaaaagguggcuucuguauuucccucccucaguaagguuauguguugcauaaagggaugaggcucauuuuggugaaaaaugcuuucauacagaaaauuuugaauugagugaccuccccgcacaggcguuccaggcccugaccugaacaaggaaaucaaaguaaguuaacaccacuggcuucacaugaaccucaagacuauaaucuaacgguaucuaccaucuccuuuacuuuaaaaaaguuuaauguccauuuaccuauaccaaaucaguagacuuaauuuucucucuuaggaaguuuuuaaccaaauuacagcuaaauuaaucucacuuuaaagugcaagaaaggcucugcuagaguaguguuuguucuguggcauagaaagaggagcaugccuccuccggcacuggccuaagaggccccacaugaagaacuagcugcaagacagugauccauuaggucugccaaaaagcagggggacucaagguucagccuagaaagaggggucccugccaagucuggcuuuuaccuguacccaggucccaaacaaaccuuggguccccuaacugauaaggcuggagcacagcaccagucaucaacagggccaaagucgucuuagcgagucagugagcaccucuaagccaugauuugucaaugcucacauggauagugguaaaggaauaaagaagccuggguuuuggaacaguacaaacauucuuuaccuaguaagcagugaucaaaguucuuaccuaggguaaaugaugaaaaaaauagguaaugagguccccauacacccgugcugagaauauuagucuaacuuuaaagcaguacaaaauggcuucuuccacacaacaagggcaagcuuuauacuaauguuucucaaaaaccaauuacaucuccagcucuagccucaauuuaauagguuuuuuacuuuacuuuauuuauuuauuuauugauggcgucucguucugucgcccaggcuggaguguaauggcaugaucucagcucgguacaacaucugcuuccuggguucaggcgauucuccugccucagccucccaaguagcugggacuacaggcgcccaccaccacgcccagcuaauuuuuguauuuuuaguagagacgggguuucaccauguuggccaggcuggucuugaacuccugaccucagguauccaccuaccuuggccucccaaagugcugggauuacaggcgugagccaccacgcccagcugauuaaguuuuuaaauauaccuuuccuaugucaaagccaagguaaaaggggagugggaugcaagaaaccaccuuuaccagaaucccuggaaagagggcucuagaagccagugggugugagcacauucaggucacgggguuugagguuaugggcccgugguggcuguuucuuuccuuccaucacugggauguccaucuuggggggcuucaaggcugcuggaucuucagccauucgguuggccugggcacguaucaguuccaauggagagggcuucugggcuccucgguaggccuggguggcaaaacuuccuacaaaagugaaccagagugcaaaugauuucaaaaccaguaaacagcucccgguauacaauaugguaagaugucugccaugcugcucucuuuuuugaaggugcugccuuaccagaaucguacuucugaagggaucucgguccaaagaggcuccacuuaucugacaaguuucuguccuuauccccacuuccagaguccauggugcuaggauuugggccagguaaggcuguggaagaaccagaagugaaccagccccugggaaagaaagaacaaaacauauccuaaaauaccucuuccuucgccccuagaaaugucucacaccaaaagaacagggaacuaucccuucucccucugaaaccacaggcuuaaauacaaccucaucugccacacuagcuuuccugaagcacgcaggaacucggaagggucacaggaagggcucaccugggccucugcuuaggugaagagugcggaguggugcuugggguggacugggcugaugcaggcugccucucuucuuuuguuaccucuccacucuguaacuuuaguuucugcucagauggguaagaagagagacuuuuuaaaaaugaaagcaaauuccaaacagauaagucuaggcauaaaaaauuugguucgcauucuaacuuuaggcagaagacaucuacagguggaaugauuucggaugaucuaacagguaguccuuuguuuuugccauacuagauggaacuccaucuccuuaaaaaauguguucauucuacacuauaucaugaacaucccuguacuuaaagcuuuacacuacaacuuuuacuuucagaaacgugaaguaauuuccccacauucccccagacaguaaaauggaagagccagaacgcuagcugccagccuucuuggccuuuuaagcagggcuuaagcucuugucucgcugcugcuccuaccauguacaaagcccugcccauccucagucucuccaagccaauacucaggcaugcugcuucucuccagcuaaaugcuuccucugaggagccuguuccauucucuccuccuucucucccauagucagccacucuggguucccucagcaccgugagcauuccucugacucgcagucuaguggggagagacaggucuacaucucagcucuucuagagcaagguucccaugcuguuuccucccuccaggccugccacgccacugcuuaacccaagcugcacaccaaacaaugaucacguuugaauuuucucaaacgcucaacagauccauucauguaaguugacaaucuguuacaagauguaaguuacagcuaauauuucagccauccucauguucuacuccuaugggcaagacacagaaagugggucaaccaaagucaauccuaccauuauauaaggugaauugcucaaauagaauucucacugaccuauccuggaaaguucucaguuaagggucaaaggcugccggugccccucucuggaagcuucugucuuguuugaaagcuuaaacuggccaccagcccaaaccugauuuccuauagcaguuuuuaaaccuagccugcaaaagaaucaucuggaaugcucauuacaaaaugcaaacagggccgggugcgguggcucauacauguaaucccagcacuuugggaggccaaggcagguggaucacaugaagucaggaguucaagaccagccuggccaacauggugaaaucccaucucuacuaaaaaucagcugggcaugguggcgcaugccuguaaauccuagcuauuugggaggcugaguugggaggaucacuugaacccgggaggcagagguugcagugagccgagaucacaacacuguacuccagccugggugacugcaaacaggccacaguuuuauauccacaguuuuauauccccacccacaggccaccagauccggguuauuccucguuauguauaauguauaccaugauucuuuccugcgucgugugcucuccucaccuugcccucaucauacccuguucagaacucuuaaaauaaagcuuggaacaagccuggauucugacccccccuugccuaaagaagacagcccaaguuucuuaacuguaauugugucucuucacaaucugccccugacuuccauaugagccccuucaggagccagauuuccaggcugcuuuggaaugaggaggaagaagccaacaggaaguaaggcaucaggagacuuggguucggguacuaugacuggcugaauagauggccucgaaccucaaucuccucauuuacaaaauauggagaagagcaucugucccaaaaggugauugugaggaugaaaugaaugcaagugcuucacaaucauaaaacacuauccaguaugaagcggucuucacugaaagaaagucauuugaaacuauucauucaaauacuuggcuaucacuaaauuaacccuuaccaaaauucuucacuuauagaaaugaaauagcaaaaacauuccaauuccacauuugauuuuaacuuguuccuuuccaguuaagcuguuaccucuguugaggcugcccaguucuccccaagauacuccacauuugcuuuaugauucauaaaguacuccuauguauauguaagcugaggcucucacuugauucugcuaaccagaaguagcaaaacagacaccccacuguauagguggauaagcaaaaacuacgaggcuaagagcucgggagcgagacuaacuccacagcccccaacuaacugagcugguaacuucaaaaccacagccacauuucaagccaugaacacugaagguuuuguuuuuucaaaguuccuaagagcuuacguggagugcuucggccacucgaagguacuuggucuccucgguggugaggcccuugugggguguguagccagcaucucucagcccugccugucgcucaaaaugcugaaugcuuuccugggucuguucugggaacagaggagaugacagucaugcccauuccccucucccaucacaaaauaaggaggacaacauggauaucuacuauucuccccagaagcaagagaccacacugaccauucaaagaagaggagacuuuccccagagaggcaccacagcaguaauucugaaccucacacaaaggcucucuagccagaaggaagccuucccucacaccaagcugaagagguuauuccuaaagggacagcugaagaaccuugaggacaauacucccacccuccucuuaguuguacauggugacauuuucuuuguauuuagaaaugcaacauggggcuggaugcaguagcucacaccuguaaucccagcacuuugggaggucaaggcgggcggaucaagaggucaggacauccagaccauccuggcuaacaaggugaaaccccaucucuacuaaaaauacaaaaauuagcugggugugguggcaggcgccuguagucccagcuacucgggagucugaggcaggagaauggcgugaacccgggaggcggagcuugcagugagucgagaucgugccacugcacuccagccugggcgacagagcaagacuccaucucaaaaaaaaaaaaaaaguuacauugugcuaaaagaacaaugaauaaguuuuguaacacugcuagaacacauucucaagcuuguaaaauaaaaguaguguugcugauucaacagaugugaauaagaaaaucaaaguauagguggugcgugauggcucacaccuguaaucccagcacuuugguuggccuaggcgggcagaucacgaggucaggaguuugagaccauccugcccaacagagugaaaccccaucucuacuaaaaauacagaaauuagccaggcgugguggugggcgccuguagucccagcuacuccagaggcugaggugggagaauugcuugaaccugggaggcgaagguuguggugagcugagaccacagcauugcacuccagccugggugacagagugagacucugucucaaaacaaaaaaaaaaaagaagagaaaccaaaguaagagucuggaccuuugguucuuggugaauucacuaggaauugcccaggacaaacugaugcccuccuggagaagauaaacaagggcuucugacuucaaaaaugagccaaccaaggagaaccucuauguaccuuacccugguaggggcacaacugcugacaaacagagccauguaucuaauuguuaacuucccacagcaaccuguacagcccuccagaaugaagaaguuuaguuagcuuguuauaagguuaaaaaaaaauccaaguucucauaucagguuucauuaggaugaccaaucauacauucuuaagacuaaagacacuuggaccugguccucuuccugguagaccaacuuugagcuguuuaaaaaaaaaaaaacaaaaaaaaaaacaaaaacugggguaagugggaaaugcccggauguuuccccuucuccagcagagcuugaaacaguaacagcagcagcugccgccacugagcacugggccuucugauccucaccucaaccugccagugaaauuccccauuuuagagcggggcagucucuguaguuaaguagcuugcccaaggccacagugacagagcugggaacaugagaucauaucaacaaagcagcaggaaugcaccuaaaucagauaagaugcuuaacauuuggcaaaucuuccacuuaauaaauggagcuucaauacugacaugauucagcagccaaacugacauuuuuuaggauaagguaaggcgagcguguugcaguaucaucuccaaucagcuuguaggaagccucaacucuucccugccccuauggcacucuacucugagggugaagagugcuuacuugugaucagagaauucaugaugacauggguagcuuuagccuucaccacugggaccuuguccacacugucaauggcugaugacagggucauggcaggggaggguagacuggccucuccuuccuccaccuguucaagagagguacaguacagaagcacuuaggcagggcaggggagucacacaccuaaacuuacuccuuuggggaggaaguuacugaaauaacauuaaucugguaagugaggaaaucauugaagggaggaguuggucaucuccacccagcuagauagguauuauccauagagacaacaaagaaagacauuaggugaauaguuuacauuuauaaaggugggaaagccagaauuugaagcucugacgucuacuaccuucccagacuaugaucuuccgauauacuauaguacuaugcccuaagaaugcagaagaaaugcuuauuacgaagcacugaccacaucccaggcacuaugcuagaucuuaauugaugagagcacuggcuaagugguucugacccugugccagccauuagaacagacugccgggcuccaccucagaguuugauucaguaggucccuguuagucugggguggaguucaagaauuucuuucuaauaaauucccagguguuacugaugcugccggucccaagaccacaccuugaggaccacugcucccaagguucaaguaauggucuuuugaaacaaacaaaaaaaaucuacuuagcuccucauuuucaaccugcaagagcuggcagccuccaccuucugcaaucgaaacaccugauaccuugcucaggccuagcagggaggagagaacaagacuuauucuuuauucugugcuugucuggaagaacugagaagaaaguaagaugguugaaaaggggggacagauaaaaaguaaugaaaaauguuguauccuuacuacaaaacagaauuuauaccuuuaagcugugaccuugaguaaaacuugagccuguuuccuuacugggaagacgguugauuccuaacauggggagaguuagggcaaaugaauaggaucgcaugcaaugagucaagcggagcucuccuuuggagcagcuguuccaagccaucagcuguuccagcugaggcccagaagaaaucuggaagcccgcucaucccuugccuuguggagccaucagcaggguguguggccuggcaagcaccaccagaagcccugcucaccuccugcucuggacccuaaagcccauugcucugacaucacaggcaagcugcagcaggccuuuucucccugcacuuuugcuacuuguuacauggaauacucucccugaacaacugacugggucauauuucaguagauaauugauagagggaauaucccccagagcuguaggggcacuuucuuagaaaggagcugucugcccugaaagucuguuggaggcggggggaaaaacacuccuuagaaauuaucaaauauggcucuacuaagagaaaguuaagcagggagccugcagucauaauaucagcuacacagcuaauacacaaugugccaacccuuuacauccccugacugaauccccacaacaccucuaugacauaagguauucccaacucucagagagagacacuggggcucaggguaaaguugugugcccaaggucuugcuagggcagaccaccugggacucacacccaggccuauuucaguggacccuuacuguguacugccugucaggcccugagcuaccauguggcucaaaguucagagaaacuguagcuacagguuaaacagccuuacgugaacuuggcgggccuacuuuauucaggcaacagucuagccuuucuuguauucuugguggcuggagagucagaggggagagagucccugaggucgggaagcagaggcuccaauaaugcgaaccuacgaaacuagacugcacgaaggacugugagguauguucggaagggccuuaggaaggaggcaguucuuacagaggauggccaugggcaaaggcagcugaggcuggagguacagcaugaggacagguacagcauguguucaagaaagggccaauuuuuuuccccaaucacaaaaugagcaguuuuugggaaucuaugccaggccaucggcuggauccugcagauaagaguacaaaccuagacauggccccuguccucaggaagcuaauggagggcgagaaagcaaugcagggaugacgacggggaccaugguaccguggggagcucagagggagaggugauggccuuaucaggaggacggagaugucaggaaaacugucacagaagagacuuuugagcuaagacuuaaaggauaccaguuuucaggcaaauggagugggagaaaaggugagaggacaggauguggauggcaaacauccuaaacaaucagggcagugugagccaaaaacugacaggcagaaaauacgcugcuaagugcaagaauuuuagguaacuugcacaguucaagcacuggguaggggagcuggagagaugcaggcaggacuuagaucacauggacuguggaucaugcugagcuuggauuuagcucuguggggaauaugaagagucucaggagcagacaaggccauucuaguuuugaauuaaaaagaaaaaaaaaaggagggagauuuaaaaaaccaucuauuggguacacuguacacuauucgggugacgggugcacuaaaagcccagacuucaccacuauacaauucauccaugcgaacaacaccucggguaacccuaaagcuacugauuuuuuuuuuaacaaaauaaauaaaaucuuaaaaaaaaaaaaaagacagcuauaacugaggcacagaaaacacauacagggagugguugcugcccagucccaugggcacagggagccacugaaggcuucuggagcagaggaaggacaaagggguugcguaugccagaaauggccagcagggucagauaccuuggcgaggugcugauacuugcgcucuggaaucacuggcuuccaagggacgcugcccauguccgauggaggaggagucaugggcgcaggguccucgaggguaucaucauagcugacugcccggcgguauaucccgaugggcagggacaucuugccuagaggcgcacuagccucaagagcuaagaacagagacaccugucaagacagguucagcaacuggacauacuagcagcuuuaaauuaaucuacaggaaggaaagcucugaaauacucuuguucuugaacagagcaaaauagcuuguuuuggaguagcuaaucccauccaggaaaggcagugguaccaaucccuuccucuaugccugacaccuugggugguccacuuaacccacucagccguccuaauccuuuuuuuuuauuauuuguuuagagacacagucuauguugcccaggcuggagugcagcggcacgaucacggcucacugcaggcucaaccuccugggcucaagugccucagccuagcgaguaguugggauucuaggcaugugccaccauguccagcuaauuuucauggaucaggaaaccugaaguuccauuuaaagguacuugaccacaacuucaaaguacaguuuggaauccaaucccaaccaaaccuaucugauuucaaagcuguguccuuuaucccacagaagccacccccuacugcaauacuaaggcucucaguucgugcaagacugaggauaugaaaugaccgaggauacgaaguucucauucccauuucauagaugaggaaacuaaggccuagggguaaagugaccuucccaaguucauucagaaaauggcuaccuggggcucagccaaggucugugaauccucuaccuuccuuuccucaccaaagaaaacaccagcacuaacagaaauguuuguggcaucacuguucuguaugauuuauuuaaacaguagagucacuuuccaucacagaaauuauugacaaccacucucacaaaucaccagcugauccugccauuccuguccacuggaacugacgcccagcaugucggguugugaugcagccaccccauucaagggcacucucagcugugccagaccagggagccaaguucauuguguuucguuugcuaauccuugcauaucagaacuaauguccagaaccuaccugaaagguaacauuuuccuguggcuaaaaucauauaauaacacucucuaagacaucaaccugccuggcaauaaguccaaaaccacaaaagguuucauuuaaacggcaaggggaccaagcagcuaucauuauuauuacuauugcuauuaguaauaauuaacaaaaccauagaaauaaaaagaggauuagagguugccagggaguggguggggggagugaggauacgacugcuaaugguacgagguuuuccuuuggagguuaugaaaacguacugcaguuuggaugggugugguggcucacaccuguaaucccagcacuuugggaggcugauguggguggaucaccugaggucaggcguuccggccuagccaacauggugaaaucccaucucuacucaaaauacaaaaauuagccaggcguggugguacgugccuguagucccagcuacuugggagacugaggcaggagaauugcuugaacccaggaggcggagguugcagagagccaagaucgugccacugcauuccaaccuaggcaacagagcgagauuccaucucaaaaaaaaaaagaaaagaaaagaaaaugugcugcaauugaucguaguguuguuugcacaacccugugaauauacuaaaaaucacgacauuguucacuuucagugggugaauuuuaugauaugugcauuacaucucaaacacacacacaagcaaauaauaauuacuaagucuuccuccuugcuagacaauuacaucccucaucuuaucuaauccucaugaagcagauauucuucccauuuucaaauuuuccauuuucacaaucaacuugcccaauaucaccuagcuugaaagagugugcugggaacuggaacacagaccugagccggugcacacacucugcaugcaacacacuacaaagcauucacugaaugggcacaauccuauggcucgcgacggcuacacggaguuugugguaaucacagcaacaaugaaagacaaacuaaaacggagcugaugauguuaagacuagagauggaucuauauuggggaauacgggagacuuggggagcaauuucaaaaacaucuuaaagacucccacugaacagccauccuaaaacaaauaaagucagcuaguauuuacuggaaaauauguucauauaaagacagaccaaaugcauucugggcaguaaauacauauuuaucacugauuuuuaacuccuguuuuuacauauuuuguuuaaucuucacaaccccgagagauaggaaccaucaucuuucuucaucaucauacuuuaccgagaaucagaaauuaagcgauucagauguaauuaaaaaucacuuuccuuucucauaaaacaauucaaguagucaucaauggugucaauaacccagaacuugacucauuaaggguugcugugagcauuuucaugauuaaguucaaucugccauuuaagcaggcuggugccuuuuuaccaagacuuccaucccaccuccccaucacccccaaaaaggugaguuuaaucacuuugguacauacuacaagaacugcacaacuuauucugaauuauuauuugauaacuaggaaaguaacaaacuugucauaauacccuuaaaugaagugacuauucucuuuaaguuaaaguuucauacuauggcugagcggcuaauaaaauauuuaaaugaugccaaucuaaggcuaggcgugguggcucacaccuguaaucccagcacuuugggaggccaagguggaaggaucaccugaggucaggaguuugagaccagccuggccaacauggagaaacccugucucuauuaaaaauacaaaaauuagccgggcgugguggcaggcagcuguaaucccagcuacucgaggcugaggcaggagaaucacuugagcccaggaggcggagguugcagugagcugagaucacaccacuguauucuagccugggcagcagagugagacucaaaaauaaaauaaaacuggcugggcgugguggcucacaccuguaaucccaacacuuugggaggccgaggcaggcagaucacaaggucaggaguuccgccgggcacgguggcucacgccuguaaucccauuaccuugggaggccgaggcgggcggaucacaaggucaagaaaucgagaccauccuggcuaacacggugaaaccucgucucuacuaaaaauacaaaaaauuagcugggcaugguggugggcgccuguagucccagcuacucgggaggcugaggcaggagaauggugugaacccgggaggcggagcuugcagugagcugagaucgcgccacugcacuccagccugggcgacagagcaagacucugucucaaaaaaaaaaaaaaaaaaaaaggucaggaguuccagaccagccuggccaauauggugaaaccccgucucuacaaaaaauacaaaaauuagcugggugugguggcgggcaccuguaaucccagcuacuggggaggcugaggcaggagaauggcuugaacccaggaagcggagguagcagugagccgagauugugccgcugcacuccagccugggcaacagagcaagacuccaucucaaaaaaauaaaauaaaauaaaauaagccaaucuaguaaaucuaaauacucgcuugguagcagagauuaaccauuaauauauaguuccgauaaaaugguuucugucuagcuuaaaacauuaauaagggcaaaacaugauuuuaccaaaaagaauuaaguuuaccaggcacuucugguugucuugaagccauugaaagacugggauccaggugcuuuuucuauacagaauuccgagcugagucccugccaccuaauaaaauaacaaagggcauuuucuuauggugagcagcaccaaugcuguucuucuggcaggcacacagaauugaacggcuuguuuacaagguugaaacacacaugcaagagccagugggugacaaacaugccaaugaaaaaagaaggauaaagucaaacgucucaccacaccuguggcugaucuuaacaccugugagaugacagagcuaagaugccauacauggugaaaaagucaccuuaccacagugaaaugaugugaugacuaagcggacagacagauguuaaugaggaacaugguccagcugcugcaaaguagcaaagcuucccaggaagaguccauccagagguucuaauaacaacaaacagccagcauuggaacagcccgucagagucugccaaacacuuguuuauuccccacaacaaccuugcucauuucauuuucuuaacucacagcaagcggcuagauacuacaguagggaaauuuguucuuuauagcuaacacuauaaacuauuuacagcguuuaucuugucuuuuaauccuugcagcaagauggcaaagcagauauuauuuaucccaaucccaauuuuuuuuuuuuuuuuuuuuugagacggagucucacucugucgcccaggcuggagugcaguggcgcgaucuuggcucacugcaagcuccaccucccggguucacgccauucuccugccuuagccucccaaguagcugggacuacaggcgucugccaccacgccuggcuaauuuuuuguauuuuuaguagagaugggguuucaccgcacuagccaggauggucuugaucuccugaccuugcgauccgcccaccucggccucccaaagugcuaggauuacaagcgugagccaccgcgcccgaccccaguuuuuuuuuuaagcuaucucuuacagaaaggcuaucccaaauuuaaagagaaggaaacuggccgggugcgguggcucacgccuguaaucccagcauuuugcgagacccaggcgggcagaucacuugaggucaggaguucgagacuagccuggccaacauggugaaaccccaucucuacuaaaaauacaaaaauuagccgggcaugguggcgggcgccuguaaucccagcuacucgggaggcugaggcaggagaauagcuugaacccgggaggcggagguugcagugagccgagaucgagccacuguacuccagccugggcgacggagugagacucggucucaaaaauaaaaauuaaaaaaauuaaaaaaauguuaaaaauaauaauaaagagaaggaaacuaaaaaucagaggaguuaaguaaauuuguccacggucacagauaagugguccgugcgcaagguagguaguuucaugcccaguuuacaggggaguuaaaacgagggccugagaaaguuacucuuguuuuucagcuugcuacaccgucccucuaucccgauaggacucagacagagcaaacaaguuauugauaguucuucacuaacgagcaucgcaaaggccgaauucagccauccucccaguccagggagcauucccgccccagacacguccccuuccccuuucccuuucccugugcccccaccccccagcucaccgucccucugccucuccuucacaauauacaagacggugccgccaggauacgaaaggccggcugcuucacccaccccuccaggcuaagauuagggccaggacccuagccgaaggcgggguguggggagaugagguugaggacaagccgcgggggcucgggcugggcuggucccacgaagcggaggggaagcccguacgggagcugcagggcauucccggagagaagccccauuacggagaccccagagagcggagccagggaggcaagaggcgacccagccgagcucgaagccgggaugaaggguuaagaggugcggggagaggggaguggcuuggaggggccccgagaucgggccucgccggaagcgccccuccugaucgccagagaacgcagccccaagggagggcccaggcccgccaucuguucaccugugauccugcugccgcgggacugccugcggcccggaguccggcacuaaaaagguuccgagggcccacgucucccgagaggcuguggcgcagucuggacccaagccauugugagagcggcggcgauuucgaagguccccaagacccacuagguagcaguaccacccagcgggcaggcagcacugcagauaaagccuccggagac

SEQ ID NO: 192421 - RNA, 61720 nt, Homo sapiens
ugaaguuuuugcuauaaaacauuuaauguuaaccuacaauacaauguaaacuuuuaugaaaaaaauuuaaaguacacuagauuucuucaguaaauuaucacaugacuauucaggcgcaguacaaguuggggcacugcauccuuuguggauggauuuccguugcuguguuccucacaaguccuaaaaaaaccaguuguagagcggagcuccuuguucaagcaccggauaaugaugccccugauuuugcauucuggggguuaucgcuccuucucagucauuuucugaaacucuuugcuuggccuuggcaccauuagcaauuuucacaacugcucaauugaagguucuagguucuuuuuagcuuaguuuuuaagagacaaguguuauccucuggccaucucuuauucaaauaucaugguggaggcaagcaaggagaaagaaguauuugcuagaggaaauucugcagaaguggaagaaaagaccagaagggcuccacugaggguacaaauauucaacugacuccaaucgagugucuuugcuuggucacuucccaugguuauucagcucaaucuacaacuucagucgugggagugcagaacaaaacuugaaacaagugcuuuuaguugaugauuugccauuuggaaacaacagcugaaauaucccagaggugauguggaaacaagagcaaaugcuugcagaucacuggcuucucagugucuucucccucgcaggucucaucaaaaucccaaaaguccuuaggaguaacacagauuguacuggcauuaagugacaaaaugugcagccuguauuugacugaggaggaaaggaaauggcaccuaggcagcagcgcuagggucagcaaggagaccggccuagggucucaguaaagcagaacuguuucaaaugggacuagaccggggcaugugcuuccggugaauccucuugaaaccuaaaguaaaugggaaggccgcccuaacaguuguacugacauaaagggagacccuucuuaauauucuggcagcugacuuccuucacugaacaacuauuaucaaaaggcgagaggcauaaagugcacacuguagaauaagaagagacugaauuaugauggaaaaaaaaaaucguaacuuccccaaagagguguggacaguguaccuagccucacaaagguccuuaauacccuccugugugcugccagggaacagcugugaauuccagauggggaggaaggcucugacuuaaguggaaaaauuccucugcaugguugucagcaggaagguuucacguaagguuauccuuauguggagaacauggguuauccugcuguucacgccagauacauuuuauugacagcagucagauggugauuccacucaucuggccuugggacagcagaaaacgaaguggaagaacaauagcuggccagggacagaauuaaauuuuccuagagaugguguucuagacagcuaugccaaggccacugggaauuucucaggcucuccaaguuaauuucuguggggugccuuacucugccaugugggauuuaccccaacaacugaggacugcaguggauaguaaccauauaauugcuaccaaaaacagugguccuuagguuuuaguuaagcaagagagaaagccuugagacuacaacuccagcaaguuaggcuuuauguugaucugaaccccccgcccucacagcauucuaggaacuacaguaacgucagucgguugcagugguacaacgagccugcaccagucuagcuacagaacacuuuggaauacuugucagagcgcacuggcaucuguuaauacauggccugacccauguacccauuaccauaaacucaaccacagacgagacauccagagguuaaaaaaaacccuauuacuucaacauagcaauagagagaaaggauaaaagcugccuccagaagguggcugcaucagaaaugaaaaugugccuuccaauagauuacacaggcugggaguucugucuuggcucccuucaaggccucugguucuauccuuaaaacaauaauacacuuccacugagacaggcagggcacucuccugugguucugcuggcuccaccacaggcccugcuaguccuuuggaaaggcaccaggcuuggcaauucaggaaagcccagggcuggggggagcagcaugcacaugucagaagaggaaugaagagcugcuauccuuugguucagaccccauaaccaccaccugguacagacuccaaggaaaagcugcaguuguguguaaaggugaguuccaccacauacauagguguaucuuuacauauacagccuuuguggggccacaaacccagauuuccucccacugcuccaaguggggugcacaggugguaagaaaggacagcaagaguuggaccaaaaagaaugaccucucugggaacgugagagggacaauggcagaaauaagcacaaaccagcccggggcacuuuuauuacacuauugugggcuaaggagcccagggcauaaacucauggguuuaaagaauuggcucuuuaucaaauaaaggaaaaaaauauauauauauaccuaugucagccucauuccuuuggucauuacaaaacagaaauaaaaguuauugaaaacuugugggcaguucaaggaacaucucugcuucucugcucugugcuuucucuucccucucuuccccagaggcaggagaagcaaguccucaggagaugcugcaaguagcugguugauggagguuuuucacuuuuauuuuucauaaaagcaagaaugaaugagaacuagugggaauguccccuucccagcugggacaauggaugggucgaaggugaagagucucuguucacuggaaggugcgugcacagaggccacaggaagggugggcuugccaagcggguacguuuguugcuaaccuugcgcgcacacacagguugugacucuuacgggcagcaugguuucugauccuuccuaaggaugcagcagucuuuuaaaaaaaauauuguauuauaauaauaauaauaauaugaauuucucucucuuguuuuuuuuuucugacuugcuguuguuuucuuuuuuccccauuucuuuuagggacugggguaggaggggacaggaagaaaaaaaugucauucgucaguuagguccugaacaaaaagaacuucuguguggcugaguccggccuccuguagcguagggggauugggccacuccucugaagggaugcagggcagcacucgccugggaaaauuggcuucaaucugaaacuuuucugggcuuuccuucaaggagaauaagaagucguggauuaccugcagaggucauauagaaaaagaaggguggugagaaaaacagaaauacacacacacacacgcacacacgcacacacaacucugaagucaaauauaccccaacucuccccaggaugacucuauaggaaagaaucacauuacacuggaauucuaaucuuuucauuucccauggcauauacauggggcagcccuuuuaaaagaaauuacacaagcccaacacuaguccuacucugaauuaaucugucucuucuuugaggugucugauaaaaugcuaacuuagaaauaaucacaaaguuacagaaaaguuggaaguauaggacacuuaauuuuuuucuuuaacucaguugagagugaagugcuaacuguaagacacauggccucaaguauucugaggugaucacggacuaauaggacaaucuucuauauaaccacaacuuggcucucaaaaucaggaaauguaacugacacauuauuucuauaacauauuauuauucaggcccuauucaaguuuugccaauuaucuuuuauauaauagcaaagggauccaguuuuuuuuuuuuguuuuuuuuuuuuuugagagagucucgcucuguugcccaggcugaauggagugcaauggcgccaucucagcucaccacaagcuccgccucccagguucacgcuauucuccugccucagccuccugaguagcugggagugcaagcgcccgccaccacgccuggcuaauuuuuucguauuuuuagcagagaugggguuucaccguguuagccaggauggucucgaucuucugaccuugugauccucccgucucggccucccaaagugcugggauuacaggcguaaagugcugagauuacaggcgugagccaccgugcccagccaaggauccaguuuuaagcccaucaaucaacguguggauaaagaaacugugauauauauauaugauggaauacuucucagccauaaaaaggaaugaauuaauggcauucacagcgaccuugaugagaguggagacuauuauucuaagcgaaguaaguagaaauggaaaaucaaacauuauauguccucacugauaugugggagcuaagcuaugaggacgcaaaggcaaaagaaugauacaauggacuuuggggacuuguguggaagagugggaaggggugagggauaaaagacuacaaauaggguauaguguauacugcucgggugaugggugcaccaaaaucucacaaaucaccacuaaagaacugacucauguaaccaaacaccaccuguuccccaauaaccuauggacaaaaaaauacaauacaauaaauguguugcaccucauaugaaucuccugucugugggaaugcccuccuuacccugcucuggcucugacaaggcacaguuaaaauccuuagugagaagggaggcaguauuaggagaguccaggaugcuaaaacuuaaacugugugugagaugccuguggaacaggccacugucaucucucccugucccugcucuguggccucuccaucuagcauucuacuucuaacaacaauucugccaaccucauucagaucaaccccaaagaugacgaacauaccauucaaguuauuuuuccuuuuugggaggaaucuauuccauuuucuuuuugauacaucucucaaaaugaugaauucucuggguuuuauaccccucuguguaaagcaguccuucauuucuuaaacuuacugcucuagggaacuuuuuuuuuuuuuuuuuucccagacaggucuugcucugucgcccaggcuggagugcaguggugcaaacacgacucacugcagccucgaccucccagguucaagcaauccuccugccucagccucccaaguaagugggauaacacauguccaacaccaugccugguuaacuuuuaaaauuuuuuguagagacagagccuugccauguugcccucuucagggauuuuuaaagggcuauaauccagaauuuaaauaguaaauccauguuccucuugucuaauccauucaugauuuuauaaacuucucauauuuuagucuaucaaccuaacucguuuucaguuuccuucucucuuugcaauucccauuaauguucacucuuucuuaacaugcaucaauuagacuuacaccaaguauucuugguaugaaaccaauaugagugaaaaaaauaccuuuuuuuuuugagauggagucuugcucuguugcccagguuggagugcaguggcaggaucucggcucacugcaacuucugccuccugggcucaagcgauuuuccugccucagccucccaagcagcagugacuacaggcgcgcaccaccaugcccagcuaauuuuuguguuuuuuguagagaugggguuucaccauguuggccaggcuggucucgaacuccugacuucgugaucuacccaccuuggccucccaaaguaggcugggacuaugggcgugagccaccaagcccggccagagacaggguuucauuaggcuggucucgaacuccugaccucaggugacccacccgucucggccucccaaaguccugggauuagaggcgugaaccaccaugccuggccaaaaaaauacuuucugauuucuuuuuaaucucugcuugagaauaccuaacacuuguacaaacuuggcuuuuguuuuucuuuuuuuuugagauggagucucacucugucgcccaggcuggaguacaguggcacgaucucggcuuacuguaaccuccgccucccagguucaagccauucuguauuuuuguauuuucaguagagacuggauuucaccauguuggccaggcuggucucgaacuccuggccuuaagugauccgccugccuuggcaucccaaagugcugguauuacaggcaugagccaccgcacucggccggcauuuuuuauuacuaauggcaaaggguugauaaccaucaggaaacagauuacauuacuacuagaggucccuuuugguuugcaauggacagaaaaauuaguucugggcuuuaucucuuauacauuuguuuaaaacaaagucagcugccucuuuuaugaccacucaugggaccuggagauuuuucugcagcguaccccuuuuaucuuagcauugcaccacuuuccagagcugagcauuaccuacaaaucugucacuccuggagauuauuuacaaaggaccaaguucacaggaaggugauacaaggucuuuuuuuuuuuuuuuuugagacagaauuuugcuuuuuucacucaggcuggagugcaauagcacgaucuccauucacugcaaccuccgccucccagguucaagcgauucugcagccucagccuccugaguagcugggauuacaggcccacgccaucaugccuggcuaauuuuuguauuuuuaguagagaugggguuucaccauguuggccaggcugcucucaaacuccugaccccuggugauccgcccaccucagccucccaaagugcugggauuacaggcaugagccacugcacccggccgacacaaggucuuuaaggguacuaaaaaacacuacagcauuauuugguuuuauguaauuaucucugugaauguuaaauuccaggccagcaccaccagggcacugcuacauuacacacuucuuuccaucucuaagacccauuuaugaccaagcauuucucuuagacuaaucucauguggccaugauacucuuuuuuauuuuuauuuauuuuauucauuuuuuuuuugagacacagccucgcucugucgcccaggcuggagugcaauggcgcagucucgguccacugcaaccacugccucccggguucaagcaauucuccugccucagccucccgaguagcugggacuacuggcacucgccaccacacccagcuaauuuuuguacuuuuaguaaagacggcguuucaccauauuggccaggcugguuuggaacuccugaccuugugauccgccugccucggccccccaaagugcugggauuacaggcaugagccaccacgcccagccgauacucuuuuuuaaaaaacagcuuuuagugaggaacccauuuaaaagucuucaaggaucaaauaguuaaugaaugguugguucccuuuuggccacaagccuauucuguuccacaguucuaacagauuuuuccuccaaaacucucaggagaguaaauuuuuguuagguuuuucauucuuuuuuuuuugagccagaguuucacacuuguugcccaggcuggagugcaauggcaugaucucggcucaccgcaaccucugccuccugggcucaagcguuucuccugccucagccucccaagucgcugagauuacaggcacaugccaccacacccagcuaauuuuguauuuuuaguagagacaggguuucuccauuuuggucaggcuggucuugaacucccgaccucaggugauccgccugccucggccucccaaagugcugggauuauaggcgugagccacaacgccuggccuagguuuuucauauauaguuuuaucuaucagaauuuuuaggguagaaauuccauguaauucguguguacaauagcaaaauugcuagugaacaugaaagcuaaaauacauacacaaacccauaguuaagaaaugggacaccaggggaaggaaauuaacgcuaauaaccaccuacuacaugguggauacugugugaggcgcauccacauuaucucaauuuaaaaauccaaaguuagagacauggggccaggugcaguggcucacgccuauaaucccaacacuuugggaggccgagguggguggaucacuugagguuaggaguucgagaccggccugaccaacauggugaaaccccaucucuacuaaaaaaaauacaaaaauuagccaggcaugguggcggcuuccuguaaucucagcuacucgggaggcugaggcaggagaauugcuugaacccaggaggcagagguugcagcgagcugcgacagugccacugcaauccagcuagggugacaaggcgaaacucugucucaaaacaaacaaaguuagagacauaagcacuucccccaauauaaauaaaugcauaaaugagagagaaauaaaacaaggaagcuauuugcuucucucuuaacaaaauguuucauaacuuuaauucuguauuaguucucugagucuuacauucuguacuggccaauaagcuccaugaauuccaaaaccaugucucacucaucuaaaugaucccuagaguaucuggcucacugcaugacauaccuauguucaguuuaaacuuaucagagggcagauuacaguucuaguucacuaaugggaaaucugaggcccuguagaauuuugcaacuugcccaauguuguccaguuaaacaggcagaagcaaugaauguacuaaccagccucaccugacuacagugcauccucuuuuaauuaugagguuuacccuugauuauucugagcgaucagggaaacugcagaauccacuauagcuauaaauuugcaaaggcaacauacugacucucaguuuaaauaaauuuucuuuugguuacaaauaccaaaaauaguaguuaguauuuaagcacuuacuaggagccaggcacaauguuaagaauuuaauucuaacaacaauccuacuagggagugccuauuauuauuauuauuuauuuuuuuuuuuuacagggucucuguugcccgggcuggagugcagugcugcaaucuuggcucacugcuaccuccgucucccggguucaagugauucuccugccucagccucccgaguagcugggauuacaggcacgugccaccacgcccagcuaauuuuuguauuuuuaguagagacgagguuucaccauguuggccaggcuggucucaaacuccugaccucaaaugauccaccuaccucggccucucaaagugcugggauuacaggcaugagcacggggcccagccgugcuuauuauuaaacccauuuuacagaugaagaaauugaggcuuagaaauuaaauaaacugacuaaggaaacacaucuaguaacccuggaagaaugaaaauuugauccucaugcugugaggcucuugaguuucugcuuuuaaugacuuccauguggaaaugacaaacacuaucacauggcuaucauauacauaaaguagccucagaaaauggggcuuccuuugggcugaguagaaagagagagacaacugcauccaaacugcaagugcacuuauauucagauaugucacuucagugcuuuuaggucacuggagacagagcuuuuccuacagagcagggguucuggugggauucugaagccaaugcaggaagacagcauggaagagccucccaucuucaaacacacaagucuuuugagggacuuauguaagguaccuuuuuuucuuagcagagccgaaacauaauuaaacaaaaacuuaaaaauugcuuugaguuggaaacuagaacugaaggagccuacagcaguccucgguacucuuccugguguccacggauggcauacccaucucucucucucucucucuguucccuguucaucagagcagcagauacaccaacaccacucucaagagucaguaaaagcuccaaaucuauagcccagaugcuacauacacuucacagaacuuaggugguccuuacuguuagagacugugaaaaguggaaucgucucucuacucgagaaucauuagguaauuugaagaugaucuugacacuuucagggucaucaggggaagguucagggggcaggcauuccaacuuccuuuccuuuuccuccuguaaauucugcagagacacaaagcaaaggugaggcuacagcucaagaaauaaauacaaugaccauguagcuuuauuacgcagucgucagaagaaaaauuaaugacuaaguauucuaagaaaaaccucucaggaauagucaaaaacaaccuaaauuuaaaguacaauugcaucucauguauucuuuauuaugucuagguauuuauuugagaaaaaggagaaagggagcagggugccaugguaugugccuguaguuccagcuacuucagaggccacagcaggacuucuuaagcccaagaguuucaggguguagugcuccaugauugcacuggugaauagccacugcacgccagccugggcaacacagugagacccugucucuuaaaaaaaaaaaagaaauaaaaggaaaugacuaaaagacacugguuauagguaagcgguaauacauaaucaaauaagauaauguauaucucagucugauugcuagggaacaaaaacaacaacaaaacaaaacaaaacaaaaacaaaaagauaaugaguaaaaugccaaaucagcuaauacugguauuaagaaugaauauuuagggccaggcaugguggcucacgccuguaaucccaacacuuuggaaggccaagacaggcagaucaugugaggucaggaguucgagagcagccuggccaauauggcaaagcccgucucuuuuuuuaaauuuuuauuuaaaaaagaaugaauauuuaaaugguaugaaaaauuuaaaucaccccuaauuccaacauguuguaauuuuuucuuuccuuuuuccuuuuuuuuuuucccucuuagucuguuuaagguggcuaucauuuuuuccuuucacacuuaagaccaagauggcaaagucucggcaguuugggaaccacagggaguaaagccacacguccauuaccugccgccgucucuccucugccaacuuuugcuguugcaccuccuccuccuuccgccgcuuacgcucccgcuccucccguuucuuucuuucuuucuccuggucagcucugagagaggccagguaggccucauccugcuguugucucagcacuugggucugguuucuuucuucccugugaauagaucaaaagcaagagaagaaaaacagcacucucacaaaguucuguguuuucuuauauugaaaucuucuguguguguguguguguaaaaauguugauauucuuagcagaugacgauuucacacugccauaagggauuccaaaagcagagcguggcagaaucugaauaagccaccuuuuuucucaguuuaauuuggcagaaaaggaaacagcaagcuuuccucuccucuuuuaaaauaaaacuuuuccccuaauucuaacaaaugugacacaguacuguuauuaugaagggaucaucaauaucauauuuuacaaguaaauaccauuuugggugacugcauuuuuguacugaucucauaaaaccaaaacacacacauauauauccauacacacauuguagcagaucugaaaauguagaguuuucagagucauucagagaaucacuaaucaaagauaaaacauuauaacauuuggcauaucuccuauuuucucuccaacaaauuucuguuuucucuuagccaaaauauuuagccaaucaaaauaguugaacagauuuuaucuuuaaaaauuaagauaaaauuuacaugcagugaaaugcacagaucuuaaauguacaauucaaugaauuuugauaaauguaaccauguaaucaccacuccaaucaagacagaacauuucaguuaccucggaaaguuuccuguucuauacauuuuuuuacacaguuaaaauaacgcuauuauuuacaggauuuugaucuugcauuuuucuuuuuuuuuggagacagggcuagccugucacccaggcuagagugcaguggugcgaucaugacucacugcagccucaaccuccuaggcuaaagcaauccugccaccucagcuuacaggcgugugccaccacgccuagcuaauuuuuguauuuuuuguagagaugggguuucaccauguugcccgggcugaccucaaacuccugaguucaagcaaucuucuuaccucagccucccgaaaugcucggauuacagguaugagccaacaugcucggccugauucugcauuuuucuaauauguaacaagcauguccccauguuauuaaaaacuuuccauaaaauuuaaguuuguuuaacuuucuugagggcaaguuggcauuacaaaucaagagccuuaaaauauacuuauauugauugucucacccagaaacugcacuuccaggaauuuaaauuuuaaucuaaggaaaccaucacaaauugcaaaaaauuaucucccuauaugcuaauuauaauaguaacaaaccgaaaauaaucuaaaaauccaacgagaguggccugguuaaauuaugauguauuuagauaauggaauguuaugcaguaauuuuuaaaauguggcagaauauuuaaugaugagggaaaaggccgugauauauucuuacauaaagaaggguuguaaaaaaguauuaucccaauuuuacaaauaaauguguacguauauagggguguguguuguguauaaaauuaaaaaaauuuauaacaauguucaaguggugguagguuuaucagugaucuuaaauuucuuccuugugcuuuuuugugguuuuaggauuuccuauaauuaauguacauaacuuauguaauggagaggaauuauaaccauuccacuuuuuuuuuuacaucgaaguucuuuauauuauauucagcuauucuaaaugccacaauauacauucuugagcacagaggccugucuuuguuuauucauucauuuauuauuuuuuaaagacagaguccugcucugucauccaggcuggagugcagaggcacaaucagagcucacugcugccucgaacuccuggccucaagcaauccuccugccucgggcucccaaggaccugggacuacaggcauguaccaccaugccuagcuaauuuuuucuuauuuuuuguagagauggggucucgcuuugcugcccagucuggauucaaguaauccuccugccucagccuccuaacgugcuaggauuucagguguuagccacugcacccagcccuugucuuuauuuugaacaucucuaagaacagauuaccugauauagaguaauuuaggucaaaguauguaaauauuuugacaauaaaugggcaaagcuaaaagcuaauagcggccugaugcacagaagaagucaggauugguagagccccagaggucagcccuccaaauuuacaacuggucucucucuguuccagaagggaacucccuuguaccuuucuaggcguucugacaccagguaagucugguuagcauccaugauaaaugucaguugguuaaugaggucaucagguugaaugaggccuucuagccgucccaccacagucauccuucgauccuucagcauaaucauggccaggaauggauagguguucucucguaaagccugugagacugauaaaaagacccaacagaucaagggcaggacuugacggugaaaaagaucaacccuuagacuuuccacaaugagugagagagaacuguuuuaauccugguuggggaagacgagagguaucauuuagucuccgcuuuuuccccgccuccuaguuucuuucuuuucuuuuuuugagccagggucucacuauguugcucaggcuggucuccagcuccugggcucaagugacccucccaccucagccuccugagaagcagggauuacaggagugugccaccaugcccaguuccucccaguuuuguaaucuuuuguuuuuguuaucaauuugcaugccuaucccuaggugcuugacuagaauaggacaggcuuuccugguggcggugugguuguugugaugaugccagggaaggcugcagaguuuaaggauaaugucuacuugaugguacaaaaaggaucuauaaagaaucuggcacaguuuuucccuguacaagggcucaaaccuaaaagggcacaaggcugcaagucucagccugaugauacugauaauaaucuccaucaucauuuuuuuuucucuugccuaauccuuuccuuauccuuucuccccacguaacuuuucuccacccuuaaaaagguuaguuuuucuguuccaaagaagcuuauuaauagaaaguugaggcugggcugguagcuccaccuuuaauccuagcacuuuugggaggcggaggugguuggaucacuugaggucagggguuugagaccagccuggccaacauaaugaaaccccaucucuacaaaaaauacaaaaauuagcaggguguggugguacgcgccuguaauuccagauaggcgagaggcugaggcaggagaaucgcuugaacccgggagguggaggcugcagugaacugagaucgcaccacugcacuccaaccugggugacagaguaaaacuuggucucaaaaaaaaaaaaaaaaaaauugguguccaaaugaccaagauuuuuaccauaacagaguuuuaccuauguuuuccuuauggugugaaauaagagauuuuauaaacuucuauuaaaaaaaaauccuuaccuuccuucuauucacaaccucccuucugcccccugcaaagccauauuagaauggcaaaacgcaugcaggaauuuggauguuuaaaaacaauuaggcuuaagauucagacucugggaugcagggacaacaucugccacaucuuugguucucaagacauggcacaguauguggcaugcuaauauaaacucaaaaguugcuggauagaaguagccacaaaaaugacuacauuuuuccucacuggaugccuucguaucuuuuacuaaccgucuaaaaauacuuaucuccaaagaagaguuauugucagcaaagaucugaacuuuccaaauccauaucagcacucaagguacucaaacaacugacucacuaugcaagggcucuguuaaaaucguugaugaaaagaauaaacucuucaguaaaaagcccauuaagauuaaaagcaagcugcuagccaagacuggguauuucuaugaauguggcaggcuuuggcaaugcugaaugugaagaacgggcuuuagaaucuggcagacccgacuguacgcuacaacuugcuaauuauggcggggcacaguggcucacaccuguaaucccagcacuuugggaggcugaggugggcugcucacuugaguccaggaguuugaggcuacauggugaaaccccaucucuacuaaaaauacaaaaaaauuagcugggcgugguggugcaugccuguaguuccagcuacucaggaggcugaggcaggacaaucgcuugaacccaggagguggagguugcagugagccaagaucgcaccacugcacuccagccugggcgacagagcaagacuccaucucaaaaaaauuuuuuuaauuaauuaaauaaaaacaaaaaaaauaaaacuugcuaauugugugaucuucagccaguggcuugaacucucugagccuauuuccuaaaccauaaagcaaagguaauaugaccccccaucucucaggacugcugagaggauuaaaugagacaauauaaaauagcaacuagcgucguaucuaccacagaacaaacacacuuguaauaaauggcauggcaugucuuuccagacuauuccaaagauacuccaacaaucucaaugaggcagaagaaacauaacuuaccccuguaucccucagguuuguuuguagagcaugcccagaagagcauccuaguguuuauuagugaaauaacuucaggugcacagaguguguugcuguggaaagguaugaaaaggauaugagaacaacuugcugacuauaaacugucaccagaaagagucagaaaagagaaggaaaauaaucaauccacuuaccgacaaaacucaucagaguccuggugaucaucuccaugaagauaaaccaaaagaaagcgaagcucccuuuuggcaucguuaagugccugugagaaagagaaggucacucacuauuaagaagacugugccuugagcuuauauuuaagcuaaggguccuaauggauacaguuauguauuuaggaacaaaaggaaaaauaaggaaaaaaggugagcaagaaaucagaaaauuccugagcuccuaccuucacaccccuggcauuguucucccuauagaaacuccacgcuaacaagcuuuaaugaaaagguuuuaguguuguuaggauucaaacuuaacagacacaugagaguagacaggcuuacaaacacagguucccaacaaaccacagaaaagucagcugcacccacagucuaaggaagauaaaaacaggagaaucugaccauaugaaagggaggugagaauuuuucuacuucacagcuacaacauccuuguaaguaaaaaauaacugcgaagacaacccugaucccaggccacauaucgaguaggaaugauggacuguacgauccaaaggcauucuaaagagcauaggguguaaaagacuuucaaagacaaggcuagcgccgaagacuccugugcgugcuccugcaugugcgugcuccugagcacauuacacuguacgacugcugacauggucaaggguggucuacccucaggaucauagcagagaggguacacaggaggugcucaucucacucaucucuguaucucuagcacugaggacauugccuggcauacaguaggugcucaguuuuuguugaguguggugggaacagccagcgaggagacugacuaugauaaaaagcagaugugggaaaaugaaagcaggaagcaagggugagcauuuuucuuucuccagauagauucaggaauucuggaggcugcauaauagaacccccuuuugccuauugccacagcauucccauaguuuucccuauuccuguaguguuaauucuauguauuucucuggcaaacuagagauauaccaaacacccacagaacucuaauuuuuccuccccugaauggugaggucuugagucaaaggucuacauggcugagguugaaugagaugugcuacccugagucuauggucuauguccuuauucaauucugugagagaucaaagaagauguaggcuuugccuucaaggggcuuucagucugguagcagagauuagacacgaacacaaaugauauaggaaagaauauaaaauugcuaucaauuuuuaaaagcuauggaagaacaaagggaaagauuaguauucuagaugaugagauagggcaggacagggcacaacaaucagggauagcuguaaguggggcgugacauaaucuaguugaaggacuggcaagauuccaauuagcaaaaaugugaggaaggcauuccacguggauggaccggcaaaagcaaaggcacagagguaggcaaguacagacuauguucagggaaugagucagcuggaacugaggguaugguaaaauaaguuaugcagaaaagaccucaaaagaagggcagcauuagaucaaagaggggccagcuaaaagguuuggucuuuuuuauuacccaccccuauaagcagugaagagcuaauuaagguuuuugaguacaagaaggacaugaucagugcugggcugugcucuccuuugaggauagaaucauuucgguaaguuggcaucuauaugguuuauggcacugaccuggcuguacguucccugguagaagacagggugugcccucccauauuucucuucaaaagagugcauaaaugaaacaauguccccaacggggucagugacccggcugcgagggucaggccguauaaaacgaagagcaaaccuggggaggaaggaauaaauaucacaugaauccagcuuacuacagugcauaucgagugggccaauuuguacagauuccuguaacagagccagaggcacggcaacaaagggaggugaacagucugugaguggaccaucaaauccgagaguagagucugguucaaaagccauaaagcagcaaguguuauucuauugccuguucaggaagaaugcaaacuacugggauuauaaauuccaacacuggccuacauaaauccugaguauuuuuuguagaacaauuuagggcuagaaggguuuggaagggaagacacaguauccaaaaagaucaugugucaggcuaugcacccagacucucuagaauggcaccgucuaaguacuguagccacuagucaaauguggcuauucugaauuuaaaucuauuacauacaauuaaaauucaguuccuuaguaaugcuagccacauuucaagugcucaacagccacguguuuaauggcuuucauacugaacagcggagauacagaacguuucuaucaucacagagaguucuacuggacagugcucuagaacagaggucauuuucugguuguccuacuugccccuccuucuccuuucuguuuuccugggauuuuaaauauugaguucacaaccccaaacuauucaacuuacggauaggaacuucaaaucugaaguugcgguuaugacuuacuugcucuucaaaggggcaaguaccuuuugcuugaugauuuaugguugauggcaaccauggaggaaguuauaaaacugcuccacaguacccuggcagauguggaguacuggcagcucuuguaaagugaagaauacauaccuaaugguaccacacaucuguuucuaaagggccuacccuauuuguauaguaccauuuauuuauccuuuggguuuccagagaaggcaacaggacagaggauaauguguuaccuaacauuaaacaagcugguuggaugauacagcugcauuaaaauuaguaauacaugccgugcauauuuucccuagaaaagcaaacaauauucauuuacuuaaaacguuuucagcacagacaaggugauuaaacugugauacuuuuccuuaacaaaaagugagucaauucauuaucccaacaaauucccccuguguauacaauucuacuuggaauuucucccgaguaaucaaaccaaauucauugacaacaacguuccagagcgaauuaaaagcacaaaauguaguaaguuguauacgugggggaaugguuagaaauucaucagaagacugauguuuuaacuacuuucuuugaaauuaagcauuuuagaauucucucuuaaagccuuuauuuuuuuuuccucauuacacaauauucccacgaucuacacaauuuaggacaaucagcuuuuuugauuuuuuagaaaaaaacagagaugucaacuuaguuuucauuaugauuuuaaagauuuuuacauguucauucuuaaauaaaauggggauggaaagaguacuaagcaauuagugaucaugaagaauguugcuaaaccaagaaagccauuaaguagacagccucauaaaacaccaaggguccaauauaaaagguacuaucugacccuuguacuuaugcagcugcuggacccacaacuucagccucugcucccuagaggcaggguaaaggcugucccauauuugaagggaaguacagggaaccuguacuuccagggaaggcccagacuacauaucccagcuccaucugcuggccuggaugcccuugaacauuuaaguuccccauaaagccuagacauggcucuggaccagauaacccaagccugacaugcuaagaaguugugccccacucauuuucuuuucuuuuucuuuuuuuuuuuuuugagacggagucccacucucucacccaggcuggagugcaguggugcgaucuaggcucacugcaagcuccgccucccggguucacgccauucuccugccucagccuccugaguaguugggacuacaggcaccagccaccgcgcccggcuaauuuuuuguauuuuuaguagagacaggguuucaccguauuagccaggauggucuugaucuccugacguugugauccgcccaccucagccucccaaagugcugggauuacaggcgugagccacagagcccggccaguugagccccacucauuuucuggccuuggacccucuguagcuuccaaugaugagcucuuuuaaugguacaugaaggaagcuagaagaaaggugaagguaugaagcaaguggguauauacauaaaaggguuccaguguuugcaaccuaggggcugccagagcaaagugaaaagguaccgaagcugccaggcaugguggcucaugccagcaaucccagcacuucgggaggccaaggcagguggaucacuugaggccgggagcucaagaucagccuggccaacaaaaugagacuccaucucuacugucucuacuaaaaauacaaaaauuagccaggcgugguggcgcaugcuuguaaucccagcuaucugggaggcugagguaugagaaucgcuugaacccaggaggugaagguugcagugagucgagaugguggcacugcacucuagccugggugacagcgacagagcaagacucuguuucaaaaaaagaaagaaaaagaaagaaaagguguaacaggagugucuagggagguccaacuauugugggaggaaucaagggcaaacuggguaaucucagagcaagagaauuuguugggauugugaguagucagguggaggagaaguaguugaggaagaaaguucuaaggagugugaagcuaggagaugauagugguuagaaaggaaaggguguggacaucaacuaggaaguguagaggugacaaauauggugggggggggagggggagacaaauaaauauagucagacugguuuuugcaaacaaaagguaagacuaauuuaaaaacaauuccauuucacaaugccugccaaugcuucaacaauuuaaaauacuuguauguuguauuaaaagacaguucgggaaguguauuccaucucaugacaaauugguaagucaacauugauagagcauaaagcuuauuuuggccuaaauuucagcuccaaagucuuacuauucuacuaauacauaaauccaaagguacauaccuaaauauaucaaguaucguguaauagguaaaccggaauggaagcauuaucaaguaauaaccccauccaagcagccccugaaaguccaaaaacaaaguuagagacaauucucucaaucccuaauauuuuaucaaauggcuaggucagauuuucucacucuuuuugguccuuccaugugauuuguuccucuaaaguacaguuccuucuuccuggccaccucauccuucuaagugccaccaucuuuggucuuauuucaucuuacuaucauuuuuuuuugcagaauuuuuguauuaaaucugcuuuaagguccagagcuguaucuccugccuguaaucccagcacuuugggaggcugaguggggcagaucaccugaggucaggaguuugagaccagccuggccaacacggugaaaucccaucucuacuaaaaauacaaaaauuagccaggcaugguggcaugcaccuguagucccagcuacucagggaggcugaggcaggaaaauugcuuaaacccaggaggcggagguugcagugagcugagaucgcgccacugaacuccagccugggggcagagcaagauucugucucaaaaaaacaaacaaacaaauaaaaaccaaaacugccuuaauacuuauuuuuggcagcuacuuauagacuugucaaauucaauugcaaauuaauguuccccaaaugauacacacucauucuuuccuuuuuagauuuacacaucaaaauaugguauacagaaauaagccaggcuugguggcucacgccuguaaucccaacacuuugggaggcugaggcggauggaucaccuggggucaggaguucgagaccagccuggucaacaugguaaaacccugucucuacuaaaaauacaaaaauuagcugggugugguggcucacacuuguacucccagcaauuugggaagccaaggcaggcagaucacuugaggucaggaguuugagaccagccuggccaacauggugaaacccugucucuacuaaaaauacaaaaauuagccagacgcgguggugggcgccuguaaucccagcuacucaggaggcugaggcaggagaaucgcuugaaccugggaagcugagguugcagugagcugagaucacaccacugcacuccagccugggcaacagagggagauucugucccaaaacaaaacaaacaaacauaaaaaccuaaaauaauguauauagaaauagcaagaaagauaaucacuauuacuaaccuuggacauugguauauaaacauuaaauaauuauauuaaccacaaugacaaauccccauauagcugcuuaucuuaguaauaaugcuaauuauuauugcuguuauuaauuauuaaaacuagcauacauccagggcucuauaguuuauaaagcauuucauaguugucacauuguguuaaccugagacacuuucugugucuguggccaggaagcucuggagccccauggcugacaugggaaucugcuacuguacuucagaaaaccacagagcacuacuuagaaacauguuuuaaaacaucaaguaggccaggcacagugccucaagccuguaauuccagcacuuugggaggcugaggugggcagauaacuugagcucaggaguucaagaccagccugggcaacauagcaagaccccaucucuacaaaaaauacaaaaauuaaccaggaugguggcgcacaccuguagucccagcuacuuaggaggcugagguggaggacugcuugagcccgggaggucuaggcugcagcgagccaagaucaugccacugcacuccaggcugggcgacagagugagacccugucucaaacagaacaaaacacaacaaaaaucaaguacuccacaaaaaggcuugaugauggaguaaauucuaacugcugcaauguuaaagggaguguuuucuuaggauucuaaaugcaaguauaaaaguauaagaggugaguauaaccccagggguaagaaaaagaaaguccaagcaguucuuuagaauucauuaucaguguacacaucugacuuccuucaauagacugugagaaauugaauuugaaaugggaagacuggcucuuuauucaugucuggaucccuaguagcaagauaccagguuauuggaguacucuuaaaugucugucaaauuuaagugaaccaccuccuugcuacuagcccuucaaggcuaauuucaaagacguggccaaagcuccuacaaagauuccauauacuuccucaaaacugguuuaagauuaaguaaacugaagcaacaaagaacuugaguaaacaaauuguaacuuaagaggcagaaaacacucuccaaauaacuggcaaagaaaagaaaaaaaaaaugaguaguuucuguaacaauuccuugaggaaucaaggcaaaauaauacacccaacgggccaagucuaacuaacagguuuacauucuaaauauuuguuuugcuccugucacagggagaucaauauaaccaaguggauauacuuauaaauaaaaaagggggaaaucccagcuaugaaauaacuugcccuugguugaggucuugagacaacauagcuguagauccuguggucagcuguauuaaccugcaggggucgugauggagguggguugaaaacacuagguacgcccucuugcucauucaaucuguccuguacagcagccugagaaggaaaacggaguggcaagaguuucagcgaugcucaaaucaaccaacaacaagaggugaggcaacuauugcgugguauuccaaaacaggauggucaugaauacaccaaaaggucacugaggagugcaccuucaugggccuguuaaccggcuguacuuggaggcaacuggaguugucacuccagaaugcauccaugguagaggagacgaggaaacuugucuggaagcuacauuuaugcagcaagcguacugccuggauucagauggcauguauuauuuaggguggcugggauauaaagugcuucacuguacaaucccaagaaaagccauccucagagaauacaauguaggcaguaccccuggaguuaugcagugaagcaguccugaugaguggcaucugaugaaggggcuugcagcagagaaacuucggucugauccaagcuccaucucucugaaaaguugcucaauguaugagccucaggucaggcgcgguggcucaaaccuguaauccuaacacuuugggaggcugaggugagaggauugcuugagcccagagaccagaaauucgagaccagccagggcaaugaaacgagacccugucucuaaaaauaaaaaauaaagaagaaaaaaacauaugagccucaguuuccucaugugcaaaauaaaggaacaauauuucugaguuaaucugaaaauuuaaugaguuggccacacauaaagauccuaauacaacuccugucagacuacugauauucaguuuaaaaaauucauucccuccuuaacucuguccuugaaauagauauuugucucaauguaguaaaaaaaaguugaccuuacccaaagagaugucugaucuuucccuuuugggagguaaucuaugucagaccugauaagcaugucuuuguuacuagauuuuagguugcagcugcaacacccaguagucuuagggugaaagccggccaugccagaaagaccaaccaugugguuuaggguggggaacuuuggacaacuugguaucaguugacuugaagacugaguucaaccaugugggcagccaaacaaaucaaucgugccuauguaaugaugcccuaauaaauucucuggaagcacugaagcuucccugguuggcaauacaguagucccuucuuauccacagggauauguuccaagaccucuaguagauuccugaaaccauguauaguaccgaacuugaaugcugucauuggaagcuauuucucuucaugucuuccacucaaaaaaugccuuuuccaucuuaacuaugcacuuaucaugcacuguggcugcaauuuuugcagaagugugaccauaaaacuacuaugaauuucuuuuucuuucuucacaauuucacaaacacaagcuagaucuuagcaacuucagcauauaauuuuuuuauuuccucauuaagucaggaacuuuaaccuuuuuuuuuuuuuuucuugagauggagucuuauucuguugcccaggcuggagugcaguggcaugaucucagcucacugcaaccuccgcgcccccagguucaagcgauucuccugccucagccucccgaguagcugggauuacaggcuccugccacugugcccagcuaauuuuuguauuuuuaguagagacgggguuucaccaucuuggccaggcuggucuugaacuccucaccucaugaucuaccugccucggccucccaaagugcugggauuacaggcaugagccacugcuggccaggaacuuuaaccuuuucacuuaaaggacacauuuccuggcuucucucuagcauagcugaguugccagcaucacuacuccugugcuuuggggccaauauuaaguaaaauaggggaaccugaacaaaaguacuguaauggcacaacaguugaucugauaacggcuacuaacugacuaacaggugggucuuguauacaguauggagacgcuggacaaauggauaauucacguuccggguaagguagaaugggacagagugagauuucaucauguuucucagaacagcaugcauuuuaaaacuuaugaauuguuuauuucuggaaucuuccacuuaauauuuucaaaccacaguugccuacuaguaacugaaaccacagaaugugaaacuguggguggagggggcuacuauacuucaugcauauuguuauacaucuaugccaagaagguaaugugucccgacucugcaggagcguaguaugcaagcuucauguccaaaauccuuuuagacucugcccccuuuuuuucuuuuuuuuucuuuuuuugagacggagucuagcucugucaccaggcuggagugcagugguacaaucucggcucacugcaacuucccccucccagguucaagcaauucucccaccucauccuccaaguaacugggauuacaggcacgcaccgccacacacagcuaauuuuuguauuuuuaguagcgaugggguuucacgauguuggccagaauggucuuaaauucccgaccucgugauccacccaccuuggccuccgaaagggcugggauuacaggcgugagccaccacacccggccaacucugcccuauuugucucuuccuuuagcugcuuuuaaucuauauguucccuauaauaaacuauaaccaugacuauaacaacuuucagugaguucuagugaauuagcaaaucugaagacgguuuugcgacacucugaaacugcaggugguuucagaagugaagguggucuuuaggagggcagugugcccucugaacucaauuacuagcuucaaacuuugaaauuuggcuaauaucagguaguccccuaguuuuacaauucaacgaggaaagaauaaucuuucaacaaaugaugcugggauaauuggauauccacaugcaaaagaaaguggauuaaccccuagaucacacuauacauaaaaauuaacuacaaauacaucaaauacaucaaaaaccuaaauguaaaagcugaaauuauaaaacucuuaaaacaaggguauaaaucuucccaaccucagauuaagcaaaaguaucuuagauacgacaacaaaagcacacgcgacaaaagaaaaaaguagauaaauuggacuucaucaaaacgaaaaacuuuucugcaucaaauuacacuaucaugaaugcggcaagauagcauguaccuguagucugaggugucagggaggcugaggcaggaaggcuucuugagcccaggacuucaagguuacagugagcuaugaucaggccacugcacuccagccugggcaacaaaccaagacuccaucucucaaaaaaaauaaaauaaauaaaaauaaauaaaaaaaagaaaacaggccgggcacaguggcucacaccuguaaucccagcacuuugggaggccgaggcgggcggaucacaaggucaagagaccaagaccauccuggccaacacuacuaaaaauacaaacaacaacaacaacaacaacaaaaccacaaaccacuaucaagagaguaaaaagauaacucgcagaaagggagaaaacauuugcaaauuaaauaucagauaagcaccaggcaugguggcucacgucuggaaucccaacacuuugggaagacaagcugggagaaucacuggagcccaggaguuuaagaccagccuggucaauacagcgagaccccaucuguacaaaaaauaaaaaaauaaaauauuagcuggaugugguggugugugcuuguaguccuagcuacucaggaggcugaagugaaaggaucacuugagucugggaggucaaggcugcaguuagccauaauaguaccacuguacuccagccugggcaacagagagaaauccugucucaaaaaaacauaaacuggccagacgcagugcuuacgccuguaauuccaggaauuugggaggccaaggcggguggaucacuugaggccaggaguucaacaccagccuggccaacauggagaaaccucgccucuacuaaaaauacaaaaauuagccgggcaugggacaccuguagucccagcuacucaggaggcugaggcaggaaaauuauuugaaccugggacguggagguugcagugagccgugaucacgccucugcacucuagccugugccacagagugaaacuucaucucaaaaaaaaaaaaaaacuuucacagcucaacaugaaaaagauaaccaaauuuaagaacuggcaaaggacuugaauagacauuuuugcaaagaagauaugcaaauguucaauaagaauaugaaaaaauauucaacaucauuuuagccacuagggaaaugcaaaucaaaaccacccuagaucacuagggugaguaugaucuagaagacaaauauuaacaaguguuggugaggguguggagaaauucagaccuuccuacaacgcuguugggaauuuaaaaugguauaaccacuuugaaaacagucugggagcucuucaaaagguuaaacauagugucaccauaugacucagcaaaguccauuccuagguauagacccaaaggaaaugaaaacacauauucacacaagagcuugaacgcuagggcccggugugguagcgugggccuguagucccaucuacuugaagcugaggucagaggaaugcuugagcccaggaguucaacugcagugagcuaugaucaaaccugcacuccagcuugggugacacaguaagacccugucucucucucucccuuuuuuuuuuugagacagagucucacucugucccccaggcuggagugcaguggcauguucucagcucacugcaagcucugccucccgaguucacgucauucuccugccucagccucccgaguagcugggacuacaggcgcccaccaccacaccuggcuaauuuuuuauauuuuuaguagagacaggguuucauuguguuagccaggaugaucucguucuccugaccucgugaucugccugccuuggccucccaaagugcugggauuacaggcgugagccaccgcgcccggcccaacccugucucuuagaaagaaaaaaacaaggccaggugugguggcucaugccuguaauccuagcaccuugggaggcggagguggguggaucacaaggucaggagaucaagaccagccuggccaauauggugaaaccucgucucuacuaaaaauacaaaaaauuagccgggcgugguggugcacaccuauaaucccagcuacucaggagacugaggcaggagaauugcuugaacccgggaggcggagguugcagugagccaagaucacaccacugcacuccagccugggcaacaagagcaaaacuccaucucaaaaaaauaaaaauaaauaaagauaaaaaaacaaaaagcaaaacucuccagauccucuguuccauuuccuaugcucaucucauuugucauuuauuuauuuuuuuaaauuauacuuuaaguucugggauacauguacggaaugugcagguuuguuacauagguauacacaugccauggugguuugcugcacccaucaacccgucaucuacauuagguauuucuccuaaugcuaucccuccccuagccccccagccccccaccccccgagaggccccgugugugauguuccccuccggucauuuauuacaaacugaaauucucuagaauuaaguuccauaagaguagggacuuggcuggaugugguggcucacacauguaaucccaguacuuugggaagcugaggcaggaggauugcuugagcccaggaauucaagaccagcuugggcaacacagcaagaccucgucuccacaaaaaaauuaaaaaucagcugggcaugguguuacauguuuguagucccagcuauuugggaggcuagggcaggaaaauugcuugagcccagaagucaaaggcuguagugagguaugcuugugccaaugcauuccagcccaggugacagagcaagaccccgucuuaaaaaaauuaaaaaagaguaaggacuuacuuuuguucacuaauauaaugccagagccuagaguuuaauugcucaaaaauguguugaauaacgaaaucauauuaggaauacauuuuauuaaaaaaaaaaacuggaaaaaaaaagggaacacguuuuuaggaauccagcacccuuuuaaaauagcauauaauaauuaaaacaguaauuugggaucaagaggguguuuugacaaaauucaacauccacucaguauaaacuauuaauauacuaagaauggaagggaaaaaccaacagauauuuauuuccauguuauaugcugggaauacagcaguuaaaacaaaacaaaaaaaucucugcucuuagggagcuuacauccuuggagaucuaucucaaaguaacaacuaacaucacacuugcuaauaaaaaaucagaggcauggccgggcgcgguggcucacgccuguaaucccagcacuuuggaaggcugagcggggcggaucaucugaggucaggaguucaagaccagccuaggcaacauggugaaaccccgucucuacuaaaaauacaaauuagccgggugcaguggugucugccuguaaucccagcuacucagggggcugagguaggagaaucgcuugaacuugggaggcagagguugcagugagcugagagcacgccacugcacucuagccugggagacggagcgagacuuugucucaaaaaaaaaaaaucagaggcauuauagugaggacaaaaugcuauuaccauuaucaacugacaguguuuuaaaguucuugcuaauucaauggucaaggagaagaguugcagagaacaugacuaccuagacaaccccaaagaauaaacuauaaaauauguaagaagaagguucacaucaagacaucugguuaaaaacuaaauauacaaaaaccaauuguuuucccaacaagauacuaacaaacaguaggggguggggcacuauauugagggauuuagucacaaauuuuucuaugauuuuauaaacuuucucacauucuuuaccuuccugcacuuuuauuuuuagagucauaauucugaaaaaaaucuacugaaaagauuccugcuauggaaaaacauacgguuuugacucuuaaucagaccagagaaaaagaaauaagcucagaacacauccuauuauaccucuauguuccaguuaugcuguuccaagguauggcgacacugauccauagauucgaugccagugagauccugaaaagaaggaugaaaacaaguuacuuagagaaaaaccaacaguauacgugugaguauuuuuacgccauauacugcuaggaaaauacacuaaaaaauguuaaaagugaguguuaaaguaugguaaaacuucaccgauucagaauuuauacagucagcugacuguucuagaugcguaaagaacuaaaaaaaugauaauuccuuuuaaaacuucaaggcuuucaauuaagaggaguacugacuaagaucaauauucuccucucaaauucaaguuuaaaaaauuaaagauuuuucaaccugugggcuaagcaaaauauuauuuaaugcuaaacagcuauucuguugauaguacagguugagcaucccaaaucugaaaccuaaaaugcuccaacauuuuuugaaacauuuugagugcugacaugucucaaaggaaaugcauaguggaacauuucagauuugagaugcucauucaguaaaacguaaauauuccaaauucucaaaacaauccaaaucugaaacacuugugguuccaagcauuuuagauaaggaauacucaaccucuacauaaugauguaaugcaccuuuccuguaaaacgucaugccuuucauuaacuuauuucauuuuauauacugguauuaaccuaguuuauaauaugaacuguguaaaaccuaacauaccgaccccccuaccccccgccacuuuuuuuucgagacagggucuugcucugucauccaguuuggagugcaauagcgcaaugacugcucacugcagucucaacuucccagacugaagcgauccucccgccucagccuccugaguagcuggcacugcaggugugcaccaccacacccagcuaaauuuuggauguuuuuuguaaagacgggaucucucuauauuccccaggcuggucuccaacuccugggcucaagcaauccucuugccuuggccucccaaagugcugggauuauaggugugagccacugcaguuacaguauuuucucacuauuuccguucagauguccaauauucagcaaaucuaacaguucauguauacaucucaugcccagaauuuccacagagcuaaacucuagcauuccuucaaagucuaauauaaaagccaaaaccauccaucuaauccauccauccuuucauuugacaaaugugugcuacaugccuauucuguacagcacuaacuuacuauguuggagggacagaaaaugaauaagauguagucucuauccucaagaaacuccucuaaacaaccaguaagcuucagggcaaagagacugaucucaaccugacaagaauguaguaguauggacugaugagucugaaaacugaaguucuugccuaauucugcaccccauggccacggacaggcacauuuuaacucugaauuuaguuuccuuuaugugcaaugugaaggguuuaauguggaaugcauuucuuuuccagagcuuaaaaaaaugaaacaaaauucaaaaacugaaauucggauuuuuagguauacaaguuuucauuuuuuauaauuacacauguaguacaaaaacuugcaauaaaaaauguuaauguuuaaaaugcugaaauagaaaaguuccuuuaagaaccacuggcuuugacaguucugagucuggauuuuagguccugaccauuacaggacucuucacauuugccuauucccuucuggcuucuaauaggacccccuuaacuuucaguguccuacauuacaacccacuaaaggacugggauguccaggguuccuccuucucgcuguggauucucuuuaagaauuggacucuaggccaggcaugguggcucacgccuguaaucccagcacuuugggaggcugaggugggcggaucacaugaggucaggaguuagagaccagccuggccaacaugguuaaaaccccaccucuacuuaaaaaaaaaaaaaaaaaaaaggccgggcacgguggcucaugccuguaaucucagcacuuugggaggccgaggcggucagaucaugaggucaggagauccagaccauccuggcuaacacagugaaaccccgccucaacuuaaaaaaaaaaaaaaaaaaggccgggcacgguggcucacgccuguaaucucagcacuuugggaggccgaggcgggcggaucacgaagucaggagaucgagaccauccuggcuaacauggugaaaccccgucucacuaaaaauacaaaaaauuagccgggcaugguggugggcgccuguagucccagcuacucaggaggcugaggcaggagaauggcgugaacaagggagguggagcuugcagugagcugagauagcgccacugcacuccagccugggugacagaggaagacuccaucucaaaaaaaaaaaaaaaaaaaaaaauuaguucagcaugguggugcugcgugccuguagucccagauacucucgggaggcuguggugggggaaucgcuugaacccaggaggcagagguuguggugagccgagaucaugccaaugcccuccagccuaggugacagagcgagacuccaucucaaaaaaaaaaaaaaaaaaaaaaagggacucuaaucuuaccaucuuccccagugugcaaaugacugcucccuccucuaaauaccaaaauuguuuucuacgucucuuaugugccuauuguuuccuaucuuaugauuauuuacauucauucuauugccuucucagaggguguaauguaaguucucugagagcagggaacaauucacuguaauauucacuaguaccaggcacacacuaugggcuuaaaucguagaagaaucaguccaaguuaaaaggaccuuuuuguauaagcuucagucaucauagcuauaagcugaaauccucuagauauuaucacaaaaucucacuuuacauuaauacacuguuuuuuuuguuuugcuuuguuuuuuuaagacagguucugucuggcucuguuguccaggcuggagugcaguggaacgaucuuggcucacuugcaaccucugucucccgcucucaaaugauccucccaucucagccuccgagcagcuggaaccacaggugugcgccaccacacuuggcuaauuuuucuauuuuucuuggguagagacaggauuucaccauguugcccaggcuggccuugaacuccugggcucaagcgauccucccgccuuggccucccaauguguugggauuauacacgugagccaccauaccugguuacugggguuuuuuaacuucaaauguucugacuagaugccaagcugguuguuaaaacauuacaaauuuguagaauuuuccugaaaaucaguaagucaggaaagagcucaggaagcaguguuuguucuuaaagcuccucagcugauucuaauguacagccgagcugggaaauccgugguauugauaguaauucuuuuuuuuuuuuuuuagacgaagucucgcucuugucccccaggcuggcgugcaauggcacggucucggcucacugcaaccugcgccuccuggguucaagugauucuccugccuuggcuccccaaguagcugggauuacagguggcugccaccacgccuggcuaguuuuuguauuuuuaguagggacgagguuucaccaggcuggucucgaacuccucaccucaggugauccacccgccucggccucccaaaguguugggauuacaggcgugagccaccgugcccggcugguauugauauguaauucuaaguaggaauagagauuauaaaucccucacuaaaguaacuuuuaggcuacgcacaguggcucacaccugcaauccuagcacugugggaagccaagguggguggaucacuucagcccaggaguuaagaccagccuggccaauauagagaaacuccaucucuauaaaaaauacaaaaaaaauuagccgggugugguggugcgccuguagucccagcuacucaagaaggaucaucuauucaggaucaccugagccugaggaggucaagacugcaguaaacugcgccacugcacuccaacuugggcaacagagagaccucaucucaauaauaauaauaauaaccuuaaauaaaugguuauaaacauugcaggagagaacagagugacugccaucuuuaauauacugaaacacuuaaccuaauuuauaaccaaaacacuuuuuaaguagugaagcagggugagcuggaaacccaacugaacaagccugcuuucaauuacuacugaucaguacuaaaacuaugcccuagaaauaagugaugcuggacacaccugggacaggauuauucauucauauaucaacauacauucacuauauauccaggauacagauacagucccugcccuguuuaaauuuucauccuaguaaauggagacuggucaaaacaaaccacacauacugaagaaaauacacuaacaaaauuuucauuuuguucuagaagauuccuuuagauugggugcucaaggaaagcuuccucaaggagauaauauuugagcagagaucugaaugaaagauaaggggccagucauggggaaauaucugggaagaguauuccaggcagaaggccaacauaugcaaaaacugugagacagauaaaaacccacagaccuuuacagcagagugaaccuuaauguauguaaauuuaaaaaaucauuuaagagaucagaggcucuccggauggaacacagacuuugacaaaagaaucuaauugucuagaaaauaugugaaacaaccucaccaaagggggaaggggggugcuaagaaacuuuggaaaugaagucuauaagacuaaaggcaacaggaacuacacuuaagcacuguucucuacuugauaagguuuuucuccaugggaauacguauucugaagccacuauaucugcauauguaucccagauuugaacaauuaaguaaaaagauggugaaugaugaaagccaguuuucugucuguagaagugagaggugacagauaaccaaaggaagaaggcuagaauggauagagugguaauggauagaauuggaaacaucaacucauguuuagcuuaauauagauacagaugacugcauacagaaaaacuuaguuuaguauacauacauguacaucccuugcucagucagcugaaagguccuacaagccacaacaucccaguagcaagcacacccaaugccuagaacuugguuucuaauaccauucucuaauaaaaagaaucagggcuccuuggagaaguggcugauucuaggacuggggccggaaauauauaagaugugccuagagaaucuuguggucaaaaggauaaaggaggcugggagugguggcucaugccuguaauccuaacacuuugggaagccaaggugggaggacugcuugaggccaggaguucaauacuagccugggcaacacagcaagaucucaucucuaccaagaaaaacaaaggauagaggagucaacugaaaaagaucccagugacuaaagcucgaacaauuuuagcaauaaaauaaauacgcaugauauaaauacauggcugaauaaauaaacuggggagaauagaaaaauauccugugcagaagaauuccaaguaacuuauauagauauuuuaccuuuaccuucaaggaaguagaacauaacuuuucauuccuucccaggaugggcuaggcaugaugacuuccuuccaaagaguacagaacggaaacagggcagggggauuaacaguggagaaaccugaccaacgcuacugcagcuaggugaucaaggccaaaacaucgacagugauaaagcaugcugagagcaccuuugauuugauguagugaaaaucgugcuuuaccucuguaaucuuccugccaaaaacccauaaucccagccccaauuaugagagaaacauuaggcaaauaucaauugagaaauauucuacaaaauaccugacugguacuccugaaaacugucaaggucaccaaaaacaauaaaagcucaagaaacugucacagcccagaggaaccuaagaugugacuacuaaauggcauguaguacccuaaaugggauccuggaacacaaaaagaguaucagguaaaaacuaagagaaucagaauaaagaaaggacuuuuguuaauaauaguguaucaauauugguucaucaauuuugacaaguguaccauacuaauaaugcaagguguuaauaagaaacauucagcaugagauuuuuaggaauuuucuauauuaucuucacaauuuccuguuaaucuaaaucucuccuaaugacaaguuuauuuaaaaaguaaaacaaaacuugaaggagggaggaaacaagaagggaggaaacauuggagacagaaccagcuuggcaaguugacagauaaggucugagaaguaggcaggggaaagaucauucauuucaggcaauauuuuuccauuuuaccuguauaagaaccauaugagcccuauuuuucuuucuuucuuuuuucuuucuuucuuuucuuuuuuuuuuuuuuuuguagagaugaagauuucacuauguugaacaggcuggucucaaacuccuggccucaagcaauccucccaccucagccucccaaagcaugagccaccauggugggccuguaugaaggaacuuuuuaaaaaaugcuacaagccgggugcaguggcucauuaccuguaaucccagcauucugggaggccaagguaagaggaucacuugggcccagaaguucaagaccauccugaacaacauagcaagacccuguucucugcuuaaaaaaaacaaaaacaagcugggcgugguggaucacgccuguaaucccagcacuuugggaggcugaggugggcagaucaugaggucaggaguucgagaccagacugaccaacauggugaaaccccaucucuacuaaaaauacaaaaauuagcugggcacgguggugugcgccugugaucccagcuacucaggaggcugaggcaggagaaucgcuugaacccgggagacggagguugcagugagcugagaaagcagugagcugagauagcaccacugugcucuagccugggagacggagugagacucuguuucaaaaaaauaaaaaaaaaaacucaaaacaaauuaaaacccuacagaugucuggacccuccaauccaaacaauuuaaccagauucucugaagguagugccuaggaaaaggucauguuuauuuccuauagggaaagggaacuuaacacaggugaugagaauguacagauaggggcugggcaugguggcucacaccuguaaucccagcacuuugggagaccgaggggggcgaaucacgagguuaggaauuugugaccagccuggugaaaccccgucucuacuaaaaauacaaaaaauuagcugggcauaguggcgggugccuguaaucccagcuacuggggaagcugaggcaggaaaacugcuugaacccggggggcggaggugguugcggugagccaagaucgcaccacugcacuccagcccaggugacagacagagugagacuccaucucaaaaaaaaaaaaaaaagaggccgggcgugguggcucaugccuguaaucccagcacuuugggaggccgaggugggcagaucaccugaggucaggaguucgagaccagccuggccaacauggugaaaccccgucucuacuaaaaauacaaaaauuagccaggcaugguggugggcaccuguaaucccagcuacucaggaggcugaggcaggagaaucacuugaacccgggaggcagaguuugcagugagcugagaucguaccacugcacuccagccugggcaacaagagcaaaacucugucucaaaaaaaaaaaaaaaaaaaaaaaagaauguacagagagggaugagaaucacuaacccagacccuucauucuaaauuuagugccagugacaugugacaugaucauaugcacauuuuaaaguaagucauuccuguuugcauaugaaguaauuguagaaggcaugaaagacagcaagacaccagcaagauuauauagaugaaguccagggaaaagagaaugauggcauagaauagaaugacagcagugaaacagaaaauggacauauuugggguuuauuuuagagguagggccaaaaggaucaggugauagauuaaacauguggggguggaagagaaauauuaagguguacucauaggcuuaagcaaauggaauuaugguguuauuuacaaagaacgagguaagcuauuugccuuugugagaaauuuuuauguaugguaaaguaaaucuaucuaaaaagaacaagagauauauaaucccucauugcuaaauuugaguggcuuuaaaaaaguaaaaagaaugggaaaaaguggaaauagacugccagaugaagguaaaaacacuauuucaucacauuaaaugcauugugugagaacuaccugaccucacugcuagucagcaggaucguuuuccagugaucucuuaaaaaagccaaaguaagcuagugugcugaacucauuuggcauucacugucuguaaacaguugcauucauaacucagacaggguugguuaccuggguuuucuaucaguuuuugugugugugugaguguguuuuuaaaccuaguauaaguuagguaaaguuuauuuauucauuuauauguuuggagacagaguuucgcucuuuguugcccaggcuggagcgcgauggcgcgaucuuggcucaccacaaccuccaccucccggguucaagugauucuccugccucagccucccgcguagcuggcauuacaggcaugcgccaccacgccccgcuaauuuugcauuuuuagugcacaccggguuucuccauguuggucaggcuggucucgaacucccgaccucaggugauccgcccgccucggccucccaaagugcugggauuauaggcgugagucaccgcacccggcugguaaaguuuaaauauuagagaaagauuagaaaugggguagcgugagaggcuacccuguggugguuccaaccauuaguaauacaacugguuuacauuuacaaauuuccuucuaguuccccacacuccaaggaaagguuuagggcuugauucaaccucuuuuacaauuaaauaaaauuauuauaggggaaacugucuaauggucuuuucuucuccauucuagacuguaugcaugcugaggaaaauccauucaucucugccuuugaucuuuacaggaaucuucugguguuuucucuccuggcuggaaaaccaacuuuuccaccccacccucucacaucacuacauacaagucaagguuugaggagccuucucuauuuucucuuaccugugugagacuccucucuuucagauauuuauaauuuugcacauuauuuuacgaaauacucccuucaaacucuucauaaacuuaauacacucuucauaaccaugguuauacaauacucuaacuggcuacaacaauuuacauauagauguuacggcugcuuccaauuuucacuauuaaaauagcacuaugaugaacacuacuauuuauaaaguuugccucuauuuaggauuucuucuggaucuagguaaaacuuggagccaaagaauauacauuauuuuuaaaguucuugacccacagugccaaaaugcauuucgaaaggacuauuccaauuuacacuggaagggcuggauucaacauaagucaaaugcuaaguaugucucaagccaauauucauugccauuucagugccaaccuaaguuuugcaaugccagcuuuguucagagagaaagaauauugcaguuuuggcuggagacauuccauuagcuuugcuaccaauucucugcucagcaauaaaauaauguuuggcuaucagcauuucuggaagagagguaaaacagagaagcagaggaauguuagacuuaacaucagucacaggcuucaacuuccuacuaauuucuucagaacuccaauuauaauucuuuuucuacaauuuuuuauuuuuauuuuuagagauggagucucgcucugucgcccaggcuggaguacaauggugugaucucggcccacugcaaccucugccuccuggguucaagugauucuccuaccucagccucccgaguagcugggauuacaggcacaugcuaccacgcccagcuaauuuuuguauuuuuaguaccgacaggguuucaccauguuggccaggcuggucucgaacuccugaccucaggugaugcauccaccuuggcaucccaaagugcugggacuauagguaugaggcaccacgcccagccuaaaauuuuuuauauuuuuuacagacagggucucucugucacucacucuggaguacaguagcaugaucauagcucacuguaaccaucugcuccugggcucaaguacuccuucugccucagccucccaaguagcuaggacuacaggcacguaccaccauacccaccuuuuuuuuuuuuguuuuuuugggggcuagauugguggggucccacuauguugcucagccuggucuugaaccuccuugccucaggugauccucccacuucagccucccaaaguggugagauuacaggugugaaccaaugugcccagcuccauaauucacuuuuaaaaggaacuuucuuuugaggagggaaucuauuuacuucuauuuuucuuuuugagacggagucuugcucugucgcccagguugggaugcaguggcgugaucucggcucacugcaagcugcgccucccggguucacaccauucuccugccucagccucccgagcagcugggacugcaggcgcccacgaccacgcccgccuaauuuuuuguauuuuuaguagagacgggguuucaccguguuagccaggauggucuugaucuccuggccuagugauccaccugccucggccucccaaagugcugggauuauaggcaugagccacugcgcccagccucuauuuacuucuauacucccaagacccagugcaaugccuuggcauaaaauaggaaaugucugaauaaaugaaugaauccuuccucagucuaacaaucaacuuuuguuuauaucucucuaguuucuuuucuuuucuugagacagauucucacucuugucguccaggcuggaguguaguggcaagauuucagcucaccacaaucuccgcuuccaggguucaagugauucuccugccucagccucucaaguagcugggauuguaagugcccaccaacacacccgauuaauuuuuguauuuuuaauagagacaggguuucaccauguuggccaggcuagucuugaacuccugaccucaggugaucugccacccucagccucccaaagugcugggaugacaggugugagccaccacacccagccuucuaguuucuuaaacacugaucuucucauuauuacacauuuauuccuacucugugucaggaacuaacauagcuaaucuucacauuuuccucaacaauccuguaagacagauauugcuaucuugcccauuaucaauugagaauacugaaucuuugaaaagaauuaugucaaaguaucccauaccaauuuggguauacaguaagugcuuaauaaaggucagcuaaaacuggcaugcucuuuagaacucugguuuacauuaagaucuacugacaucuggcugggcgugguggcucacgcccauaaucccagaacuuugggaggccaggaauuugagaccagccuggccaacauggcaaaacccgguucuguauaaauacaaaaaaguuagccaggugugguugugcaugccuguaaucucuagcuacucggguggcugaggcacaagaaucgcuuaaacuugggagaugaagguugcagugagcugagauggcaccacugcacucuaggcugggcaaaaagggcgacacugacucaaaaaaaaaccaaaaaaaaccaaaaaaagucuacugacaucuaagguggcuugagauagcauuguacaaauuagcugcaauggauacaaagguuaacuauggcacccccuucucucucuaaucuuucagggccgagugucuaaugucaucaauugcuaccauaaaucccccacuggucugggacagacaagugaccaaaaaaaaaaaaaaaaaaaaaaaaggaaaaaaaaaacagccauugggcaggcccaucccagucugucuuacugagaaaaaucccuugcuccgugauccuuucccuccuuccuccucccuucagagaugacuccccuuccauaaacugacuucccaaggauuuuggagagcacugcauuuaauuacagaaguuaaaaauguaauugccugauaguaucagugggagaaaggcauuauuuacuuuuggggcaucuuacuagagacugaaccccaaucaaucucuaguaaaaugcacaggggagacuggggaagugugugaacuauucuauacuacuuuccuacuucagcuuuggucaaacaucuuguaaaauguauacgggagauugcagaagugugugaacuacuuuccuacugcagcuuuggucaaacuuccuccucucccaagucagaagacaagaaggugucagucacuugcagacuagcuuucgaaauacugugaucccgaucuaucucuugcuaaagcaugacucaaagaagguaucacaaacaauaauagaugguguguaguauuuuaaccagauggcucaaacagcuauuuggauagggauuggguaaccaggguguaaucuccucauuuuccuaaguggaguuuaucuuuccauaucucaucuguuuauacuaacaaacgcugcacgggguuggugugaaaucucagcugagauuuaaguacucucuaaauuccaauuggcuuguugguuuuagcuugcuaagaaugcauauuuuaggucuuguuuucaguuauucccagagagaaacuuggcaaaaacuaggaaucuuuguucucuccuuccgaccacacagacagcuuugcuuugcuuuauguaauaggcaguaugccuucucugauaguagcaggagaaaugaaaucugaaaucuguucaggaaauuaagugaucauggcuaggcucugaucuaaaguaauuuaaacucuuacacacacucagaucuuuauuauucacauuuaauuacugauacuccaaauuaaguaccagcagcucccauuuacuaaacaucuauuaccguguaauaaaacagauacuguaaguauugaaacccuuauuuucaucacugagaaagccaaagauucaaaaaguuacacgccuugucuaggaauaucuagauaaugguaaaugguggagugaagacugaaaucuagauuaauuacuuccaaaguccagauucucucucaugccaaaaugccucccauuauuacuugaaaucguuuucuuuucuuuuuugagaugaagucuugcucuguugcccaggcuggagugcaguggcacgaucucgguucacugcaaucccugccuccuggguucaagugauucuccugccucagccucccagguacccauuacaggcaugagccacugugcccagcuaaaauagcuuucaguaaauccuuaauucagaaaauuucaauuucugggcugggcaugguggcucauaacuguaacuucagcacuuugggaggccaaggagggcagaucaccugaggucaggaguuugagaccagccuggccaacauggugaaacccugucucuacuaaaauacaaaaauuaggcaggcaugguggcaggugccugcaaucucagcuacucaagagguugaagcaggagaauugcuugaauccaggagguggaggcugcagugagccaagauugugucauugcacuccagccuggaugacaagggccaaacuccaacucaaaaaaaaaaaaaaaaaagaaagaaaaagaaaauuucaguuucuuuauuguauauacuaguagcugaauaucagcccacagacguauauaaaacuguucuccuuuaggcacaagaucaacaaacauguugauacaguuuuucucuauggacaaaggguuuggggucaaauaagacuagaaaaugguacauaucuggccaggcucuguggcucacgccuguaaucccagcacuuugggaggcugaagcggccagaucacuugaggucugaaguucaagaccagccuggccaacauggugaaacccugucucuacuaaaaauacaaaaauuagcugggcgugguaguggcgcaugccuauaaucccagguauucaggaggcugaggcaagagaaucacuugagccuggaaggcggagguugcagugagcugagaucauaccacugcacucuagccggggcgauacagcgagacucugucucaaaaaaaaagaaagugccuaucaaauaccucuuuucaaauaccccuuuuagaaaucugcaauauaaucuuguaaaggcuuugaaagguucugcuucuagaaaaaaagaaaauuuaaccucacaacuucacauaagggaaggucuuuaaaaaaaaaaaaaacuaauaucccuugaagaauuuucacuuagaaucaguuuggcagccuggcaacacagugagacccaucucuacagaaaauaaaaacauuagccgggcauggugguacaugcauguagucccagccacuugggaggcugaugugggagggucacuugaguccgggaggucgaggcuacagugagcuaugguugugccacuguacuccagcccaggugacagagcaagacccugucucaaaaaaaaaaaaaaaaaaaaaaagaaucagcuuggaaacaccagaaauggaaccaaauggucugugcaaaucaagauauaaccauaucuuaaucuuaaauaauagauucucaaauauuugauaacugauuagacccaaauggcauuacacaaguguggauguuuacuguauaaauauucgaauauacauaaauaccacaugaauaaacauuuccaaaaaaaccccccacaauauucuuuauccaagcaauuaaaauaggugggggcuggguguggcagcucacaccuguaaucccaacacuuugggaggccaaggcaggaggccuuaaggccuuaaggacagccugggaaacacggugagacccugucucuacaaaaaaaagaaacaaaaaaaagaauaaguggaagaaguggcugagcuuuguuggaaaguuagagacacaagcaauuuuaauuuguguagcagcaauagaaaaauuuaaggcccggcacaguggcucacgccuguaaucucagcacuaugggaggcugaggcaggcagaucacuugaggucaggaguucgagaccagccuggccaacauggugaaaccccgucucuacuaaaacuacaaaaauuagccaggugugguggugagcaccuguaauccuagcuacacaggaggcugaggcagaagaaucacucaaacccgggaggcggagguugcagugagccaagaucacgccacugcacuccagccugggaaacacagcaagacucugucucaaggaaaaaaaaaaaaaaaaaaacaugcaauaacccuuuauucuaauucuaccacgcacuagcuucguaaccucaggcaucuuucuuagguuuagcuuccucacugguaaaauguaaauaaaaauagugcuuaguuccuuggguugugcagauuaaaacagguuagcuaauauuacuauugagaaacaugaggucuuccagaaucugagucaggaaaaaaaagaaacaugaaggacacauuaaggagacauuuguaaagcacugugagaugagucugaacuagcuuaaaagguucugaaguaauacaauuagauuuugggggaaccaaauaaauuaucuuucauuaauuccuuuuuuuuuuuugagauggagucucacucuguugcccaggcuggagugcagugauaccucuugacucacugcaaccucugccucccgggccaagcgauucuccuguuucacccucccgauuacaggagucugccaccaugccuggcuaauuuuuuuuguauucuuaguagagacgggguuuugcuauguuggccaggcaggucucaaauuccugaccucaggugauccacccgccucagccucccaaaagugcugggauuacaggcaugagccaccaggccuggccccuauuaauuccuauucuaguauugauucuuucacuuaacagacuuaauuccacuaaaacaaacacaaacaauaaguauguuggcuauauucaaccuuuccuaaaugugacuuuaccgcucagauucaagcagaaacguuguuucaagagaaaugaagguauuucuguuauccucuuugugaaaaacacuauagcgaagcaaacuuuauugguccuccaaaaauaaucuaauaauuugaccuugucuguucccugcccaucccucaccccuucuaggcugacaaauucugccauuauguuucaaaauagcuugaaaucacaccccuagaauuucacaugcauaagauguguauauauuagcaaaauuuaaugucaagucacaaaauguuaaaaauuuaucacuuuucaaucuuaaaacuugacaugagaggaugcucuaggauuuagauucaacuauuuauuaaacaucuauuuuauuuuauuuuuuugagacggagucuugcucugucguuaggcuggagugcaguggcgcgaucucggcucacugcaaccuccgccucccggguucgagugauucuccugccucagccucccaagcagcugggacuacagacaugcgccaccacgcccggcuaauuuugguauuuuuaguagagaugggguuucaccauguuggccaggauggucucgaucucuugaccucaugaucugccugccuuggccucccaaagugcugagauuacaggcaugagccacugugcagucuauuaaauaucaauuaaccaagcacuauaguauguguuuucugauccacucuuuuuucuuguuuuguuuggagacagaaucucacucugccacccaggcuggagugcaauguugcgaucucggcucauugcaaccucugucucuuggguucaagcaauucucccgccucagccucucaaguagcugggacuacaggcgcuugccaccacgccuggcugauuuuguauuuuuaguagagaugggguuucaccacauuggccaggcuggucucgaauuccugaccucgggugauccucccaccucagucucauaaaguguugggacuacaggugugagacacugcaccuagcuuuucugaugcuuacuucuaacaccccuguaaaguuuaaaaauauuaaucauuaaauguaagaccuaaaacuauaaaaauccuacaagaaaaccuaguaguaucauucuggacauuggucuuggcaaagaauuuaugacuaaguccccaaaaacauuugcaacaaaaacaaaaauuggaaagugggaccuaauuaaacugaagagcuucuacacaguaaaagaaacuaucaacagaguaaacagacaaaaugggagaaaaucuucgcaaacuaugaaucugacaaaggccuaauauccagaauauaugagaaacaauucaacaagcaaauaauaauaauaauaaccccauuaaaaaaaaacuggcaaaagccaggccgaguggcucauaccaguaaccccaucacuaggggaggccaaggugggaggaugacuugaaaucagaaguucaagaccaggcugggcaacacagcaagacccuaucucuaaaaaaaaaaaauaaaauaaaaaaaauuagcccaguguggugguguacaccuguagucccagcuccucuggaggcugaagugguaggaucacuugagcugggacucugaggccacagugaacuaucaucacauuacuauacuuuagcuugagagauagagcaagaaccugucucaaaaaaaaaaaaaaaaaaaaaaaagcugggcacaguggcucacaccuguaaucucagcaccuugggaggccgagguggguggacugcuugaggucaggaguucgagaccagccuggacaacacagugaaacccugucucuacuaaaaauacaaaaauuagcugggcauguuaguaugcgccuguaaucccagcuacucaggaagcugaggcaagagacaucgcuugaaccuggcaggcagagguugcagugagccaagauggcacuacugcacuccagccuaggcgacagaguaaaacauugucugaaaaaaaaaaaagagaagaaaaaaaggggaggugggugcaaaaguacaugaacagacacuucuuucuuuuuuugagucaaagggucuuacucugucacccagguuggagugcaguggcaccaucuugcuuggcucauugcaaccuccaucucccagguucaagugauccucccaccucagccucccaaguagcugggaccacaggccuacaccgccaugccuggugaaucuuuuggauuuuugguacaguuggggucuugcaauguugcccaggcuggucucaaacuccuaagcucaagugauccacugccucagccucccaaagugcugggauuacaggcgugagccaucacacccgccucagacacuucucaaaagacauuuacagggccaggaggcagaggcugcagugagcugagaucaugccacuacacucuagcccaggcaacaaagugagacccucaggaaaaaaaaaauacacacacacacacacacacacacacacacacacacacacgcggccaaaaauagucaacaucacugcucauuagagaaaugcaaaucaaaaucacaaugaguuaccauuuuguaccagucagaauggcuauuacuaaaaagucaaaaaauaacuagauauuggcaaggccacagagaaaaacgaaugcuuauauaacacuggugggaauguaaguuaguuuagccacuguggaaagcagucuggggauuucucaaagaacuuaagaaaaaaaccagaacuaucaauugacccaacaaucccauuaauggguauacacccaaaggaaaauaacucguucuaccaaaaagacacacacucauauguugaucacagcauuauucaugauagcaaagacauggaaucaaccuagaugcccaucaacagugaucugaauaaagaaaaugugguacauauacacuauagaauaccacgcacucauaaaaaagaacaaaaucacauccuuugcagcaacauggauguagccggaggccgucauccuaagcaaauuaaugcagaaccaaaaaaccaaauaccacauucuuacuuguaaguaggagcuaaacacugaguacacauggacacaaagaugagaacaauagacacugaggacuacuagaugggguagagugggaggggggcaaguguugaaaaauuaaacuaacuguuggauacuaugcuuacaaucugggcuaugggaucauucauacaacaaaucccagcaacaaauaauuuacucauguaucaaacccacacauguacccccucaucuaaaaugaaaguugaaagaaaaaacaaaacaaaacaaccacacccacacccacacaaauaucuaugucauuuugcagauacagaaacugaggccuggaaggauuaaguaacugucagagaucucaaauugccaaguuccuaauacagaccuccuuccccuacauugcugcaaagaugagaauaugguuaacuuucaaugcucaaaaaacaaacaaacaaaaaagaagcugaggcaggcagaucgcuugagcccaggaguuugagaccagccuggacaacauaaugagaccaugucucuacaaaaaauaaaaauaaaaaaauuagcugggugugguggcgugggccuguaguucgagcuacuugggaggcugaggugggaggagugccugagcccaggagguuggagcugcagugaaccaugaaugagccacugcacuccagccugggcaacagagugagacccuaucucaaaaagaaaaaaaaaaaaaaaaaaaagguuaacuggaauuuuggcuuucuucuuucuucuaaaaauaggauacuuaaugcuguuggaauugcuuuaacaaagagaaagagaaaaaaaagaauccaacaaaaaacucuuugggauugagauuucuggugaauuagucauugagcaaauauuaauugagcaucuaucaugcagcaagcacaaagaaaucaguuugaaccccccaaaacucuguggaguuaaaagacauguaaauuauuuuauuauuaugacaauuacuacacaccaguaaacaaauccuuaaguccuucaaggaacuuaucaagaaagaaaucaagguucugagcugaaaacuaguggaaggagaaauuucaggacaagggaagagcaagggaggcaugagaaggaauaacauguuagggaaauuaaaaaguaucacuggaauagaaauagaaaggguaaaaauguaagguuugacagugaagucagaccaugagguacaaagaaaaauuuuaugcugcucuaaucaauaccacuccaauuauuuuuguuagaaauacuguucugggccaggcacaguggcucaugccuguaaucccagcacuuuggaaggcugaggugggcagaucacgaggucaggaguuugacaccagccuggccaacauggugaaaccccaucucuacuuaaaaaauacaaaaauuagcugggugugguggcacgcgccuguaaucccagcuacucgggaagcugaggcaggacaaucgcuugaacuugggagguugcagugagccgagaucgagccaccgcacuccagcgugggugagagagugagacuccgucucaaaaaaaaaaaaaaaaaaaggaagaaaaagaaaaauauuauucugaggccagacgugguggcucaugccuguaaucccaguacuuuguaaggccaaggcagguggaucacuuaaggccaggaguucaauaccagccuggccaacauggcgaaaccccaucucuacuaaaaauacaaaaauuagcugggcgugguggcacgugccuguggucccagcuacgcaagaaggggagcuggaaagauggcuugaguccagcaggcggaggcugcagugagccaagacuguacaauugcacuccagccugggcgacagauacucugucaaggaagagaagagaagggagaagaggagugaaaagagaagagaaagagaauagaaauauuauucuggaaaaaguaggaaggcugaauugagaagacuuuaaaugugggcuaccaguuauacaaguuuaguccagaggagaaaugaaguauaaacugaggcaguggcaaugcauaugacaagaggguuaacuaaggacugugacuuuuugugacuuuaacuccaauaagaauuuacaaacacacauuuaaaaauauuccccaguauuuaguaugaaaaauuguucucuuucaaauuuauuccaggacugugagaaaguuuucauaauuuccuugguggaaaaguccaaggcccacacacaggccccccaaguguucacggugauuucugcuauucaucacuucuggcacucucacuaacaguaguauuaaacacacacacacacacacacaccccugaaaacaguucaaaucaaauaaucaguuuuaugacuauuucauuuuugauacuaauuuuaagcaaaaauacaauguuggagaaacgacaacuagaauccuugaauaugugaaauaauccucagaugguccaaaauaaaaaugacaaaauuaacguuuauggccgggcacaguggcucacgccuguaaucacagcacuuugggaggcuguggcagguggaucaccugaggucaagaguucgagaccagccugcccaacauggugaaaccuugucucuacuaaaaauacaaaaaaauaagccagaagugguggugggcgccuauaaucccagcaacucuggaagcugaggcagaagaaucacuugaaccugggagacaaagguuguagugagccaagguugagccauugcacuccagccuggggacaacagcgaaacuccgucucaaaaaaacaaaacaaaaaauacuaaucuuuaucaauacccaucucaaagaccuacuucuaaaagacuaucugcuguaaagguaaucuguuacucagaguaaucagaauguauacuacuuugcaagguucagaaauauuccucuuaaauacuuagaggaguucauaaauaucgaugcccagcccacucugaaaaaauaacgcauuuugaaccaacuugauaauaagugucuguacuugucaaauaaagaaguaccccaaaaaagggaggccagcaaacacuacugaguaaguaugucaaaaccuuuccaagauauaacuauguucuugaacagauucagcaacauaaagaugucaacuacaaccccugaaguucauuuacaaauuucauaaaauuucaacuuuaaaaaguugauuucaaauuucuuuuagaggagcaaauaaacaggaaaacucugaaaaagagcaacagaguggaggcagggguguuccuccagaucaaaauauaucauaagccucuauaauuaaguguuauauuggcauauauaggggaagaccaguggaacagaaauuccaguugaggcugggugcaguggcucacacccguaauuccagcacuuugggaggccaagggguggacugcuugagcucaggagaguuccuguuucauugcuguuuuaauuugcaauuccuuaaggaccucaaauccuuaaagauuugagcaucuuuucauaugcuuacaugccaucuguauaucuuuuuuggugaguugucuguucugaucuuuucccuaccuuuugauugaguuguucauuuuaaguuuuaaaaauauauuuugggccgggcacgguggcucacgccuguaaucccagcacuuugagaggccgagguaggcggaucaccucaggucaggaauucaagaccagccuggccagcauggcaaaaccccaucucuacuaaaaauacaaaaauuagccgggugugguggcacacaccuguaaucccagcuacucgggaggcugaggcaggagaauugcuugaacccaggagguggagguugcagugagcugagaucacaccacugcacugcagccugggcaacaagagcaaaacucugucucaaucaaacaaacccagucagucuucaugacuacuuaccuaugcuaugcagaguuaaguauaauauaaucauaucucuauaagacaaagacagaaguucucuuacccaaugagaaugagacccauaacuaaucaauuaacugaagucaaaguaauaaaaauauucauuuuaacauuuuacauguuuucauuuuuacauaaaugaauauuuauguaaauauuucauuuuaacauaaaguacucacaugaacauaaguuucugauaaaagccuaucguuuucuuuagggaaugaauccacuagcacuccuuggaacuucuuuaguuuuuauuuuuaguuuuuugagagggagucucacucugucacccaggcuggagugcacuagugcgaccuuggcucacugcaaccucugccucccagguucaagcaauucuccugccucagccuccugaguagcuaggauuacaggcacccgccaccaaaucuggcuaauuuuuguauuuuaguagagaugggguuucaccauguuggccaggcuggucucaaacuccuggccucaggugaucugcccaccucagccucccaaagugcugggauuacaggcgugcaccacugugccuggcuauuuuuuacuuuuuuuuuugagacagggucucacucugucacccaggcuggagugcaguggugcaaucacagcccacugcagccuucaccuccuaggcuaaggugaugcucccaccucagucucccaaguagcugggaucacaggcccacaggcaugcgccacuacgaccagcuaauuuuuuuguuguaguuuuaguagagaugagguuucaccauguugcccaggcugggaucuuuuuagcauaacccauacugauuugauuuccuuaaguguagugcaaccuuaaacacuugccaagcaguaaguguacaauguuguaucucaaugauuucucccuaagucauuuacaguuaacuugcccacaccuaacuaaacaacaauuuuuuuuuuuagcaauuuccccagacagagccuguuuaaagcuuuuaauuuaguuuucguaucgaugaaaacucuuuuugcacugguauuuuacagguuuauguaguguuuaauuaaacacaugugacaaacauaaccagcacacacuaguuugggagcaaauauaacugccucuugucaggaauacaacuugacuggugagacacuugagugcauuacagaguagaguuugcagaaaugcuugaacauauuacagaauagaguuuaggaaaaggaggauaucugcuccaauuaaucagucaagugaagguuaagguuaagagagcuuccacauuaagcuguguaugcagaagacaaaaauacacaaagauaaacaacaaaccuggaauuagaauggggaaauaaaauaagauuugauuacuuuuuaaaauacaauuguauguugcuaacuuccaacaagcauguauuauuagauuuuuuuuuuuuuuuuuuuuuuuuuuuuuuuuuucagacagaaucuggcucuguugcccagguuagagugcaguggcacgaucuuggcucacugguaccuccaccuccugaguucaagugauucccaugccucagccuccugaguagcugggauuacaggccugugccaccacacugggcuaacuuuuuuuguauuuuuauuuuuauuuauuuauuuugagacggagucgcacucuguugcccaggcuuggagugcaguggcacgaucucggcucacugcaaccuccgccuccagaauucaagugauucuccugccuuacccucccgaguagcugggauuacaggugcaugccacuaugucuggcuaauuuuuauauuuucaguagauacgggguuucaccauguuugucaggcuggucucgaacuccuggccucaagugaucugccugccucggccucccaaagugcugagauuauggcacccagccuacuagauuuuuuaaaguaaaaaauaaaaagaauguugugaacuagauaauaguaucuccaauuuuuuuuuuuuuagagucucgcucuugcccaggcuggagugcaguggugcggucucggaucacugcaaccuucgccuccuggguucaagcaauucuccugccuuagccuuccgaguagcugggauuaugggcaccugacacgacgcccagcuaauuuuuuuguauuuuuaguagagacgggguuucaccauguugucuaggcuggucuugaacuccugaccucgugaucugccagccucggccucccaaagugcuuggauuacaggugugagccacugcgcccggccaguaucuccauuuuauagaaaaugaaagagguucaaagaagugagaaccuguucaagaucacagaacucaccauaagcuguugaaaaguuaagucauguuugccuggauuuucaaagcucuuguuuucucaacagugccaaauucucuggcaaaaaacccucaaauggaccacuguauguucuguuuuaaauacaugaacaaaaagcaccauguguuuuuuuuuccuuuagguaauauagucaggugaagccaaaagaaagauuuucaaaaugacuuauaaauuugauucuacagcccagcguucaggcuaucauuuaaaaggaugagggucauaaauuucuuccuccugugcaagcagaaaagggaucauuucuuccucugcuggccugcauaacuccuuuaauucccccuucucucuguccaugucauccuucuccaguuguucaaacagcaaccuagaggcaguaaaccaagacacuaggagagucugcuauauuuggaaauuugggaaaaugaacgccaauaaaaguaaccuuccacauaccugcauuagcucuccuuaaaaccuauguccuuauucuuucccaucugaaauagcugaaaacaauugucugcaauaguuauucauauucaacugguuccaaaauaaacagaaguggagaacuguagaaaaauccuggaagauaucaaaugggcugagaaacaugauaugaaauaaaaugccuuggggaguucuaaccaaauaacaucauaaaaaaauugaaauacaggaaaccugagauuuccaaaauauuuuacuuuuacugauuucaauauaccaaaugaagaaacauauugagaaccaacuccuagcagugucauccuguucuguacugaccccuguggagauuccaaacacauacuccauacugcuaaugaagcaaaccugaaaccuagugucacucccuaguugaaaaauccuuugauggcuccccucaucuacagauuaaaguuuaaacauugugaacagcuuugaaaggccuccaaaaucuggcuuuaauuuaccuuucuagucuuauuguccacuuucaauacucuucaguucaucaccacagacacuucacuuucccaucucccuaccuugugcaagcuauuucuuuagcuuugaauauucugcccaacacauguugaaacucuauuccucuuccaaaguagcaagguauauuaguaagaacucagccaucaaguccagaucuagacccacuagaauuccacuaccuaguagcuuaaucaccuugaguaaauacaucaauagaucugcuucauuaugcauaccaccuaugguacuuuguaaacugcuguaaggauuaaacauaauaguuauacauuaacaccaugccuaaggcauaguagauacuuaauaaauguuaccugcuggccagguccgguggcucacgccuguaauccgagcacuuugggaggccgaggcagguggaucaccugaggucaggaguucgagaccagccuggccaacacggggaaaccuugucuguacuaaaaauacaaaaauuagccaggcaugguggcaggcacuuguaaucccagcuacucaggaggcugaggcaagagaauagcuuaaaccugggaggcagaggcugcagugagccgagaucgcaccacugcaccccagccagggcaacagagcaagccuccgucucaaaaacaaacagacaaaaauuagccaggcacuucuaguccuagccacuuaggaggcugaggugggaggaucacuugagcccaggaguuugagguugcaaugaacuaugaucacgccacugcacuucagccugggcaacagagauauguugucucaaaaaaaaaaaaaaaaaaaaaaaaaaaaauauauauauauauauauguguguauauauauauguguauauauauguguguauauauauauauguauauauauauauguguguauauauauauguauauauauauacacacacacacguauauauauguauauauacaauauacauauauacacauauauauauaucuauauauaucgcauacccauuauucauguguguacuugacuucuccauuaaguuacacagaagaugguuguggauauaaauuucuaaaucucuaccacuuacuacuugugaaagcuauuugaccucucagaaccuguuucuucauuauuaaaaugaacaagauuaacccuuuacacuguuauauuaaaagguuuaaaagaguuaaggggccaggugugguggcucacaucuguaaucucaacacugaggcaacucaucucaacacuguaaucucaaccucugaggcagcaguuugagagcagccuggacaacauagcaagacucccgucucuacuuaaaaaaaaauuuuuuuuuugagacagagucccgcucuguugcccaggcuggagugcaguggcacgaucuuggcucacugcaaccuccaccucccggguucaagugagccuccugccucagccccccuaguagcugggauuacaggcacaugccaccaugccuggcuaauuuuuguauuuuuaguagagacgagguuuugccauguuggccaggcuggucucgaacuccugaucucaggugauccaccugccucggccucccaaagugcugggauuacaagcaugagccaccacacauggucuaaaauauuuuucuuaaaaaaagaguuaauguacaucaacugcugcuugguauaaugcuuggcaucuaauaaguuucaacaacuguuuguuuaauggcagucuggauaaugaaucugauccagcgauugcuuauagaauagaaaaaugaaagaugcauuucccucaauaaauccaauuucauaaggcaaucuuaauacagcucgaaccugcuacccaccucucuucuaauaaagaucuccacaguuuuggccgggcgcggcggcucacgccuguaaucccagccgaggagggcggaucacgaggucaagaaaucgagaccauccuggccaacaucgugaaaccccgucucuacuaaaaauacaaaaaauucgcuggaugugguggcgcgugccuguagucccagcuacucgagaggcugaggcaggagaaucgcuugaaacuggaaggcggagguugcagugagccgagaucgcgccacugcacuccagccugggcaacaagagcgaaacuccgucucaaaaaaaaaaaaaagaucuccacagaagauaaaauggagguuccuaugcacuuuacuucagaaaugcuaucauagauuuauauucaugcucuuccaguaugagacuaaauauaccauaauuuauaacucacauuacuucauugcacuuaaaccacauguuagcuuaccccugaagaguucuaagggguaaaauggucugccaaaguuaaacaacacucugaaauugguggucuaccuggaaguguaagcugguugucuguuuaacucauucucuaauaauaauuugcugggucaucaauucaauuucucuaccaaaaauuccaaucaaaugucaauuacaucuaugacagcauuuuuccauuuauacacuuccaacacacugcucaauuuaagaggggaaaaaauaaccacuucaaaauuuauuauagugaagucuauucaaggaaauugcaaaaaagugagaacucgccaaaaaaauauuuauuuucucagcauuugcauuccacacucaacuguacacugaaauauaaguugcacaagacagaagucagaagccugggaaggguucuggaagauggacauagcuuuaaaucugacaccaucauuuucuagcuguguaaccuaagcauuuuauuucuuaguccugauacccuucaucuguaaaucagggacuagaacaguaugaaccucauaggguugcuguauuaaaugagguuauguaugcuaaguguuuacaaaguacuuacaucugaaauaguaagugggauucuaccuagcagcgcugcgcacuaagguucuucauauaguugaauaaaugaauauuuacacauuuuauauaaggaaauaaguguaucaauaacuuuaggucuauccuaagucaaauuaauagcagaaaauacuauuugggggcauuuugcagucuacaaggcccuucuaacauccauauguccauuugaucucccgaacauccucaggagguagauuuuuuuuuuuuugagacggaguuucacucuuguugcccaggcuggagugcaguggcacgaucucggcucacugcaaccuccgccucccggguucaagcgagucuccugccuuagccucccgaguagcugggaccacaggcgugcaccaccacgcccggcuaauauuuguauuuuuaguagagacgggguuucaccauauuggccagaguggucucgaacuccugaccucgugauucgcuggccuuggccucccaaagugcugggauuacaggcgugagccaccgcuccuggccuggggguagacauuuuuaagacaguccuuucagagauaaggaaacugguaacaaagugccaagguuacccacccuagugguauccuccaaccauucuccagcucagggguaagugaucaguggcaaauguucuuaauacaacaucuuguauuaacauaacauuucugcaaguuaccacccuccucaagcauaguuaagcacaggaauccaggaauaagccaaaaguaauaaaucccgacagaccacugaugacacuuaucaucuugcauuguuuccucacuugguguccucccacaccucuagggcggggaccagaucuguguguaggugcccccuccccgaccggaacccccaacacgaaaccugguauccaagaggccccaguuugugggaguguauguggaaauggcaugggaugcuggcaggagguuuuccugucagagacccgaaaugacgccaacuccgcgguggggacuaagcuucuccggcagauauagacucguugggcggagaggguccgaccgauaaccgggcugggaaggauggcugaggacugacgccgcuaaggcaaaccagggaagcugacacgcugagggcacagaggcacagacgaggcgggucugcccgcagcgauggcuggaaggcuaggguccaacagaggcuugggggccgggggaaucagggcaguuggagucugggggggagggggccggccugcuggucugagaaggaucugaacccaaucugaggaggguucugaacuccucuaggggccuacuccccaucccacggaggcaucugcugcaccgaguacucgcugcuaccugaaacugcagcagcuucucugucugcuccuggguuagaucccgcuccucaggcgccgccauuuugccgccgccucuacgcuccugacccguccgcaccgucacccgccggaacu

SEQ ID NO: 192422 - RNA, 44049 nt, Homo sapiens
aggcgccugagaggcucucuaccggugaggguuugcggggaagauggaguaucccgcgccggccacggugcaggccgcggacggcggagcggccgggccuuacagcagcucggaguugcuggagggccaggagccggacggggugcgcuuugaccgcgagagggcgcgccgccugugggaagccguguccggugcccagccgguggguagagaggaaggugagucgggggcuuuggaggcagaaagccccucgcccgcugcgcggcucgcggggaacugcggaagcgccgacggucacacccccuggcccgccuccuugcgugcugcgccccgggacccccagacuugugcuccccauccgggcgcgggcaccccaagaaucgggcccccagcgcgcugagggugaagggccgcucacgcucaggcccuggguuuuccuccuccuccuucaucauucacuacagcgcaguuuuucccacauucgaggacugucaucccuauacucguccugucggagaccuacagucuuugccaucccgguaagccaagccgagugccccucaccacuccuugacuccccaucgucccaaucuccagauuuccuccuagggccucucgccucccuucucucaagccccacacuuccgagggcucuggaaggccuucuccuuacccccuggguuccuccuggucuugaugacugagcccuggcuuacccguuuuuagcucucuggccucuacuugcugggucccuuauucuaagguggggacaaggagccugagaaacuggucuggguuugcuuuggcuccagcuucuuuguguccuacacuugacccaaaguugcugagaacaguguaugcaaagccacguuaggggucacuccugggccgaagcgccccagcuugcucugcacuugaccugagacuggguaagaugggaugaaagaaagagaaggauggaaaagagcuguccugaccugcuugugugacucccuucacuguccuuuacagagccagcugcuugaugcuaacccagauguacaagaacucuaucugggcuucucugcuaaccuugucagguaucuggagggaaaucagauuucuccagugauuuguuugcuugcugagcagacuugucuucgaaaguuuaauaugcuauuugugaacugacugcccuggauaaaauuggauaaaauugaaauuuugaccauaucuaaggaagguacacagaccuauacccugguauauacuucuccaauuuaaaaacaagucuagccugucuccuaaguuuauauauauauauaauguauauuauauauaaaaaagaaggagacagggccccagaaaugguguguguguaugcguauauauaauauacacacacauaaauguauauauauaauauauacacacauaaaucuguauauauauuuuuauauacacuuguaaguauuuuauguauacacacacacacacacacacacuauuucuggggcccucucuccuuuuuuuuuuuuuuuuuuuugagagagucucacucugucacccagguuggagugcaguggcacaaucacacugcaaccuccgccuccuggguucaagcaauucuauacugccucagccuccggaguagcugggauuacaggcugcugccaugacgcucagcugauuuuuguauuuuuaguagagaugggguuucaccauguuggccaggcuguucucgaacuccugaccucaagugaucugcccgccuugaccucccaaagugcugggauuacaggcaugagccaccgcacccggcucuccuacuuucacacuuguuugguaguuuccuccccuaccccaauuuuccuuucauuaacuugacaaacacucacugaugccugcucuggacccggaacugguugagcuucagagcuggaguaucagaggaagauacugcccuugcccuggaaaggcuugcagucuaguccaggaagcagacaccaaaacaguuccaguguaauguaaaggaugcagugcugaggaauguuuuaagaguuggaggugcacaagaagaaagugaccuuugcccuggaucuugaagcagaaaaccacugugcucugaaaagugaacugucugcuauguguauaugaguguauaguggcacuguuaugacccauuucauuucccuguucucacuucucccacauuuaugugaaaucuagguagacaccuacaacauuaaguucuacucacccuuuuucuacucuuagcaccuucaugugaguuacaauuuauauaccauacaagucacccauuguaagcauaucgccagugauuguuagccaguguacagaguuguauagccauuaccacaguccacuuuuagaacauuuccgucaccccaauuaguuccuuugagcucauuuauauuaaauccccacucccaccuccugcccuaggcaaccagugaccuguuuucugucuuggguagucuuuugaguuuggcuucucucagcauguuuuugaaguucagccaagucaugguguguauuaguacuucauuccuuuuuauugcuaaauagaauuccauugaaugaauauaacacauucuauuaauccauucauuaguucuagacauuuggauuguuuccaguuuggaguuuuugugaauagugcugcugcgaacauucaugcccaaguuuuugugugaacauacauuucauuucuugaguauaucccuaagaguggaauugcugggucauaucguaacucugacauuuuggagaacugccaaacuguuuuccaaaauggcuucaccuuuuauauuucugccaucaguguaugaggguuucgcuuuuucuauaaccuugacaacacuugucuuuuuugauuauaggcauucuagugggcauguagugauaucucauugugguuuccuaaagacugauaauacugagcaacuuuucaggggcugacuacccauuuguagaucuuuggugaaauaucuauucacaucauuugccuauuuuguaauugggcuguuugucuucuacugaguuguaagaguuaucuguguauucuggguacaagucuuuuauuauagauaugauuuccagguauuucccccugacugugacuuguuuuuucauuuucuaaacagugccuuuugaagcacaaaaguuuuaaguuuugaugagauuaaauuuaucauuuuuuauccuauguauugugcuuuagugucauaucuaagaacucuuuaucuuaacccaagauuugagaaauuuucucuuguagaucuuccuuauuauuauuauuauuuuuuuuuuugagaugcagucucacccugucacccaggcuggagugcaguggcaugaucucagcucacugcaaccuucgucucccugguucuccuggaggaggucaagcgauucuccugccucagcgucccgaguagcugggauuacagguguucaccaccacaucuggcuaauuuuuguauuuuuaguagagaugggguuucaccacguuggccaggcuggucucaaacuccugaccucaagugaucugcccccuucagccucccaaagugcuggcauuacacgcgugagcuaccaugcccagccccuuccucaucuuguuucugaaggaguuugugaaggauggauugguaauuuuuuuuuuuuuuuuuuuuuuuuugagacagaaucccacucuaucgcccaggcuagagugugguggcacgaucucagcucacugcagccucccugucccagauuuaagugauucucccgccucagccuccugaguagcugggauuacaggagggugcuaccacacccagcuaauuuuuuuguauuuuuaguagagacagaguuucaccauguuggccagacuggucuugaacuccugaccucaggugauccaccagccuuggccucccgaaguguugggauuacaggugugagccaccacacucaguugguaauauuucuuuuuacaguauuuuauagaaguguugaccugcaaggaagaggcuaacacacaaaauaugauuugaagaguuuacuugauuuuuaaaggcaaaaaaauguggacagggagugggacucauacaaaguuguuuaucaagaauucucauugauuuacagaaauaacauugguuagugauuggcuguacauuaagcuguaggauguaggauauagcgucagguagggcauuauuagguuaauccuuacccacuuguggcaauagcaagcaguuuugauagaugaaucuuagcucaaaaagggagaauaggaagugauugcuaucucauuuuaauaucucucugggcccugaucauuuaaaaaaacuuggauucuuuagauaaaaguuaucuucuuuuuuuucagacagagacucacucuuccgcccagacuggagugcaguggugugaucucggcucacugcaaccuuugccucccggguucaagcgauucucgugccucagccucucagguagcugggauuacaggcgccugccagcacacccagcuaauuuuuguauuuuucguagagacggaguuucaccauguuggucaggcuggucucaaacuccugaccucaggugauccgccucagccucccaaagugcugggauuacaggggugagccaucacgcccagccgauaaaaguuauuuucugaccugccugggcaacguggagaaacccuguaaauuuuuguaaaauuuguguuuuuguaaaaauacaaacauuagccaggugugguggcucacaucuguaaucccagcuacucagguggcugaggcacgagaaucgcuugaacccaggaggcuaagguugcagugagccgagauugugccacugcacuccagucuaggcaacacaguugagacuuugucucaaaaaaaaaaaaaaaaaaaaguuaucaccagugaagcuaccugggccuaagcuuuucuuucuuccuuuccuuuuuuuuuuuuuaaauucucuauuuauuuauuuagagacagggucucuguugcccaggcuagagugcaguggcacaaucauagcucacugcagccucagacuccuucaaacucaaagcuaggacugcaagggcauaccaccaugcccagcuaauuuuuguguuuuuuuaaauagagggucuugcucuguugcccaggcuggucugaaacuccuggccucuagugauccuccugccucagccucccaaaggguuaggauuauaggcaagcaugcgccauggcacccagcuggcuucggcuuuucuuuguggaaagguauuugauuauucauuuucuuuacuuguuuuaaguguacacagaauauuuuguuucuccuugugucacuuuuuuuuuuuuuuuuuuuuuuuuuuuuuuuugagacggggucuugccaggcuggagugcaguaaugaucacugcagccuucgccucccagguucaagcaauucuccugccccagccucccgaguagcugggauuacaggcaugugucaccaugcccggcuaacuuuuuuguauuuuuaguagagacgggguuucacuguguuggccaggcuggucuugaacuccucgaacucuaaagugaucuguccgccucugcuuucccaaagcacugggauuacagaugugaggucccugauuauuuucuugguuagucuagcuaagaauuugucauuuucuugaucuuuucuaguuucuaagguaagaucuuauguugcugauuugagugauuugagauccuucuuuucugauguagauguuuaaaauuauaaauuucucucuuaagcacuugugacguuuuauauauauauauauauauauauauuucccuccauaguuccuggcucacagcuucuauaacccuuguacuuuccucagugacuaaagcaguaagaguaucuucuguuaaaauauuuggccuuuuguccuugcuuccugaaacaccucuggaacugcuccagagcaagaaaggugaaaaacagacuuuuguuauuuauaacaagccccuuucuuuuuuuuuuuuuuuuuuuuuuuuuuuuaugagauggagucucgcucuguugcccaggcuggagugcaguggugcgaucucggcucacugcaagcuccgccucccagguucaugccauucuccugccccagccucccaaguagcugggacuauaggcgcccaccaccacaccuggcuaauuuuuuguauuuuuaguagagacgggguuucaccauguuagccaggcugaucucgauuuccugaccucguaaucugcccuccucggccucccaaagugcugggauuacaggcgugagccaccgcacccggccauauaacaagccccuuucagccacaccuugguacauguuaauagggugauuuuugagaagucccuagauuaccacauucugguuggcugguugccauaggaaccaaccaugugcucagaggcuuggaaguuacagccccccaucuugagaggguagaaaggagcugaagguugaauugaucaccgauagccagugauuuaaucaaccaugccuauguaaugaagccuucauaacaacccaaagaccucaguuuaggggcuuccaggaaggugaacaagaacacauucaugugcuggaaguguggcacaccccaauuccauggggauagacgcuccuacacauuagacccuuccagaccuggccguauguaucucuuuaucuauuuguauccuuuaacauaucuuuuagguuggccugacccaguggcuccugccuguaauuccaaaacuuugagaggccaaggcaagaauguuaguggccaugaaucucaauuucugccuccucagaagaaagaauucaaccaaaggggcauaaggcaaagugagagaccaaggcaacucuuagagcaagagugaaaguuuauuaaaaaguuuuagggcaggaaugaaaagaaguaaaguauacuuggaagaggaccaagauggcgacuugagagagacaaguaggcgguuugaccuuugacuugggaucuuacacauucacacgcuugcugggucuugcguguuacuucuccccugguuuuucccugaguucugugagcugcucuagcaaauuaauugaauccaggggugucauggaaaccucgauuuauagccgguuggucagaaaaacaggugaaagaauguggaaccugcaauuggcaucagaaguagggcucagucuuguaggaauaagcccucaaccuguaggaucugaagcugucuccagguagauagugucagaauugauuugaauuaggggacaccaacugguguccacugcagaauugagugcuugguuucugggaggagaaaacccacacauauggucacagaagcguucuguauuguaaaaguaaaguaggauaaacugaguuuuuuuucuccagagcacugcuuuaguugcaacucauaaauuuuugaauguuuuauuuucacuuaaaucaguucaaaauaauuucuaauuucccuuguaaaauuucuucuuugauacauguuauucaauuucuaaauauuugaggauuucccagauuucuuccuauuguugauuucugauuaaauuccauugcguucaaagaauauacuugagaugaguucaguccuuuuaaauguagugcaacugggcugggggcgguggcucacgccuguaaucccagcacugggaggccgaggcggguggaucauuugagggcaggaguucaagaccagcauggccaauauggugaaacccccaucucuacuaaaauacaaaaauuagccgggcaugguggugccgugccaugggguuucaccguguuagccaggauggucucgauuuccugaccucgugauccgcccgccucagccucccaaagugcugggauuauaggcgugagccaccaugccuggcuauuucauuuuuaaauaacagcuuuauugacguaaaucucacauuccauaaaauucaccuguuuaaaauguacaauucugugguuuuuaguauauucacagaguucugcaaccaucaccacugucuaauuuuagaacauuuucaucaccccaauaaagaaacccuauaccuaggagcaaucaucccuggcaacgacuuaucuccucucuuuauggauugaugccuauucuggacauuucauguaaauagaauuguauaaauauguggcauuuuugugacuggcuucuuucgcuuaguguaauuuuuuuuuuuuuuuuuuuugguuuuuuuuugagacgacauuuugcucuuguugcccaggcuggagugcaauggcaugaucuaggcucacugcacccucugccuguagaguucaagcgauucucuuuuuucuguuuuauuuuguuuugagacagagucucgcucugucgcccaggcuggagugcaguggcgcgaucucggcucacugcaugcuccgccuccuggguucacgccauucuccugccucagccucccgaguagcugggauuacaggcaugcgccccacagccagcuaauuuuguauuuuuaguagagacaggguuucuccauguuggcaaggcuagucucaaacucucaaccucaggugaucugccgccuuggccucccaaagugcugggauuacaggcaugagccacugcgccuggacacuuaguguaauguuugcaggaucauuuggcuggauauagaauucuuaguugacauuuuuauucuuuuucaccacuuugaauaugucauuccagugccuucuggccuuaauuguuuucaaauaagaaguugucauuaauugaauuauuucacuguacaugaugagucauuuuucucucucucucaccgcuuucaggauuuucugucuuugccuuucaacaguuugugaugugucuagguguagcucucuucacauuuuuccuaguuuggguuccuugagauuuuggaauguguagauuaauguuuuucaucaaauaugggagguuuuuggacauuuucuucaaauauuuuuuucuacucucucucucuucucucuucuucugaggcucuccuuacacauauguuaguaugcuugaaguuuuuccauaaucucugaagcuuuguucauuauucuucaauguuauuucucuuuguucuucagaucagcuauuucuauugcuguaucuucaaguucacugauucuucugccauuuugaacuugcuguugagcuccuccagcaaauuuauuguauuauaauuucaacuccagaauuuccauuuguuuguuuuauuaguagcagaucaucaguacccuuacauuugcuuucuucaugccuuuucuuuuuucuuuuuuuuuuuuuuuuuuuuuuuuuugagauggauuuucacucuuguugcccaggagugcaauggcacaaucucagcucacugcaaccucugccuccagauccaagcaauucuccugccucagccucccgaguaacugggauuauagguaugcgccaccacaccuggcuaauuuuuuguguuuuuaguacagauggaguuucacuauguuggucaggcugguuuugaccuccugaccucagguaauccacccaccuuggccuccuaaagugcugggauuacaggcgugagccacugcacccagccuuuuuuuguuuuuguuuuuguuuuuagacagagucuugcucugucaccaggcuagagugcaguggcgcagucuuggcaugcugggauuacaagcaugagccacugcacgcagcuuuuuuuuuuugagacagaguuucgcccuugucacccaggcuggagugcaauggcacaaucucaguucacugcaaccuccaccuccuggguucaagcgauucuccugccucagccugcugaguuagcugggauuaccagcccucuaccacaccuggcuaauuuuugcacuuuuuaauagagaugggguuuuaccacguuggccagccuggucucaaacuccugaccucaggugauccgcccgccucggccucccaaaaugcugacauuacaggugugagccaccaugcccggccucuucaugcccuuuucauuggauagaaauuugagcuucuugagaccaucagcaguauggauuuggccaggcaugguggcccacaccuguagucccagcugcuugagaggcugaugcagaaggaucacuugaggccaggagucugaauucagccuaggcaacauaaugagacucugacucuaaaaaauuaaauuaaaaacaaaaacacaguauggacucacaaaauggaaguaccagugcuaaguagacuuaauaggaccgucuuguucauucuuuuaggccauacugcccauuaaaauacuacauugucuaaccauucucauccauggguagauuauacccaaccucccuuuccuaugauuguuugagggguuuuugcuuuugagaugggggaucuugcucugucacccagcugaagugcaguggcgcaauuauggcucaccagagccucgaacugcuagacucaagugauuucccccaugucagcuucccuaguaaccagcacuacaggcgugugccaccacaccuggauaauuuuuuaauuuuuuuuguaaagaugaggucucacuuugcugccuguguuggucucaaacuccuggcaucaagcaauccucuagccucagucucccagagugucagauuacaggcgugggccacugacccagcccuaggaucuuuuauuuucugcuuucugacuauagcuauaccuaaaaacccuuugccuccuaauaagcuggguaguaaauagguuucaucuuccuaaggaucaccuucagucaguugacgaauuuuuuuguuuuguuuuguuuuguuuuuguuuuuguuuuguuuugagauggagucucacucuguagcccaggcuggagugcaguggcaugaucucugcucacugcaagcuccgccuccuggguucacgccguucuccugccucagccuccugaguggcugggacuacaggcacccgccaccacacauggcuaauuuuuuguauuuuuaguagagaugggguuucaccauguuagccaggauggucucgaucuccugaccucgugauccacccaccucgaccuuccaaagugcuaggauuacaggcgugagccaccgcaccuggcccaguugaugaauuuauacagagcucaauuguagauucuaaggucacauguaggccuaaggaauagcaagucauuuuugagacagggucucacucccucaccaaggcuggagcauagcagugcaauccuggcucauuguagccucgagcucccaaacucaggugauccucccacgucagccacuugaguagcagggauaacaagugugcaccaccauacccagcuaauuuuuuguaguuuuuuauagagaugggguuucaccauguugucuaagcuggucucgaacuccuggcucaaaugauccucccaccucagccuccugaauagcugggacuacaagugcaugcaggcuaccacaccuggcuuaaauuuccuuucuuucuuuuuuuuuuuuuuaauuuugagacaaggucuugcagugucacccaggauggaggcugaagugcaguggugugaucacagcucacuucacugcagccuugaccuccugggcucaaguucaaacgauccucccaccucagccuaccaaguagcugggacuguaggugugcaccacgacacucagcuaaucuuuuuugguuuuuuguaaagacagggucccacuauguugcccaggcugguucuugaacuccugggcucaagcgguccuuccaccucagccucccaaagugcugggauuauaggcaugaaccaucacacccaacccuuaaauuuguuaaguuuauuaauuaucuugcugucccacaaaaguucucuguguuccuacuucaucgacccugugaaaagcagcccugugcuucauacucuagauggcaucucucagccucugccccauacaucuuuuacuuggcuaucauguggauauaaauuaaauccugugaauacguaacaucucauaggauguagaaugcagaaaugcaguaaagaccauacuucugugccucuuggcuauuguugcugucaaaaaaggucauggaacuacaucaguuuuccagcauccguuguccagcuucauagguugagagagaaguuguuacagucaaagcaucuugcuuccagcagagcugugaaggagccucagagacuguaggucaccuauuggaacauguaugcauuauuccuggagauguuucuggaggcccaaccuaguaucauacuuucagccucucuagugauuuucuuuuucuuuucuuuucuuuucuuuuuuuuuuuugagauggagucuuacucugucgcccaggcucaaguguaguggcacgaucuuggcucacugcaaccuccaccuccuggguucaagugauucuugugccucagccucccaaguagcugggauuauaggcacauagcaccaugccugccuaauuuuuuuauuuuugguggagacggggguuugccauguuggcgaggcuggucucaaacuccuggccucaagcaaucuaccugccuuggccuucccaaguguugggauuacaggcugagccaccacgcccugccucuccagugaaugaaugaaaagcaccucauuuuccauaucaaaucuuuugcacccuggagagauaguugguaguuggauuaaaguugugugcagauaucauggcaaaaaggauguguagucaggcugccaucucagaauuuugacaauuuuuuuuuuuuuuugagacagaguuuuacuccuguugcccaggcuggagugcaauggcgcaaucuuggcugacugcagccuccgccucccggguucaagcaguucuccugucucagccucccgaguaacuggaauuacaagugccuuaccaucacacccggcuaauugacuuuuuuuuuuuuuuuuuuuuuugagacaguuucacugugucgcgcaggcuggagugcaguggcaugaucucggcucacugcaaccuccgccuccuggguucaaucgauucuccugccucagccucccaaguagcugggacacaggcaccugccaccaugcccuggggcuaaacuuuuuuguauuuuuaguagagacaggguuucacuauguuggccaggcuggucuugaacuccuggccucgugauccgcccgccucugccucccaaagugcugguauuacaggcgugagcuaccgcacccggccuaauugacaauuuuauccaaguuuuuuuuuuuuuucccucugugggccuuagcuuccuccaaccucauaaaccucucaguuuuugugggccaggaauuugggaaaggcuuggcuggauaguucugauucagggucucuuaugcaguugcagucagaugguggcucaaguugaaacagcagggaaauggagcaucugggagcuagagcugaaacaacagcgggguggagccucugggggcuggccagacaucucucuuuucauguggugucaggaacucuccauguggucuugaugcaugaaauagucugggguuucucacagcuugguggccucagagcagucagacugcuuacauggugggcaaaggcuuuaaaagcaaacauucccaauuugguucccuuuuauaauuucuacuuuaauguguuuauguugcuuaguggucagauuaacuagggauucaacaagaucuuguucuaaacaccuggagccuauaagcccuugauuuuguauuguuggaucuguguguugguagggaagcauaaucaaaguucaagucauuuugagaucuacccuucccacgagguccuuuugcaucucuuuuguguguguacgcagccucaggguggccaugaguauguggcuaacuugggcccucucaggucuccgcugucacacagucucagccaggaacacacuugccccaaccaugagcacaccuccggccagugaagccuuucacucuuccugcuuacugccuuggagaucaucauuuccaucaacaauauugcuacauguaaaggaaaucaagugauuuccuuccuucuguauggaagcuauuuguuuucauggcuagcaccuucuugccagaguuucuacaccgauugcaggaagggcugagagcagccucaccugagccugggaaauugaggcuacagugagcugacauuaugccacugcacuccagugugggcacugcagccugggaaacccugagguuuuguuuguuuguuuguuuuuccccaucuggggaaaaaaaaaagccgcugauuccuacuguucuuaccugaaguucagcaguuuugcaagcacaaaauugcucucggauuguuaagucccuuugguuaacuuccagagugcugaagugguugguuuugucaguuuuguccgguuuugucaguuuuguccuguuuuauuguugcuucugcaggagaucuccucacucugccuuggccagaaguuccacccuguacucacuuuguuuuauauucaacuucgcuuccucugccugacuucaaaauugggagggucccaaggcucagucucugaaccucuuuccuucuucaucuacgcuaggcaaucucuuccagccccacaguguucaauaugauugauauaccaaugauuccccauuuauaucuccagcucugaccucccccuugagcuucaagugacugacagaucugaaucuccaacucaucuccaccuauauaucugauagacuacucacacucacauaacgaaaagucuuuaauuuuuccuccaaggcuaucuuccccuaguucuaaucuauucacuuguucaaguucaaaaccuaggaguuauccuugacuccuuuccuuccuucacucccacccccacauccagucuaagaaaucagaugucaaaccuauugccggaacauaauuccaaauucauucacuuuucuccaucuccacugacaaccugccuaguccaagcuuccaucaucuauucucugaagacuacagcagccuucuccuuguucuuucugcuuccauucuuguccccauacagucuguugacaacaacugucagaguaaucuuuucaagggcaaaccagaucuugucaccucucauuacacuaacaauaaaauccguaguucauacuguggcuuauggagccuuauauucauucaacaucaucuacuaggccucaugcugucucuccaacuuaauuuccuaccauucuucucucauucaccauauuccaggcauagugggcuucucuccauucuuugaacauggaauaugccaaacucaucccugccucacagacuuaauacuguuucagguuggaacacucuuuuccuguaagccuuguggcugacacuuccccaugaugauuuuuuuuuuuuuuuuuaaauuuucagagucaaagucuuucucuguugccuaggcuggagugcaguggcacauucacggcucacugaagcuucaaacuucuaggcucaagggauucucccaccucagccuccugaauagcuaagacuacaggcaugcgccaccaugcccaacuacguuuuuuuuuuuuguguguguguguuuuuuaauuuuuguagagauguggcucucccuguguugcccaggacagucugaaacuucugggcugaagcaauccucuugccucagccuguugaguuucugggauuauaggugugagccaccacaaccggcccugugauggucuuuacuaacucuccugccccgucauucucuaccccguacucugcuuguuuucauagcauuucuaauucucugucauugucuugcuuauuuuuuacuuuauaccccaucuucuuuguugguauggcccccagcacuaagugcaguguugacacaaagcacguauuauaaauauauuuguguggacuaugugaauguacucucuaaggccagagagugcauuccagcagagagguacauuuauuuagcaggugcuuaccugcccuugcuguggguuugggagucugauucugaauaugcuugaaaccucaucucuugaacaaaacaaaauccacaaucuccaggugaggaagugaugacugaacucugaccccuggguauuaccuuccccauguggguuucuuauugugagaagccucugacccucuuuuuuuucuucuuuuuucuucuucuucuuguguguguguguguguguguguguguguguguguguguccgaguuuugcuguugcucaggcuggagugcaauggcacaaucucggcucacugcaaccucugccucccagguucaagugauuguccugccucugucucccaaguagcagggauuacaggcaugcuucaccacacccggcuaguuuuguauuuuuaguagagaugggguuuuaccauguuggccaggcuggucucaaacuccugaccucagaugauccacccaccuuggccucccaaagugcuaagauuacaggcauuaccaaucgugccuggccaccucugacccucuuuuaaaaguucugggccaauuuuguuuauagagucauuucucuugguuuuucagagcauagcuaagacaggcaaggucuuucacaaaaauuuaccauuuaaaagaaaaaugcagaaauaaaaagagaucauuaggggcagaaauacagcccuucugccuaaaagggcugacauagguaagcuuuagauuuuguggauuaaggagagacaucuuaaaagcuccccaccaagaaccucuuccagggcaucgacuuuuuuuuuuuuaagacaggggcuugcucuguuauccaggcuggaguacaguggcacuaacauggcuugccauagccuugaccuccugagcucaagcaauccuucugucucugucucagccuuagccucccaugaagcuggaaccacaggcaugugccaccacccccggcuaguuuuugguuuguugguguguuuguuucuauguagagacagagucucaccaucuugcccaggcuggucucaaacuccugggcucaacccauccucccaccucagccucccaaaaugcugggauuacaggugugagccacugugccuagccuugaccacuuuuuggcugagaccaggagauuaaaaaugugggccugcccuccucucccaguuuuagacucugccucugccucugccucacauugccagcgccaugauagaacucaugccuuggccgggcgcgguggcucacgccuguaaucccagcacuuuggaaggccaagguggguggaucacgaggucaggagaucgagaccauccuggcuaacacgaugaaaccccgucucuacuaaaaauacaaaaaaauuaguugggcgugguggugggugccuguaaucccaacuacucgggaggcugaggcaggagaauggugugaacuugggaggcggagcuugcagugagccgacaucaugccacugcacuccagccugggugacagagcgagacucccucucaaaaaaaaaaaaaacaaacaaaaaugaacuuaugccuugggagagauuuuaccuccucuucucuucucaaaaagguaagacuguucuccaggcacaauaauuuaagcacagguuaauaccauguuucauauaguguggcacuuauauaauacguuaugugauuuuauuuuauuuauuuauuuagagacagagucuagcucugucacccaaguuggaguuaguggcacaaccucagcucacuacaaccucugccuccuggguucaaacaauucuccugccucagccucccgaguagcugggauuauaggugccugccaccacaccuggcuaauuuuuguauuuuuaguagagacaggguuucaccauguuggccaggcuggucucgaacuccugaucucaggugaucugcccaccucggccucccaaagugcuaggauuacaggcgugagccaccacgccccacccuguuaugugauuuuaaauguuucaaagucagaucaagaacaaugagaaaaguauuccuuuuucgagucuuucaguccuccugauucuaucugggaagaaguuucaguugggugcuaccauaucuuaaaaccucucagcacaguugcuguucucuucuuccuggggaaugcuccaagccucauuuuuaucauauuuauuuuuauugguaucugcuuaaguuuaugaucuaaagauuccuuuuuaaaagaaguuccuaaguaaagaaaguuggcauacauaaaauuauaaaauaaguaauaguguagguggugugagaacacagcaugagucacgguggcaguaggaaaggcuggcugaggucugccaguguccuaguauggcaucccaucauucagugccuguguuugaggcaggguucaaaggcagugcuguugagguaguguuugucaacucaaugauuucuuguuuuccccucuauaguggagcacaugauccagaagaaccaaugucucuucaccaacacccaguguaagguuugcugcgccuugcuuauuucugagucccagaagcuggcacauuaccagguaugccaucauacuuuuagaacugcguuucuuuucagaccuggugccaaaccacuaauucucucuggcuugcauggugaaguguaauugcugcuuagccacccagauguugccuccaugcauguuggcuugugacuugaagauugacuuaaucuccuugagucucaucucccccauccaaaucaggaucauuauauguguaucuucccuugcagcuuggcauagcauaaaguaugagcuuuggcuuuaaauagaucugacuuuaaaucaaaacucugcuacucaucuugagcaagaaacuucaucauuuuuagauguaguuuccucauccauaaaauagaaauggucauaauuuucucauagauugugaagauuaaauuugguagcuguaaaaugccuugcacagagcaggaacucaaacuucccucaccuccuccucaaaacuuuuugugaggaugaaucagaugaaaaucucauaaguguuuuugagugccuuaaguaugaaguagcauuuggcuaucuuugaucuuucuccuggguuuuugcagagcaaaaaacaugccaacaaagugaagagauaccuagcaauccauggaauggagacauuaaagggggaaacgaagaagcuagacucagaucagguaauacagcugccauauugagcccacuugcuucaugaugaagccagccagcagguugguguggugaacaagucagacugucuuggcuucaaauccuggcccuguugugugacucgggcaagucuauuacuucacaaagccuugauuucuuccucuauaaaaaugaggaugguaauaucaacuaccuuucaggauuuuuuagaacuaaaauugagggcagauuuauaaaaagcacccaauucagagccuggcacauaguagggacucaguaauggagcugguauuacauauuaccgccuagugguuuguuagagcaagacaagagaaaauggaaagaagccaggcugcuugcuuucuugagggccaaggaaaagaacuaaguucagcacuugaauguuuugcauaaauaagcagaaggaacaccuuuccaaaugucugcugugauugagaggugaucacaugugcuuuuuggcucagaaauaauaugagcauuaugcugaagcaacccccaaucccucaggaguaccaucucaucaugggaagagaaguuaagcagacuagggcucaaagcuggcugugugucuuacugaucgggugaguuuggccaagucacuuaaccucugugaacuucccccauaaaguagagauaaugccuacuucuuaaggguauugugagguaaaauuucaauuccuaguagaugcucaauaaauaagaguuuacucuauagacugcuaccuccuauuauaguagccacaggucaggaagguccuuguuuaucucuucucaaaauuuacuggacucauccccugguuucccuuauuauuuauuuauuuaucccugguuucccuccuuucuauuucucuaucugucuauuugugagacaggaccuggcucuguuacccaggcuggagugcaguggugcagucacggcucacugcagccucaaccucccaagcucaagugauccucccacuucaaccucccaaguagcuaggacuacaggcacacaccaccacgccuggcuaacuggagugcaguggcacgaucucagcucacugcaaccuccaccuccuggguucaggcgauuccccugccucagccucugaaguagcugggacuacaggcacgcgccaccacacccagcuaauuuuuguauuuuuaguagagauaggguuucaccagguuggccaggcuggucucaaaccucugaucucaagugaucugccugccucagccucccaaagugcugggauuacaagugugagccacugcgcccagccgccuggcugauuuuuuaaaaaauuuuucguagagacagggucucgcuuuguugcccaggcuggucucaaauuccuggucucaagugauccucccaccucaggcucccaaaguaccaggauuacagguaugagccaccacaccuggcccuuuucucacaauuuauaauucagaaaggcaagauaaacucuaugacccugggcaaguuauuuuacauauuugcacccuauucagagaucaggcuuucugagagagaugcugggaucccuuuauguagucuugaaauacaugguuuccuagccuaaucauaaucaacaaguagaacgcaaugggaggcugggugcgguggcucauaccuguaauccuagcaauuuagguggcugaggcaggcggauugcuugagcuugggaauucgagaccacccuaggcaauauggugaaaccccgucucuauaaaaaauacaaaaauuagccgggugugguggcauauuccuguagucuggcuacuugcaggggugggugggagaauugcuugagcccuggagguggagguugcagugagccgagaucgugccacugcacuccagccugggcaacagagugagacccugucuuaaaaaaaaaaaaccuaaugguccacuuguucagcaaacucugagcaucuacugugugccagacuccagcugggugugaaggauaagaaacaaaaaugagucaaauaguccguguuccaaugucacacuugaguucacagaaaagucuccuaagcuaugacacugucaguuuaggguggcaagugguaugacagaggucuauuuaauguacucugggagcacagaagaggagcaggguuaauucuuccuggaauacacaaagggacuugacaguuguuuacugaaugauguuuuuuuuuuuuugagagaaagucccccagaggaaaagcuuauauuuaaauugggucuugaaggcuaagcagacacgcugccaagcaggaaaggaaggaagcacauuuuagacagcaggaauggccaaagcaaagcaaggaagcaucagagaauaaagugggggauggugaguagagucugggacaaaguagcuggagaagaaucuagaaaguagguugggguuaaugugugaggggggccauaaaugccuguucuguuaugggcaguggggaaccauugaagauuuucugguggggcagugguaugaucagaccuguguucuuucuuccaaccagaagagcagcagaagcaaagacaagaaccagugcugccccaucuguaacaugaccuuuuccuccccugucguggcccagucgcacuaccuggggaagacccacgcaaagaacuuaaagcugaagcagcaguccacuaagguggaagguacugguuuuccugaguagugcuauagugggaccccugccguccucagggcacuacugccaggggcucacagagauccucacugaggccacagacuugaagaaguugaauugcuuuugagaacccuuaaaaaucuccaaguagacccagcuucacugaaaugcaaucucagaauuaugcucaccuaaccucccuuucuuugguuauagguuuuucucuauaggcugagcuuuuguccugacuaauaauuauaacucaggagugccaaaguccuccaggccacgcauaccaugagagcauucuaucuccuaccucucccacuagauuuuuccaucccagcauccaccugcccuuauuacugcauguuccaaguugaaagcuaaauccuugucuuuuucacaugcucagguuauggccuacucacuuuaauccucaaaagcugccuguucuccucaagacagggacuugccuuucaaagcugaauacuucagugcugcuacuacugccccacaaucuguaacugccaugaauucauucccaguacagugacuucugaaauagcccccuuuaucucgucacgacuagggcucagcccucacuuucaucucauuaacuccugacuuucugggguuuuaaccucugcuaauugcaauuagucaagagugaaaguucuuugauguuuauuucauuguuuucuugauaauuuuugcuucucuauuuuggaccaagaaguagacuacacuauuaguaauacuauuauccuuuuuguguuuacugacaacuguguuuuggaagccuucaaagguagggugaaaaaucacucauaauuuuuuuuuuuugagauggagucucgcucuguugccuagguuagagugcaguggcaugaucucggcucacugcaagcucuaccucccagguucaugccauucuucagccucagccucccaaguagcugggacuacaggugcccaccaccaugcccagcuaauuuuuuuguauuuuuuaguagaaacgggguuucacuguguuagccaggauggucucaaacuccugaccucgugauccaccugccucggccucccaaaguguuaggaauacaggcauaagccaccacgccggccaaaaccuuuuuuuuuaaauagagauggcuucucacuauauugcucaggcuggucuugaacuccuggccuuaagugauacucccaucucagcuucccagagugcugggauuacaggcaugagccaccacaccuggccacucauaauuacaccuuuuuaucacacccacaucuaguuauucaugguaugaaacagcagaauguggacuuugaagucacagagucccagguuuaaagccuggcacuguuacuguuuauaugacuuuuuugugucugaacugccuaaccuauaaaaugauaauaauacugucuacuucaucgguugugaggauacaauaauguguauuaaaaacacaggacauaggccgggcaugguggcucaugccuguuguaaucccagcacuuugggaggcugaggugggcagaucacuugaagucaggaguucaagaccagccuggucaacacggugaaacccaaucucuacuaaaaauaacaaaaauuagcugggugugguggcacgagccuguagucccagcuucuugggagacugaggcaagagaaucgcuugaacccgggagcuggagguugcagugagcugagaucgcaccauuguacaccagccugggggacagagcaagaccucgucucaaaaaaaaaaaaaaaaaaaccaauuuuauaaggucacagacuucucuucccacaaaugggaaaauucucugcauuaugccuugucccugaaauuucauacucgagauuauuuuccauauucacuuucagcuuuugccacauacuuuguuuuuauauaguugugaucauaaugcagguacccuuuauaucccgcuuuuacuuuucauuuaauuuuacagcuuaagcacauuuccauguuauuacacaacuuuauaacuauauuucugaaauuaaacacuuuuuaauguaaaguaauauaaucauguuguaagagauaaggaaaacauggauaaauggaaagaaaaguuacccauaauuuuaccauucacagauaaacacuguuaacauuuugguuucuccuauaaucuguuucuccuauaaucuuauuguuauauguaucuuuguauaucuguguguauauucguuuuguguauaucuagguuaacuccguguauaugugcauauaaacauagacuacuuuaaauaacuuucauguuuuuauaaaaacaaugcauacucauuaugaauaauuccacuucaaacaauugcaaaagauacaaagaagaaaguaaaauaucaccuaaauccuacaccaagagagaaauacuguuaauauguuggugauguuuuaaaauaccaguaugcacauauggauuacacgugugggguuuuuaaaauuuuuuuauuuauuuuuauuuauuuauuuauuuauuuauuuauuuauuuugagaugaagucuugcucugucacccaggcuggagugcaguggcacgaucucggcucacugcaaccuccgccuccuggguucaagcgauucuucugccucagccucccaaguagcugggacuacaggcgcgugccaccgcgccuggccaauuuuuguguuuuuauuagagacgggguuucacuauguugcccaggcuggucuugaacuccuggccucaaacaaugaucuuaccguaugguauguacaauugccuuuuuuguuuguuuguuuuuuguuuuuuuuuuuuuuugagauggagucucccucuuuugcccaagcuggagugaaauggcgcaaucucagcucacugcaaccucugccccaccagguucaagcaauucuccugcuuccaccugcugaauagcugggauuacaggugcccaccaccauacccggcuaauguuguuuuuuuguuuuuuugagauggaguuuugcugucgccuagacuggagugcaguggugcaaccuugacucacugcaaccuccacccucuggguucaagcaauucucuugacucagccuccugaguagcugggacuaccggcaccugccaccacgcccaguuaauuuuugcauuuuuaauagagacaggguuucaacauauugcucaggcuggucuugaauuccugaccucaggugauccacccaccucagccucccaaaguucugggauuacagacaugagccaccgugcccugccuaauuuuuguauuacuagcgaugggguuucggcauguuggccaggcagaucucuaacuccugaucucaggugauucacccgcuucugccucccaaagugcuaggauuacagacaugagccaccgcaccuggccauacaauugccuucuauauguuuuuuauuuaauaugacauuuguauuuccccauguuauuaaaaaauucuuuauaagcauuuuuagugacugcaucguacuacauuuaauauucgucuaaugcugaacauuuaaucuccccaccccccacuuuuugguguuacagauaacacuacagugaacaucucuguagaacacuuuauuacauuucagguuauuuucugagaacagacucuauaucccucauuuuauuggaugcgcauuaaaugguucuagacuuacuuacacuuucacuucugaugcuucuguucaguaucucaaagaaugaccguucucucuuaacaaccauuauaccucuuuucugauguuaaaaaucuacauucauuacagaaaaguuggaaaauaguaggccgggugcucacgccuguaauuccagcacuuugggaggcugaggcggguggaucaccugaggucaggaguuugagaccagccugaccaacauggagaaaccccaucucuacuaaaaauacaaaauuagcugggcaugguggcguaugccuguaaucccaucuacuucggagacugaagcaggagaaucgcuugaaccccagaggcagagguugcagugagucaagaucgugccauugcacuccagccugggcaacaagagcaaaacuccaucucaaaaagaaaaaaaagaaaggaaaagucggaaaauagugaaacacacucuacucucugugcuuuugaucuuuuuuccaugcugucaccuaugcguuuguuguuguucuauaaaauugaggacauaagaagcagauugauguguaacuuguuuuuuucuuuuuuuuucuuuuuuuuuuuuuuugagacagaauuucacucuuuucgcucagaguggagugcaauggcgcaaucucagcuuacugcagccuccgcccaccuguucaagcaguucuccugccucagccuccugaguagcugggauuacaggcaugcacuaccacacccagcuaauuuuguauuuuuuuaguagagacugaguuucaccauguuggccaggcuggucucagaacuccugagucagauuaucugccugccucaaccucccaaagugcugggauuacaggcacaagccauugcgccuggccuguaacuugcuuuuuuuacacucaacaccacaaacagaauauuuucucauauuauaaaauauucuacaacauguacauuacuuuuuugaugacuugcugaaacaaaaucaacaagcagagaaacugaaauucccuauacuagaaaaaccauugugggaaaggccagcaaauuucuucuggcuugcccaaaauccucaaaacuuccccaguugaagugauacagguauggaagagcaucugagacauaucaucugugaguccugcugagccccaucaguccuccaccacuggugggggcuucugggccccacauuuuuaaagcaguaguugcuagguugacaccauuucagccacauggacuuguuagugagucguggcauccgcuuuaugaggcagcagcgcagccuagagucaacaucaagccauauguugaugcacaagaggcucgcauguaugccuauaccaggcucugauucacugaauucauuggccagaaucagggauguuuucugaaggcguaaguaagagcuauagccuucaggucuucuugccacacuggcagccuggcauagcaaagagagcacaggcuuuagggucacagaccuggcuucacucacuggcugggucaccuugggcaagccacuucacucaucugagccucaguuuuucugaauaauguggcaaagugauaccuaccucauugggguaguucugaggaccaaaggagaaaauauauguagaaaacacaucacuaauuuuuuuuuuuuugagguggaguuucgcucuugucgcccaggcuggagugcaguggcgcaaucucggcucgcugcaaccuccgccuccuggguugaagugauucuccuaccucagccucccaaguagcugggauuacaggcacacgccaccaugcccagcuaauuuuugaauuuuuaggagagacaggguuucaccauguuggccaggauggccucaaucucuugaccucgugauccgccugccuuggccuccugaagugcuaggauuacagaugugagcaaaacgcauaacuaaauguuaaugguccucuuuucucucuacucagccuauaauaugcaauguagccuaaaaggcaucccuaguaugguuaccuuuucugaaugaccuuguaugagcuccaggaacucaagccucaauuucuguaucugugcauuuguucccagcucugcaacuguauuacuuuaaggaugagaauaaaacucccaaacuucgugucccacuugcugugaaguucugggaaguacugagguaucccugcaagagugcaagugugcaucucuagucuauuguaacuuggcagccugacaggagaagcucagggccuccuaagaauaugagaaccaccaggauuugugggcuuaaaguaguuaaagccgcugaaugaaauagccagucuuugggcucccucaaaucuucccagguuucccaauuagagaaugcauucaccugugugacucacacaggcagugccacaucugcaguaggauuaacuggugucacagcccuuucuauucagcauacucaaaagccugacaccuucuggguuuuuucauuguuucuguuugaacucucucacugcagcucugucaaaacgccuuacaaauccuuuccuuguggccuccaccuuagccuugcaccagaauagagagaugauagacccagacaaguucugcagccucugccaugcaacuuucaacgacccugucauggcucaacaacauuaugugggcaagaaacacagaaaacaggagaccaagcucaaacuaauggcacgcuaugggcggcuggcggacccugcugucacugacuuuccaggugagggggccuagcucacacccagagcuggaccaggguuuggccacuggggcuacccggaccagcugacguugugcuuuuccuccuuaggucuuguaaguaggguuugcgaacucagauggcuacagaagccagaugagaaauuaaaaugagagccaggaaggggauauggucagcugaagagugaaugccauuccuacucagcuguuaccauaucuuucagguuuucuuuucuuuuuuuuuuuuuuuuuuuuuugagacagagucuugcucugucacccaggcuggagugcaguggcgcgaucucggcuuacugcaagcuccaccucccagguucaugccauccuucugccucagccuccugaguagcugggacuacaggugccugacaccaugcccagcuaauuuuuuuguauuuuuaguagagacgggguuucaccauguuagccaggauggucucgaucuccugaccuugugauccgcccaccucggccucccaaagugcuagaauuacaggcgugagccaccgcgcccagcccucuuucagguuuucaaaagacucuggaaagccagauuuauauagaaaucccucuguuuuuguuuuugcguuuguguuuuuugagauggagucucccucugucacccaggcuggagugcagcggcgcaaucucagcucacugcagccuccaccuccuggguucaagcgauuuuccugccucagccucccgaguagcuggggcuacaggcacacaccaccacgcccggcuaauuuuuguauuuuuaguagagacaagguuucaccauguugggcaggauggucucgauuuccugaccucgugauccguccgccucggccucccaaagugcugagauuacaggcgugagccacugcacccggccccucugauuuuuaaauguguaacuaaauuaaaaaauuuuuaagcccagccaggcauaguggcuuaugcuguaauccaaacacuuugggaugccaagguaggaggaucacuugagccuaagaguucaagaccagccuggccaacauggugagaucccaucucuacuaaaaauuuuaaauauuagcugggcauguggcgcaugucuguagucccagcaccuugggaaggcugaggugggaggauaacuugagcccaggaggucaaggcuaaagugagauaugauugugccacuguauuccaaccugagugagagcgagaacauguaucaaaaaaacaauuuuuuuuuuuuuuugagacagucucacucugucucccaggcuggaguacaaugacaccaucucaccucacugcaacgucugccuccuguguucaagcgauucuuaugccucagccuccugaguagcugggauuacaguuaugugccaccccacauggcuaauuuccggcuaauuuuuuuuguauuuuuaguagagacaagaguuucaccguguuggccagguuggucucgaacuccugaccucaagugauccacccgccaugaccucccaaaguggugggauuagaggcauuagccaccaagcccagccaaaaaaaaaaaaaacuauuuuuaaacccuguguaagucagaccugucugcaagccagauuugggccaaggacccuuagcggauuagaucagaaucucauguucugauaguucuuacuuuguaccuccacaaaggugaaccccugagagagaaaagguugcuuccuaucagcagaauuuagaccccuacauuaaaguuuugccucccccauucuuugguugugguuauguuaaggagauacugguacuaagaaaaacuacuaaaacuacacguacacaugguccccaacuuccuaugguucagcuuuaugauuuuuuucaacuuuacgauggugugaaagcaauagauguugaguagaaacuguacuucucuugcacugcuaggcagcaauugguaauaaguuuaucuagauguaaccccauuguaagucaaggaacaucuguagagugagagaaagcauggaaaucuucugcugacuugcaggauccauucaccacucauugguaaaggaugaauuccuuguuuuuaccuuuuuuuuuuuuaagagggucucuugcuggaugcaguggcucacgccuauaaucccaacacuuugggaggccaaggcagguggaucauaaggucaagagggcgagaccauccuggccaauauggugaaacccagucucuacugaaaauagaaaaauuagcuggacguggugacacacgccuauagucccagcuacuuaggaggcugaggcaggagaauugcuugaacccgggagguggagguugcagugauccaagaucgcgccacugcacuccagccuggcaaaagagcagcaagacuucaucucaaaaaaaaaaaaaaaaaaaaacagggucucuguauguugccuaagcuggucaugagcucuuggguucaagucauccuucuaccuuggccgcccaaagggcugugauuacaggcaugagccguuacacccagccugcuguuaucaaguaugcauuuaagucuugcccaaaguauuuguguauuuugguacuuuuaaugcuguuuuaaaaugaacauuccuuaaaguugacuggaccauuucuaauacaauaaggauaauuuuaaaagaccuggaagaaauucaguuuucaugaauauuauacuguuaagagagggaaaaaaauaucgaccuugaugaguuuuucuuacauguguucuuguuugcuaugaauucauugggagaaaauauuugcugccuuuuuacugugcauuccaacuguauucuuaaaacauuucaaaauguauguauauuuuaacauuuugugacauacuaacauguuuuuagaauauacuaguccaugccuaauccauaggggauacguuucaaaaccccccauggauaucugaaaugguggauaauaccaaacccucuauauacgguguuuuucucucugagaaccaacauggcuaaggcacuaaugagcagauagcguauacaguguggugaacaaagggaugauugacauccuaaacaggguagaaugggauagcuugagauuucaucaugcuacucagaauagccagcacuuuaaaaaacuuaugaauuguuuacuucuggaauuuuuuuuuuuuuuuuugagauagggucuucucugucacacaggcuggagugcagugcacaauuauggcucacugcagucgugaccucccagacucaagcauuccucccaccucagccucccaaauuguuuaaccacaggugugugccaccacaccuggcuacuuuuuuauuuuuuguagagcuagagucucgccacguugcccaggcuggucuugaauuccugggcucaagcgauccacccaccuuggccucccaaagugcugggauuacagacaugagccaccaugcccaaucuggcuauuuuuuauuuauuuauuuauuuuuuuauuuuguuuuuuugagauggacuuucgcucuuguugcccaggcuggagugcagcagugccaucucagcucacuggaaccuccgccuuccaguuucaagcaauucuccugccucagccucccguguagcugggauuacaggugcccaccaccaugcccggcuaauuuuuuuuuauuuuuaguagagacaggguuucaccauguuggccaggcuggucuugaacuccugaccuugugauccacacagcucagccucccaaagugcugggauuacaggcgugagcccccgugccuggccggcauuuuuuauuucauauuuuuggacugcaguugaccacagauaacugaaaccauagaaagcaaaucugcagauguugaguggggagugguggcgggacuacuguaaugauugcauaguauaaucuauuaauccagaacagaaggaccucaagugaacuuaacuaauucaauuuacuuagauuucuggguaaaaacugauucuauaaauuaagaaauaguagguucuuuaugguaaagauaccuuucugaaaaguaaaaaauuguauugaaauuuuacuaauauguagauuuugcuacauauuacuauuauauauuacauuuacaaauacguagguuuuuuuuuuuuuuuuugagacagagucucauucugucacucaggcuggagugcaauggugcaaucucggcucaccgcgaccucugccuccuggguucaagcaauucuccugccucagccuccugaguagcugggauuauagacacccaccaccaaacucggcuaauuuuuguguuuuuaguagagacggaguuucaucauguuggccaggcuggucucaaacuacugaccucaggugauccaccuaccucggccucccaaagugcugggauuacaggugcgaacccaccacacucggcccuaauauguagauuuuucugagacuucauauagcuaucucugaaauuuugggcacuaaaagaacuugagaaaguuacuucauaaauguguggaaacuggaaauugacucuauaucuuugguaauaaagggguaaugucaguauuuucaacauccugguguccagucuagaaagaccuaguaggagaaaaauauuaggcuuuuccaaaggaucuguuucugauuucuuaacauaaauuuggccuuguugaguccuuuuuaauuugaaccggcaaaguaucucccccugccucagaaauaacuuauugauuaaaaucgaaaacuagggccaggcacaguggcucacgccuguaaucccagcacuuuaggaggccaagauagguggaucacuugaggucgggaguucgagaccagccuggccaagauggcaaaaccccaucucuacuaaaaauacaaaaauuggccgggugcaguggcucacaccucuaaucccagcacuuugggaggccgaggcaggcagaucaccugaggucaggagcuggagaccagucugaccaacaaggagaaaccccgucucuauuaaaaauacaaaaacuagccaggcaugguggcaugcacccguaaucccagcuacucugaaggcugaggcacaagaaucacuugaacccaggaggaggagguugcagugagccaagaucgugucacugcacuccagccugggcaaaaaagccagacuccgucucaaaaaaaaaaaaaaaaaaaguuagccgggcaugguggcaugcgcuuguagucccagcuacucaggaggcugagucaggagaaucucuugaaccugguugcagugagcugagaucacaccacugcacugggcgacagagcaaggcuccaucucaaaaaaauaaaaaucuaaaaagaaucuaaaaagccaggaaacuacaggugcuggagagguuguacagaaauaggaacacuuuuacacuguuggugggacuguaaacuaguucaaccauuguggaagacaguguggcgauuccucaaggaucuagaacuagaaauaccauuugacccagccaucccauuacuggguauauacccaaaggauuauaaaucauacagcuauaaagacacauguauguuuauugcggcacuauucacaauagcaaagacuuggaaccaacccaaauguccaucaaugauagacuggauuaagaaauuguggcacauauacaccauggaauacuaugcagccauaaaaaaggauggguucauguccuuuguagggacguggaugaagcuagaaaccaucauucugagcaaacuaucacaaggacagaaaaccaaacacugcauauucucacucacaggugggaauugaacaaugagaacacuuggacacaggguggggaacaucacacacccaggccugucaugggguugggggaggggggagggauagcauuaggagauauaccuaauguaaaugacuaguuaauggaugcagcacaccaacuugguauauguauacguguguaacaaaccugcacguugugcacauguacccuagaacuuaaaguauaauaaaauaaauuaaaaauaaaaaacaagaaauuauuacugaauggaauauucauuuuaugcuaguuauuucaaguuuuuaaauacauagaggaacguauuauagaaagaccucuguggcuggguuugauggcucacgccuguaaucucagcacuuugggaggccgaggcggguggaucaucugaggucaggaguuugagaccggccuggccaaacuggugaaaccccaucuccacuaaaaauacaaaaaauuagccgggugugguggugggcgccuguaaucccagcaggagaaucacuugaacccgggaggcggcgguugcagugaacugagaucgcacuauugcacuacaccgugggugacaaaagugaaacucugucucaaaaaaaaaagaccugugucucuuuuucuuuuaaguuuuuucucuuuuuuugguccuuauguagaacaaauaaagacucuaaaacuaaguuguauauuaucaauuagagaugcagguggcaaucaagccaaauaacaugacuuuaaaauccaguguucucagccgggcgugguggcucacaccuguaaucccagcacuuugggaggccgagguggguggaucauuugaggucaggaguucaacaccagccuggucaacaugcaaaacccugucucuacuaaaaauacaaaaaaauuagcugggcaugguggugugcaccuguaaucccaacuacucaggaugcugaggcaggagaaucgcuugagccugggaggcggagauuguggugagccaagauugugccacugcacuccagucugggcgacggggugagacccugucucaaaaaaaaaaaaaagaaaaaucagguguucuacaccuucacucugaggucauagauuuucuuauuuauuuauuuauuuauuuauuuauuuauuuauuuauugagacagaguuucgcucuuaaugcccaggcuggagugcaauggcgcaaucucggcuuacugcaaccuccaccuccuggguucaagcaauucuccugccucagccucccgaguagcugggauuauaggcaugcaccaccacggccagcuaauuuuguauuuuuaguagagacgggguuucaccauguuggccaugcuggucucagacuccugaccucaggugauguggccgccucagccucccagagugcugggauuacaggcaugagccaccaugcccagccugaggucauagauuuucaagaggacuuggauuugaagaauaucgauacuuuuuuuauuucaaaaaaaaaaauagcugggcgcgguggcucacgccuguaauuccagcacuuugggaggcugaggcaggcggaucaccugaggucaggauuucaagaccagccucaacauggagaaaccccgugucuacuaaaaauacaaaauuagccgggcguaguggugcaugccuguaaucucagcuacucaggaggcugaggcaggagaauugcuugaaccugggaggcggagguugcagugagccgagaucacgccauugcacuccagccugggcaacaaaagcgaaacuccaucucaauaaaauaaaauaaaauaaaauaacuaggcagagagucagggguauuagauccccuuuugauaggaauauauacauuauaauuuuaaucuccacacguuccuauaaauagauaugauuuugaccacuucacaaauaaagaaguugagacccacagugaaugguucaagcuuauacagcugauaagcccuugauguuaauaaauguugauaucacugugggucuuuagcucuguguggcuccaaaccuuacacuccuuccaccugccuccagcucucagcauacuuggcaggaggcucuccaaguguaggaugucuagcagaggcacugagccccacucugucccccuucuuacagaggugggcuguugaccuagaauaugcagguaaugacuucagcugacaaggauucuaccuuagcaaagaauuuagguguuuuuguuuuuguagagacaggguuucaccagguuggcuaggcuggucuggaacuccuggccucaagugauccacccgccucgcccucccaaagugcugggauuacaggcaugagccauugugcccggccuauuuagguuuguuaacagcuugucuucucccugcuggcuucguucaaggccauucauucauuuaguucauucauuuagucaagucaccuaacacuuacugauagguguuauaguccagggcuugggcuaggugcucucacauuuaauuaccugauuuaauccugacaauaacuguugaacaacuuugauuauccccauuuuacagaugaggauauuaaaaccagaaaggugaagugauuuuccaggguuccacacuaaagaguggcagagccagagcccacauugaaacccaauguaguucuguguuggauccagagaauaguuccugagggucccugacaagugucucauggcaaguauggaccuacuguaagauuacccaggguauccaaaucccaccaggggcaaaugcaucaucuaccacgcagaucaaauaagccuuagagugguuuuauacuccaggcuuguguuucucucauauucacccaagaaggccagaacuaaaaccuacauagcauucaggcaaauccuucuugcccccagagcauugaauguccccuccagguuacugaaauccucugcuucaccccauuacuuucccuaauuagggucuuaucucccacucaguagagcugcuuucugagccccaugcuggucccccaguuucuucagcuuuuauauacaggacaaguuuucaagucuuacuaaauucauauauagucaauaaguauuuauuggacuuuuaccuaauaugugccaggcauugugguaaauacguaguaaacaagacagguauugucuguguucuuauggagcuuacagucuagcagagaagacaggcauugagcaaacaguuacaacugugacaaacuucagaaaaaaagacaaaugcaagacugugggcacauaaaaugagaggagauaagaugggggagcagggaucaagaaaggcaccccagagggcaaguaggauaguaugggacguagugacgcggaggacaugagcagguguccacgcauggcuuugugggucauguuagggcagcgggccuucacccugagagcacugggacugggaagccgcugccaguuugagcuuuacgggcggaucauccugguuccagcgugaggagguuuggagccugggcaacauggcacaaccccaccucuacaaaaagaagaaaauacaaaaauuacccagguguggccaggcacggcggcucacgccuauaaucccagcacuuuaggaggucgagguggguggaucaugaggucaggaguuugagaccagccuggccaacauggugaaaccccaucucuacuaaaacuacaaaaauuagccgggcgugguggugcacgccuguaaugccagcuacucgagaggcugaagcaggagaauugccugaacccaggaggcggaggugccuccacugcacuccagccugggugacagaaugagacuccaucucaaaaaaaucaaaaauaaguugggcugggcacaguagcucaacaccuguaaucccagcacuuugggaggagaccaaggcgggcagaucaccugaggucaggaguuugagaccagccuggccaacauagugaaacccugucuguacuaaaaauagaaaaauuaggcaugguggcacgcaccaguagucccagcuacuugggaggcugaggcaggagaaucgcuugaaccugggaggcagagguugcagggagcagagaucacgccauugcacuccagccugggcaacaagagcaaaacuccaucucuaaauaaauaaauaaguugugggcuggggugguggcuuacgccuguaaucccagcacuuugggaggccgaggcggguggaucacgaagucaggagaucaagaccauccuggcuaacacagugaaaccccaucucuacuaaaaauacaaaaaaaauuagcuaggugugguggcaggcgccuguagucccaguuacucaggaggcugagggaggagaauggcgugaacccgggaggcggagcuugccgugagccaagaucgcaccacugcacuccagccuggacgacagagcaagacugucucaaaaaaaaacaaguugcgguguaauugguuugaggguaagaaaagcuaaggaucaggccgggugcgguagcucacgccuauaaucccagcgcuuugggaggccuagacggauggaucaugaggucaagagagagagaccaucauggccgacaugauaaaacacugucucuaccaaaaauacaaaaauuagcugggugugguggcacaugccuguaguuccagcuacuugggaggcugaggcaggagaaucccucgaacccgggaggcacagguugcagugagccaagaucgcgccacugcacuccagccuggccacagagcgagacuccgucucaaaaaaagaaaagaaaaggaucagaagaaaggaaaggaucuagcuaagaucacuugaaagcagaaccagcaguucaguucccuauccuggcuccucccucacuaccagaccaugugggaaaagccacuuugucauuggagcagcccugagauagggucugugauucccaggguagaaagacagauugauuaucauaaccagcguucucacuaauuacuguuaccgcaagcccuaggagaguggcaccuucccagagaucucucagugaaggacguccuuaaugaggccacuuagcacagucaagguagaaauacagaccaaaugucaccucucuguucugucauucuuuuaucacucagcagacagcuagucugggccaggcucuacgcuggaacgagggacacaggaaugaggaucuucccaaccccaggaagcacauaggcacacagucugugccuccuuagcacuguggccucuggguucucaucagggccagcaaccucaccucgccucaccuguccguccuuagaagggcauuuguacacucugaaaagcaacggucuucagguuccuucuuucuggauuacuaagaucuugauuuugauguguuucagcuggaaagggcuaccccugcaaaacauguaagauagugcugaacuccauagaacaguaccaagcucaugucagcggcuucaaacacaagaaccaguaaguaaccauuuuuugaaauucuaggauccauagcaggagcucaggacuucugcaucagaacaaagccagguaguucucggcugaaauggaauccuggcagucuuuuuucagugaacagaagaugaaucauguaacaggaacaagugucuccucuauauguauuucuccaccagcuucugcccagccuuuagaccuguuggacucaaggguuuaauagagaagcauacaugauuuccuuggugggacccuaagaacaccuggcuguccuagucuguagcacucugacuggggaagugcuuuuccacuggccuggagacccucuccuuuucuggcaggaguucccucuauaggucauuaucaaauaugaccaggcccucucauuccuuaaucaaauauauauugagcaucuucugaaugauggccaagacagacccagucucugcucuccugaccuuacagccuggugggaggaaacagacuaagcaaguaaacaaccaauaaucacagauugugauaaggguuuugaaggaaccaggugaacagagaguuaccuguucaugguaaucuuggaagugacuaacauucauugagccccucuucuguugcaggccauaugucaagcagauuuucucagguaauccuuccaacccugagaggaagagauaauuauucccauuuuauacauauagacaaccagcauucaaaguggugaugugaaugaagcaaggucaugauucaaacugaagccugucuggcucacagcaugcucuucccaaggcgucaggcucagaaguaggcuauggcaccacugauaugaagagaauagggccuggccuggagggcccacaugguucugucccuuccucuccgaagggaaacgugugguaugagcagugugccacaacauaacguuuuuuuuuuuuuuaguagagaugggguuucaccauauuggccaggcuggucucaaacuccugagcucaagugauccaucugccucggccucccaaagugcugggauuacaggcaugagccacugcaccuggccccagcauaaccuucugagauagguagaagaauucccauuuuacagacaaggaaacugaguuucaggcaggcaagcugccgaaaugauugcuuugacuuuggucauugauuuugcuuugcucauugagcugaaugauuuaaaggugguagaaacacagaguauugguguaaaaaauguccuuaguucucucugcucugccuggagucuccucucucacacuguagcagaucauccucuuuaccugugaauauguuuuuuacuuugggggacucuuagguguagacuugaguugccccagcaacucagccccacaguguuucagcauacauaccucccuugcagccuggcugauggcaguuacaguagacaaccugaagccaaccagagccccucccuggggcuacccacaccugaaauugccaguguuguucgcugcucucuugcuaaacuuuccagcagugugaccuugggcaagucaauaagucuguaauucucccaacaugggcaauguagugagaccccaucuacaaaaaauaaaguuagccagguguggcggcacacaccuguagucccaacuacuugagaggcugaagugggagaauagcuugagcccaggaguuggagugagccaugaguugcagugagcuaugauggcaccacuauucuccagucugggugccugagugagauccugucucaaaauuuuaaaaaagccucuaauucuguaagaauaaagcuauaauuuguugaauaccugauugagucucauuaaauuucucaacaaaaggucugaaauuaggauacccccucccaaacccaucuuuuacaaccaaagaaagccuaauuaucagauagguuaauugacuuccccaaggucacuuaguuacuugcaguuagaccugggauucaagccuguuugacuucgaagcccauucauuuuacucugccacuaccaaauggaaugaguuuuuauagggcccuguaggcagugguuugguauagugaaaaggcauuggcuacaguccugaaccuaccaccuaaaaacauacuucgggccagccacuuaagcuuucugaacuuuaguuuccuuguauguaaaaugagggugcuguuucucaccuugcagaauugccaugaggauggaaugauggaagcuaagcauccagcauucugccagcccacaguggaccucagugaaggaaagguguccugucuauuacuccaaggcccuggaagggcagugcuaucauugcaguaggccaauacagcugccacacacugacccucuuccuuuguuccuucucaaauacaggucaccaaaaacaguggcaucaucccugggccagauuccaaugcaaaggcaacccauucagaaagacucaaccaccuuggaagacuagaggugauucugcccagcaucccauauugggccagccaugagccagcuucccgugacugcucagcccuuggcucccucuugcucguuguucucaccaggaaaguacacgggccugaggcaggauugggccacagacagccucucauugguccgggcuaauucacuccugcugcuccccuuuggcagggguccuguaggucaugacaggggaggcaaggguauugagagacucggggucucgcggggugguaguuuggaggguggcuuuccccauuucccaaccccucugggccuuaggugcugaggccccugccaccugucuuuccucuaaaggucaguuuugggccaguucuugcaacuaaagagcagagaucucucugggcccuagacauuuccagcaaaaccuggaacuuucaugccaaaccuggggcagggcaggaaacagaggaaauggcugcaacaugggagcuuggagcuaauacgacacucugccuucccccagaaggugcaggcuuuccugagucuuagaccagauauggccaguugcgcagguuucugccaacugugaaguauccuccuggagcagugacacaaucuuggcggagcauugcuacccccgcugcccccuccacaguuccugaauggugcuaaggaucugcagcaguuggcaacgagcuggggcugggggcggccuccauguccacugagaucauaggacacuccaauggggaugggaccuuuccccuccuccaucagaggugcucugacccuagguuacacgggaaagugccccacaugcaagucucccugaggguucugccccuaaaggcagacugccucaugcccgcuagcugugagguucauugcuacccucggcccuacuagcccucucuucccccuugugcagcggaccacuugcccaguuugcuguggugcuagccuuccccaucauccaccgggugauuucugggucccagggaaagaaagagagagcugaugcagguuucuacagugaggaacaggcguuucccaggccccacacccagauuucucuaucuuugcuguguuuuauggccugggacugaguccacacggauagauuuuuccuuguaaccuugagacgagaauuccaaggagugucaccaucagaggcuucucuucauugugucaaagaagccccuagcugcucucguggccuccuucccccacucccuaucccuucaccugugaaaugccuuugcuuugcauauuguguguggauguguguguguguguguguguguuuguguguaugugugugcuucugugugugccuaaugcucugucucuuggucacugaagcauccaaauaaagaauuucccucaugggccagacuacaacuuaacagaccuaggguuuugagccauauugccauuggaucuaguaugucugucuugaccccucacccccaccccauucagaccucaguaguccccaguagucacuuuaggaguugggacagagucgagcacccugugaaagucucccuugaguucaggugcccugaacucaguacagccucaucuucucauccaccaccuucuccugcuucuccugucacauagggccucaugaaggucuuuaaaggguuuaagcuggggaucugcuuuauguuugagagaacuguucuggcuguuauguaaaggagugcagggaggggcaggaaaggagacaaggaggccaguauggacacuguguccaguauggcuuuccaggcuaaucacuuagggcagagacccagccuuauucaucucuacuuccugauguccauaguggugugucaugaauuuuuauugaaugaacaaaugagguguaugaggagagaugguuuucuccugcucagcucuuacacagugauagguuuguuccaugggacuuaucauaggccuggugauucuugaaagagcauuuuucaugacucaaaaaugagcugagaaggaguguuauggccaggugcggcgucaugcaccuauagucccagcugcucaggaggcuaaggcagaaagaccauucaagcccaggaguuccagccugaaguaugcugugaucaugccugugaauaaccacugcacuccagccagggcaacauaacaagacucuaucuaa

SEQ ID NO: 192423 - RNA, 20323 nt, Homo sapiens
agaacccauugcuggggcuggccggcgugugccuuggagccucuaaggagaugaaacugcacucaaccaggaugagaggcugcccggccaaugcagcugccgccccgucugcugcggaggcuuugcuuuuugacucccuggcgacaguaaaguugaagagcuuccggccggaggccaauagaugggacccccggaaggcggaaguucuagggcggaaguggccgagaggagaggagaauggcggcggaaggcuggauuuggcguuggggcuggggccggcggugccugggaaggccugggcuucucggccccggcccuggccccacuacaccucucuuucuucuuuuguuguuggggucugugacugcggauauaacugacggcaacagugaacaucucaagcgggagcauucgcucauuaagcccuaccaaggugaagcccuuggggcgggaaugagugaagagugagggcgaggcugaacagggcuaggggaaggcgugcccuuucuccugagcagagcaucucuguggguuuccugccucuggugaggccaguccuggcguggccucuuagcaccugucucuucccacaggggucgguuccagcucuaugccccucugggacuuccagggcagcacuaugcucacgagccaguacguacgucugaccccugacgagcgcagcaaagagggcucuaucuggaaccaccaggugagugguucucaagaggauaggcguacugugcgguuggcugcuagucccugccucccgagcagcugagaccccagcuucguuuauagguuugcaccuccgucccuggccuuuuccucaucucggucacacccaccaauaauaagaggcgauggguauuggguacuuacuaugugucaggagcugcgcuugacacuuuacauccuccucacuuuaaaagccaugcgagaugaguaauguuaucuccauuuuacccacugagaagcuaagacucagguuugaaagggccuuacccaaaguuacauagccagaaaguaguggaacugucaggcugucugccuugaacccccucaguaaugggaagaaccgagcgaacuggaucuuuauuggguguuuugcuguguauuaggcacugaccuugccaugccuuauugcauuuaauuuucaaacaagcuguuugaaauagauggcuuucaugacuauacaaagauaacccagcuagcaaaugucauaaacaguauuuaaacucugauuugucugaucucuaagcccagcaguucacucgauguacuugacucuuuucaccuggacaguggaggaaccccuuagaacccuuuuugcaaugcuugguugagggucuugucaucaguaguguggagggacuggaccugugggcaguucuagugucugugaccuuugccucagaguauguaguauguaguaugugagcaguggccaaugacagcugcuacacagaauccacacugaggcagucaaggugaggaaaaaggggaaagaagaauaauuuggggcuggguuacagcuuggagcgggaccugcuccugccccagcuugccuaaucucagcccuucccauggcuuaagcuguuggccaguguucuaguuuucuccaucacccugcucucugaucccugcugguugacuuucuuguuuaguucugggaacccacacuguccuuguguugccuggucugcccguccccucugcuccuccucuccuuccugccccgagccuccacacugcuguuaguggcaucugcggauacuuucuucagcuuucagucugauccucagagcguggaguccccugugaagggguaagcaugcauuaugucugcacaaucuggccccuugugcaucuccagucauucucuguguuaauuuuguuccagcccccccuggcugccuucuugccucaggaccuuugcaccuguuguucccucugucugggacacugccuccuggcuccucaugccugcuugguuccuucucaucuguuaagucucaauucaagugccacccacgcagacauuucuucauuaaccacccuaucucccccgagucacauucugucacauucugucuuagggcuuucagauauuuuaaagaaaugauaauucagccuuauauuuuucauggaaaugaguucaguauagcauuauuauuauuuuuugaaagcaaggugcaaacagugcuggaacuguagaaaucaggaguagccacaaguaauagacgcaucuaagacaguggcuuacauuuugguuguagauagcugaugguuggcaucaucaguggcucgaggaugucacaggacugagaggcuucugcacuugccuucaucgaauuuucagucuggaguacaauuguuuugccuuccuuccuccaccuuucuauuuggcucugcugauauuccugaaacauuuggagugcuuccuguaaacucuggaaagaaauggcuuggaaaucagaauuuucuguucaguguuucccaagaacugccucuuccuuuaaugagcuggagagaugcuuccuaaacuuuucccuuuuuuaucuccuucauucacuccauccgggagaggcaugcacucaggcgaacauucccugaacaccugcugucuucugagcagccauaaaauagcuccugcuguggugcaggggggguggucuagaugaaggaguggcucagaguugacuagaacucuuaagugccugguggcugcagcauaggaccuggggaggcugcucaggcccuguccuuuugggggucuugugcggaggcugcggcaguggucuuuaagcuuucuuugcuguuguagcaaccuuuugaaaaguuggcaucaaaaauuguuugucauuagguuuaaguauuugcaaaggaugacagcauauuuuaaauauugacauuuuaaacuaaaacuguucaguauuuuaaacauucaguggaaucuaaauauugcaauuugauauccacuuuuuuuuuuuuuuuuuuugagacggagucuuguucugucacccaggcuggagggcaguggcgcagucucggcucacugcaacuuccgccuuccugguucaagugauucuccugccucagcccccugaguagcuggaauuacaggugugcaccaccacgcccagcuaguuuuuguguuuuuaguagagguuuuuuuuuuuuuuuuuuuuuuuuuugagacagagucaugcucuaucacccaggcuggaaugcaguggugcgaucucagcucacugcaaccuccaccucacgaguucaagcgauucuucugccucagccuccccaguagcugggauuacaggcgcgcacugccauguccagcuaauuuuuuguauuuuuaguagagaugagguuuugccauguuugcgaggcuggucuccgacuccuggccucaagugaucugcccaccucggccucccaaagugcuaggauuacaggugugagccacugugccuggccaguaugucaguuuuuuaauugaacuuguacuuucauuuccacacagaauauuauccuaaugcaauauauuuaaugcuugaaaauguuauucauuagccuaccauauucuucugcaaguaaaauuaauauaauaauuuaaacuuuucaauuuuguugagacugaaacuuuuaauauuuuguuugagauuauuauaauuaucuguacacacuugauaaaaguaaaugcauuacacaguuuuugaguaauuauacaaaaguaaacauuuuuugaaacaugagaucucaguaggaugucaccccccacccccaucuggauggauaauacugucagaauaagacaaguucaguaccacuucuacuuuuuguuuuuauguacaugaauucugagaaacuguguucucuuaaauaguaguuggagaugggguuauuuuuaaaauuuuaaauuucuauuauagaugggaucuuacuauguugcccagucuuaucuugaacucuuggacucaagcaaucuucccaccucagccucugaguaucugggacacaggugcucaccaccacugugccuggcacagcgggaguuuugguagagcagcaucacugaauauuuugaucuucuuuugguuuauaaacccaacgucaugcagugaucuuuuaucaaaauuuuugaugauguuucggcugacuguugauuacaucugcauuccguuucguugcaagcagagauguggaaacugcugaacuguaaaauagccucuuauugccaggugauucugauguaguuggccugguguaggaccaaggcauuaagcuuucugagcuccccagguggguuugcuguggguuaagaacuguggucauaucguguuuguccccaaaagcagcuucugaaucauuuccagccugugccuugccugcuuaagauccuccagaggccuucuauugucuguaucauaguaugucucuacuaaucugcaguuuuaaucuggggucaugaagacuuuccaaggccugcguaguccuggaggagucuguuuccagguccuccacugucucaugugcucauuccugaaaccagccuccccgugaacaugcugggaauggguguguggguuuuccuuucccaccucccucacucaguugcccuucugcucugaggucagccucccaacagccuggucuuucuucaggguguuguccccaggugcagaaaacuccugggcaccaaagagaccauuugaaaucugguuucugggcugacuuuuguacaugugagauauuuuuuuuuaaaguuuucaaauauaugagggcuauuuuaguuaucuuuuaaaauuguuuauuauuguuagauagcugauggaauugcaucauggucagauuuuuuggacgcguucuguuugugcuuaugaauguggauucucuacuuguugacuacagugugccacguagguucuuuaggucaaacuugcuuucugagcuucccaggugggucugcugugcagccaggguuaagauugaguucggaucuucucuagcuuuccucauguuuuugucugcuugcuuuuauaaguuacuaagagagcuuuguuaaaaauuucuguguauggcugggcaaggugacacgugccuguaagugucagcuacuggggaggcugaggcaggaggauugcuugagucaaggaguucaaaaccagcccaggcagcauaguaagaccccaucucaaaaaaaaaaaaaguguuaaaaaaauuucuguauauggauuugucugcaucuuuguaguucugucaguuucuguuuuauauguuuugaggccaaauuagguacauacaaaaacuuagauuuauuauaucuguagguaaauggaaucuuuuaucauuaagaagaaccccuuuuuacauuuuguuauggguauagcuauagaagcuugcuuuuuuuaaaaaaaaaacaacaaccgguaaucaauuuauuaaaauagucaacuuuaaauaucugcaauggugacuuccaccucaacuccuggcucaauacugauggaaguaaucugcuuaaucucagaaggacuguggaggucagugagccacuuguggauucucaucuggaaacgaucccguguguuagaaccuucacaaggaguuuuucuuguggugauucucgaagccuugauaggcguuccagcuggucuuuucacuuugagauucuuuuccuuugcuccucugaucaagucagcacacaccuuuucuggggauucuauguugcagcucauuaaagugauucagauucagugaauugucaccucuggcuccgcagguuuucuucagguaucuuuaaagccgugggugggccgggugcgguggcucacgccuguaaucccagcacuuugggaggccgaggcaggcagaucaccugaggucgggaguucgagaccauccuggccaacacggugaaaccccgucucuauuaaaaauacaaaaauuagcugggugugguggcgggcgcuuguagucccaguuacucuggaggcugaggcaggagaauugcuugaaccugggaggcagaaguagcagagagcugagauuaugccacugcacuccagccugggcgacagagcgagacugucucaaaaaauaaauaaauaaauaaauaaauaaauaaauaaauaaauaaauaaaugcaugccauggcugcugcgagccuuccugaccaacuuguuccucagccagagcaaacaguggugaggcaggagcaggagcgggcagaccacagcucugcagcgccuguggcccugucuuccugaaggagcagaagcuugcuuuugguuaguguuugcaugauacauuuuuccuguccuuuuacuuuuucccauuucuuuauguuuuagcguuuucucuuauaaaugguauauuacuaggcuucagggguguuguuuuuauguuguaaaugcauauaacauaaaauuuaccacuuuaacccuuuuuaccuuuaaauccauuaauuuaugaaacuauuuucuucaguaggcuacacauugacauugaaagaguggcuuuuuuuuuuuuuuuuuuuuuuuagacagggucuuaaucugucaccuaggcuggaaugcaaugguguaaucacggcucacugcagccucggucuccugggugugauccucccaccucagccuccugaguagcugggacuacaggcgcacaccaccaugccuggcuaauuuuuuuuuuuuuuuuuugguagaaguaggguuucaccauguugacuaggcuggucgugaacucugggcucaagcaguccacccaccuugcccucccagagugcugggauuacaggcaugagccacugcgcccagccugacaauggcauuuaaaagaugucauggcuauguaaaaaaauguuuccacuguuguacguacacaucugcacaugcaagaaaauuucucaaaucuuucuuccuuuucuuuucucuucucuucuuucucuucuuuucuuuucuuuucuuuuuuugagacagggucucacucuguugcccaggcuggagugcaguggcgcgaucucggcucaccacaaccucugccucccggguucaagugauuuuccugccucagccucccuaguagcugggacuacaggcgcccgccaccgcacccggcuaauuuuuguauuuuuaguaggacgagguuucaccauguuggccaggcuuggucuugagcuccugaccucaggugaucugccugccucggccucccaaagugcugggauuacaggugugagccacugcaucuggucaaauuucucaaauauuucuauugugauaaaauguauguaacacaggcugggcgcgguggcucacgccuauaaucccagcacuuugggagaccgagguagguggaucacgaggucaggagaucaagaccauccuggccaacauggugaaaccccgucucuacuaaaaauacaacuaauuagcuggucaugguggcguguuccuguaaucccagcuacucaggaggcugaggcaggagaauugaaccagggaggcagagguugcagugagcugagaucacgccacugcacuccacccuggcgacagagcaagacucugucucaaaaaaaaaaaaaaaaaaaaaaguaacaaagcguaccauuuuaaccaguuuuuaaaauuaaaaaaaaauuuuuuuuuuuuuagagauggggggggucucacuuugucacggaggcuggagugcaguggugcaauccuagcucauugcagccucgaacuccuggaguccagugauccuccugcuuaguguccugaguagcugggauuacaaggcaugugcuauugugccuggcuaauuuuuuuuuuuuuaauuuuuuguagagcuggggucucacuaugcugccccgggcuggucucgaacuccuggccucaagcaauccuccugccuuggccucccaaagugcugggauuacaggcgugagcuacugcgccuggcccauuuuaaccauuuuuaaguguacaggucaguggcauuaagugcauucacauugcuguguagccaucaccaccgucugucuccagaacucuuugcucaucccaacugaaacucucuacccauuuaacaaucacucccauccccacagucccugguaaccaccauucuaccucaucucuguaaauuugacuauucuaggcaucucacauaaaugauaaauggaggcauacaauauuugucuucuuugacuuauuuuacugagcauauguugaacguuccuccauacuguaguauaugucaguacugcauuccuuuuuguugcugaguaauauucgugugugugugugugugugugugugugugucuagaccacauuccguguauucaucuauucguaauggacacuuggguuguuuccaucuguugccauugugaauagugcugcagugaacauugguauacaaguaucuguuugaauccuacuuucaguucuuuuggguauauacccaggaaguagaaucucuggaucauacggucauucuauuuuuacuuuuuugaggacuaccaaacgguuuucuguagcaacugcaccauuuuauauucccaccagcaaugcacaaggauuccaauuucuccacauccuugccaacauuuguuauuauuuauuuauuuauugagaugaagucucgcccugucgccaggcuggagugcaguggcgcgaucucggcucgcuggaaccucugccucccggguucaagugauuuuccugccucagccucccgaauagcugggacuacaggugccugccaccaugcccaguuaauuuuuuuaauauuuuuaguagagacaggguuucaccguguuagccaggacggucuccaucucuugaccucgugaucugcccgccuuggccucccaaagugcugggacuacaggcaugagccaccgcgcccggccuaggguuuuuuaauauauucuagauauuaaucccuuaucagauaugugauuugcaaauauuuucuccuauucuguggguugucuuuucacccucuugaucaugcucuuugauguacaaaaauuuuaguuuuagugaaguacaauuuaucuuuuuuuuuuuuuugucugugcuuuuggugcuauauccaagaaaucuuuacuaaauccagugucaugaacauuuuuucccuagauuuucuucuaagaguuuuaaaggguuuuuuuguugguuuguuuauuguuuuuugaggcagggucucauuuuauugccuaggccggagugcaguggcgugaacacggcucacugcagccuugaccucuccagcucaagugauccuccugccucagccccacaaguagcugggacuacaggcaugcgcagucaggcccagcuaauuuuuguauuuuuuuguagagacagguuuucaccguguugccugggcuagucuugaacuucugcgcucuggugauccaccugccucagccucccaaaguguuucagauuacaggugugagccacugcaaccggccagguuugagcucuuaaguuuagaucucugaucuuuauauacuuauuauuauuuuuuuuuauagagauggagucuugcuguguugcccaggcuggucuugaacuccuuggcucaagcaaaccucccaugauggccucccaaggugcugggacuacagguaugagcuacugcaccuggccucuuuacuuuucaaauuaaacuuuuuauuuugacauaauuauaaauucacaugccguugcaggaaauaauacagagauccuaggugcccuuggguuuuguuuuuuuauuuagcauuuaguccauuuacauuuaaugaaauaugauacauuuggguuuaaucugcuaucuuacucuauauauucaaauugccuauucucuguucauuuuucucucuagucuucuuuuagguuaauuuuuauuauccuauuuuuccucuucuauuagcuugaaaguuauaugcucuuuucucaguuuuaaguggucacccuagaauuuaaagcaggcauucauguuguaccaaagacuaaugauaauguguacuuuaccuucuuccuggacagugcaaggauccuaacacacuuuaacuccauuuauuguugucauuuguuuuaauuauuucuguuuuaaaucacacaacccauuguuuugugcagucagauauuuagauuuucacccuuauagucacuguauuuguuguucuucguuccuucuggaaucugacuuuacaucuggauggggaucauuuucuuucucccugaagaaugaaagugugagucugcuaaugaauucuuuugguuuuuguuuguuugucucaaaauaucuuuauuuuaccuucauucuugaaggauacauuugcugaguauagaaucccaugcuggcuguuaccuuccuguaucuccaaacauaucagucaucugccuucuugcucccgcuguucccgccgugaagccgggugucaggcugauuauugcuccugugagagucauugccuuuuuucccucugguuccuuuuucuuuaagauuauuauuuuuuuuauggccgggcgcgguggcucacgccuguaaucccagcacuuugggaggccgagacgggcggaucaccuuaggucgggaguucaagaccagccugaccaacauggagaaaccccgucucuacuaaaaauacaaaauuagccaggcguaguggcgcaugccuguaaucccagcuccucaggaggcugaggcaggagaaucgcuugaacccaggaggcagagguugcagugagccaagaucacgccauugcacuccagccugggcaacaagagcgaaacucugucucacaaaaaaaaaaaaaaaaagaaaaaaaaaggcugggcgugguggcucacaucuguaaucucagcacuuugggaggcugaggugggcggaucacaaggucaggagaucgugaccauccuggcuaacacggugaaacccugucucuacuaaaaauacaaaaaaauuagccgggugugguggcgggcgccuguagucccaacuacuggggaggcugaggcaggagaauggcgugaacccgggaggcagagcucgcagugagcagagauugugccacugcacuccagccugggcgacagagugagucugauuuuuuuugagaaagagucucacucuguugcccaggcuggaaugcaguggcacaaucucggcucacugcaaccuccaccucccagauucaagcaguucucccgccucagccucccaaguagcuggaauuacaggcauguaccaccacgccuggcuaauuuuuguauuuuuaguagagacgggguuucaccauguuggccaggcuggccucaaccucaagugauccaccugccucagccucccaaagugcugagauuacaggcgugagccacugcacccggccaagauucucuguuuuuaaggagaacaauagacacuccagacuagaugggggaggacguggguugaaaaacuaccuauuggguacuguucucccugccugggugcaguauacccauguaaccugcacauguagccccuguaucuaaaauaaaaguugaaauugaaaagaaagaaaaaaugcuuuuguggcacacguucucaggauugccuggggcuguaccacggggaaaaaaauuagaaaaaaauaguuucauguuaaaaaaaacuuuuuuguuguuguugcuguuuccucuaucccucccuucuuuuuuugugccuaaauaugguuuucuuuuuagucaucuccuuugguuuguaggacuuuucaaguuuguggcgugucuuugaaucaguuuuaguaagugcuuagacgucuuuaaauauuccuuugccuucauuucucacaucuuacucgggaaucccaauuauaugagucuuagccucucucacuguuuccucugucucuuacccacaauucuauaucuuccauucuuuugugcucucggggacucggccuagguuuuguuaucuggguuccuggugcccagagugggagcagugagucuguggcaucaaugaaugcaugaagcauauugcucaaauugggguacaguguuuuuuauuuuucugugaucacagaaguaauauguuuauuauacauuauucaaacaugguaaacagucgccauaaucccccucccagaauuacccaucauuaauacugguucauguuccuuuacuccuguauucauuucucuucaugcucaucugcauuggacguuaauggucuuuuucacaguugccagucugacaggucaacauccuguuuggguuugccuuugugaugggucuuuguuuaaucacuugcuuacauacccaucugcagacuuccugaaaguggauucuugucaccguguguguugacaccuuaguuuucacaagcgacuuccugaugccuaaggcaaggcuuucucccuuggcguaggcggugcccaucccugccccagcucacaugguggugcccuugagucccagagcacgacccugaccagcucucauccccagcgcugguaccacacuuaggcugggcuggggaggugaacuggugaagggcuggguuuuggagucagccagaccugggcuugaggccagcagcacugacccggccugauuuuccucacuugggaagguugguuagcaggguggauguggcaguggaugugggugaccagaaaggggcuggugcaauuuaugugaaaggccugcaggccgcgggaaguacugaaggcagagcagagcucucggagucagaaaacccugcaugugaauccagacaguccgcugagcagagcucucggagucagaaagcccugcgcgugaguccagacaguccacugagcugcucuggacaaguuguuacaccucugaauuuguuuuccuguaaaauacuuugcucaaauaggaguuguaacgucugcagaagguuccagggcaagagcaguggauggagaggaaauggcugguggguuuggcugguaaugagggugaacaguguggcagccaccuaaaccuacucaggagcagccugaggucugcuggcggggucugggccucaggcagccuuggaacacuggccucccccaccucaccuggugcccaacagucucuucccuucacggccagaacauuuaggggucuguggucaguggcacuuguggcccugugccaaggagugcccagucuuagcuggggagagaagagaggucuguggggcaggggccgugcugggguugccuccagcuugcuggaaggcccuggggagcucugagcagcccauucugcucucccuccagccgugcuuccucaaagacugggaaaugcacguccacuucaaaguccacggcacagggaagaagaaccuccauggagacggcaucgccuugugguacacccgggaccgccucgugccaggugggcugguguucgcucagcugggcccugugggggugggcacgggcauggcugcuggcccccuagggaggugggguggggcugccuguggcucguggggaccagcgucuccucuccuguuaggaaagugcugccucccguggauaaaguccugcgccuccggaaggagccuggcucuggaaggaaggucacugaggggagaggagcagcuggguccugcagcucaacccuacacccucauuggccugguuuuaccauuuuaaacaguuauuguuguaaaaaagccaaaacaugaagacuguguggcugugacugcauguggcccacagacccugagguguuuccuugguggcucuucacagaauguuugcugccccuaguauagaggguagagccuccuggguagggcuguccuguggcucacuguuuuuuguaggccagguacccccuugacaccugacaucugccucaguccccucacaguucagccuucaaacuugaguccucugugucauaugccuagaccccccacuucugaggagaaagccucagcuuucuccuuucacgaucccuucucucucggugaauggccaguggguugggcucucuugcccccacccauguuggcauugcuugccuuuuagguacccaugggacggcuccuguuucucccauucugagagcaucugcuuauaauucuagggccuguguuuggaagcaaagauaacuuccacggcuuagccaucuuccuggacaccuaccccaaugaugagaccacugagguaggccccugcucuauccugcugagcaggaaaggaaggacugggcagucggcuagaggagggggcccugggacuuccauggucccagcacaagaggagccuccagggauugggguggugggugccccugcucgccccacaggcugggcugcuuguggaguaaccgaugucuuggucccagcgcguguucccguacaucucggugauggugaacaauggcucccuguccuacgaccacagcaaggaugggcgcuggaccgagcuggcgggcugcacggcugacuuccgcaaccgcgaucacgacaccuuccuggcugugcgcuacucccggggccgucugacggugagcaggcuaggcgguggggguggcagcugguggcccugugcuggucccacagaggcucaggagggcaggcugcuguccugcgaggugcuuagcgugcugggcccugcaggugaugaccgaccuggaggacaagaacgaguggaagaacugcauugacaucacgggagugcgccugcccaccggcuacuacuucggggccuccgccggcaccggcgaccugucuggugagugggccgggccaggcguugguucccagcccagcucacccugagggacugggagcuuuccaugcaguugauugccugccuucaugugguuucugagcucaccuggcuguguuccuccuccuccuuucuucuguaaauggccuguccgggccucaguuccugugguuucugggcucaccuggcuguguuccuccuccuccuuucuucuguaaauggccuguccgggccucaguuccugugguuucugagcucaccuggcuguguuccuccuccuccuuucuucuguaaauggccuguccgggccucaggccuugaacggucccuuggcaaccuuccccaucaacaggaggcagcgggucaguuagauuugggcaauguagauucccagauuuaucuccagcccagaccgcucuggaccugcucagcccuugugcccacagcugaggccacaucuugcccaucgggaugucaguggcaccugugccccucuauuugcuugcugucuuuccggacccuucuuucucucacauggcaccucugguccaucaacagucccuguggcuuuauuuucacagcacgucucaccacuucccuccccucccugacuaccuggcggcuucaggccaccagugucucucacaggagucucccaagugguccccuccuucaccagcccccaacagucucucgugagcacagcagccguguaaucgccuucaguaaucgccuucagcccgugugaggccuccugcugcucugcgcagagcucugcagggggcgccagggccucugugccagcccugccaccucuggcucccugcucacugcucccccugccuacuguggcuuccagcugcugccuggaugcgccugugcccuccugccccggcuguuucacccuugucuccuagggccuugcucagauguuaccuccucagugcggccuucccugaugcccucguggaaugucgugcccccuccuguguccccagcccacuccccagcaucuuugcuggcuuuauuuuucuucauaauauuuaccaucuuugagucuaccgaguaauuaauuuuauugucucuggcccuccugcucaauuguaagcucuauaaauggcuguuuggcccagggcaggugcucagcgagcacuggggugccucuaaccugcucaggccucacuggucaccaggccgugguggcccuuggcugugguucucgguuucucuuuggggcccugagcaggugccaggcccagggccagcuccugaccagaacuggcacgugacacgggggaccugacaugggcgguuuauccucaggaugacccauuccagggccuguagucugcccacugcccaggagccuccucucucagcauggaagugcuuggguccgcucagaccccagaacauccauuguuuggggguuuuucagucacauacccagcagaggagagaggucugguaagcacccuuccugccaaccagcuuucaucauuuccagcucgcgccuggcugguuucccuccugccccggguugccuggaacuucaucacacuguuucagcccuugucuuuggaggguucuugauaggagcagagcagcaccagugcuguggccgguggcagcucucacagcuguugggagagcccagcacagaguggaggaggcaccaugaggggagccgugucugaccacuggucaggggucaucagugccaggcaccuuacgggugaugucaccugauguauuuuuaggcagauggccaucucguucccuuuuuacucaaccauugggaguuugaaaacugaaaggauuuuuccuaagauacgagcaggaagcagcagagcccagaugggaacuggggccugacuccagggccgguccuuguccugcagggccgcucgccgucuccaagggcugugcaugcucggcucucacacugugugccuggccgagcucuugcucauuagguccccccuuggcuccagagauuccugcucccuucaacaaggccuuuccucagauuccagucccaggcugaccaggacccacgugucggcuuugagccucagccuccucaucucuacaauugggugauccaucagcgucaagccagggcucuucccugugcaugccauuggacagagccuuuccccagucuccucaggcacagcugcugaccugcguuaggcucaggcccuuagcugguugccgaguuguuccccugcagccuguaugugggucucuguggcaagaaugucugguggcuccugcccuugggaccucagccuucucagccagucacacagcgacuguuggucuuucccgggucuguuuuugagcacuuauucugcaggcaggccaucuucugugugguguagacccuucucauguacuugccauggcaaccacacagauggagaucaucacuccucuacaugugcggaacaugagccucaaagagggcggcagaccccaggauuuagacccagaugauucugcuuguaaagcccuuacuguuuucucuccacucugccuccucucuuuuuuauugcuggugacuggagggagcugggaagaaaacaggcccuagccggcugggcagugcucuccccaggggccuggcagguuuacuggcugcagcagcagcuuuccuugugggagggucuugggccacgugcccugcggcuggccuguaggcugucacagguuuauucuugguccugcagacaaucaugacaucaucuccaugaagcuguuccagcugaugguggagcacacgcccgacgaggagagcaucgacuggaccaagaucgagcccagcgucaacuuccucaagucgcccaaaggugcgugugcacagccccgcccugccugggccugggcggccugacccagaauggggugaagccagccuggcgggucuugugguccagucgugguuguggugguuguggucugggcucuuggaucagcccgguccuggcaagcggcacuggcuggcccuguccgagcuccuagaguauugggcuuggaucgugucagcucuggcaaguuuuugaguaaaugaaugaggcggaagagaagucugcagagagucagucccugaggacauccuagucacgugagugcuguggcagcaagcaguggcugaucaacaaacgugugaguggugggccagcauccucccucacuaggugcuggggcaguggccagcagagccagggggcuggguauguuggcccaccugucccuucugugagccaccuggaagaagucgugcugcuggucaaggggguggauuccuuagcuagaaggagagagagagcaagauuggaaauuggguuucuacaaaacccgaagccuggguucuucccauggcacuaauuagcuaccccuuuccucacagagugaacguugugguuggaggaaugaggcaucuguguguggagaaguccacccuaagagccacagaugugugccuggggguccagccagugacagaagugcacggcgcgggcucugucguagcccagcccuggguccccaugccgugugggccaguuuggccgcguguuucugcuuuucaggagaagccaagauccaguguuuuaugugacaguucacuuuuuaaagauucagauuauuuugaaauguuuuggggaccacacaaaccuugcugcaaccuuuggucagaaggcugccagcugcuggguguuugcagagguggcaccugccuugcccacccagcaucccgugcagcuggcaaggcaggaugaacucguuuuuagauucaauccauuuguuccuucagaugugaccaaagcugcccucugugccuagccaugggcugggugcuggagacacgagaucaggcaggcccugccccuggggcucauucuagggucugcggcagacagggagacagagggagcugugagagcccugaggcugaguggcuuucuggggaagcaccaucccuagggaccuccgcguucggucaguggccgcugcugucggugugcagagcagaggcuggggcgagaguggucagcaggccugcugguggcagcuugugcaggaagggaggauggagguuggcuuguggcuggcaagaggguggcaugcacgucgcugaaaggcagggccugggcccgaggccuggguguggggacgccugaggagacuguacaguguggagucgggggggccgcagucagggagggaggcagaguggcagaaacagggcccagccagaccccagcuccuccacccacagccuggagagcuugggaaagucagugucuucucuccgccuguacaagggagcguaccagugggccccaucccaggaugggcaggaccugugggaaccuuguguggaggagagaggcugugggcugggguggagugugggacucagguccugggagacccuccuggggggcugccgagagcauccagcugugggcugggagagccugugaccagggccgcgcugcuccagaaagggcccucagaccacagcguggggguggggcuuggauauguagacuccugggccuccccuuauccagaguuggacucagaggagcccaggagucugguuuuaacuggcuuccugcagcagaaggcagcccaggcuugucgcuggggucccgggucccugugggcuugguccucucucugccccacccugcccuggggacugcagagcuggcugggaugggcuucaccugaccucugccccuccccggugaggggggugaguacgaccggccugcccaccguggccggcuguccuguuccauccccacugcccuccugcagcccccugauccccggcccgugcugccguuucagcucccccguuucuucucccccagacaacguggacgaccccacggggaacuuccgcagcgggccccugacgggguggcggguguuccugcugcugcugugcgcucuccugggcaucguugucugcgccguggugggggccgugguguuccagaagcggcaggagcggaacaagcgcuucuacugaguggcgccuccggcggggccugucccugggcccaggagccaaugugaacuuuuuuuuuuaccgggauuauaaaagaacaacaagaugaccuuauuucuuaacuguuucaaauaaaugauuaaaguauuuucauacauuuugcuucuugcccagcagggacagguggcagagccgaggcuuagggucuggcaccccccacagcuggagacggaggcucuccuggggcuggugucucaggagcaggggucugugucuacagaugggcuguggccccugcaggcagcuguugaacacuggagggucccccggaccacacuggggugggcuccugaggacguggggaagugauuuuguuuugugguguguggcacguguggcgacggauaaggccugaacugggaaacccaggccuuccuguucacccugagcugcuuccugagacagaugcucaagugaggcugcaggcgcggugugguggggccgagugugaccguuugcuaaauaaagugaaauacccaaccuca

SEQ ID NO: 192424 - RNA, 3887 nt, Homo sapiens
aagauggcuguggagcugggcgugcugcucguccggccccggcccggaaccgggcuggguagagugaugcggacccuccugcuggugcuguggcuggcgacgcgcggaagcgcgcucuacuuucacaucggagagacggagaagaagugcuuuauugaggagaucccggacgagaccauggucauaggugcgggggcggggaggaaggggcgaguuuggaacgugaccguggucuuggggcgggggaugcgagacagucagcucucuagagccgggaggagacggccucgccgugcccaggcggucgcggaacccaugccaccucgcgcuccucugaccugggcucgcccugcuucccucaaggaaacuaccggacgcagcuguaugacaagcagcgggaggaguaccagccggccaccccggggcuuggcauguuuguggaggugaaggacccagaggacaaggugagccaaccgccccccuccucuccgccagccucucagcuaggcgggcuccgguacuuccucuucuaguuccugcaucugcuaaagugggagagacaguugauguugugggaauauccugcugacuugcagaccccgcccggucugugaaaugggcggauuaauuguggugauaaaaaucaaagaguuuugucaacucuuaaagucaucuagacuuuaagauuucacagaacaugauacuuuccccacaaaaugagcagcuuuuaaucuucccaaguaaggauauuaaaacgaacggcaaaacccuucagcucucaccuucugucacuuuucguuaaaaaacucauggcggggugugguggcucuugccuguaaucccagcacuuugggaugccgaggcggguggaucacuugaggccgggaguucaggaccggccugggcaaccuccgucuggcaaaccccgucucuaguaaaaauacaaaaaaaaaaaaaaaaaaaaaugagccgggugugguggcgcacaccucuaauaccagauacuugggaggcuaaggcacgauaauugcuugaaccugggaagcugaggcugcagugagcugagauagcaucacugcacuccagccaggacgacagagugagacucugucucaaaaacaaaaacaaaaaagaaccccccaaaaaacaacucacaccaaaaaaguugaaagggcauaagcuauaaaggaaagcccuucccaagagcagucagucacuugccacccuaaugucagacucucagagucuaaacaccugccccagagaguucucacacaagcauauggcaacagcugcugagcagcuuugaaucuuucaguguugugaggugcgaaaggcugugccugucaacuuuugcaguacuuagagccuuaagcacuguuuuccuccauucccaucccuaccauaauacugacugaagcuuguuaccuuccuccaggucauccuggcccggcaguauggcuccgagggcagguucacuuucacuucccauaccccuggugagcaccagaucugucuucacuccaauuccaccaaguucucccucuuugcuggaggcaugcugguaagugggcccaugugagacuugcagguuucagccuucauccuuuggugaggacugggggacugguggugcugugggugugagaggauuaugucagauuuugugucuccuaagaacacuggguuuccacuggauguccaggacacagugacugagcucuuuguacaugccucacucagagcaccagcccaggcuuaauacuugcuugugugcccagagccucauggggcuaagacacugaagagggcccagucuguuggcuaaaugaacagaugaaggaaagucggggaugagcugucagucucuggcaggaagauggagcagggcuaccagauuucccuuaucuccuuugucuguccucagagaguucaccuggacauccagguaggugaacaugccaaugacuaugcagaaauugcugcuaaagacaaguugagugaguugcagcuacgagugcgacagcugguggaacaaguggagcagauccagaaagagcagaacuaccagcgggugagugacugggccgggagcagugggcuucucccuagaagcugcccacuggcucagccaggaauuucacauuaaauucauucugagacccccaagggacuuaccugcacugcauuguaggucguggggcggguauuacuaacucgaccuuguaauugaggauacagacucguaagaggcugucauugcccuaaaucacaguuacacacagaauggcacaguagcauuugauaccaacaccuugggugcuguuucaguggguccacaugcucccaggaccagggucucaaacuuaccggugaccaggaaccagagauuaccauaagugaaucugugaccuuaaggacuaguagggcagugacccaucuaaacaagcacagccacuguucagugucaccugggggcuuccuugcagaaauaccagcccuggcuuuacagauguuccauuuuuucaagaggaaauaggauuuuuaugcgaacauuuuaauuuauuuuuuauuuuuuucuauugcugcugcacaaauuaccuguguuuuaaauguugacaaaagacugugcacugugugaggccaacaaaacauaccuaaaggccagauccagcccccagccugccaguuuacagccugugcccaccaucuucaaggagcagugugggagaccuaggcagagggcuuagagcaaguccacuccugugugcuccaggacagcucugccucguggggugauaccacaacuaccuuaccucucucccaggcaccagggcaggacuaggugagggcuaugccugacagaugaagaaacagacuugggagaaugaguagguugccugaggguaaagauaguccccagguagagugacacuuugcaggcacuuggcuggaaccugggcaaagcuggcugaccuugggcauccucuuggucugggaaucagcaguucuagcagccccagccaacucaggcucaccuuauauuccccugcaguggcgagaggagcgcuuccggcagaccagugagagcaccaaccagcgggugcuguggugguccauucugcagacccucauccucguggccaucggugucuggcagaugcggcaccucaagagcuucuuugaagccaagaagcuuguguagcugucccaggcgucacaacccauccucccaggcugggggagaaaggaccuccuggaacugacuucuucugucaggaggacugguuuccagccauaccuguucuggaagggagaggggcuggaggcacccacaggcacaagcugaaggcagcagcuuggcuaauacugagcagguaguggggcaaauuccugcccucucucucuggccucugggccguuugguaguaaucacccaagggcugguaaagccccuccucuuggcaccucagaaucacaguguuacugaucagggaugugaggcugcuguuggggguggggggaggggaaugggcaggcaagccagucuucugucuuccuuugcuaacuuaggguuuugagcagguugggguauggugccugucauacccaccugccacccugggaaccucacuguucucucuuucagccuagaccugcugauccagggugugugugaguugaggguggguggagggguuugcagugugggaauguggcccugcaguugaccugagcugcuucacaugguuguccauucuggggcuuaaagaacugggaccagaccaaguagaggccuuggugcugguugggguggggccugcagagucuuaguuacugauuucauuuucaauaaauguagguuuguuacaugaguuucccaauaa

SEQ ID NO: 192425 - RNA, 13681 nt, Homo sapiens
acaggcuccgggaccgcgcucgggggcgggucuauagugggaaggggacgcgcgcccugcggcccggccucuagucaucgcccucgcagcggcggccaacaucaccgccacugccaccccucccagacuguggacgggaggauggagucgauggccgucgcuaccgacggcggggagaggccgggggucccagcgggcucaggucugucggcuucccagcgucgggcggagcugcgucggagaaagcugcucaugaacucggaacagcgcaucaaccggaucaugggcuuucacaggcccgggagcggcgcggguaagagccucgauuuccccucagucucccgcccaucaccuugaaucuucagggucauucuucccucucccaccuccacuccucugaccuuuuugaccaagccuugcucuuugauuuccucucugucccgccccuucggugauaucccaaguucucaucccugaaccccaggauguuccuagucgcuccccucaauuuucccggggccucgccgugagauuuuccccacccugccugcagagcucucacucccucuucccaguuacguugaacagccccuuuuuuccuuagccacuccucgccuuucuugaagggcgcacguuguauccccagacugucaugucuacugcuccccuuaggaagauggcuuuccuucuuaagguuccaagugcuuuuccuuacagugccuucucuagcgucuaccuucuuuugccuuuugcuguguaacuccuguccgcccacaucagccugucuuuacugaacugcccgcuaguucauccuacguguaucagggacucuugugcucauauccuaguguuuguguucagugccgucaacacugucaccuacgggccggcuagaaaaggugggaaaagugagagugagcauucuucagagacccagcaagugcgaagugcacaccugagaguuuccucuccucaugaggggauauuguugugauugaugucuggagcugcauuucuaaggagagcgccuccuuccucccccaaacacauguccaaugauuuucuuuaaaaaaaauuuauuucacgugaguauaauugagcaauuagcgcgcccuaguguuaucuaaguuuccaguguuuccuuuaguaauuggccuuuagucacuggucgcaagcuccuuauaucuuugugacuuuuguucuguaaggcuuuagguguauagcucugaacuuuuaggcaguucaaaugagagguaagaaaaccauuucaaauucuucuagaacaauagaagaaacauuuuucuaucgggcuauuuauucuuaaagcauuauuuaugaucuuaccugagguacuuucuauauuuuguucuuuugcuuugaaaauuuuaugucuuuaaagguuguuuuauuuuuugagacagggucucccucuguaggccaggcuggagugcaguggcaugaucauagcuuacugcagccucaaacuccugggcuuaagcaauccugcuaccucagccuccggaguagcuaggaccacagguguacaccaccaugccuggcuaauuuaaaaaaaaauuguguguguggagaugggggggucucacuauguuuccuaagcuggucuggaacuucugggcucaagugauccaccagccuuggcuuccaaaagugcugggcuuacaggauuacaggugugagccauugugccuggccuuuuuuuuaaaacaaaaacaaaaacaaaaccccagaguagugucuuaaaacugcugaagugccuacuaauggcugccugacuacauaaacaguagcuuugggauaugccacacccuaugcucauagggcacuggauucagaaaucuaauuuuaaaauauagauuuuaaaaggcuuuacugauuuuauauuuuuaaccaaauaagcuaaggcaggcaaugcaaucauacaucugggauauauuauccauaaaaaguuggucuuuucagcuugcuccaucucugaauaucuuucccaguuugucuacuaaucuuaucuccuacccacaaaguuuggguuauuuccucugcagaauauucauuuugggugauacauuuugaggguguagaggaagaauccagcuuuuuucuuuuuuuuguuuugagauggagucucacucugucgccaggcagaugcagauggaguguaguggcgcagugucugcaaccuccuccccccggguuucaagugauucuccugccucagccagaguagcugggacuauaggcagcugggacuacagacacacgccaccacacccagcuaauuuuuguauuuuuaguagagacgggguuucaccauguuggcuaggauggucucaaucucuugaccucaugauccgcccgccucagccucccaaaguguugggauuacaggcgugagccacggcaccuggccgaaaccagcuuuucuuuaaugcagaaucgguauuuauuuauuuugaugcagaggcugcugaguucuagcugcaacagcauauuuuaaaacauaaacauguaagguguuugccaguauggaauaaauacauaaggcuuuuacauuucuuuucucagaagaagaaagucaaacaaaaucaaagcagcaggacagugauaaacugaacucccucagcguuccuuccguuucaaagcgaguagugcugggugauucagucaguacaggaacaacugaccagcagggugguguggccgagguaaaggggacccaacugggagacaaauuggacucguucauuaaaccaccugagugcaguagugaugucaaccuugagcuccggcagcggaacagaggggaccugacagcggacucgguccagagggguucccgccauggccuagagcaguaccuuuccagauucgaagaagcaaugaagcuaaggaaacagcugauuagugaaaaacccagucaagaggauggaaauacaacagaagaauuugacucuuuucgaauauuuagauuggugggaugugcucuucuugcucuuggagucagagcuuuuguuugcaaauacuugguaagaaaagaucuguaaauuauuaacuaacuuaauggaaaaugcaaaauguuaauaauuaugagugcuuuugaucauagaagucauugccaguauuaauaucuaccagauccauguggcuguuugaagauauauuauuaacuuugcuauucaucucauagaaugaaguguucugguuaaauacagagccuaauaauuacuguuggcccuccauaucaguugguucugcacccuauguggauucaaccaauuguggauugaaaauauuuggauuuagccgggcgugguggugcacgccuguaaucccaguuacuugggaggcugaggcaggagaaucgcuugaacccgggagguggagguugcagugagccaggauaacggcacugcacuccagccugggugacagagugagaccccgucucaaaaauauauguauguguauauauuugggggaaaaauaacaauacaacaauaacaaauaguaaauaauacaaauaaaaacaguauaacaacuauuuacauugcauuaggcauaaaaaaucuagaaaugauuuaaaguauaugggaggaagugaguagguuauauuuacugugccguuuuacauaagggacuugagcaucuauggauuuugguaucaggaggaaccugguaccaguccucugcugauacugagggaugacuguacuaaaacccauuuuucauucuacggaccuuucucauuguuuugcauacauuaauucaucuaauccucauucuuaugaacuugguauuaugugaauccauugggaaaugaagacucagagagguuaaaccauuugcccaaggucacacagcuacuaagcggugcuaggauuaaacccuggcaguuucaguccuuaaccaaaggguuaagugcuuuacauauauauacuguauauuaucaauuuucaaauaauuugaaauaguaaaaugcaguuccucugguccugaauaugagguaaucuuccuaugguucagaagacauuucagcauuuccuaauauaucauaaugaguccauuuugguuguaccaugauguagucauuuuguuuuauaguauauuaaagaaugcagaaaagcauagcucauaguucagugucuugcucugagguuuuuccauucaguagacauuuuaaguauauguaccaggcacauaaauauccagauaauuaaaguuuauaucauuaagcaaaacaguuuuuguaaaucuuuuuuuuuuugagguggaguuucuuucgccaggcuggagugcagugaugugaucuuggcucacugcaaccuccaccuccuggguucaagcgauucuccugccuuagccucccgaguagcugggacuacaggcaugugccaacacgcacggcuaauuuuuuguauuuuuaguagagaugggguuucaccguguuagccaggauggucuccaucuccugaccucaugauccacccaacucugccucccaaagugcugggauuacaggcaugagccgccgcacccagccaagcauuuaguuuuguuguuguuguuguuuuagagauaggaucuugcuaugguguccaggcuggacuagaacuucugggcucaagcaguccuccugccucagccuucugcauagcuggaagaaugccacguauuuugagugcugggccuuuucuguaugcuuccuggauaucaauuaauucccucugggugaccgagauguuaccgcaucuguguuacuguguuaaacaucugucaccauuuaauacuuuaaauaauuuaaaagauaaguuuuuaugagagaagacaguuuuggggacgcuaaaagaauaugaaagaauuguaugacuugagaaacauauuuuauguuaggaaaucaaauauuuuauuuucuucacccuucugcagaaaaaagauuacuuuuaaccauuaaaauuacuauuuuaugggaggcugaggcaggagaauugcuuggacuggggaggcagggguugcagugagcugagauugagccacugcacuccagccugggugacagagcgagacuccaucuuaaaaaaaaaaagcaauugccaggcgcggugucucauaccuguaaucccagcauguugggaggccgagguggguggaucacgaggucaggaguucuagaccauacuggccaacauggugaaacccugucucuacuaaaaauacaaaaauuagccaggugugguggcgggcgccuguaaucccaucuacucagaaggcugaggcacgagcaucgcuugaaucugggagguggauguugccaugaaccaagaucgugccacugcacucagccugggugacagaggaagacuccgucucaaaaaauaauaauaacaacauuuucuuacagcuuuugcuuggaauuuucuagcugcuguuugauuuauugugauuugaaugauuauguuggaaauauuuaauuuuaucuucuaucuucacaguccauauuugcuccauuucuuacuuuacaacuugcguacaugggauuauacaaauauuuucccaagguaaauuaauuuuuuuucuaaauuucgaugauguguuuggauugauuuaugacuagcuaauugaaggaacuuaaaaauguuaguccugcuuacggucugaaucagugcuacucaaagugugguuugcccacuuaucuccaaacuauguguuuguguuuguuauacauuaaguucaaaaaaugaguaauuggccgggcgcaguggcucacgccuguaauccccacacucuaagaggcugagguggguggaucaccugaggucaggaguucaagaccagccuggccaacauggugcaaccccaucucugcuaaaaauacaaaaauuagccagguauggugacgcacaccuguaauuccagcuacucaggaggcugaggcaggagaguugcuccaacccaggaggcagagguugcagugagccaagauugcgccacugcacugcuccagucugggugacagagugagacucugucuccaaaaaaaaaaaaaaaaaaagaguaauuagaaacuuuuauagcaauuugacauugccauaacauuguuauucuguuuuacaaaaauacuguggauugagguccuucaugaaaaagugugaauaguacuuguuuaagcaaaguauuaaauuuaauuaguaaauuuaguaauucauuuugucuauaauaaaggaaauuaauuaaaaaauggauuugauuaucucauuguacuucauauuggacacuuaauagcagugcacuuuaucuucaguguugagggccugauauuugcaauaaauauuuggccaauauuacagaacagaaugauguugagagucaauguuuaccuggccuacuugacuacagauauauacaguuuuaugaggcuuggcuugccugacauagacgauagccuaacuagugugaucgaauuuugugggagcuuuuugcugaaaaaauugcuacuuggcugucugcguguuauauuuaaugggcugacagaccuguguaugauuuuaauggauuugaagcauuuguauuuuugaagggucaaauaggucaaauauaagaaguaaaagaguaaauaacauuguaauuuuaauuaagcauuuguuuagaaauucaccuuugaggcggggcgcgguggcucacgccuguaaucccagcacuuagggaggcugaggcagguggaucacgaggucaagagaucgagagcauccuggcugacagggugaaaucccaucucuacuaaaaauacaaaaguuagccgggcgugguggcaggcaccuguagucccagcuacucgggaggcugaggcaggagaauggcgugaaccugggaggcggagcuugcagugagccgagauugcgccacuguacuccagcagccugggcgacagagcgagacuccucaaaaaaaaaaaaaaaagaaagaaauucaccuuugaggcugggcgccguggcucacgcccuaaucccagcacuuucggaggcugagggggguggaucaccugaggucaggagcucgagacuggccuggccaacauggcgaaaccccaucucuacuaaaaauauaaaaauuacccaggcaugguugcgggugccuguaaucccagcuacuugggaggcugaggcagggagaaucacuugaaacugggagguggagguugcagugagcccagacugugccauugcacuccagccugggcaacagagcgagacugucucaaaaaaaaaaaaagaaaaucaccuuugaaacauugauuguaguuuugcaguagcaaaguuuggaaccuaaauguccacugagugacuacauuaaaaaaaaaaaauuggccaggcacgguggcucaugccuguaaucccagcacuuugggaggccgaggcgggcggaucagcugaggucgggauuucgagaccagccugaccaacauggagaaaccccgucucuacuacaaauucaaaauuagccaggcaugguggcgcaugccuguaaucccagcuacucaggaggcugaggcaggggaaucacuugaacccaggagguggagguuguggugagccgagaucgcaccauugcacuucagccugggcaacaaagcaaaacuccaucucaaaaaaaaaaaaaaaaaaaaauuauaacguaucuauucagaaugaagaugcucucaauguacugacaaugguaagcucuccaagaaauauuaagagaaaaaaaaacaaaauucagaauagaaucuauagaaucuauacuaauuucuuuuugaaaagaaaaaauaauguauuauuugauuuugcuuauauaugcauaaacaaacugaaagacuauacaugaaauuauuaacaauacuuaugugugugauagagauguauauauggguacuauguaaauggaagagagaaaagggagacuuuauauauucucccaacaaaacagcauuuuguuauagcaggguuuuuuuugcuuguuuguuuuugagacagaguaucacucugucgcccaggcugaagugcaguggcacgaucucagcucacugcagccuccgccuccuguguucauucuccugccucagccugccaaguagcugugacuacaggugugagugaccacacccacuuaauuuuuguauuuuuaguagagacgaggugucaccguguuggucagucuggucuggaacucccagccucaggugaucugcccaccugggccuuccaaagugcugggauuacaggugugagccacugcaccuggccuguuauagcaguuuuuaaacacaaaaguuggccaggcguggugccucacgccuguaaucccagcacuuuggaaggccauggugggcagaucaccugaggcugggaguucuugaccaaccuggccaacauggugaaacgcuaugucugcugaaaauacaaaaauuagcuuggcaugguggguacagaccuguaaucccagcuacucagugucugaggcaggagaauugcugacccgguggcagagguuuacagugagccaagacagcgccacugcacuccagccugggcgacagagcaagacuccaucucaaaaauaaauaaacacaaaaguugaaagaauugugccgugaacacccauuuauauaauaccaacgaccuagauucuacaauuaacaucuuauuauauuauguaucuaucagguuuucuuuuauuuuucaaacccaagauaaucucuguaaaguuuuuccaucaaauuuuucuugaugcauuucaaaguauguuguagguguacacaucgguauaccucaccccucuuacauaacacugacuuacaauuuacuguuuuaagguucuuuagguaauuuuuuuuuuuugagacgaggcuugcucugucacccaggcuggagugccaucucggcucacugcaagcuccgccuuccggguucacaccauucuccuaccucagcuucccaaguagcugggacuacaggcgcccgccaucacggccggcuaauuuuuuuuuguauuuuuaguagagacgggguuucaccguguuagccaggauggucucgaucuccugaccucaugauccgccugccucggccccccaaagugcugggauuacaggcaugagccaccaugcucggcauuuuuuuuuuuuuuugagacggagucucgcucugucaccaggcaggagugcaguggcacaaucuuggcucacugcaaccuccaccucccagguucaagcgauucuuccaccucagccucccgaauagcggggacuacaggcacacgccaccaagcccagcuaauuuuuguaauuuuaguagagacgggguuucaccaugcugaccaggauggucucuuucuuuuuuuuuuuuuuugagauggagucuugcucuuucgccaggcuggagugcaguggcgagaucucagcucaccacaaccuccgccucccagguucaagcgauuccccugccucagccucccaaguagcugggauuacaggcaugugccaccacaccuggcuaauuuuuuuuguauuucaguagagacgggguuucaccauguuggccaagacagccuugaucuccugaccugauuaucugcccaccucggccuccuaaagugcuagaauuagcuggucucuggucucuaucucuugaccuugugauucgcccaccuccgcuucccaaagugcugggauuacaggugugagccaccgcaccuggcuuuuagguaaaauuuuaagguaaaauuaguucugaggccgggugcagugguucacaccuguaaucccagcacuuugggaggccgagaugggcggaucaccugaagucaggaguucaagaccaguguggccaacauggugaaaccccaucucuacaaaaauuugccgggcaugaugguggguaccuauaaucccagcuaccggggaggcugaggugggagaaucgcuugaacccagaaggcggagguugcagugggccgagauccugccauugcacuccagccuggucgacagagcaagacuacgucucaaacaaaaaaaauuaguucuaauaugaagaguaggguaccagcguaauuaauugauugcuugaaaugcuugucuuaauuguaccauuuaauacguuuguuauccuaugaaacccauaccucuuucaagguuuauaacuucacugucaccccaggaguuucuuucaugcuccuuuccaggcagucccagucccuauaccccaaagaacuuuuucccacgauagauuaguugugucuggcauaguaauccauguaagugggaucauucuugauuuuacuuuuuugugcaagccuucuuuauuccgcaugauauuuuugagauuuauccauguuguuggauaaaucaguaguuaauuccuuuuuuuuucuuggcucaguaauacuacauuguaugacuauauccauuuaucuagucuccuauagauggacauccugguuguuuucaguuuugggguuauuaugacuaaaacuaagagcuuucuuguaugaggcuuuuugugagcauaagcuuucauuucuuuuagguaacuauaggguuuuuuuuuuuuuucagauggagcuuugcucugucacccaggcuggagugcaguggcacgaucucggcucacugcagccucugccucccagauucaagcaauucuccugccucaggcucccaaguagcuuggauuacaggcaugugccaccacgccuggcuaauuuuuuuguauuuuuaguagagacgagguuucaccauauuggccaggcuggucucgaacuccugaccuugugauccacccaccucgaccucccaaagugcugggauuacaggcaugagccgcugcacccggccaacuauagguuuuuauauuuaaaaauauuuuaaaccguaugauuggauuuugugauaauaaagaaaaauucagcuuuuaaucucuuaaaaaaaugagacuagaaaauuaauaaguaaauguucucucuuccaccagaaguauacugaauuguucagugauacccuauuggauguguaaucaaguguggauuccuuugcauaacaauuagggcccuacauuccuauaagucugugacaaauuacucauuguucuccaagcauucuucugccucuaacuuguccugagacuuaacgcuucaaaaaacuuucacuucugccagucuaaauccugcucuucuuugaaggucuguuuuuaguuguuguuuuuggagacgggggucucacuuugucaugugggcuggagugcgguggugcagucucaguucagugcagccucaaccucuuaagagauccucccaccucagccuccugaguagaugggacuacaggcucaugcucagcuaauuuuuguauuuguuguagagacagagucucccuauguugcccagaguggucuuaaacuccuaggcucaagccaucacccagccucggcaucccaaagugcugggauuagaggcaugagccacugcacuuggccugaaggccuguuuuuaauuuuacuuccucugaaguccuccuugugcuuuauuuacauaaaacacuggaguaauuuauaucuccugugagcuccuaugucacacauuauccaugucagucauuuagcaguuauuuauguccugucuaguaauauuuuucuuguuuuuauauuguacuguuguauauaucauaaauuguuauuuaugucauacuuccaagauaacacuuuuuaaaaacuucuaauaacaagacugggccaggugcaguggcucacaccuguaauccugacacuuugggaggcugaggcgggcagaucacgagaucaggaguuugagaccagccugaccaacauggugaaauccugucucuacuaaaaauacaaaaauuagccgggcaugguggcaagcaccuguaaucccggcuacucaggaggcugaggcaggagaaucgcuugaacccgggaggcagagguugcagugagccgagaucgugccauugcacuccaaccugggcaacagagcgagacuccaucucaaaaaaaaaaaaagcaagacugaugucugcuauugccuagcagauugaugaguuacauauuauaugcucaguaaauguugguaucuuacugauuguuuugaaacaucauuaacaguuuuuaaaucauuucgguuaaaaacagcaguacugaucauguuuguauagagcuuaauguagccugcugaaacuuugaagauuaauuugagucuuucucuacacagagugaaaagaagauaaagacaacaguacuaacagcugcacuucuauugucgggaauuccugccgaagugauaaaucgaucaauggauaccuauagcaaaaugggcgaagucuucacagaucucugugucuacuuuuucacuuuuaucuuuugucaugaacugcuugauuauuggggcucugaaguaccaugaagccuguagaacugagaaggagaagcuuacaaaaaaaaaaaaauccucuucuauauugcagugucucuaaaggaggcaaauugguuuacaccuucauguaauucuuuuacuuuagggguuguaaagcuacuuuauuagauauagaauggcagauucucugauuuaaaagggcugaguuuguauuauuacugauaugaagaauagaguaccaaugucauuaauugauuuuucuuguuaaucagaauuccuauucuguaccuuuccucuaacuucucagauuuguaauucuucuuuugggagcugagcuagugcuuuuaggagaacagauaaauguggucucagccagcccuagagacugcuucuuguguuugugucauucuguccugagaaaugaagucaucugaaaaauaaaaugaaagaaacugaauugucuaauguuaacucugcacauuguaacuuuucuuguugaguuaguaucuuaauuuuuacuccagcacaaguauuuaaucaaagaaaagauucauacaugugaaauuggaagguauuuauaaaauuuuuauugcuguauaccaaacucagaauuggaacuuuuuacauuugaguuucacuuuuuagaaguauguuuuaagcaagcaaaaacaaaaugggaugugaagaauugaggcaugcaacccaauagcauaaauguccuuuuuccccccaaauauggucuagaugaguuauuauaaacauuguuuuuauuuuuuugagacagaguuucgcucuuguugcccaggcuagagugcaauggcgccaucucggcucaccgcaaccuccaccuuccugguucaagggauucuccugccucagccucccaaguagcugggauuacaggcaugcaccaccacgcccagcuaauuuuuauauucuuuaguaaagacaggguuucuccauguuggucaggcuggucucgaacuucugaccucaggugaucugcccaccucggccucccaaagugcugggauuacaggcgugagccacugcaccuggccuuauaaauauccuuuuaacuaacucaguaacugccauauuuuguuggguugucuucuuaaaagaauauaagacuaaaguguuaaugucacuugguguuacauuuccuuacagauuuuuguauagucuaauuugguuaauccuugugacauuaaaaacacauacacuuuuuaaaaaauua

SEQ ID NO: 192426 - RNA, 43802 nt, Homo sapiens
cagaauccagacgcuaaggaaaaucccuaagcagagauuuucuguuggaugcuaaaagcaaggaauaaaaguugaaaauuuggaaaaugucucaacaccgucaccagcgccacucgagagucauuucuaguucaccaguugacacuacaucggugggauuuugcccaacauucaagaaauuuaaguaaauauuaucuaucuccauugccuguuaagaaaugugcuaguagaagugugagggcagggugucaguguucucucagccucuucccucagauacucgucugcuuaccaaaauaaguugcauguccuugacaaucugguuucuaugauuggugaggcuggcaugcuauuaccuuuaugugcccuguagacuugaaugaccaguuugaccaguuugacuguuagauaaucugaaggcuuuucucuuuuuuuauaauagaccccaucucaaaucagauaaugaaaauuacauaucuugauauauuagaaaaguauauacauucuggcugggcacgguggcucacaccuguaaucccugcacuuugagaggcuggggcggaucacuugaggucaggaguuugagaccagccuggccaacguggcgaaaccccaucucuacuaaaaauacacagauuagcccggagugauggugugcaccuguugucccagcuacucaggaugcugaggcaggagaaucccuuuaaccuggggggcgaagguugcagugagccaagauugcaccacugcacuccagccugggugacagaacgagacucugucucagaaaaaaaaaaaaagaaaaggaaaaagaaaaauauauauucuauauuuuuuuaacuuaugagaauguguucauuucauuuguaacauauaaugggaaacaguaauacguacucugagaaaaauugcaaagcacagauaaauggaaauaaacaggaaaaagaaucaccuauaaccucaccauccauagacagacacuguuaaaauuuuggcauauuuccugcugauuuuuucuacugcugauuuuugcacaggugagauaauuuugaacagagaauuuuguaucuuugguuuuuguguuuugcugcacacaaaaacaaaagauauaaaaauggaucauaaacauuuuucuaaauccugaaaaaugcauagacauauuuuagugccuguauuucacaagauggacauaccauaauuuacuuacacaguccuuuuuguuagauguuuaaguuguuuucaagcuucucagugcuggaaaaaauacugagauagacauguuuaguugaaguuauuucauuucagguuauauuaucuugggucagagaaugaaugguucucaggcuuuucaaaagagcuggucaguuuuuaugccucuggcaguuuuugagagugcucaaucauacuacacuguugccagcauuagaucuuaucacauuuaagucauugcuaauuuuauaaacaaaaacaaugguuuuacuuugcaucucccugauugguauugcuguagaacauauuuggagaaguuuguuugucuuugguguuuauuucaugaauagauugugugcccauuuucucuugggguauucaguuuuuuauuacugaugugagcauguguaugggugauuauuugaugauuaucaguuuugcuuaguagacuggcaauauuuagucuugcugucacuguguucccagugccuacuagauugcuugauauguaguugccacucaauaaagauuuguugagucaaugaagaugacacuuuguuuugcuggagaaggaguggugaccauucuuuuucagagguccagggagagggagcuaaguaacugagugaggacagaguauccaugaucaucauauauaugucaguggucauuuauucaacaucucauugcuauuuaaaaguauauguaaauuuauauucacacaagggagaaagcagagccuugucccuacaaaaagguaugcauuuuauggggaucuagcucuauugugcuguaaccauacuucacauucaacuuuuugacaggaggaacgaugaugaaugucgggcauuugugaagagagucauaaugagccguuucuuuaagauaauuaugauuagcacugucacaucgaaugcguuuuuuauggccuuguggaccaguuaugacauaagguaccgcuuguucagacuucuugagguaagcagacaaaauggguccauuuucuucuuuuuuuaaaacaugcuuuauuucuggaaacauuauaagauuuuuuuuuuuuuccgagacagaaucucacucugucaggcuggagugcaguggcgugaucucagcucacugcaaccuccaucuccaccucccagguucaagcgauuccucugccuuagccuccugaauagcugggauuauaggcacccgccaccacgcccagcuaauuuuguauuuuuaguagagacgggguuucaccuucuuggccaggauggucuugaucucuugaccucgugauccacccgccucagccucccaaaaugcugggauuacaggcguuagccaccaugcccagcccauuauaagauuuuaaggguauuuugcuucaagaaauuuucuguagaauucuaaaaauacucuaaaaucugggaagaggguggcaagagcagcaguggugacaugguggauuuuuuuuuuuuuuuuuuuuugagacagagucucgcccuguugcccaaccugcagugcaauggugcuaucuuggcucacugcaaccucugccucccagguacaagugauucuccugccucagccgacugaguagcugggaucacaggcacacaccaucaugcuuggguaauuuuuguguuuuuaguagagauagggucuugccauguuggccaggauggucuugaacuccugaccucaagugagcugccugcgucgggcucccaaagugcuggcauuacgggcaugagccaucgcgccuggccagugacaugguuuuuaagucuccuugaaucuccucucaaaaacugagcaagccugggcaacaaagugggacuccuaucucucuuuuuuuuuguuuugagacgaagucucgcucugucacccaggcuggagugcaguggcgcaaucucggcucacugcaagcuccaccuccuggguucacgccauucuccugccucagccucccgaguagcugggauuacaggcgcccgccacaacgcccggcuaauuuuuuguauguuuaguagagaugggguuucaccguguuagccaggauggucucaaucuccugaccucgugauccgcccuccucggccucccagagugcagguauuacagacguuagccacugugcccggccccucccaucucuauuaaaaaaaaaaaguugggcaugguggugcauaccuugagucccagcuacucuagagguuuaggugggagaauugcuugagccugggaguucgaggcugcagugagcugugauugcaccacugcacucuggccugggcaacagagugagaccuuguccuaaacaaccaaccaaaaaaaccagagcaacuagguagcaaagccaagaacccacaggcagcauuuacaacaaaacugguuaguuuccuuacuacaagccguaagaacugaauaguaugucucuguggggaaagaaacagagggaagccauuauuuauuuauuagaaagugugaugggcugaugugagaacagcauuugauaucaguaacaguauugucuaauccaauacugggcuagaucaagagguuccugguaauuuuugaaggggcuagaggagcagauggugugaacuuucaaagcugaccagcuagaggucuuuuuaaagacaggaucccacaguugggauaaauacuggaaauggaauaaaaauugagcagguuagagacauagagaugaaggaagagaagguucagauaaaauuggaggaggaaccaggauaccucaaaaaucaagcuacugcguuuuuaaacacaacacaaaagcagaagaaugagcucagugagguuagaaccacaccaucuucuaaaagcucaagaaaacaaauuuuauguaaaacagcacaauagaaaaagauugaugcugcuauaguuguguuuuuagaaaaaaaaggguugagauaaagucucauacacaauuacuguaagaaaaaagagaaugagguagagaauaauccccuuauacaggcugagcaucccgaauuugaaaaucuggaaccuggaaugcuccaaaauacaaaauauucugagcacugacgugacacucaaaggaaaugcuuacuggagcauuuuggauuuuggauuuucagauguggguugcucaacugguaaagaaaaugcaaauauuccgaaauccaaaaacuuugaaauccaaaacacuucuguucccaagcauuucagauaagagauacuuaacccguagauaaugaaagcccaccacaaagacaugcccacaaaacagggagagacuguagcauaugacuuuaaaacaagccagauguuuaagaaagugauacaagauaggaaagaacagaagugaaaagacaaaacucaggaaagaacuagaaauaaaaauuucaaaaauaaagacuaaaauagacuaagcaauuaauugcaacagauaauagcuuaagagaaguauaggauuaaauguaggaaauuuuuuaaaucaauaagaaaugaagacaugaaaagguuucaagagaaaaugaugaacaucgaagauggggaaaaaaaaauccaguguaaugacaauaggagccccugaauuugaaauaaaacagacacaaagcaaaggaacagaacaaaugcuaaaguguauaauccaagaaaaguuaccugaaacaaaagauuuggaacuauacguugaaagagcacacauugcauaccugagaauauggaguuugaacaauaaacaccaaaacauauucuaguaaaauuauuggauuuuaaaggaaagagggggugaaggaaacuaaguaucaaugcaauguggcuuauaagaagauaaucacuuaucaucaaacuuugcuaugguaauauguuaugccaaaagaaaauagaguuacauauuuaagauacuucagcaaagaaaauguaaaccaagaauuuuagaucagaaaaauugacuuucaaguauaaaggacauagacaaauucaucaauauucaaaaacuuggggaauauuguuuccaagagcccuuccuuaguaauuuacuaaagaauagguuucagccaaccaaaaugauuagagaagcaucaacauuaggacugaagaugagcauuaaauauguaguuauuuguagaacuaauauuaauugugguuuagcagagagaauauaguauauaaugaaugcaucaucugacagugaagauagaguaugacuaaaaaaugggagacaauggggaaagccaagauaaaaaguuucaaaaucauuuucaguaaucaacuuaguggcaacaguauuaguaguguuauucugagacuuguaugucuguaauacaggauaaggcaauugaguaauuaugggacaguuuauuucugucaucuccuguguucuuaagaaccaggauacucauggaggagagaacccaggacuucuuugagaaauaaccaauuccaggucuagggcaggagguacacaagaugaaccaugauuaucuugucauagacauuagcaaggaagcuaucaaagacuacuggggucaugucaaaagucucaggagacuaugugaagaguccuacuggccaaagaugggacaguuugagcuccaauaagaagaauaauugccauguauugaaacucauuaaauaaucugugagguuuuacuacuggccaaagaugggacaguuugggcuccaguaagaauaauaauugcaauguauugaaauucaccaaauaaucuaugagguuuuaaugauaccccaaaacaaacuguccacuuuuggaggaugauaaggagcuaauccuuuaucuugauaauuaguaaauuaagggaaagagucaagcauuacugaccuuaugugaacugcaauacugaguaagcauauaguaggugaggggaaacaucuuuuuauagaugugucccccuuaauaaaugaaaaagaaaugauagaauaucacaguuuuucaaugcccaaagaaguuauugaucuaggcacugagcaucaaugaaaagagagacaaccagaaauuaugugccgucuauaaaagaacagcaccucuaaucuugccaaagagaucaggaaauauggaggccagagggauaugcugaacuguaccaugagcgugcacucagcaaaauccagacugggagauuuuacaagucaaacuccccagguucuuuaacagauaaauuguaaggaaagaaaaaggaaugggagacuuaaaagauacaccaaaaguuuaaaaauuuauaaaauggcaagacgacuuauuaguucuagggauggaugcaugaauuuuuaucuauaaagaaaugcaagguauuaauuacuauaaaaauuuggauagugguuaauuuuggguggagggagggaguuguaauugggaugugggacaugugaggggcuucugggauggcagaguucuauuucuugaccuaggugguaguuacagggauauuggccuugaaauaauuuauuacacuauauauuuguucaugugguucuauauguguguuuauuuugcaauaaaaagguuaaaaauauacucuucuuaucuuuaggauaaauaacacauuuccuucuugggggugaaaagguuagcauaaacauaaugugguaucagaggcagucgagguggugggauaccacaauuaaugcuuaaaaugugucagauccacuuggcaccacuucugugaacauguugguauggcagugaauuccacaccacaaauccagagauugguuauggacuguggaacaucauguuagguauaggacuuggcaggggucagggaaagagacaaauugaggagccuaaacccucuguuugccucccugaugccauaagggucacuaagcauguauccugguuuagggaccugguuugcaagccuaggggauguucugugaugggcagacuuuggaguuauacagauuuggguucaagccccagcuuccuaccuuauuacuaacugagaauuuggacaaauuacuuaagcucucugugguuugucugcaacauuuguaaaaugauauaauuaauauacaacuuacaggguggugguacagccauugaaaauaacauguaugaaagccccugguuaacugugaaacugagaaauuauuaacacuucugggaacuccacugaaggugccgggaaagaugugagagagcccugaucucucaccucuggcuaaccuugaggcucugugcaagcaggaaaugaaggcugaggcagagugguaaguugcuagagcauugaacauguggaaaugcuguaggaaagcuuauaaaaaaagacaaacaaacaaacaaaaaaaacccaggcaacauagugagacccugucucuguggggaaaaacaaacaaacaaacaaacaaaaaaaacaggcauggugccaugugucuauagucccagcugcucagaagucugagguaagaggauugcuugagcucaggaggucaaggcuguagugagccaugauugcaccacugcacucccagcuggaugacagagugagacguugucucuuauuaaaagacaacaaauaaaugcuggugaggauguggagaaaggggaacucauacauuguuggcaggaauguaaauuaguacagcuguuauggacaacauuauggagguuccucagaaaauuagaacuaccauaugauucaacaaucccacuacuaaguauauagccaaagaaaaugaaaucuguauauugaagagauaucugcaaucccauguuuauuguaacacuguucugaauagccaagauauggaaucaaccuaaguguucaucaauggaugaauggauuuuaaaaugugcuauauauacacaauagaauacuauucauauguaacaaaggacaaaauccugucauuugcagcaauguggaugaacuuagaagacauuauguuaagugaaauaagccaagcacagaagaacaaauacuacaugaucucacucauguggaaucuaaaaaaguugacucauagagguaguauauuaguuaguuuuugcauugcuauaaagaaauaccugaggcuggguaauuuauaaauaaaagagguuuuauuuuggcucaugguucugcaggcuguacaggaagcauaguaccagcaucugcuucuggugaugcuggcaccagaugcuugggaggauugcuugagccugagugaugaucugugaucacaccucugcacuccagccugggugacagagcaagaccccauaccaaaacaacaaaaacaaaaccccaccccaccccacccccaaaaaaacccaaggucuguucuauugccucugcaaccaaggagcaggguuucacauugggaauguaagcuggugcaaggggugggcucccggggccuugggaagcuccaccccaguggcuuugcacagugcacucccugugucugcucucauggguuggaguugaguacuugcagcuuuucuaggcuuaggauguaagcugcucauggcucuaucauucuugggucuggagagcagugggucccuucccagagcuccacuaggcagugcccuaguggagacugugugggggcucuagccccaaauuuccucuuugcacugcuuuaguaaagguucucugugaggacucuggcccuauagcaggcuucugccuggacaccugggcuuucuuguacaucuucugaaaucuaggggaaagcugcuaaaccuccaucacucuugcauucccuaagcccacagacuuaacaccauguggaagccaccaaggcuugcagcagcuugugcucuccaaagucauggccccagcaauauggguuccagagcagaccuuauuugagcuaagacuggagcuggagaagccaggauguggggagcagugucccaaggcugcucagggcagcagggcccugggccuggccccagaaaucauucaguccucuuaggccccugggccuguuaugagaggggcugccuugaucucugaaaugccuucagggccuuuuccccauugucuugguuauuagcacuuagcucccuuucagucaugcuaaucucucuagcaagucauugcuucauagccugcuugaauuucucuccugauagggcuuucucugucucuggcaaauggcgagucugcaaauuguccagacuuuuauacugugcuucccuuuuaaauauaaguuccaacuuuaaccucuccuuuccucccauaucugaucauaggcuguuagaagcagccaggacacaucuugaacauuuugcugcuuagaaauuucuuccgcuagauucccuaagucaucacucuuauguucagcuuuccacaaagcccuaggauauggaaacaaugcaaccaaguucuuugcuaagggauaacaagggugaccuuuauuguaguucucaauagacuccacauuuccaucugagaccucaucagccugggcuucacuguccaugucuuuaucagcauuuuggucacaaccauuuaaccagucucuaagagguuccaaacuuuuccucgucuuccugacuucugagacuuccaagcucuuccauucucccuguuacuuaguuccaaagcugcuuccacauuuucagguaccuuuauaucgguaccacacuucugguaccauuuucccauauuaguuuuuguguugcuguaaagaaauaccugaggcugaguaauuuauaaagaaaagagguuauauuuuggcucaugguucugcagaccauaaaagaaguauggugccagcaucugcuuuuggugagggucccaggaagcuuacaugguagagggcaaaggggagccagcaugucacauggugagagagagagcaagagagagaggggggaacugccacacacuauuaaacaaccagaucucauguaaacucagagugagaacucacuuaucaccaauggaauggugcuaaaccauucauaagggaucugcucccacgauccagucaacuccugcugggccccaucuccaacacugggaaccacauuucaacaugagauugggaggagacgaacauccaaaccguauuaugucaauagugguugcuaaaggcugggaagagcaggggggaaggagaggagcagagguugguuaaugagguacaaaguuacaguuagauaggaggaauuaauuuugguguucugugcaauagggugaugauauuuagcaauaugcguuguauacuucaaaauagcuagaagagaggacuuugaauguucuuaucacaaagaaauggcguguuugaggugaugaauaugcugauuacccugauuugacauuacacauuguauauaugucuugaaauaucauacuguaccccauaaauacauacaauuauuauaugucaauuaaaaacaaaauaaacguuaaaaaacaaaacacaaucuauaaaaaaacugauugcaaacauuauacuuaaugaugagaaacuugaugccuuccuacgaagaucaggaacaagaaaaggaugcuuacuuucaccacuccuauuuaacaucauacuggaagucauggcuaaugcaauaaaacaagaaaaagaaauaaacauguaaagacuggaaaggaagaaauaaaacugucuuuguucacauauauauuuuaaaaguuaggaaaguuuuguuauauuuucuuuuuuuuuuuuuugagacagagucuugcucuguugcccagguuggagugcaguggggccaucuuggcucacugcaagcuccgccuaccagguucacgccauccuccugccucagccuccugaguagcugggacuacaggugcacggugccaugcccggcuaauuuauuuuuguauuuuuaguagagacgggguuucaccauguuagccaggauggucucgaucuccugaccuugugaucugcccgccucggccucccaaagugcugggauuacaggcaugagccaccgugcccagccaguuuuguuauauuuucacugccuuguccacuccccuccccagcauggugaugauccugaagacagcagcucacauuccuaauguagaacccugguccuugguuccagagcagacuuuauuuguuuguuuguugagauggggucuugcucuguuacccaggcuggagugcagaggcgugaucacagaucguugcagccucagcugcuugggcucaagcaauccucccaccucagccuccugaguagcugggaccauaggcaugcaccaucaugcccagcuaauuuuuguauguuuuguagagauggggucucgcuaugcugcccaggcuggucucagacuccugggcucaagugauccacucaccuuggaucucccaacagucaugagccaccaugcacuaacccagaccuuguucuuaaagaauuguauugguccauuuugaccugagagccaggugaaggacugauggaaguugacugcuuuuguuucaccuagcuuggaauuuucucaaagcagaaagguggcuauagagagggaauuucuuacaaacauuaaaaggcaugugaacagucuauugcugccuggggcaaaaaaaguuaaagcaaacaacggacauacugaaguguaggaagaaaggccuagaagggagauucuuuggauaaguaggacauugagaagcuccgguguauauggagaaauuuagaaagcauucaugcccaaggcaggacgaauguuucaaaaagaccuaaggucucaagauuucaccuuuagcugaucuuuaggcucaguaaaaacuggaaguuagggguaauguagaguuguaaauggcuuugcuaagcccugaaagaguaccccaacacagagccaaucuaaaaaaucuaggagaacuuuucuuccucccucccucccucccacccucauuucccacccuucccucccuccuuuccuacccuucccuccuuuucuucuuucuuuuugagacaaagucuuacucuguugucugggcuagagugaagugacaugaucauagcucacugcagccuuaaacuccuggacucaagggauccuccugucucagccugcugaguagcuaggacuacagacauauaucaccaugcccagcuaauuuuuuaauuuuuuguagagauggggucucacuauguugccuaggcuggccuugaacuccuggccucaagagauccuccugccugggccucccgaagcacugggguuacaggcaugagccaccaugccuagccuaucuucuuccuuuccuuuuucucuccucuccuuuauucuccuuucucuuuuuuucuuucccuccucccucccucccuccucucuuccuuccuucccucccuccuucccuccuucccuccuuccuuuccuccuuucuuuuuuucuuucuuucuuuuuuuuuuuuuuuugagauggagucuugcucugucaccaggcuggagugcuguggugugaucuuggcucacugcaaccuccagcucccugguucaagugauucuccugccucagccucccgaguagcugggauuacaggcaugcaccaccacacccagcuaauuuuuguauuuuuaguagacaugggguuucaccauguuggccaggauggucucaaucuccugaccucaugauccucccuccucagccucccaaagugcugagauuacaggugugagccaccacgccuggccccuuuccuccuuucuuuaucagacagucucacucuguugccugggcuugggugcagugacaugauuauagcucaaucagccuuaaacccuuggacucaaaagauccccacauaucagccuccugaguagcuaggacuacaugcauacaccaccauguccagguaaugaaaaaauguuuuuuguagauacaguaucucacuauguugcucucaaacuccuggccucaagagauucuccugccuuggccucccaaagcacugggauucaggcaugaguuacaaugccuggccuuucucucucucucuugcucucuuuuucuuauuucuuuuuauuuuuccuuuuucuuucuuccucuuuccucccuuccuucuuuuguuucuucuuucccucuucuucccuucauuuuuuccccaaacccucucucucucucccuuuuuuccuucuuucuuuuugcuugagacauuuaagaaaaucucuguuggccgggcacaguggcucaugucuguagucacagcacuuugggaggcccaggcaggcagaucacuugaggucaugaguucgagaccagccuggccaacauggugaaacccugucucuaauaaaaauacaaaaaaauuagccaggcauggugccuguaaucccagcuacuugggaggcugagguaggagaauugcuugaagcugggaggcagagguugcagggaguugagauugugccacugcacucuagccugggugacagagugagacucugucucaaaaaauaaauagaaagaaaaucccugucaaaacacuaguugaccagaaagugaagaaauagagacuucagagaucacacacaacaaagaauauaguucuuugcaaaaauaguuuagaaaagucacuaaacaaguaaauacaacucacauaaagcaacaaaaacaaaccaugaggagggggaagaauuugauuuccaaacuuaccacguugcaauauuuaaaacauuugguuuucaacaaaauauuauaaagcaaucaaagaaacaaaaaugucugacuuauacaaugaacagaaacucuuccugaggaaacccagucauuggaauuacuagacaaaggcuuuaaaaauaaaugcucaaagaggccaggugcgguggcuucugccuguaaucccggcaauuugggaggcugagguggguggaucacuugaggucaggaguugaagaccagccuggccaauguggugaaacauugccucuacugaaaauacaaaaauuagccaggcuugauggcagggccuguaaucccagcuauuugggagacugaggcaggagaauugccugaacccaggagacggagguuaucuagggggauucaguaacagauuugaguaaauagaauaaagaauuggugaacuugaagacaggucaguugaacuuguucacuuugagaagcagaaagaaaaaaugaugauaaaugaacagagccuaugagaacugugggacaccauaaaacauacuaauauacacauaauagggguuccagaaggagaggagaaaauaaggcagaaauaauauuuaaagaaauaauggccccaaauucccaaauuugaugagagacaugaauauauacauccaaaaauuccaaugaauuccaagaaggagaaacauaaaaagagccacacuaagacauguaaucaaacugucaaaagccagaaauaaagugagaaucuugaaaacagcaagggauaagcaaguugucacauacaagaaaccucaauaagauuaacagccgauuuauccucagaaacuauggaggccaaaacacagugaaaagccauguuuaaaauauaaaagaaaaaauacugucaaugagaaauacuguauucagcaaaauuauccuucaaaaaugaaggggaaauaaagacuuccagauaaacaaaaaugagaggguuuguugcuaguaaaccugcccucaaaaaaaugauaaaaguuguuuuguagguggaaaugaacaagacaguaacuugaacucauacaaagaaauaaagaacuuggguaaggcaacugcaucaguaaauacaaaagcuaguguuauuguguauuuugauuuguaacucuuuuuaaaaauauaugguuuaaaauaccaauguuauaguuaaugggcacacauguuugaaggaguaguuuauaaucacaaaaacaugaagggagagagaugaagcuguauagagcagaauuguuauauacuauugaagcuaagguuguguuaauuaaaaauagauuguuauaaauuuaagagguuaauuauaauccaaaggguaagcacuaagggaacaaccaaaaaaacuguacagaaaaggaaaugagaaaggaaucaaaauggcacaguacaaaaaaaucagguauauaugcaaaaaggcaguaauggaggaauugaggaacaaaaauauaugacauauagaaaacaaauagcaaaacagcagaaguguguccuuuaucuguaauuacuuuaaauauaaauggauuaaacucuccaauuaaaaggcagagaugaacagauuuuuaaaaucccauucauauguugucuacaggagacucacuuuagauucaaagguacaaauagucaugaccagccuggccaacauggugaaaccccaucucuacuaaaaauacaaaaauuagccaggugugguggugcacgccuguagucccagcuacccaggaggcuaaggcaugagaauugcuagaacucgguggcggagguugcagugagcugaaauugcaccacuacacugcaaucugggugacagagugagacucugucucaaacaaaugaagaaacaaaccaaagauacaaauagguugaaagugaaaggauggaaaaagauauuccaaacaaauagaaaccaaaagauagcugggguggcuauacuaauaucagacaaaauagauaguaaggcagaaacugcucuaagagaaaaggaaggacauuauauugacaaagggaucaauucaucaggaagauaaaacaauuuuucucuaguacacaaggaucacucuccaggauagauuauauauuagaccauacaacaaaucucaauaaauuaaaauauugaaaucaaagcaauccuaagcaaaaagaaaaagucuggaagcaucacauuauccaacuccaaauuauaccacaagguuauaguaaccguaacagcaugguacugguauaaaaguagaugcauagaugcaguggaaaagaauagagaacccagaaauaaggccaaauacuuagcaaccaacccauauucaaagcauacaaaaacauaaauuggggaaaggacacccuauucaauaaaugguguggggagaacugguuagccacauguagaagaaugaaacuggaucccugucucucaccauauacaaaaauuaacucaauggaauaaagacuuacaucuaacaccugaaaccacaaaaauucuagaaggcaaccugggaaaaacucuucuggacauuggccuaggcaaacaguuuaugauugagaccccaaaagcaaaugcaacaaaauuguauaaaugggacccgauucaacuaaaaagcuuuugcaaaggaaauaaucagaguaaguagacaacauacacaaugggagaaaauauuugcaaauuaugcaucugacaaaggaauaauauccaaaaucuacaaggaacucaaagaaauuagaaagaaaaacaaaucccauuaaaaaaugggcaaaggcuauaaauagacuuuuaucaaaagaagauacacaaauggccaacaaacauuugaaaaaaugcuccauaugacacuaaucagcauggaaauguaaauuaaaaccacaaugacauaccaccuuaccccagccagaauagccauuauuaagaagucaaaaagcaacauagauguuggugugguuguggugaaaaggaaaugcuuauacauugcugguaggaagcuaaauuaggacaaccucuauggaaaacaguauggagauuucuccaagaacuaaagguguaucuaccauucaauccagcaaucccacuacugacuaucuccccaaaggaaaaaaaaaucacuauaucagacaccugcaugcauuuuuuuuuuuuuugagauggaaucuggcucuguugcccagacuggagugcagugagaggcacgaucucagcucccugaaaccucugcucucagguucaagugauucucccgccucagcuucccgaguagcugugauuacaggcauacgccaccacgccuggcuaauuuuuguauuuuuaguggagacgggguuuugccauguuggccaggcuggucuugaacuccuggccuugagugaucugcccaccucagccucccaaagugcugggauuacagucaugagucacugugccaggucugcaugcauauguuuauugcagugcaauucacaguuguaaagaauugguaucaaccuaagugcccaucaaccaaugaguggauaaagaaaaugugauauauauacacgaugaaauacuacucagccauuaaaaaagaacaaaagaaugucuuuugcagcaacuuggauggaauuggaggguauuauucuaagugcaguaacucaggauucaaaaaccaaauacugcauauucucacuuauaagugggagcuaaacuguggguaugcaaaggcaaacagagugguauaauggacauuguggggagacagugaacucagaagggggagguugggaggagggugagggacaaaaaacuaccuauuggguucaaugcacaccuacaugggugaugggugcauccaaguaguguacauugcaccuaauagguagucuaaagucccagacuucccugcuacacaauucacccauguaaccaaaaaccauguguaccccuaaaaguauugaaauaggccaggggcaguggcucacaucugcaaucccagcacuuuggaaggccaagaugggaggaucacuuaaguccaggaauuugagauuagccuggacaacauaaugggacccccaucuauuaaaaaaaaaaaagaguggugauguaugccuguaguccuagcugcuugggaggcugaugugggaggaucacuugagcccaggaagucaagggugcagugagccaugacugugucacugcacuccagacuacgugauagagcaagaucuugucucaaacaaacaaacugacaaaauccccccaaacaaaaaacaauugaaauuuuaaaaaaauuuaaaaagaaacacacacacaagaaacacacacacacagccauauauauauacauauauaaugaauucuaccagucacuuaaauauauauauacauaaaauuagacaaaguaucuucacugacagcaaugaaacggaacuacagaggaaaacuacauuuuucaaauauguguaaauuaaacagcauacucuuuuuuuuuuuuucugagauggaguuuggcucuuguugcccaggcuggagugcaauggcacaaucucagcucacugcaaccucugacuccuggguucaagcgauccuccugccucagcuuucugaguagcugggauuauaggcaugugccaccacacccagcuaauuuuguauuuuuaguagagacacgguuucuccauguuggucaggcuggucucgaacuccugaccucaggugauccacucaccucggccucccaaagugcuggaauuacaggcgugagucacugugccuggccuuaaacagcauacccuuuuuuuuuuuuuuuuuuuuugagaugaagucuugcucugucucccaggcuggagugcaauggcacaaccucagcucacugcaaccucugccucccggguucaagcaauucuccugccccagccuccugaguagcuaggauuacaggugcaugccaccgcgcccagcuaauuuuuguauucuuuaguggagacgggguuuugccauguuggccaggcuggucucgaacuccugaccucaggugauccaccugccucagccucccaaagugcugggauuauaggcgugagccaccaugcccagccaacagcauacucuuaacuaaugggucagagaagaaaucacaagcgaaauuagaaaauauaagaugaaaauaaaaaacauaacaaaacucauaggaugcagugaaagcagugcucagagggaaauuuauaccuauaaaugcuugacauuagaaaagaagaaaggucucaaaucaguaaccuaacuuuaugccuuaaggaacgagaaaaagaagagcagauaaagcuagcagaaggaaggaaauaacaaaauacuagaacgagauaaacaaaauagaggguagaggaacaauagagaaaaugaacaaaaucaaaaguugguucuuuaaaaagaucaacaaauugacaagccuuuagcuagauugacuaagaaaauaagacucaaauuacuaaugucagaaaugaaauuugggacauuucuacugaucuuauagaagcaaaaaggguuauaggagaauacuauaagcaauuauaugccaacaaguuaaauaaucuagaugaaauggacagcacacaauugacuuaagaagaaauagaaaacugacccaucagaacagauaacaaaagguugaaucaguaaucaaaaaccucccaacaaagaaaaucucaggaccagguaguuucacaugugaauucuaccagucauuuaaggaaagauuaacaccaauucuucccaaacucuaccaagaaauagaagagggaagacuucugagcucauccaugagaccagcacaaaacaucauuaaguaaagaaaacuauagacagauauucuuuaagaauauagauacaaaaauugucauugagagaguaacaaacuggagccagaagcauacuuagcaggauuauacaccacgaucaagugggauuuaucucaagaaagcaagggugauucaaaauacaaaaaucaaucaauguaauacaccaguagagugaaggaaaaaaauucaccuuaguugauguagaaaaagcauuugaugaaauccagcauucuuucauuauacaaaaaaaauuaaacuacaaauagaaaggaaauuccuuaacuugauaaagggcauuuaugaaaaaacccacaguuaacuucagacuuaauugagaaagacgaaaagccuucccccuaaaauuaggaacaagacuaauaugacugcuuucaccacgauuuaacauuguacugaaaguucuagccagagucaucaggcgagaaaaagaaauaaaaggcaucuaaauugaaaagaaagauguaaagcuauggauaugccucagauauuguggauuaaguuccagaccaccacaauaaagugagucacaugaauuuuuuuguuuccugguacauauaaaaguuaagguuacauuauacuguagucuguuaagugugcaauagcauuagaucuuaaaaaaguauauacuuuaauuuaaaaauacuuuauugcuaaaaaaugccaacaaucaucugagccuucagcaagacauaaucuuuuugcugguggagggucuugccuugauguugauggcugcuaacugaucaggaugaugguugcugaaggcuggagugucuguggcaauuucuuaaaauaagacaacaaggaaguuugccacaucaauugacucuuccuuucaugaaagauuuuucuauagcaaguaaugcuguuuguugaaauauuacccacaguagaacuucuuucaaaguugaagccaauccucucaaacccugccacugcuuuuaucaacgaaguuuacggaauauucuaaauccuuucuugucauuucaacaacuuucauagcaucuucgccaggcguagauuccaucucaaggaaccaguuucuuugcucacccaugaaaagcaacuccucaucucuucaaguuuuaucaugagauugcagcaguuuagucacaucuucaagcuccauuucuaauucuaguucacuugcuauuuccacaacaucugcaauuacuuccuccagugaagucuugaaccccucaaagucauccacgaggguuggaaucaaccucuuccaaauuccuguucauguugauauuuugaucucuuccugugaguccugaauguucuuaauggcaucuaggauggugaauucuuuccagaagguuuucaauuuacuuuacccagacccauccgaagaaucacuaugucagcuauagccuuaugaaauguauuucuuaaauaauaagaguuaaaaguugaaaugacuccuugaucagaauggauguuuuauuagcaggccugaaaacaacuucuucaucuuuuuauacaucuccaccagaacucuuaggugaccaggugcauugucaaugggcaguaacauuuugaaaggaaucuuuuuuucugagcaauaggucucaacagugagcuuaaaauauuccauaaaccaugcuguaaaccgauaugcugucauccgggcuuuguuauuccauuucuagagcacaggcagaguagauuuagcaucauucuuaagggcucuaggauuuuuggaauagucaaugagcacuggcuucaacuuaaagucaccagcugcauuacccccuaacaagagagucagccuguccuuugaaguuuugaagccaggccuuacuuuuccccuguagcuaugaaaguccuagauggcuucuucuucagauauaagucuuuuuuaucuacuuugcacauugaaaaucugugguugaguguagcuacuuucaucaauucucuuagcuagaucuucgggauaaggcguugcagcuucucuaucagcacuuguacuuuuauguuguggagauaaguuauuuucucaaaccucaagaaccaaccucugcuagcuuucagcuuuucuccggcagccuccuucucucucucagacuucaaacaauugaagagaauuagggccuugcucuggauuaggccuugguuuuaaggaauguuguggcugguuugaucuguacagacugccaaaacuuucuccauaugagcaauagggcuguuuugcuuucuuaucauguauguguuuacuggaauaacuuuuaauuuucuucaagaacuuuuccuuucuauucccaacuuggcuaacuuuuuggugcaagaggucuagguuuucaacaugcuuuccucacuaagauuaauuauuucuagcuuuugauuugaagugagagacuugcaacccuucauuucacuugaacacuuacagaucauuguaggguuauuaacugaccuaacuucaauauuguuacaucucaaggaauaaggaggccccaggagagggagagagauggaggaauggcuggucaguggagcaguccgaacaugcacauucauugaguuugcuguauuauauggauccaguuuaugccaucccaagcaauuaaaauagcgugaaccccgaaaaucugagacaggucucagcaaauuuagaaaguuuauuuugccaggguugaggaugcaugacugugacacagccucaggagguccugacgacuugugcccaagguggucagaacacaguuugguuuuauacguuucaggcagacgugagacaucauucaacauauguaagaugaacauuggcucagucuggaaaggcgggacagcucaagcagggaggacuuucagguccuagguagauaagagacaaaugguugcauucuuuugaguuucuaauuagcgucuccaaagguggcaaucagauaugcauuuaucucagugagcagaggggugacuuugaauagaaugagagguagguuugcccuaagcaguucucagcuugacuucucccuuuagcuuaguaauuucagugcccaagauauuuuccuuucacaauaguaacaucaaagaucacugaucacagaucaucauaacagauauaauaauaaugaaaaaguuggaaauacugugagaauuaccaaaauaugacacagaaacaugaaauaagcacacaccguuggaaaaaugacaccaauagacuugcuugauguaggguugccacgaaaguuaaauuugugaaaaaccugcaggaucugcacagugcaauaaagugaagugcaauaaaacaagggaugccuguaucucuauuugcagaugacuugaucuuauauauaggaaauccuaaaagaauccauauacucacauacacacaagagguauuaaacaaauucagcaaaguugcaagauacaagauuaacaacaaaaucaauuauauuucucuuuuucucuguacuguauuagcugaaaaaaaucaauuguauuucuaugcacuaucaauuaacaaucugaaaaagaaauuaagaaaauuaucuuuacaagagcauccaaaaggauaaaauaccuaggaaaaaauuuaaggugaugagagaugaguacugaaaacuauaaaacauugcugaaagaaauuaaagaagacuugaauaaaugaaaagacauccuguguucauggaagagauuuaaucuuguuaaaauggcaauacuuuucaaagcaaucuacagauacaaugcaauuuuugucaaaauuccaauaguguuuuuuauugcuacagaaauggaaaaggagaucuucaaauucauauggauauguaaaaggccccaaauagcuaaaacaauauugaaaacgaggaacaaaguuggaggacuugcacuuucugacuucaaaacuuacuacaaagauauaguaaucaaaacagcaugguacuagcaauaggauagacauauagaccaagggaauagaacugagaaucuagaaauaaauucaaauaucuauggucaauugauuuuuugauaacggggucaagaccauucaauggggaaagaguaguagucucuucaacaaauaguauuuggacaacuugguauucacaugcaaaagacugaaguuugacaccuaccucacaccgugcacaaaaacaaacucaaaaugaaucaacaaccuaaauauaagaacuaaaacuuuuagaagaaaacauagggguaaaucuucaugaccuuggauuugguaauggauucuuacacaugacauuaagaguacagacaacaaaagaaaaaacagacaaauugggcuucauuaaauuaaaacauucaugcaucuaaggacacuaucaagaaggugaaaagaggcugaguaugaugguucaugcuuguaguuucagcacuuugagaggccgaggugggaggauugcuugagcccaguuugaguuuggaccaaccugauggaaccuugucuacaaaaaauacaaaaauuagccaggugugguggcaugugccuauggucccagcuacuugggaggcugaggugugaggaucgcuugagccugggagguugaggcugcagugagccauggucaugccacuacacuccagccuggaugacagagcaagacccuguuuugaaaaaaaaaaaaagugaaaagacaauccauagaaugagagaaaauauuugcaaauuauauaucugauaaagaauugauaucuagaauauauaaagaacuucuacaauucaacaacagcaucaacaaaacaagcaacccaaucuaaaaaugggcaaaagacuuacauagacauuucuccaaaguagauauuacaaauggccaauaagcacaugaaaagauguuugacaucacuagucguuagggaaaugcaaaugaaaaccacaaugagauacaauuucacaccuauuagaauaguuauuauuaaaaaaaacaaaaaauggggccgggugcaguagcucacaccuguaauccuagcacuuuggaaggccgaagcggguggaucaguugagaucaggaguucgagaccagcuuggccaacauggugaaaccucauuucuacugaaaauacaaaaauuagccagguguguuggugggcaccaguaaucccagcuaccuggggggcugaggcaggagaaucacuugaaccugggaggcagagguugcagugagacucagaucaugccacugcacuccagccugggcaacagagcaagacuccaucucaaaaaacaaacaacaacaacaaauggacacuaacaagugucggugaagauguagagaaauuagaacugcauugcuugugggaguguaacaaugguacaacuacuguggaaaacaguuuggcaguuccuaagaaaguuaaacauaguauuccacgaucuggcaauuccacuucuggguauauacccaaaagauuguaaaguggggacucaaacagauacuuguauugugcauacauguucauagccgcauuauucacaauaggcaaaagguggaagcagccuaaaugcccaucaacagaugaauaaacaaaauaugguagaugcauacaaugcuauauuauucaucuuuaaaaaggaauagaauucuauuuuuaaaucagaaaccaacacaugcuagaaauagaauucugcauucuauuccacgugcuacaacauggaaugaaccuuggaaacauuccaugaagugaaaaaagccagacacaaagggacaaauauuguaugguuucacccauaugagauaccuagaauaggcaaauucauaccaucagagaguagacuagagauuaccuaggguugcggggagaggggaaugagaacuuauuguuuauuggguacagaguuuccauuugggaugaugaaauccuucuggaaaugguaguaauaguuguacaauauugugaaugugcuuagugccacugaauuguacaccuuaaaaugguuaaaaaugauaguaucaacaaaauaguuaaaaagaaaauaucaauaaagucaaaguuagaucacagaaaauaauuauaaaauaaagaacuuucuucaugagacgaucaagauaaauagaagcccuaaauuaggaauuaaaaagggaaguacagauacgguagauaucagaagucuaacaauuuuaugccaauaaauuugaaaaccuagcugaaauagauaauuuucuaaaaaaaauuauaaaacugauucucaauaagcaaaaacuugaaauaaacauuauauauccuuuaauggcuauaaagcauugucuuaguuuaaaauuucuacugcccaaaacaaacuaaccuggacuauaugguuuaccugcauggaagguauaauuauaaacauauaaaacuguccaggcgcaguggcucacaccuguaaucccagcacuuugggaggccaaugcgggcagaucacgugagaucaggaguucgagaucagccuggccaacauggugaaacuccaucucuacuaaaaauacaaaaauuagccaggcgugguggcaggugccuguaaucccagcuaccugggaagcugaggcaggagaguugcuugaaccugggaggcggagguugcagugugcugagauugugccacugcacuccagccugggugacagauugagacucugucucaaaaaaaacuauaaaaaaggugaaaagucaaugugauaagucggugugggagaagauauuuguaacacauauaacaggcaaagcauuaggauucaaaauguauaaagaugucuuccugaucaauaagaaaaagacaaaacaauccagcagaaaauuuggcaaaagauuagaaacaggcaauucauaauuuaaacauauaaaaaugcccaacuuuauuaauagagaaaugaaaauuuaaaaauaggauacuauuucauauuugucacauugaugaagucugauagucaaaguguuagcaaagauguagaacaagaggaacauugcugauauuaaaguagauugguucaauaacuucagaaaacaauuugccaauauauagugaaguuaagauguucauauccuacaacgcaguaauuccacuccuagguauauaucugagagauacuuuagacauguguacaauaaaacauacaagaauuguugugagauaucuuaaaaauguaaauuaguucagaucacuuccuuccucaaaauccucugaggcugagauuaaaauucaaaguccucaccaggccuacaaggcaugacaguuugcuugucuaaccaccucugcugcucugcucucucucucucuguucuagccaugcugacuuugcuguuccuugaacagccucuuuuucucccuggggcucuuggacucaccauuucuucacuuccucaaaguguucccccaguuuuuauuuugucucaauuccuggcuucagcgagaccucugucgaccaccuuuucuuucccucccucccuaccucccucccuuccuuccuuucuuucuuccuuccucucugccuccuuucuuucuuuccuuccucccucccuuccuucaucccucucucucucuuuuuccuuccuuccuuccuuccaauacauauuagauguacauauuuugggcuacuugauacauucauauaaucaaaucaggauaauugccuuaaauauuuaucuuuuucuugugcuaggaacauuugaauuauucucuucuaguuaucuugaaaugcacaauagauugauguuaacuauagucacuucacugaucuauugaacauuaggucuuauuucuucucgguguguauuuguaaccauuaaccaaccucucuucauccccugcccuuccuggccucugguaaccacuagucuacucucuaucuucaugagauccacuuuuuuagcucccacauaugagugagaacaugugauauuuguccuucuguguuugguugcuuccaucuuuucuaaaauagcugcuaggacuuccucuucuccuccaaccuggcgagucccuuuaucuucuuuggcugguuuauuuuccuuccugccugacauuauauucuauauacauuuguuccagcauuuauuucugucucuccuacuagacuguaagcuucccgggggcuggacguuuucugccuuacucauuguugcauuucccggugccuaaaaugauguuugcuuguuacagggugggugcucagucacagcucuuccagugaaugaauggauuugcaugauagucaagauaaguccauuuugaugggaaggaaacacuuagaugacacaaagaguacuucuugguaaaaacaaagccauuagaguuguagaugcaugaaaagaauuugaagaagauucguucauaaaguguaaaagaauauucuucagaaacagauugaauauguaugauuaaguuaauagauuaaacauaaguagauaucugaguauuucaucuauauuccuaaaaguuuguauauucauguuggucagaaaacucuugggaccuucccuugggaaaccuuauauucagguugaguugcaguaugcuagagcuuauacagucauucugucugccaggcagucauucccaaguacccagggucagacccagccccagguguagggccacgggguagggaggacagagaaggggaagggaaucaggcacacugagcgugugcugugugccagaaacucugccuggguuucucucucaugugggugacuuaggagcaccccuuccggggcucacgcagggagcaggccagagcucuagggcugugcagcucgaucugacuucuccaacccuugcuaccccuguaguucucggagaucuucuuuguguccaucugcacaucugaguuguccaugaaggucuauguggaccccaucaacuacuggaagaacggcuacaaccugcuggaugugaucauuaucaucguuauguuuuuacccuaugcccuccgccagcucaugggcaaacaguucacuuaccuguauaucgcugauggcaugcagucccugcgcauccucaagcuuaucggcuauagccagggcauccgggugagugcacugggggugucauggugcugggagggcaggccguaggcccauuugcccccaagacacuaaggaaauaaugacucuacuaccaucuuccaguuguugaguccaacguguguggcagguugaucuuuaccaauauuaucucauuuaaucuuaaaacaauucuaagaaugguauuauuagcuccauuuuacagaugaagaaauugaagcccaaggucacccagcggugcaaugucagagcugagauuugaaaggcgugccugacuccagaggccacgucugaacuuuuccucucucucaugcugcaaagugccugauuuucuuaugcuaugcauccuuugaacuacaugcccaggacgccuuggcuuuuugguggcccaggccacuagcugcuuuccccaaacagcugagucugcucucuugcuggaaauagucucugugcuucguuaagguggcucuggaagggcuacuccugcugagaagucuuucuggguugcugaaaaccaugaccaacacucccuugacucagaggcuucagaaagaaccucagggcugccccccugccuugaaucgugcccucaggcacuuguccugugcaccguagguucaccuagcucugcacccaguguccauccuucuccaggugggggcuggucuggguucccguguucagucggggugugucguccuguccugccggaggcugccccucgccugggcuuggguggcuggccgucuagggccuggccccacacucugggagccccaggccuggguagaaaagagaaggggaacguuagaggucuccccugcugcauacacaccuuuguuuguuucuugcugucauguaaacaaacgccugccuguguguguccccucucaaacaacgcaguccagcccucccucuccuucucuucauggcgaaccuucuggggaaaggugucuguacuuccagucccacuucccuguccgucauuuaugcccuagcuguuuucccuacacuccagaauaucuagccucucugaaguugccagcagccuccuugucuccaaauccaguggccaguucccuuggcauccuugucacugcuuucucuugguuuuccuccagccugacuucucaggagcguuuauccuuugccuggcucauacacgcuguuuucucgggauggucccugaguucuccuccucugcucccucugcacauucucucugggugaucuuuuccacuuuccaggacccuccaccugccuaccccucucucuuugaccuuuagacccagcugcccucugggcaucucacaggcuucucaaauuugaugugucuaaacugaaguugucacucacccccauccccaaccucaaaucccaaacccuggcuuccccuccaguauuucuuuuuuuuguuguuuuuuuaaaaauuauucuuuaaguucuaggguacacgugcacaacgugcagguuuguuacauauguauacaugugccauguuggugugcugcacccauuaacuugucauuuacauuagguauaucuccuaauacuaucccuccccgccaccccuccaugacaggccccggugugugauguuccccuuccugggucuaaguguucucauuguucaguucccaccuauaagugagaauaugcaguguuugguuuucuguccuugugauaguuugcugagaaugaucauuuccaucuucauccaugucccuacaaacgacaugaacucauccuuuuuuauggcugcauaguauuccgugguguauaugugccacauuuucuuaauccagccuaucauugaugggcauucggguugguuccaagucuuugcuauugugaauagugccacaauaaacauacaugugcaugugucuuuauagcagcaugauuuauaauccuuuggguauauacccaguaaugggauggcugggucaaaugguauuucuaguuauagauccuugaggaaucgccacacugucuuccacaaugguugaacuaguuuacagucccaccaacaguguaaaaguguuccuauuucuccacauccucuccagcaccuguuguuuccugacuuuuuaauaaucgccauucuaacugguaugagaugguaucucauugugguuuugauuugcauuucucugauggccagugaugaugagcauuuuuucauguaucuguuggcuguguaaaugucuucuuuugagagugucuguucauauccuuugcccacuuuuugaugggguuguuugauuuuuucuuguaaauuuaaguucuuugagauucuggauauuagcccuuugucagauggguagauugcaaaaauuuucucccauucuguagguugccuguucacucugacggugguuucuuuugcugugcagaagcucuuuaguuucauuagaucccauuagucaauuuuggcuuuuguugcccuugcuuuugguguuuuagacaugaaguccuugccaugccuauguccugaaugguauugccuagguuuucuucuaguguuuuuaugguuuuaggucuagcauuuaagucuuuaauccaucuugaauuaauuuuuguauaagguguaaggaagggauccaguuucagcuuucuacauauggcuagccaguuuucccagcaccauuuauuaaauagggaauccuuuccccauugcuuguuuuucucagguuugucaaagaucagaugguuguaguugugugguauuauuucugagggcucuguuuuguuccauuggucuauaucucuguuuugguaccaguaccaugcuguuuugguuacugcagccuuguaguuugaagucagguagcaugaugccuccagcuuuguucuuuuggcuuaggauugucuuggcaaugcgggcucuuuuuugguuccauaugaacuuuaaaguaguuuuuuccaauucucugaagaaagucauugguagcuugauggggauggcauugaaucuauaaauuaccuugggcaguauggccauuuucacgauauugauucuuccuauccaugagcauggaacauucuuccauuuguuuguauccucuuuuauuucacugggcagugguuuguaguucuccuugaagaaguccuucacaucccuuguaaguuggauuucuagguauuuauucucuuugaagcaauugugaaugggaguucacucauuauuuggcucucuguuuguguguuauugguguauaggaaugcuugugauuuuugcacauugauuuuguauccugagacuuugcugaaguugcuuaucagcucaaggagauuuugggcugagacgaugggguuuucuaaauauacaaucaugucaucugcaaacagggacaauuugacuuccucuuuuccuaauugaauacucuguauuucuuucuccugccugauugcccuggccagaacuuccaacacuauguugaauaggaguggugagagagggcaucccugucuugugccaguuuucaaagggaaugcuuccaguuuuugcgcauucaguaugguaucggcuguggauuugucauaaauagcucuuauuauuuugagauacgucccaucaguaccuaauuuauugagaguuuuuagcaugaagggcuguugaauuuugucaaaggccuuuucuacaucuguugagauaaucacgugguuuuugucuuugguucuguuuauaugauggauuacguuuauugauuugcauauguugcgucccauaggaugcagccuugcaucccagggaugaagcccacuugaucaugguggauaagcuuuuugaugugcugcuggauucgguuugccaguauuuuauugaggauuuuugcauugauguucaucagggauauuggucuaaaauucucuuuuuuuguugugucuuugccaggcuuugguaucaggaugauguuggccucauaaaaugaguuagggaggauucccucuuuuucuaucaauuggaauaguuucagaaggaaugguaccagcuccuccuuguaccucugguagaauuuggcugugaauccaucugguccuggaguuuuuuugguugguaggcuauuaauuacugccucaauuucagagccuguuauuggucuauucagggauucaacuucuuccugguuuagucuugggaggguguagguguccaggaauuuauccauuucuucuagauuuucuaguuuauuuguguagagguguucauaguauuaucggaugguaguuuguauuucugugggauugguggugauaaccccuuuaucauuuuuuauugugucuauuugauucuucucucuuuucuucuuuauuagucuugcuaguggucuaucaauuuuguugaucuuuucaaaaaaccagcuccuggauucauugauuuuuuugaaggguuucuuuuugucucucuaucuccuucaguucuuaucugaucuuaguuauuucuugccuucugcuagcuuuugaauguguuugcucuugcuucucuaguuuuuuuaauugugauguuagggugucaauuuuagaucuuuccugcuuucucuugugggcauuuagagcuauaaauuucccuguacacacugcuuuaaaugugucccagagauucugguaugcugugucuuuguucuccuuguuuucaaagaacaucuuuauuucugcauucauuucguuauguagucauucaggagcagguuauguagucauucaggagcagguuguucaguuuccauguaguugagcgguuuugagugaguuucuuaauccugaguucuaguuugauugcacuguggucugagagacaguuuguuauaauuucuguucuuuuacauuugcugaggagugcuuuacuuccaacuguguggucaauuuuggaauaagugcgauguguugcugagaagaauguauauucuguugauuuuugguggagaguucuauagaugucuauuagaucugcuuggcgcagagcugaguucaauuccuggauauccuuguuaacuuucugucucauugaucugucuaauauugacagugggguguuaaauauugacagugggguguuaaagucucccauuauuauugugugggagucuaagucucuuuguaggucucuaaggacuugcuuuaugaaucugggugcuccuguauugggugcauauauauuuaggauaguuagcucuucauguugaauugaucccuuuaccauuauguaauggccuucuuugucucuuuugaucuuuguugguuuaaagucuguuuuaucagagacuaggauugcaaccccugccuuuuuuuguuuuccauuugcuugguagauuuuccuccaucccuuuauuuugagccuaugugugucucugcacgugagaugggucuccugaauacagcacacugaugggucuugacucuuuauccaauuugccagucugugucuuuuaauuggagcauugagcccauuuacauuuaagguuaauauuguuaugugugaauuugauccugucauuaugauguuagcugguuauuuugcucguuaguugaugcaguuucuuccuagccuugauggucuuuacaauuuggcauguuuuugcaguggcuguuacugguuguuccuuuccauguuuagugcuuccuucaggagcucuuuuaggggaggccugguggugacaaaaucucucagcauuugcuugucuguaaaguauuuuauuucuccuucacuuaugaagcuuaguuuggcuggauaugaaauucuggguugaaaauucuuuucuuucagaauguugaauauuggcccccacucucuucuggcuuguagaauuucugccgagagaucagcuguuagucugaugggcuucccuuuguggguaacccgaccuuucucucuggcugcccuuaacauuuuuuccuucauuucaacuuuggugaaucugacaauuaugagucuuggaguugcucuucucgaggaguaucuuugugguguucucuguauuuccugaauuugaguguuggccugccuugcuagguuggggaaguuccccuggauaauauccugcagaguguuuuccaacuugguuccauucucccugucacuuucagguacaccaaucagacauagguuuggucuuuucacauagucccauauuucuuggaggcuuuguucguuuuacucuuuuuucucuaaacuucucgcuucauuucauucauuugaucuucaaucacugauacccuuucuuccaguugauugaaucggcuacugaagcuugugcaugcaucgcguaguucucguaccaugguuuucagcuccgucaggucauuuaaggccuucucuacacugguuauucuaguuagccauuugucuaaucuuuuuucaagguuuuuagcuucuuugugauggguucgaacauccuccuuuagcuuggagaaguuugaucgucugaagccuucuucucucaacucaucaaagucauucuccauccagcuuuguuccauugcuggugaggagcugcguuccuuuggagggggacaggugcucugauuuuuagaauuuucaguuuuucugcucugguuucuccccaucuuugugguuuuaucuaccuuuggucuuugaugauggugacuuacagaugggguuuugguguggauguccuuucuguuuguuaguuuuccuucuaacagucaggacccucagcugcagaucuguuggaguuugcuggagguccacuccagacccuguuugccuggguaucagcaguggaggcugcaaaacagcgaauauugcauaacagcaaagguugcugccugauuguuucucuggaagcuucaucucagaggggcacccggccaugugaggugucagucugccccuacuugggggugcuucccaguuaggcuacucggggaucagggacccacuugaggaggcagucuguccauucugagaucucaaacuccgugcugggagaaccacugcucucuucaaagcugucagacagggaaauuuaagucugcagaaguuucugcugccuuuuguucagcuaugcccugcccucagagguggagucuacagaggcaggcaggccuccuugagcugcugugggcuccacucaguuugagcuucccagccgcuuuguuuaccuacucaagccucagcaauggcaggcgcccaucccgcagccucgcugcugccuugcaguucaaucucagacugcugugcuagcaauaagcaagucuccgugagcaugggacccucuuagccaggugcgggauauuaaucuccuggugugccauuugcuaagacuguuggaaaagugcaguauuaggugggagugacccgauuuuccaggcgccgucugucacagcuucccuuggcuagcaaagggaauuuccugauuccuugugcuuccugggugaggcgaugccucgcccugcuucggcucucacucagugggcuccacccacuguccugcacccgcuguccgacaagccccagugagaugaacucaguaccucaguuggaaaugcagaaauuacccaucuucugcgucacucacacugggagcuauagacuggaguuguucuuauucagccaucaucuccuccaguauuucgucuuuugguaaagaggggucccccacccgcauucaguugccaagucauaaauuugacugucagcuuagacuccucucucaagcuuuguuguguggccuccucagugguuauugacuuguccacaucucuucauuccugucaccaucagccucaccuggauuccugcauuggcgucccacacuacugggagcccuggaacagaaaugcccgugugggguggggaggaucuugaaagugcacauccaaucauagcauccuagguuucaagccugaggguggcuccccauuuucaggcuacagacagaccuugcaguguguccuaagaggaagggaguauguaaggugcugggcacuggagucagcagggaugagaggaaggcagguggacgggaaagaagacuggaggcccgagguguucauggucagaugggcaccccagagugagggcgggaucuggcagugggaaguguaaucugguuuuuccagguguugggcaccaagggagcaggggccaggaguggcaccagggucacuagagagggaaguccaggggugaagaggccuggcaucuuccauaaagauguggaagguccccaggcugacagcaggguugccuggagaaggagguacugagucuggaggcagagacuucaagacaugagggagagggggaagcuggaagguuggcccugcccaaaagcagggucugugccugugaaaacaggggaucccaggauaagguagaugguggcccccugaaucugagggcugucggggauaggcagccuucuuggagaggggaacuggguugugauguccucugcugagagaggacuuucaggugaggccaggagagaggaacuguggaaugagggugccagagaccagugggaaucaugcgaggaacagggcggagggcagggggcugaggaaaaggagacccaggaccacacagggaggagggaagcaaaaaggacugguggcagggagggcuuccaucuuggaagaaaggggcauugacccagacuggcaccucaaggcugggggcacuugcugcuggcuuagugcaccgucuuggcuguauuguggcagccugauuagaaggcaaaggcuccugcuggccaagggcuguaucccagagcaagccggccugcuuggggacugcucagccuuuggcccuugcaggcaugcacagagacccugggcaugcagaggcaacaggcacacacgcaugcaccacagguuuggccucaugguuuuucugucauuaagcagggccuugcauccuagagugauucccuggggaucaccagccacccugagcuguggcucuccuguagccuugggaugucaugggacccuagauccccagaggcacagaagugacccuggauaacaugcccucugaauguuggcuggccugcuggccauggggagcuggaccugcccauggucgggacuuguaccucugggcuaauuucuauuaauugaagucuaaaggaauccuuaaauaaagagcuacaaucucagagcccagagauggcgcucuggcgcauucuuggcuccugaccccugauuaauuaaaaugacacucugccuucuaccuaugacaaugaaccugcaccaugaggaaaugcuguuuugcacagagaugcacaaauguucaucagcauuucagccggaagcaaccuucagaugcugggcugugaugugagcauuagucccccuuccucccugccuccuccuccuggggccagaucaucuuccacacauccaaugggcuguguaggaggggucccuccaagcacugggccugggcaccugccuugccuggagcuccuuuccacauccagaaugccccagggcuguggcuugauccagagcccgggagagcugaacuggguacagggaauugcccccccaaaagaauuugggaauucaaaaucacacauccaaugggggccagaccaugggccucaaaacuuagaacuuccucaggagggagcuacuggccuaaggggaacugggcaacccucuccuaggacuggauuuccgcaccuuucuggacugcacccuaagagggccugcguggauugugcuuaaagaacuuggccaacucuagcugucauggguccuuuauggggcucccaggagagcgugucuguuccuccacugcugcucuaaagguugcucagcuuggaccucagguggcaccagcuugugggcuggccuggaggugggaggcccaaccaggccucuccgcaacccuucugcacaggcuuuggauucuaccacccaguguuccucccuucccacucaaaaccugaucugcagaccauaucucaucacagcuuuucucaugaggauuuacugcuuucaucuuaguccuugggaaagaaguucugccucuguuuaguugggaggaaggcauuaagaaaaaaaaaauaucggcugggcgccguggcucacaccuguaaucccagcacuuugggaggccaagguggguggaucacgaggucgggagaucgagaccauccuggcuaacacgugaaaccucaucucuacuaaaaauacaaaaaaaaauuagccgggcgcaguggcgggcaccuguagucccagcuacuugggaggcugaggcaggagaauggcaugaacccgggaggcagagcuugcagugagccgagauugcgccacugcacuccagccugggugacagagcgacuccgucucgaaaaaaaaaaaaaauaauaauaauaauaauaauaaaaucucagcuguuuugcaauuaauccaaaaacauuuauuuucuuuucccaaggagagaugggaggcaucuggugugcauucaccccugcaggcagcgccaaaccguuccgcauggagggcagcccagggcucuuggacugccucuguuucccagguuaccccaaacuguccaaacuguacugccuuguuucuuagcucuaaggaccuccuuuccuaguacuaagccaguaaacagucucugugcucagggucauuagugguugaaggugguggcauggggcaaaggcuuugagaguuggucccagcucugccauuguauuggagugugacccuggccaagacaauuugcuucuuugagccucugacggcucauuuugaagugggaagaaugauaacaccuaccuaccuugagguuaugucugugaaacgucuagguaggugaacaugcauugagugacuacugcaugcaagacuccagagcaggaagaaugaaugauaaggagucauacacggugcuccccagaaaugggcaauguagcggggagauaagacaaaugcccacuucauacggggcaagacugagguuacaagacagggaccuaccugugaagacggggucgacaaggaccagggagccacauuccucucggccuucuguauacucacucccagagucguuccccuacuccuccugggcccggggcagagagcauucagggcuggcccucagcugagaagcaaaagcaggacgcccugagaugaccacacagccagguugggguucaaguggaguggucaccucagaccugagagaauugacugaggguggaugucagacacugguaaagcacuguuaaauugauccagcccucaaucugggcacaguucugauucacuucauuaauucguuaguuuauucaaccaaccaaccaacccacccacccacccuuauugagcaucuaccuugugccaggcauggcaacaguugcuggggacagcugugaacugggcagaauggaccucugucccuggagcccacccagcuuggugguacccucgccuaccacagugucccugccuugcagacgcugaucaccgccguggggcagacagucuacaccguggccucugugcuccuccugcucuuccuccucauguacaucuucgcuaucuugggcuucugccuguuuggaucuccagacaauggugaccaugauaacugggggaaccuggcugcagcuuuuuucacccucuucagcuuggccacgguacuguguuugggaacaguggugagggcaggggccuuaggaagggacagccuagguggugcaagcguguggacauguggggccucacauggggcuuuccucauguccagguacucaucugggccuagggaagcuggggucuguuccccaucacaagccagcacccugcacggggcuccaucgcugucucuaggccugugauuccuuauagugcuuccacaugucucacagggugaucaaacuuugcagaguccucaaaugauaauucauuuggauuaaguuuaauuuauaaaugaaacccaugucauauagccuuuggggaauuggcugucacaaauccaccuagaagaagcaugcaaaacccaaaucuagaaaucuagauucuguuggacucuggaaagaguggggucuuuuuaaaggugggccuggcagagaggcagugucuuucugggaagguugggaggccuugagaaaagagaccucgaggcauguuggucaauagcauccccacccaggggugcucugcauucccaggccaucacguaugugcuggagccaguggacugggagguguugaggggaugacguggaagcggagccacccuucuccucagugggccugggacuccucuagcauaggugaaaaggaggccugugccacugggucugggcccucagcauacucuucccugccugagcagguugauggcuggacagaccugcagaagcaguuggacaaucgggaauuugcuuugagccgggcauucaccaucaucuucaucuugcucgccucuuucaucuuccucaacauguucgugggugugaugaucaugcacacagaggugaggccacaccugugaggaucggaggucagggcagguguggcagauggagcuguagggcaagucuccagggaggaccuggagcuguguagcugugucuucccaaugaaguggaguagagguggccagauggaccugucccucacccggcccaacucuccucccugagccagugcauuugccuugccugcugaugguggucaacaggacgguggggcuuaagaagccucugcagcuacaguuggcagcuugaguggcggcuggcccuguguggggaaaagugcuccugcugagggccugagcagcggugcaagacuggggaagaggaaagacugggucugggcauguagcgagagccuguaguugaccuccaucgucugacucucuaggacuccaucagaaaguuugagcgagagcugauguuggagcagcaggagaugcucaugggagagaagcaggugauucugcagcggcagcaggaggagaucagcaggcugaugcacauacaggugaguggccccugcaggcagguggacagauggguggauggaucgucaggcugaugagauggccaggaggaggggccguggugccuguguagagagcagguggccucaggcaucugcagccuuagguaagacagcugccuuccuccaauguuuuauagaaucagccuuuauucucggcauuuuuguguuucucuggaccucucggaguguugaguacugugauuauaaugucucccucuguugugggcagaacuccacugcugggcccuuuggggccaggcaaucugugcugaggcuucuucuuggggacucacuggaugccaggcagccauggccccaggccacugaguggacgaggaugcagaggcucugacagagugccagacaaccuugguucucucacauuccuaaacccagaacaagaaugggcaaaccaggcuggagauuuucugucaagcaugaugcaaccaugagggacccgggugaauuuucccccugagccugagugcucuaagccucccaugcugagcuuugggugcucugcugggccucccucccuuggugggugugucucuccuuguccucuucucugggguggagacaugugccugucuucaccgugcccaagguucguccaggguugggagagccugcgcugagccucaguuggacuucaugugcugccuguccucaaugguggccgccucaccccggaguccagguucagaaggggucaggaugaaguugugacaaggcugaagcuuccuuccaggaccagggucaggccgcugccuggggcccauccuggagagucuccaugucucugugcagcucggcugucaccuccucaucacugcucucucguuaugcuuuccucucuagaaaaaugcugacugcacaaguuucagugagcugguggagaacuuuaagaagaccuugagccacacugacccaauggucuuggaugauuuuggcacuagcuuacccuucaucgauaucuacuuuuccacucuggacuaccaggacacaacuguccacaagucaguuccagccccagccuucccuggucccuagggcuuccucgagguugggcugugucaggugcccugggagagugaagggggugaugacugaagugcugaugggcaguggguggguggaacauggcuuucuugggguuacaggauuccauauauacacaggggcugggcugcuguguggacgggccauggcuggggggaaucugccccuccugccccuccccaacccaccuugacuuguauguaaaugccagcuccuugaagucuccaggccucuccucacuaaccccuuuucagagugcagaggaaagaccacuggguagccucagcuucuggccugguugugccacuaccuuccuguguggccuugggcaauucucugccccuuucccaucugucacaugaggggcuacugggcugauucaaugaaaacaguauaugugaagcucugaguguggccuggcccagggcuugugcucagugugagucagcugggauuaugagcagccauuacugagcaggaaggauguaaaaaccuggcugugggcaucaggagcuacggugggcugugggcacuagggagcuacaguggacucuucagugaggacagauauaauuagccuggcuucucaaugaaagcugcuuggagggcuuuagagaugggagaaaccaaaaaggaaggcauuguuggggaaugcccacuuuuggcccagcaggggucagucacucucugggcaccuccacacaguuacuucucucaggaccuaagaauuuauuuccaccugacacaugaaguaaaauacuuugcuccagggggccccaggcagaguggcagauccaagauuccaacccagccucaucuggcucugaaguccuugcucuucuuugacccuacaccugugcaggugcaaacguguggucaguggggccaggggguccuggagccugccucugaccucagaucuuaucuccuccugcuccauuuuucaggcuucaagagcuguacuaugagaucgugcaugugcugagccuaaugcuggaagacuugccccaggagaagccccaguccuuggaaaagguggaugagaaguagcugggcauggggcacccaugugccgagagccuugcagaccaugacaggucccuauuaaacacaggcuuucugaguuguccucuc

SEQ ID NO: 192427 - RNA, 21013 nt, Homo sapiens
ugccaaggacagcgaaguuucauuuauuugugcaaauacaggcaugagcaagaauguucuaaacaauguaacgauuuccagcauugauuacagaauuuccucugaucauuugauuugguuauagaugaauuuaaacuucaauuuaagcuugacuuuuaaaacucccccucugcuuccugaugaaccagcauaauuccuaaaauuacaccuaaacaagucugucuugacacauugggguuugccuuuagaaacauuuagaaucuaguaugggcaaggcggcuggaacgagguuugggauggcacaaugauuuaugcuuaguucuguuuggaccacugauacaaaaucauugucauuucauuuuuaggguuuccauaauuguagcaauuaucucugaaacauuuuuguccacacuuauuuggauaaaguuuucuggagcugcugggggcuccagagucucaaacugggacugcaauaauucagggggcauaaaaugucccucucuuuugaguaagcguccagagaugaccucaaacgacccgcucagauggaccaccaggagcugcaucucagccugcuuugcuuccuuucccgacuccucacacuucagagcuacaccaucuuuuccuuguguuaauaugucucuguacguuuucuucagggcugaacaggcuagaaccacacgcugucccgaggcuacaucucuguuuagaaaaagaaaaaaaaaagagggaggcuaaagaaggaggacauuuaaaguaaccucugucaauucuaguugcaggacucuaguccuacuuccugccaguggaaggcauuagaaaaugguguuuaagcaucaggcaguccuagcaucgaguuaaauaucuucugcuaguaaagugaacaaucuugggccaaggcauuuaccucucugagcgucaguucaucaucuguuaaguggggcuaccuaggguacuugcccauagaucugucaaaaggaaaacacuguuugagaucucugauacacagauaugcucaguaaguguuaguucugcuuugauggaugucagacguugcucugucgcaguguguggacacagggcugccggcaugccccugugccaugcaaacagccaagcucagguccucugcaggauguucagggaucugcauucuacaacuggauucuccccauuccuacucuacagugucugggggaguugccaggugcaaugcagagcuggagaaagcgggagagaagggagcaucagccucucugugggcaaggugagcagcauaugagagguuccuagggaugcacuaaggaaaaaacuccagccagaaacagaggcagacacagcagcaauaaggggaaaccagugcggccagagaccacacaggagagugagccacagcuuccacuuggcugcugagugugggaggcagucauccuggggucaggacaggauucuagaguuaagagguggugcauaaauucuggcuuggggcuggcuuggggauccaguauaaaguucucuucagaaugaaaguucugaaggaaggggccuccccugcuuuuuuuuuuuuuuugcagccaauacauggcuagcaaauauaaaaaugaagccauacuccuuuuuaugacuaugaaaugauaguacuguaaaaauagacucucaugaguauauuauauuagaaacccagguaggcaaaaauuuucaaaccuugaaacccagaaccauaaaccccuaaaucaaaacucagcccaugcaaagacagggcugccagccaugucaacgggugugaaaaaagcaaacugaauuuauguucauuuaaguauauuauaacuucguauggccuagaugguuuuagauggauaaaauaugacuucaucuuagaaagcaagauccguaacccacucccugccuuuuccuuauccuucuccacgucccgaccaggauuuccacuggggucaugggugcuguuggggggggacccuguucgcucaggggcaugcugcagagcugggcaauguggacucuaauccugguggcuaauuaccuguucacucacaaaugaccucaggccuuccugguagucacagcuugaaguaaagggaagaaaaauugacugagauaggcaauaacagaaguggcaucaguggacacuuuuugagcacuuacuauguaucagauauuguucuguugcccacucaccaacucacuuauuccuuacaaaaaucugugaguaggaacuauauuaauucccauuuuacugaugaagaaacagacuuauggaaaccaaguagcugaucaagacugcuagcuaguaacuguguggagcugucuagaagguuugucuccagagcccgacuaaacuccaugcugccuguggcugguugaaaucauugugguuaccugauagaagugcagccaguuucuagaauccuuuaccaucagucaguugugauuucaggaguguauuuuuuuucccugucuuuucugaggguuuucuuuaccugcuggcuuuggcuuaugccaaggccugguggucucuuaccuuaguaaaaugucaugcaaguuacagagccauggaauccgguccugaaaaaaacaaaaacaaaaacccagacacaacgugacuucuccagguauuguuuguuuguagagaaacaguuauaucauguucacaaauguuaagguccagcgagagcucaguggugugaggagugggccaugcacaaggcugaggggccagcugcugggcagaaacauuuucuuucagcuggugucaguggcucuuuucauaauaauaaaaauugcccuaaaguaccaguauguaucuccccauauuaaucuccccauuuuacacguguccucccugguucugauacguuuacaaaucuuuuauuguacugccuguauucuuuagguaucucugaucucaaauguagagagauauucacauaaacccuuacgucagcuguccccugguccuauucuucaaacccuccaaagaacaaaauuccccucagauaaaauuauuuuaagaaauuuauauuuuugccaaagagaagacagaugaaauuuacguagcacgugcuacaguguuucacaaagaaauccuccugagacaaguaaauucucuccuuccuggcgcaaauccugauuauuggccauaaugcauuggaaaacaaaacaaaaaaaacuuucuauuauugaaaaauuuaaacacacugaaaagcagacaaaauaguacaaagcaaaccucuguauaccaauacccagcuucagcaauuuucuuuugagauggaguuucacucuuguugcccaggcuggagugcaauggcacgaucucggcucaccgcaaccucugccuucuggguucaagcgauucuccugccucagccuccugaguagcugggauuacaggcaugcaccaccaugcccgacuaauuaauuuuguauuuuuaguagagaugggguuucuccauguuggucaggcuggucucgaacuccugaccucaggugauccgccugccuuggccucccaaaguucugggauuacaggugugagccaccgcacccggcuggcuucagcuauuuucaacccacuauuagucuuguuauacguaugcccccaaccacaucccacaucccaaauaaucccauccuagguuauuuugaagcugauuccagaaacaugauguguuuuuaaaaguccuugcuuuuaggcauuugauuacuaccguuuuauuuagaauuuuugauuuuauauacuugagaugggccuauauuuuaaaaauaugguccauauuaaaugucgguaucagggcuuuacuagcuuuauaaaaugaguaggauaguuuucccuuuuguccuguucuuucaaacagcuuguauauaauauauuauguuugauaaaacucaucugaaaaaccuucugggccuggggccuuuuuugaggggagaucuuucauuacagauucaauuucuuuaaugagcauuguauuguauucagguuuucuauuccugauucacuuuugguagcuacaacauuuaugauggcaggaagagaccacacuuagacaggugagccaccaucccugcccuucccaucucuuacugcauccucuuacuuggcuaaagaaucaggaacuugguggaagccaggcagccacacagcaggagcagauucagcucauuucagcccagcuuccaggccuccagaaccuugaacacaguucguaucuguagguuacacuugcuguacaagauagucacuuuuuaucaccuuugucauuacuucaaaggaguaacauaaacaauccaugcccuuacuauaaauuauacagcucucuggaccuucugcugcuuaagccaaaugcagcaccagaauagucacaauuucacuggggaaaaagcaggugucccuaagcaguaucugccacuagaucacugccauccaaccccauuuuccccagucuugauauuuuucacugaaauuauccaguuuugucuaagucuucaaauuuacuggcaucagguuuuccaccucccucuuuucauuauucaucucaauugugcugcuuucuucuugaugagucucaccagagaucuauuuuuauuuugucaaacaacuagcuuuuguucauaguuuauuuuuucccaugacacagcccucaggagauccugagaacaugugcccaguuuguuuucacuagcauucauuucuguuauuuccugcauuuauuuuuuucuacuugaacugagcaacuagcucguuacuuuucauucuuguuauuucccaaaaauguauuuagaggcuaguuucccucuaaguaauguuguaacugcaucccacaaauuuuaauugauaguacuuuuguuguauauuacuuaauauucuguaauuuccauugugacuuuuaacauaaauuauuuauaugaauguuaauuuuuuaaaaaauuugcuuauuuauuuuuagaguucccaaccauuuuggugaugugugugcauuuuuauuauugauuuacaguucauuauaguaaaaaaugugagugguaugauacugauucuuugaaauuuguggcaauacucuuuguggucuaguacaugucaauuuuuauaaaugucccacauguacuuaaaaagaauauuauuuuucauuaaugccuaugucaggcuugaugcauuuauucaaaucuucuauauucuuacuaauaauuucuuuugucuacuuuauguaucaauuuuucaaguuauuugaaauuccauuagacugagaaguugacaguccacccuucugucuuuguguauguuagaaaaugucuuuauuuugugcuuacuugugaauaagauuuuuuuaguuggugaagaauucuugguugaccauuauuuuucaauaguuugaauaauuauuucauuuuguuugggccuuuauuguugagaagucucuuuuaguguauuagucaauccuuuagaaaauauaucuuaucucugguagcuuuauguaggaaaaagccucuuugucuuugagcggcuuugcaguuuuauucuugcccugcucaggacuuauuuugcauauucagugugaguacucauacccuggaaaaguuguuacuaccuauuugaauauagccuuucuccuauucuauuuacuuggguuccuuguagcuauccaggaaguuugacauuuuaucauacacaucuauucauuuuucuugaauauuuucuguuuagcucucuucuucauccuggguaauauccuccaaucugcuuuucuucuaauucacuaguucucucuucagcuguacuaguuuauuguuuaauccaucuauugauuguuuuauuucuaauauuuuuauuucauucuuuuucaaauuuuccuauucuugucuuccauuugauucuauuaugucuaguucuuggagaacaacaucuuaccauuaguguuuuugcugauucucucucauagugguccauuuucccauauaguuuauaguuucugauuguaguuucaucuucagcaaaggauuuuuuuuuuuccuuugugggaguccuaaguuuuggaaacacuuucacgggcaguuucaccaauucuagaacaguuuuaugucaguuuauaagcuuggugccucuuugucauauagugugaauuuggguguagccggagcucagguuucucaaggaugauuguuuuuucccaccuguggcccagggaggcagcuagauuuuuugcuccuuuugaguucaguggguggcaauauuuuuaguccucauucaaagacagcccuuauaugaggacuuuauauucuacaacuugacaucaaugcuaacaacaacaacaagacuuuauguaagauacucagguccagcuccaugcuucauacaggcuuacaaucuuaucucccaucucuauaggcucaucaaaaccucagccuccugcucuccuggcuuuuauacagucaaaaaaugugggggaguggguuauucugguuuaguucagccuugccacacuuugauuuuggcacaugagauguucucguuuugcuuuggacuuuggccauuuuuauuuuccuuugaucuuuuccaugaggagccuuuuaagcucuccagcucuggguaaccaccuuuagcuccuggguaucuccccugggcucaggccauuucuuauucacaguaauuuaucuucaguaagugcaaggucauucuaccaaggcuaucacuuugugcucagcaagucaaaaacccucuaguuaccuggauccacucuccauagaaggaagaggagaauuagaaauaauauuucuuuuucuucauaucaaauacaagauuauuuuuaaagcacugcgugcuaauguaggauugagggucccguaaguuuacuaaucauagaacucuuaagacuuuacuuccaugcacacacuauuuaaccagagaucacuuaggaguucaaauguaauagcuacaaaaaucacaaaauguacagaucaaaugaugacagucacacaguuuacacaaauuauaaucuaaaugucaauagcuacauaauuaacauaaaucauuacucaaaucacaacaguuacugucauguauguacuuagagcugaaauguacuuaacaaaugaaacaucuguuuauguuagcacuugucugggagguguauguagugaaacaagugugguuuuuuguaaaugcaguaacaagaugaugaggcuuaccagcuccauauuugcagaccacauggucaauuuuuauaaaugucccacauauacuugaaaauaauaugguuauuuacuuuucauuaaugccuaugucagacuuaaugcauuuauucaaaucuucuguauccuuacucauaauuucuuuugucugcuugcuguauaaauuuucaagaaagguuuuugaaauuucuccauuagacugagaaguugacagucugcccuucugucuuugugugugucagaaaaugucuuucuuuugugguuaauaaaacacaaaauaaaguuauuaauguuagaauauaugaggagacuuuaugugcucuuggagaagaguguauauauuuaaugcuuauuauuggcaagguuuucuaggacauccuacuaaaaaacuagauguucuggacacucugugaagagaaaaaaaguugggcagucuacauuuaugcaacuugaaacuaccauugcaauucaguguuuucugggcuuaugguggggaauggggaagaaggaugucaaggauuauaggcuacagggacaauuagcuggauugacugaccucugaaguauuuuuugauggaaaauugccccuggggagaagcugcccuuucaagcacaaauuuggauuuccacuuuccuuuauccauuuauaagugcugauuguguguguagggagacccagccacuguuguaggugcuuuugguccaauacccuagauaugaucauucuaaguuugaguaauuccuaagguaccauuugaacucaucuuucuaaauuccuuucuuucucuuauuccccuuguaauuagccaagcuuuucuacuacauucacaggcuaauggagaugaaaaagauaauacugcuauaugucagcuuuuuauaaaaaaacccucuuggauauauuuucuaaaacagcuccucuaacagacaguuguaaugaaagaaggcacugggccuugaagccucccacauuagcaggagguucuacuucccacucugggauucaguccuauaaaaauguggcauguacuggcccgcguagaauaagcauuuaggggacugauuucuaaccccagaguauguuuuacaugaaaauggaggcaucugccuucaaaucauagaaauuaugucaacuucuacaaagcuaugagucaaaggauuuaucuuugagaaaaugaggaccacagcgaggugcuuuccuaaggacuuggaaaagaaggaaauaagauuguucucuaaggguuaaauuuaaagaucaacaguuaaaaggaaggggcagcgauguguaaggucaugcgaaggaguuagaaugacucccaggcuagcaaggcaucacugugauccaucuuaauauuuucacauaccuagaggaagcaugucugucccaggcaggcuggguaggcaagaaggccagagcagggcacuguagauugaaaugugaagcacuguccagcggacauggugccuuggccauuggccuuugaacaucguauucucauuagcaagccuuuuccuacuaaugcauggucucgcgccaccagauucuuugguccuaacucucccauguucacuaagaaaccucuguauguugguuucugaaaauguggguacuaaugugauuguuacaggccacgugacaguuguauuucuuuugguacauugaucaacuggcauuuugguuuaugcaggaacuuguaaaccugauugguaggggucucacaugacagaugaauccauguucaguguguugacaauaucaagggggcugggccugcaagacagagagccagcccuggagucccagcuggguagucaaccagccuuuuccaaggugcaccccuugucauuguagaagucucuggaugggacuuuuaaggcuuuauuuaagacuagugccgugggcugcgaaucuccauucagcaagaagaaugcuuuagaagaggaagugauuggaaaguucugagggcugaaugcuaauuuacaugaucacauaucuacuuagaguuaaggggcaauucgaacuaugaauuaggacugacucagagaugaaauacacagaaaaaaauuaauuucuuuuuggcacgaguaaauguucauaaugaguuuggggugaaccaaagagagaggacaauuuguuuaaauaccagaauuucuuucuuauuagcagaggcacaaacuugcauuuugcuauuuugcucagauuguacauuccgccauuccaucugcacaaauauuucuauuugcuugugcuguggaaauggagaucaaucucuguauuauuuuauggcuuaggaaacaaauauacuuuucauuaagcugaguguugacuaucuuauucauuauacuuucuaugugccugaaauauuucauaagaaugaaacaaacaaaaauuacagaaaacauauuuggguaauaaguuuucuaucuuguguacaaagaaauagagcuuuacuuugaauacauguuuuuucauuguuuuaauagugccuuaauggaugcuuuagucaauaauaaagcacacugcuucaucuagucauaauaaagcuuuucagaaucucaacuaugaaagccauaauaaacauaaauauaaaacuauuuaaacaaaaauaggugcuuuuagacauccaccuuaucggaauuuauggcagaccagauuaaugaccaugcaccaguaaggacuguguccaucagucauaaaaacaauagagaggguuggaaauaaaagagcagcacuuugaacauuauuccugaaauuuccaaauagugaaucauaauuaaaugauuaugaauuuucuuuggagauucccauaaagccacaaggagaaagguuuuuuccaaggcagcgccaguguagaaauucaaguucuagugccugaccugcuuuaagccaggcuaccaugucagugccgucaugaccacccuuuaagucagugccucagacaucuuuaaggccuaaccccuaccauggaugugcuuguggggaacugccccucucauuccugcugucauucucacccucugucuaacccuuuucucucaauuuaacaaaccuugauucacuucuugugaaucauuuguuuaaugguuggaugaucagggccuuuaacacaguaggagaaguaugaucuuugaaguuagaaagacucccuuugcuguguggcuuugcucaaguuacuuaauuucucugcaccucucuuuguucauuuguaaaguggggaucguauauaauucauugagcugcucugggauuuaaauaagaaaaggaauaaacuauuuuuugguugauuuaacaguugaaauaaacaguacuuauuuccaacucugaauuuuugaaagaguuuaaauucaugaauuugguaggcacugggccuuaauuccacaaacauuaaauguggugcaaagcaccauacugagugagcacuggggauaaauaugaauggugugguuccuguccucaaagagaagaggcaaaugaguaaucuauuaagucaccugcagggcagugaugagggcugugggagauauacuaagaagggcuaugauaacacagcaggaggacaggccaaucuucuuuuauuuuuuuauuuuugagauguagucuugcucugucacccaggcuggagugcaguggugugaucuuggcucacugcaagcuccaccuccuggguucacgccauucucccgccucagccucccgaguagcugggacuacaggcgccugccaccacgcccggcuaauuuuguguauuuuuaguagagacgggauuucaccguguuagccaggauggucucgaucuccugaccuugugaucugcccgccucggccucccaaagugcugggauuacaggcgugagccacugcgccuggaggacaggccaaucuugaucaggccuuggaaagaguaaaucuuaaaagauaaagauaauuucaagaccuugacuggccugcuaaggaguguggaccuuauuguaaaggugcuaggaaggaccuagacacaugagcuccaaauuuuauguucauaaugaagaaaggggggaauugagaucucucuacagugaagaaauuggaagaaggagauauuagagcaaauucacugagcucuaugccuuccagacaguuacuguggacaauauaauaaguuaugaaaaucaaacacacagaaguuuuagaggaaagaaaugagacaauccaaauuagcaucucugccuauggcucugauguucaagguuuucacacuccagaucaagcuuguacaacacacagcccgcaaacccuacugcggcuuugaauguggcccaacauaaauuuguaaacuuccuuaaaacaugagauuuuuuuugugauuuuuuuuuuuuuuuuuuuuuuuuuugcucaucagcuaucguuaauguuaguguauuuuauguguggcccaagacaauucuucuuccaguguggcccagggaagccaaacgacuggacaccccugcucuagauagucccuacacgcaaagauggggaaggcagugcacucccgacucccagcccagugcucggaggugagcacaaugaaugcucuacgaagagugaaaucagaaugucaugaggcuagagaaagcuuucuuggccuauggaaacaucuugagaaauuaaaugucuuuuggaaggggaugauggguaaagagagaacagauaaugguagaauauggguggagagagacgggaaggaagauggggagugggaauggcggggagauggguguguuuuaccugaugcaaaaguuaaguauauagaauguuauauacugacccccuccaugaaaaagaagaauuccaaaauucaauucauagauauuuuuggaagaugagaccaagggugauauauuuugugaaaaaauuuuuuaguacuuuccaaauuuucuauacagggcaaauauuacaauuauaaucaggagauuuuuuucaggauuuuuuuuuucccaaaaaaagcccucuuuuuacaauagacuuugaaguugaagacuauucaggugccccugcaggcucagauaggacacugugggcugggcaccuaggggagacucacugacugguggcuuugaaauucuuuauuauuaauuucaucauaacgcuaauaauuuaucacagcuuggguagaauguuucuagacuggcacuguccaacacagcuuucugcaaugauguucuauagcugugcuguccaguaagguagccaguagccacucauggcuacugagcuuuugacauguggcugguauaacccagggacuagauuuuacauuuuaucuauuuuaauuaauuuguauauauuuuuuucagacagggucucacucugucccccaggcuagagugcaguagugcagucacagcucacuguacccucgaacuccugggcuuaggccauccucccaccuuagccucccgaguagcugggacuacaggcaugcaccaccagccuuuuuuuuuuuuuuuuuuucaguuuuuguagaggcagggacuugcuauguugcccaggcaggucucaagcuccuggucuucagccucucccuccuggggcgcugggauuauaggcuugagccacugagccuggccuaauuuacauuuaaauagccuuagggagcccuuaacauguucuacacagacugcagcucugagcccuccgaacacaaaacucuccccacguccucccuagacucuuccucaagggagaaccagggccucugacuuggacacggacacgcuuuaauccauucacagggggcuuuccucagcucuguagcaugggggcagugcggggaggguggggaccgguuaccggggcaaccaggagcuguauuggugccagcccagcugugacccauaucuucagucuuagacucguuggauucuuaucaagaaugaaaaucaucugucguucuaccucuugagaauguaaaccaucugucguucuaccuccuuaucucucuguuuugguuaucucuaaggucugccuagcuuguaguuuuuuuuucugaaaaaauuuaguaaguaacuugugucucuuccaguaaucuuuucuccuguacauaaauuucucuucugaauucuaccccccaauccauagaguccacuuaacaagcaucacuugugaagaagaggaagacuacagaaauuccauuuuaaaaucuaucaauuuugguugcuuuauuuuguuauuuaacuuaccuuuuauuugcagucaccaaagagaaaccuaaaauaacacuggcacagucacauuuuauacacucccuuagaaaugguuauuggcauguauauaugauuuauguuguaugcguaugguuagcaauaauuuuaaaacgugauauuuauugaaugcuacaggcacuuuucugugcauauuuuuuguauuaucucauuuaauacuuccaagaauccaaucaaauagauccuguuaccauuccuaccccacaggagaaaaauggggcacagagagacuaagcccuuugucaagcucauacaagccuggugguggaaccagguugccuauguuuauuaucucuaguuuaguaucaacauuauuacuacucuuuuuuauuacuacucuauuauacuauuauuacucucauuauuauuacucucuuuuauaguucuauugcccuaucuucuaaaaucaaauguugcaaaccugugaugauucaaggccugaagcacugcaaacucaagcuguacccccaauaacaaagagaagugcacucuuggggugcucuagaauagaccuaauaaugguuuaauggcucaaggcacaaaaaagaaaaagacagugagcuagggaaaggacaccugggggugagcccagccccacugaaagugagaacaacaguguuggucugcggccaguuccauucguucuugcccuuuggacacacuuagugcguggccccagccuuugaccugcccucaucucuccugaacuauggccaguuaugccagcgaguuuguaacucuggugugagacacucuaggggauggccucacggccugcacacaggagagugcuauucauccauucauucacucgaaaacaugccacaacuauuuucugauguuuacugugugucaggccugggggguacaaugguuaacagaaacagccacagucccugcccuuuuagggguaaagucuaguugcagagacaaacauuaaucaaauucucagaccaucaguuguugagcugccacagggacaagugcaacaaugaaauggcaccaugagaguccaucauggagguuucacuucccugaggaagcagcaugggugcugagaucaaaggaugagaagggcuagcucagggaagaagggaacagggauacaaaggccccaugggagaagcauugcagugggaggggcuggaagaggccagggagcuccuguggagauauggaggcgcauggcuccuaaagaggcuggagccauguggaggccaugccaugcaugcuuagcaguguaaguauuuggucuugauccugagguuggugggaagccucuaaagggucacaggcagaagaaacauggccagcuuugaguucucaaagaucacucuggcuuuagggugaaugcuagaguacggugauagugguaggcugacagcaccugggaagagaagaugaggacuuccccauguaugaggcacagggagccucugaccucucaggaauuacauucuucagguuaaaaucccacaacaagguguuuuggcagagccuguucaggcuggggcagaggguggcauuguuccuggggccauguucagacaguuguucaggacuggagcuaacauauguagaggaucuacugggcaccuggcucuuuguagccccuguacagugaccuuaggacucacgaacucuacuacagcaagugcuguagcgagcucauccugucacccagguggaauaugugugauggacacagacagcaauuguuaccuggucauugagcgguaugccuuuucccaucuuccuucgauuuuccuccgggugauaaucaucagcaucauagaauuuccaucccagcuuuaagaacaaagugaaaggguguauguggcaggcagaugggccaaugugauagucauugugggauuacuaacaggcagguguagaaacaauaccacccgccugguucccaucaaccccaaggacaacccccaggagggaagcaccuugucaugccauuucacaacccccaugacugggcuaccacagccuccuuuaauucauuacuuuuuuuuuuuuuuugaaauguagucucacucugucaccaggcuggaguacaguggcgcaaucuugucucacugcaaccuccaccucccggguucaagugauuccccugccucagccuccugaguagcugggacuacaguaggcgcgugcaaccaugcccggcuaauuuuuguauuuuuaguagagaugggguuucacuauauuggccaggauggucuugaacucuuaaccucaugaucugcccaccucccaaaguguggggauuacaggcaugagccaccgcacccugccuauucaucacuauuuguaaucaccaaggagaaaaacaaaauugcuccagugggguucaaagccauguggaagugucuguacaaagcagaaaaaaggcagagaugcaaggagaccagaacacaaugggacaagcacucggaaggcauuaggacagguuacuaaccucagaugccagcagggcgcccacgguggaucuguggagaggacacagauguucccguuacugcccugcccaauguguggagcuuccuucugugcaaggaugucugggaaagggauggcugccuuagcaggaauuuaaacaccaaucacuguguaauccuaaagcagugaugcccgugaccguggagucuggagacuggccuuagcugauccccacgaaugucaaugaagaaauaauuaguuaacacuauuucuuucucuaaaggcaauauauaagaucucauuaaacccaaguuuuuucuucaguaaucaguuuuuggucccuguuguguaauuuuuuuuuuuuuuuuuuuuuuuuugugguggggauguugaauucauagugauaaaauucugcugaaaauauugaauggaggggucugauggaggauuuaaucuccagcagcacccauguaaaguucaggacacucauaaaagcauaaaaacauuuuuggaguuuaaaagagacacacucguaaaauaaaggacaugggucaauaucucaugaaucaccggcacuuguuaagacuggggguuaaauguucucuguguagagcauuugguaacuaucuguucauacucuaccaggcagcaugugcuagugaaaggggcucgggacucaguacuggagauggggccacaguugccuacugccacuaaaugacugagugcucccagccaagucaccuguuccuuuaaaccucaguuuucucaccugcaaaacaagggaucugagccacaugauguauccauccaccuacauuucauuucuuuauugagcaccuaccaguucccaggauguaacgguaagcucacugacacauggccucagccuuccuaaacagucuaguacauaggguagguagggguggaggccagcagacaaugacccauaaagugcuuucucgcuuucaauguuuaaaguguugcccaaaugccaauuauuuaagcacuaucuuccuaauuuuuaccuauccccauacuauuuuaucaugcccucuuaaauuuuacauaucaccucaacauuuugauguuuuuauuuaauugcuucacuuuuaaaaauuaaauaaguguguuaaagaaggaaacuuucuuucauucccuugcacaagaagcuaucaucacuugccuugaauagaagguaccugaaaagcuguauauaaugaaaacagaacaaugugauuaaauucuagcuggauacuguugccuaacaaagguccucuuucuuucacuaaaaagcuaucagagagguguuagacacaguuguaccaaacugagaucugcuccuggauguaaccaaagguugcgagagcagugaaaccuuucccauuaguucauucuauugaaggcugcgcagggagacaugcagccuacggaugaguagaccaucccggccaaacuccauggcuggugaagccagaagugugcauagcagaaaucacacuuaagaccaaguuagguugagcccuuggcucacgccuauaaucccagcacuuugggaggcugaggcaggcggaucacuugaggccaggaguucgggacuagcucggccaacauggcaaaaccccgucucaacuaaaaauacaaaacuuagcugggugugguggugcacgccuguaaccccaguuacuccggaggcugaggcaugacaaucgcuugaacucaggaggcagagguugcagugagccgagaucacgccacuguacuccagccugggcgacagagugagagucugucucaaaacaaaaaacaaaaaacaaaaaaacaaguuagauuagccaugaaugaacaugccagccagcacucauaauuugaaagcagagguaaagagauguggguguagacugucaggaagaagaugggaaaagaaaaaccacugucugucuaaaccagagaacaccuggacucuugaauaugcaccaaagacccuggcagaaauaaggcacagugcugggcccaaaaauacuggucagacccaggauuacaaaucaagauuugggguccauaugucucccaguggguuggucuaaaucaggggcaagggacuuaaaaagacaacacagaccaaugggggagaaggaagggaugcagaaucaaugagaaagauauucaaaaggucugagcuuguuucaucagcaaagagaaggaaaccuggaaggagauguuaaggguggcuucauuaagauugugaaaauauaaagaaaauuaacucugccacccacucagaugccugccgucuuccauccauccauccauucauuaagucaacaaguauuuaguaucuacgaaaugccaggaacuguucuagacacauguaucaguaaauaaaaaggaaaauaauccuuuacauucaggugggggaagacaguaacaaacuuaguccuugaggucacuguguuuuaacaguguucuaaauggagucuuucuguuuugagacuauuguucucuucagccauuaggcugugauaaauauuuuucuaaaugcuauggaguauaauuaaaaaauccuguagggcuccaauagggguucacaaagucacuaaagaacuugauguugcuacauccaaugaugaauauaaucaagucccagucuuuuuauuacucagcuagucaauaacauuggacacaucucccugacccugcgccacugaaaguccccaggguucaguucuuggccagcuucuuuaucuacaugcacuccuuuggugaucucaacaccuuagaucuuuaaguacacccacacaacagugauucccacaguuagaucuaaagucccucuccucugaacuucagacuuggacauccaaccaccauccacuggaugacuaauuggcucguccaagucaccauaucccacacugagcuucugagguugucuuccaaaucugcucuaucuacugcuuccccaaaucaguuuguggcgacucccuccuuccaauuacucaggccuaaaaucuugaaucauccuugacuucucucuugucuucuuacacccaacauccaguccacaaacacaucuuucugacucuaccuucaaaauauugccagcauaugaccacauucucuuuaccugcauuguuucugacuucaucucccaucaugcuuccccucacucagccacaauggguuccuuccugcuccuuaaagaagccaagccuuagcugggcgcgguggcucacgccuguaaucccugcacuuugggaggcugagacgcauggaucaccugaggucaggaguuugagaccagccucgccaacaugaugaaaccccgucucuacuaaaaauacaaaaaauuagcugugcaugguggugggcgccuauaaucccagcuacuuaggagccugaggcaggagaauugcuugaacccgggaggaggagguugcauugagccaagauugcaccacugcacuccagccugggcaacaggagugaagcuccgccucaaacaaaacaaaacaaaaaaaaaacaaaagaagcuaagccucagaaccauugcaccugccauucccucugccuguccugcccuuuccucagcuauccacauggcagguuccucaagucuugcaggucuuugcugaaacgccacucccccagaggagacaucccugaccacucugccuggcacucuuuguuccccuuacuccagagcaucuaucaccaacucacacacuacauauauucauuuacucugucucccauaccagaauguaaauccuuugagggcagggauuuuaucuguccuguucgcuauaugacaaugacauagaguaaggauugagcucaauaauuacugaguacaugaauaucacaagcuauacaucauagggauuaggccucccucaucugauucaagacucagaggggguacaugaacugcccaggcucacacagccagacagcaacagaaccaagaccuagggcucuucacuccuguuacaucacaccauggcaaugauuuuacauucuccaacugauucaaaucauauggcagcuagggauuugggggcuccauguuuuauuucaauugcaguucaagauuucuuuuuaucuuuguggcugagaacccuacaauaauuuuggaaagcaaaacccaucuaccuggaguaaaucuuuaauauacaccugacuacacaggccacaacaugggccguuccugauucagaaaauucuagaaggguccuauaggcccuugaagguuaugauguuuuagcugaucaaguucuguccuuugcugccuguggucgaaugguacagcagcugucuuuucugauaaagggcacaguuagacuuugguuuaaacaggaagccaaauguuaacuccucagucuccagguuagcacacugggcuaccucugugguuuccacaauucucuucuuucuuuccaaacccucaggagccacccuccauauuaacgcugucuccuuccagguuaagcugaugaaaggaaggggaaaacgauucacuuuccaaaauugaaucggagaaguccagggccucauaggaggaggccgcuguguguccagauggccaaaggucugugagagccugggccgugguuugcguccucucgcuagaggccgugcgcccucccgccuggccccgacaaggcgccccgaaaccuagccccgcgccgcucgcuaggccuccaccugcgcggccccgcagccgccuguucaggagcggcuuccucccugagccugcggucgccgcagccuccccgucuuagagcgggaacccggagcucggaugcggucccaggaugggcgccccgcgagcaggcuggagggcggggagagggcgcggcagccgcgggccucgguuucuucaucugcaaagggaagggugggggguccccaagaccccaguccaccggcagggacggcgacgcguccggccuccgccgcgcccgcaacacuugucccgggcgccccccgcccucucccggaccuacuuccccgagccgcucacgcccaucaccagcagcgcgcccggcgccgccauaacccaagcucggcuccuucccgucgccuuccgggccccgccggccccggccua

SEQ ID NO: 192428 - RNA, 48291 nt, Homo sapiens
aauuucgcuaaccgugacgucaucucggugcgccguuacagcgcuuaacuggaaacugcgauuuaguuuuuggugaaaggaguggaaaaaaaccaugaacugaccuaccccgccccauuuugcuuuuaguccuucacacuggcuucgccugcacuuugggcaauggagcgggaaaggaaaaggcacgcaggcugagcucaaagucgcgccagccggggaugacucggcgacgccgccaggcgcguuacccggcgugcuccgcgcggcgccggcgaagggacgugggggaaggggcagggaggaggaagcgguggcugcugcggaugucggugugagcgagcggcgccugaacacacggcggcugccgagcgccugacccgggccugcgccagagccugcaccgagcuccggggccccacacccgcuacgguggcccugcgcccguugcuacugaggcggcgugcucugcauucuucgcuguccaggccugccggcucuggugucugcuggcuccuccuugcucgccugcucccuccugcuugccugagucaccgccgccgccgccgccacagccauggccgagaguggugaaagcggcgguccuccgggcucccaggauagcgccgccggagccgaaggugcuggcgcccccgcggccgcugccuccgcggagcccaaaaucaugaaagucaccgugaagaccccgaaggaaaaggaggaauucgccgugcccgagaauagcuccguccagcaggugaggccgccuggggcucgggccgggauggggguggcggcaggaccuccgcccgccgccccaggagaccuuuuggaagggccugggagaggggucguccucggccauucucccgggcgucgucccaaauuagaucacacccaaguucguggguuugcgccuugggacaccgcaaugguuuguggcguggcggcgcggccuguuugugggacgggcugaugccgcuuuucucggagccuuccuucucugguauccgccgacccucagccuccucccccaguuccccgcccuccgucgccuccccuccaacuccucacaaaggaaagggacccaccgccagccuccgggcgggguggaggcugggcgggggcgaggguucgcuuuagcucaggcugcgguuuuguuucaugaauuaaaaaggggugggugggauccucguuguuuuacgugccugcuuguuaagguggguuuuggggugaggugcauguguauauuuaguucugcauuuuaacuccugaaaucuuucccaccuugcaaccuuuaaaaaaaaauuaugacguagaaacuguuuuuagcuccaucuuaaguaauagugauaguacuagguuuaaggagaaaagugaaugacuuucuuucacugaugacuugcucuuucccuuuuaguauguuuaucaucucuuagaugccaaucauuggguagguuuuuguuugauuuuagaggggcgauagcgauguugauauuagcgguugcaaucaaauaaaagaaaaucggagugaaugcagaauauuacuuaaacuugguucaggaauacaaaucuugcaguuaauuaagauucuugguggaauuuaacaaauaauuuuaguguauuguugaauacgucguguuuuccauaauuacugacuuaaucucugaagaucgcaaacaacgugaacaguuggugacaggaaacaacaauuccugaaauguaccuaucaguuuccccagggacaguaggugauugggguauugguuuaacgaguuccaaagguaguguauuuugugaagcagugagguguguaacaucaaaugagagaaacuuuuaccaccaacagaauuaucacuuuuguuuuugucucccagugcuuguaaaaauuuuccuuaccauuuuuguauuuucaagcaugcggaaaguugaaagaauugggaaguggauacacauauguccaucaucuacaauuagcauuuuacgguauuauaaucgauuaucaaguucauuuaauuuuggggagcaauucagaguaaguugcacguaucaguagaugacaccaguacaugucacuucagcauugugaacuuauuugccuaaguucaacuucauuuuuuacguuuuuuugacguaauuuuggcagcagugaaaugcauaugguugccauuccgugaguuuucauaaaugcuuacaccuguguagcccaagcucuuaucaagauauagaacauuauaauugacuagaaaguuuuuucuugccuuuucccagucauuucagucacuuggccuuuccaucaaccacccaguuuuuuuuuuuuaugcccuaaguuacagaguugccuguuuuagaacuuaacauuaaaugggaucccauagagccuauaguacuguguguauuuuucuggguaaggcuuuuuuuucccacucagcauaauguuuuugaguuucgucuuuguugcguguaucaguaguuccuuucuuuuuauuaguguguaguuuuccacuguauguguauaccauaauuaaucuauucacuguugaaggucaccugggcuguuugcaguuaguuacuaugaacagucuuauacaagucuuuuuguggucuuacucuuuuaucuuucaugguuauauacuuagacuugguuugaguaggucauagggcaauuguauguuucaguuuugugagaaacuauguuuuaaaaaaugcuucugggccggaugcgguggcucacaccuguaaucccagcacuuugugaggccgaggcggguggauugccugagguucgagaccagccuggccaacggggugaaaccccgucucuacuaaaaauacaaaacuuagcugggcgugguggcaggcaccuguaaucccagcuacuggggaggcugaggcugaggcaggagaaucaucgcuugaaccugggagagggagguuacagugagccgagauugcgacauugcaguccagccugggcaacaagagugaaacuccguuucaaaaaaaaaaaggagugcuggcuucagcagcacauauacugaaaaaugcuuguaucauuuuaccaucccgccaaugaagauacaugggaguuccuguugcuccauaucccugcuaacauuuugauauugucagucucuguaauuuuagcuauuuuagcggguguguagccauauuaaguuuuaaagcucucggaucucuuuucuaggauuccuaauucaugccuccaccauccugggugcuuucagcauuuuacugcaaaagauuagaaauaaucaguauuuuauaaauagaaaaauuccuuucagucaauauaugauguuauagcugugaggauguuuuugcuuuuugugauguuaaaauuauaaauucugugaacgcuuuuauuuuacucugcuguaaccaaagugagauuuuuuuuuuuuuuuuuuuuuugagauggagucucugucaccccccaggcuggagugcaauggcauggugucggcucacugcaaccuccccuucccggguucaaggauucucccaccccagcuucccuaguagcugagacuacaggcgcaugccacaccacacccggcuaauuuuccuauuuguaguagagacaggguuucaccauguuggccaggcuggucucgaacuccugaucuugugauccgccugccucggcuucccaaagugcuaggauuacaggugugaaccaccgggcacccggcccaguacgaauuguuaauagauaaaauuaaagucuuucugaaguagccuuuucugaugguaguuuauuuuuaaauucuugaucauuguuuuauguugaagcagaaaaugugauaaaaauugacgcuuaucaccacaccagagaaccuguagacaaguugggcuuuguauaugcaagggaaacagauacaggaaaauguggaagaaaaagaaaagcaguuuucaaaugaccuauuuguaaaaucuacuugaagcacaaaagauaugccauuuuauaauuuaaaaauuuuaaaggguuugauugaaacuguuuguuacaaaugaaaauuugucauuaaaaauacuuaaugacauuaaaauuccacugaaaguguccaguuagaaauugggaaauauuuagucuuuaaaauuuguaccuaauuuuggagggucagaggguaagccgaagaccuccagaggauaauauugaaggcuuaugcucuguaucagacaaauuccguuuucuauaaguuaaaauuucuuucaauaaguauuucuauguaauguagauuccuuaacacauuauaccaaaauucuguuuauaugaacaugcuguaauaagugauuagaugaaauuacguuaaacuucuuggguaaauuguaaggugguaauuuauuuuccuauuuuuccauugguuucuggucgugaguaccaacaggcagaaacagguugccuuaauuuuuuacagugcuauauacauuugguauuuaauaauguuacuuguucaagguuacuaauaaagcuuaagcuuuuuuccaauuuagagugaaauuuauuauucacggagcacucagaaucaacugaguaacauaaauuuuuacuuacagguugcuagaauagguagugagaauauaaacugcacuguguacauuccaaggugcugucauuaauagagauuuuuguaauacagguuuugaguaucccuuaugggaaaugcuugggaccagaaguguuugggacuuuggauuuucuuuuuuuuuggauuuuggaauauuuguauauacauaaugagauaucuuggggauggcaccuaaauauaaacaugaaauucaguuauauuucauguacauuuuaugcacagagccuaaagguaauuuuauacaauauuuuaaauaauuuugcgagugaaacaaacuguauacauugaaccaucagaaagcaaagguguuacauaugggauuuuuccacaugugaugucaugguguuaaaaaauuucagauuuuggagcauuucagauuucauauuuuuggauuggggaugcucaaccuguauguaaguaaauagauacaaaagcauaaauguguaguggcacaaagucccuguguaugagauuuuuuuuuuuugguuaauuguucaucaucagcuauugaaaagagcuuugaggauuuccaaguauccacgagcaagauaacaucuagaagaauggagaguuauauaugugagacauuagugcagauaauggaggggaguuucuguguaacuucuaauuagcuuauucugggauuucauagacuguuagguuauguguaaaauuuugaaguacauuuacuugaaauguucaggcaguauauacucugguuuuagaaagugccuucugucagugcaaacuucugggaaaauauuaauauacuuagacauaauuuaaacguauugagucaaauugagccuuucuuugauaaggcaacuugccuuagggucaucaucacacacaugauuuaacguuauacuguauaguguggaucuagaacuauacuguccacuuugauaccaucacccacaugugguuaaguacuuaaaaagugagauguguuaaguguaaaauuuauaccagauuuugaaaauuugguaugaacaaaauaaauaucuuaauacuuuugauauauuauguauugaaauaguauuuugcagaucgugaguuaaguaaaauaucaaaauuaauuugaccuuuuauuaaaaacuuuuuuuucaguauggcugcuuaaaauuuuuaaauuacuuguggcuuauauauauuucugcuggacaacaucuuauccagaagguuggauugaaucaguauagcaagauaucugagaaaaaaaaugucugugagaucauuguuuucuuauuugcuuuguucuaauacuggacagcugaaaaacucguuauuuaaugauucugauuaacagagauugcuuagcuuuuuuuaagaaagagcguaauugaaguguaauuugccuaccauacaguucaccauuuuaaagucuguaauugauguaauacauucacagggucguguagucaauuuuagaacguuuagaacccucaaaaagaaacgcuguacccuuuagcaguugcccuucguuucucccugggccccccagccuuaggcaacuacugaucuauuuuuugucuauagauuugcuuguucugggcguuuguuguaaguggaaucauguggucuuuugugauuggcuuucacuuagcauaguguuuucaagguucaucccuguugaagcaugugccgguacuuacuuccuuuuuauugccgaauaacauuccauuguguugccaacagcauuccacauuuuauuuuucuaucacgugguggacauuggguuguuucuacuuucuggcuauugugacuaaugccucugaacacucauguauaaguuuuuguggggacauaacguuuucauuuuucuuggguguagaucuuggaguggaaauugcugggucaaagcucuauguugagcuuuaugaggagcugccaaauuauuuucuaaggugucuguaccauuuuacauuuccacuagcaaugcaugaggauuccgauaaccacauucucgguaauacuuauuacugucuuugugauuauagccaucuuacuggcugugaaaugguaucuuacugugauuauuuugcuuuuuauuuucauuauuauuuuugcugggggcacucugaggaaaacuggacagccugcuagacaaauuugcuuuuuguuaucugagcaguaguucucacugugguuuggggaguccccauacccuguuaaggguaccaugagaugaaacuauuuucauaguaauucugagauguuauuuuuauuuuucagucuaauuuucucaaaacugggcagugcacuuggcuagagucuuuaaggugugggauaugacaacagaugugaaaauccagcugucuucuauuacaagacuaaagugauuuccaaaaauuuaaaauaaugccacucuuaucacugagaaaauaguuauuuuucauaaggauguuauuuuuauuaauauauaauguauuauuuuuaaaugaauuuauuuuuaaagguuauucaguuuuaauuuguaauauuauaaauaucaacagcuauaaccuaaacaagcaaaacucuuuggaguucugaaguuguaaaaugguguccugagagcaaaaauuucugugguggcguauuuuauagauuacguacuuaaaauaucggguaguggcuccaauaaguugccauuaccucuugccuagaaacugcaguagccuacuggucaguugccugacuucuauaacucucccaccagccauuccaagagugaucucugaaaaacguuaaucagagcaugccacccucuguguaaagcuaauggcucccuguuggucuuagaauauauaauggaguagcgaggcccuguguaauacgguuccaugcccucuccauuuuuugcagaugccuucuuucuuugcuugcuuggcugacuacauugaccuucuaguucccugaccuguuaauacuuuuuuuccugccugaggacuucuguacaguuuguucuugcuaccuagaaugcaagaacacucuuugcccauuccuuuuccaucuuuaaaucuuaaugcaaaggucaguuucuccagguaguaucuauuucugauuguccagacuggauugggauccccuguuggauuucucacaguagccuguuuuugauaagaauucaucacaacuaaaaauuguauauuuaugugauuccuucucuuuagagaggggcugugauuguucaccauuguguuaccagagccuagggcucaauaaauuauuuacagaugaaucuaguccauuauguacaauaauacauauucaguaauaacuacuuauuguugaaccuuuacugaguguaguauguacauaaucugguagcucccaguccuuuuguggaagcuuccucuuaagcuguuccccccaggucaccacucuccaggcacaacucuugacugcuucaugauguucacucuugcuucucugccuggaacauuacucuucuagaaccaccuuucuuagcuggagauucucaucugaaccacagagcacagaaagugauaugaauagcuauccauuucuuuucaaagaugguucauaaugaauauaauuuuagauguauaggagagaaguuaauucauuacauagugagugguuuguugguaaaugcugguuuaucaacccguucuucaggaaaaacacugauuuguaguguuugcuggauuuccaugauguaaauauucucacuguggcagauuucaagauaccguuauuaaacuggcucacaaaauuuaugaaaauuuaagagccauugcuuauaaugggugccuuagggcagaggccagcaaacugguagucgaaaucuauugugcccauuugcuuauguguuaucuauagcuccuuucagaauagaccauguggcugguagagccaaaaauauuuacugucuagcccguaacagaaaguuugcuuacccugguauuagggcuuccuguuaauauaucuuguucaucaaaacacuucucauuggaaauuuuuaccaugacuuauuuuuuauagaaauacaaugugagcugggcucagugguucaugcuuguaaucccaacacuuugcggggccaagguggcaggauugcuugagcaccauggcucagugaucauggcucacugcagcccccaccuccuggaguucgagaccagccugucuacaaaaaaauaaaaauuuagcuaggugugguggcacacaccuguagucccagcuaguccagcaagguugagcccaggaguuuggagguuacacugagcuaugauugcaccgcagcauuccagcuguggugacagaaugagacuuggucucuuaaaaacaaaaaacaguaugagccacauauguaauuuuccuauuagccacuuuaaucaaaaggaaggacugaagucaauuuuucaauaguggugacucacacauaacaaaauuuaucauguuaaccauuuuuaaggguucacuucagugacauuaaguacauucacauuguuguacaauuguuaccaccauccguuuccagaacucaucuugcaaaacugaaacccuggaccguuuaaacaguaacuccccauuuuccccauucccccaccucuagcaaccaccauucuucuuucugucucugaauuugacuacucuagguauuucauauaaguggaauaagacaguguuuggccuuuugugauuaacuuauuucccuuaguauaacguccacaagguucauuuauguuguagcaugugucagaauuuacuuuuuuuuuuuuuuuugagacaggucucacuuugucacccaggcuggagugcaguggcacaaucauggcuugcugcagccuccaccuccugaaguucaagugauccuccugccuuagccccccaaguagcugggacugcaagcucacaucaccaugcuuggcuacuuuguauuuuuuuguagagacaggguuucaccauguugcccagguuggucucaaacuccugagcucaagcgaucugcccccuuggucucccaaaaugcuaggauuauacaagugugagccaccgcacccagccagaauuuacuguguaugacugaauaauauuccauuauauguauguaccacauuuuaaaaauccauugaucuguugcuggucgcuuggguugcuuccaccuuuuggcuauuguaauuuuaauaugcuuuauuuaacccaguaugucuaaaauauuuuaaggugcaauugauauaaagacuauaaaauaucuugcauuuugaaauacuaagucuuugaaauauauuuuguaauuuacacuuaagcauaccucaguuugaaguagccacauuucaggugcuuaauagccauauguagcuagugacugcugaauuagcacagcuaauaaagcuuucaggaugugcuuccaccugccuuuucuccuguuuucauugcauuucagccaguuuguauugucucuuccccuacccucaaauaucacuggcucuuucuuccccuuuuugaaccuuugcaaaugcuguuaaugacaaugacauaauggccaauauuuauugcaggcaugauuuauaaggcaugaugcauuauauuuuuuuaaaaugucacauaacuuuaugaugaaagcacuauuauuauccuuuuuuuaaaaaaugaagaugcuggccaggcaugguggcucaugcugcuaaucccggcacucugggaggccgaggcggguggaucacaugaggucaggaguuugagaccagccugaccaacauggagaaaccccgucucuacuaaagauacaagauuugccaggugugguggugcaugccuguaauccccagcuacucggaaggcugaggcgggagaaucgcuugaaccugggagguggagguugcagugagcugaaucgugccaucgcacuccagccugugggauaagagugagacuucgucucaaaaaaaaaaaaaaaaaaaaggguacaaaaaauagccgcgugugguggugcaugccuguagucccagcuacuugggaagcugagguggaagaaucucuugaaucugcgaggcagagguugcagugagcugagaucuugccacugcaguccagccugggcgacagagggaaacugucuuuuuuuuuuuuuuuuuuuuuuuuuugagacagugucuugcacuguugccccggcuggagugcaguggugcaaucucagcucacugcaaccuccgcccccuggguucacacaauucucuugccucagccuccugaguagcugggauuacaggugcacaccaccacacccagcuaauuuuuuguauuuuuaguagagacgggguuucauuauguuggccagacuggucuuggacuccugaccucaugauucgccugccuuugccucccaaagugcuggaauuacaggcgugagccaccgcgccuggccuaugucuuaaaaaaaaaaaaaaaaaccagaagauacugagacucauauuaauaaugugaucaaauucauacacauauuaaguaguagacuguagauucaaacccaguacaaacuugggaggccucaccgauccacugccccaaacugccuugacuuuccuuugacuggcuuuucagucuuuaaaguucauugaauagcuaggugugguggugcaagccuguagucccagcuaauugggaggcugaggugggagaauuacuugagcccaagaguuccacgccagccugggcaacauagcaauacucuguaucuuuuuuuaagaaguuuauuuaaauauuaguucaucagaggguaauuggacucaucagucuaugucagaucauugauuauaaucucugauaauauuuugugauuauauggauugucuccuucacccagccccccugcccccgaguacuguaagaacuucaggggcagggacuguuuugcuuacuuucuaaucccauguugccuagcauuguguccugggcacacacugaguagacaaguauuuauugaaugaccaaauaguguuuuaaauauuuaucugcaauauuuuguaccuaguugggauuuuuuuuuuuuuccuuuuuuagacagaaucuuguucuaucacccaaccugaagugcaguagugcgaucacagcucacugcaaccuugaucuccugggcucaagcgauucucccacuucagcuucugaagaaacugggacugcaggcgugcaccaccuugcccagcuauuuuucuuauuggguuuuuuuuuaaaauuuuuuuguuuguuuuuauagagacaggauuuugccauguugcccagacaggcuggucuuaggaauauuuuaacaaugugauuuugaaaaaguguguuuauucuuagucaacuuaagugucugauggcauuauuacaguuacuuuccuguaccagcagcugcaacuacaaaaaagauaagagaggugauagauauauuagcuugauuuagucacuccacauuguuuacauauaucaagacaucauguuguacuuuauaaguguauacaaucaugauggcaggcggauuaugaggucaagaguuugagaccguccuggccaacauggugaaacccugucucuacuaagaauacaaaaauuagcugggcgugguggugugcaccuguagucccagcuacuggagaggcugaggcaggagaaucgcuugaauccgggagguggagguugcagugagcugagaucgugcgacugcacucuauccuggcaacagagugagacuccgacucaaaaaaaaaaauuaauuugaaaagugaagugaaacuauacaaauaccauuaaauugagauuaggagcuuuuuuuagagacugaaguugauacuuaaaucugcuguuugcagagacuguuggauuagcauacuucacagauucuauuuauuauaggcaugaaaauauauguguguauuugcagaauauuguugcuagaccugaacucugauuuuuccagguaaauuuauacaacuaugaguuaguuugauguccuguagauauggcaacagucugccugguuuacugguuaagcagcugccauauagaugucuaaaacuuggggguaauuuuuuuuuuuaacucuuuaaagcucucuccaguuuucuuaaaggauauaacuuuuacauuuaaaaaauaccuuuuacauauuuuugcuuuaaaauuaagaaauucaaaugauguugaaaaguauaaaaaaggggacugggcauggcgccucacgccuuuaaguccagcacuucgggaggcugaggugggcagaucacaaggucaggaguucaagaccagccuggccaauauagugaaaccccaucucuacuaaaaaaauaaaaaaauuagccagugugguggggagcaccuguagucccagccaccugggaggcugaggcaggagaaucacuugaacccgggagguggagguugcagugagccaagauggcgccacuguacuccagccugggcgacagagugagacuuagucucaaaaaaaaaaaaaaaggugggagggcccauucaggauaaaagguaaaguuaacuuuuuuuuuuuuuugggugauucuguccagaaagguauuuauauguucauauauaauuuuuaccuuuuguuaagcaaauggggucaaccacccacaauuuucuuuaucuuacucguucuacuuguguuaccuugguagucuuuccauauagaacuagcucauuagacuauuacuuauuauuuuuaugauuuauuguuuugguuugcuuauuaauauuuugagaaaggagagcaugaaccuuagaauuggagaaaucugaugauggguaaggagcuuuaaucaucucagccucacuggcuacauuuuuaacauaucguguaauaccugcuucaguacauuguuuggaggauuuugugacaucguaugcauaaaguaccugacucagaguuuauaugauuuacuuauauugguuucuuuccccacagccuuuuguucaccggugaauugaguuuuaaguuuuugcaauagaaggaaguauaucuauccuagcaugugaauagugaaacauuuaguuuguuauucuugucagauuuaaauuagagagaaucuaaaaaauaaauuuucugaacgauacacuaacauuuguggcuguguacaguuuuaugagagagugccccuuucucauacguguuacauauucaguguaguaguuucucauacuuggcauccuuguauaaaggguuaugcaguguuuuaaauaagacuacuauaagguuaaacaucagacucuuggagaaugauaacugacagaaccauguauauggaugauuuauggacuuuuuucaaauacuauuagcaauauugaguaaggagcuaauucaaaaauagacucuugaaggaucucugccuuaaaauacugaaauagcaaagauuugaauacaguauucagauaacuauuuagagaauccuugcuaaaugcuguuaauaugugauucugcgggaaaugaaauuguguguguuuuaucuucagagcugaaguaaauuuuacuuuuggauagguugauucccaacuccccggauguuuaauaggugagauggagaaugguuguuuaaaagcaaguuuggauguuuggauuuugaaauguuuguaaagggugacaauguugcuuuuaaagucagauuaacuccauuuucagaguguuuacaguugagaguuuauccuugcauaauuagauuagcaauauuugaaugucuuagugaaugaauugugcccaggaaauuuccguaugucucuuaauucucccaucagcccugcagaauaaguaucucuauuccugaugaagaaaccaaggcucagagacagguaacauccuccaggucacacaacuaguauguagcaaaaccaagauuugaauucaggccuacauguuucaaaaauacucuuuccuaaccuugauucuccucucuuuccuccauaugugugucuuauuuucuucucaaaaacaauugagaacagggaguaagcaaagucagcccucagcagcugagauuggcaccauaaaaguugauacacuaaaucuugauacauuuucauuucagggcagcauuucacauucucugcguacucuuauuugauacgguuuucuaacuucucuuaauuauuugcugcuucuuccucagauuaaaaauagaaaauuuaggggagaaagaagguaugcuuucaagacaagaacuugacagucugguuaaaaaaaaaauaagaaaaagaaaaaggcagauacaagauaccuugagagucuggacaguuaucacuauauugcagaacagcaguugauauucacaccaguaacucagcauuaucaaaaguuaaaauuacauucaguagaauggaaaacaauuuuggugcucaaacagagguaaccuucaguuagcuggagaauccacucaugugcaacaccuggcuuuuggaugauguugaaaaaaaugggguugcugaaaguuguuuugucugugcuggguucauuuugaaaucauuacauugcuuauucaaggugcauuagaauuuugauucuuaugguuguugagaaagaguuuaguaauucucagcuuucaguucucuggccuguaguuauuguagguuaucagugcaagaccagaguuggauguacauuuguaggaaauauggauacuuugaggcccguucuaucauguaucuuucauuuugaguuaauagugaccacauaggcuuaaggauaaaaauaaguuaaucuagguaaucuuuuuaauggaaauuacaaaaauucuuccuuuaugguucuggcuauucccuagaugaaaauauuuuuuuauuauuguuguuauuauuauuuuuaaaacggaguuccgcucuuguugcccaggcuggagugcaauggcaugaucucagcucaccacaaccuccaccucccggguucaagcgauucuccugccccagccucccaaguagcugggauuacaggcauuugccaccaugccuggauaauuuuguauuuuuaguagagacgggguuucuccauguuggucaggcuggucucaaacugccgaccucaggugauccgccugccucggccucccaaagugcugggauuacagaugugagccacugcgccuggccgaaaauauuuuguauaauuguaauaaguuuuauuuuucugcagaggaauagugucagugagcuaccucugucuaaacagcuuugagauuuucuaagauggcuaauuaaguuuuuccauaucaauacuauuuaguuucugauuccugcuguuguaugauaaaaguguagauuaaacagacaaggaaguuacguucaaauguuagugauaaaauuucuagaaauuuugaagacaguguaaucugaaaacuuucucuuuauucuguaggaagcagaauagaaguaaaagauauuugaaguacgugcagaauuuuuagcuguaggacaaauuccauuuagauaaaaacacuacauuauuuaacuugauuuaauuuucuaaaauaugguuuauucggaaaaguguaccauaucuggcacgguacaauuaaacuuaagauucuuuuaccuuuguuucaaauagaguggcagacagcuaaacuuacaaaguugcuuauuucuugguuuuugcuugcuuguuccaaguuuuguauauuuuuuacucagaacaaaucaauuuaacaguagccuucuacuuggaagugguucuaguaucuaaauuaggugacauuggugguuugaaauuuaaaauaagaacugaauuaugaaugguagucauaugcaguugucuguaguucccuagaacuguacuguaugcuaucaccauuuuuaacauguuuuccaacuuuuagcaugaagugccauaaauucauacuucaagacuaagauaccccuccagaaccaagaguuccaugagguuggaggaucccaguaucuaugacauuaauugucaacagcucuguaauuuugugagugaacgugauuucucacgugucugucaggacuuugguuugguuucuugagguuuuguuguaaggagugaaugugaaaauguguguguggugccagguacagcauagcuguguaauaaugauuaauggagguaauuuucgaaugugugguguaguguccuacucuacugcaucuaggacauuguagagaagcccuuagucuguccagaaagcccugauuauccuucagguacugauacugacaacucaugguuaggagacuccugucuuuaaauguuaccagagguucaagugagcuauauucauugcuguucuauuagauuuugagauuacagcuguuuuggauaucagguuuuaauugucucugccacauacgauguuaauggaucaucuuuuagccuuuggugauuaucucuguugucauuuucaugucuuauauccagucuggucugcuaccuaaaacuaaguucucuucauuccauuuccuuucaguugaccugcccaagaugaggcauauauauauauauguauuauauguguauauauauauguauauauuguguuuguuuuuuauuuuuuuuauuuuuuugagacgagugccucucugucacccaggcuggagugcaguggcgcgauuuuggcucacugcaaucucugccuccuggguucaagugauucucgugccuuagccucccgaguagcugggauugcaggugugugccacgaugccuggcuaauuuuuguauuuuuagcagagacgggguuuugccauguuggcuaggcuagucucgaauuccugaccucaggugauccacccgccuuggccucccaaaguguugggauuacaagcgugagccacugcgcccgcucccauugaggcauauuuuagcuuuggggaagggaauaauuugaaauugaaauacuaaggagagcuggcuguguuucgacuucuugauguuucuguucuuguuuuuuuuuuugagacagagucugguuccauugaccaagcuguugaccaagcuggagugcaguggcacgaucguagcucacugcagccuccaacuccugggcuuaagcaguccucccauguuggccucccaaagugcugagguuacagucaugaaccaccacgcccagccccugcugcagcuuaaaaguucacagccaacuuuuaaaacuauuuuuauuaaaguacaguauagaggaauacaugugucauaaauguacagguucguguuuuagccuaaaggucgagaaaguagaacaugauaccaacucccaagaagucacuugcaaacuuaagguaaccacuauucucacuuugggcaccauggauuuuguccccaacccuuaaaaaaacgaaaaaacucacauaaaugaaaucauacaauuuauauucauuugugacuggcuuuuucgcucguguugagguauccgugaugauauguggcaguaguucauuuguugucauuggggguaaucuaucaaaugacuauacuauaguuuauuuuacaguugagggacauuuggauuguuugcaguuuuuggccaauacaaguaauauugguucaaauguugauuguauuuuuuguggacauguaguuuguuaaauaguggaauuguugggucauaggguaagcauauguucaacuucuguugcaaaauguuauuccaaaauguacugauuuauacuuguacccacagugugugugguuuccaguugcucugcauccucuguaacgcucuuuaacagucuuaaacugaaccauucagugcauuuguuacugguuuuaauuuaaaguuaccuguguuguuugccauuuaaaugaaaaggauuucauuuuugugaaauuccuguuucaauuucuuggccauuuuucaauuggguuguguuucuuggugauuuguagacauuaugaaaucuggauuugagcugugcugguuguguugcaaauugucucuuuaagggcuuaucuuuuuacucugcuaaugauaguccaguauauggugccccuuuaaaacaaugguuaggucuuuuuguaucccacuuaggucaucuuuuccaauugaucaacacuugauuucuuguuaucuuuuugguaguuuaauugcauguggucacagaguacaacuuggucagauuuuaauuuuuugaaauauguugacuuucuuuauggcccagcauauguagucuaauuuaguaaaggcacuuaaaaagaaugcuuauucuguaguuguuggguuuggugaucuguguaugcucaauuaggucauauguuaauuguucauagcuuuucuauuuuuacuaauucauuuuugcccauuuagucugucaguuucucugagauaaauguaucacauuguuuauaauagccaaaaggcagaaacaacccaaaugcucaucaccugaugaguggauaagcaaaauaggugguauauucauacaauggcauacuauuuggccauagaaagggaugaaguauugacacaugcugugacaugggugaaucuuguaaacaugccaaguauaagaagcuagucacaaagaccauauguuauaauauugcauuuauaugaaauacucguauggaaacagaaaguagaaauuacugguuucuuaugguuggaagugaugagccauaggugggugauagcuguaggguauagauuuuuuugagguaaugaaaauguucugaaauggauuguaacacaugucugugaauacuccagaaaccauugaaucguauacuuuaaaugagugaauuacgugguaugaguuaugucuccauaaagcuuaaaaaauacuauuuuuugguagguauuugaaaggauguaagaauagaugcaugucuuuuuuuuuuuuugaaacggaguuucgcucucaucgcccaggcuggagugcaauggugcaaucucggcucacugcaaccucugccucccagguucaagcaauucuccugccucagccuccugaguagcugggauuacagacaugcaccacaaugcccagcuaaguuuuguauuuuuaguagagacgggguuucaccauguuggccaagauguucucuaucuccugaccugucaucugcccgccucggccucccagagugcugggauuacaggugugagccacugcaccccgcccgaugcauguguuuaaucuaguaucuuaccuucaaauccuaaaauacaauaaaaugcuauauaacuguauguucaguaauuaagucacuuauuucagaauaacgagggauaucaaaaauuuuggaaagcauuucugaguuuaagguuaagaaacacaaaucuaguuuuacccucucauuuugcauaugaaaaauaguuaaucuggauagguuugucuuugaagucaaaucuaaguuugaauccuaacuaccaguuuauuagcuguaucagugugaggggaagggagacaucuguaaccucuuuuucugugucugaaauaggauuaaaaacucucuuccucgaaaaauuguugaguauuaagagaacuggcauaguaguagcuaccauuuauugacuacugccuauauaccugauguuugcauuuauauacauucucguuuaauucuuacaaaccauguguucugccauucauuauauuacuauuucggauagguacuaaagggaaaaaugagaugucuaauaaugggaguauaguuaaauuaugaccuguuucuagauauagaauaucaugcaaaugguguucugugaagauuuucuguuaguuacuuggaaauugcuuaucuuagauaaaaggauuauauaucauaggauuucaaauaaaggaaagaaugcagauggaaaagcuucaaaauauuuacugaaguauaguuuuguguuaucuuuaugcuuuuuugguuauuuuucaaaauguuagcaauguguaugggaguugacaaagguaaaacagauuuuuuaaaaaucaguuguuuauauuggcuguuguaaauugauuauggaaaauuuuguucauacacaaauguagaguguuaggaacuuucaugcaccuaucucugauuuucaacaaugauauauagcuuaucauguuuuuuauauaugccuucccuuccuuguccccacaagauuuuuuaaaucucagacauucugucauuuaaugucuuuccguuuaucgugacaaccagaagaaugccccuauauauuuccaaaacaccuucuuggcagcaauuuccuuaucuguugagauccacugcugugggacagugagguagagugguuugaagaugugauucuuuucugaauuuggacugauuucuugagccagucuuuuaauguagauuccugggcccacucugaagcuuuccuauuuggacagucugguaaagccuaagcauacuggugauuuugguaaagaucugagaauaguauaaguaaguguuucuuuauagcaugaugcucuuuucucuugucugguuuuaugugucuggucccuggaaagccuuucuucagguuuuaucggcuacuuucuuuaguagucuuucuuuaguuuucacuuagggaaagcuuucccugacuucccuuuaugcuuccuuuggacuucaugguuuuacuugacucucauuggacugcucaccuucagggagaguugugucuuuuaucuuugauuuuccacaguacugcuuguuaauaaauauugaauaaaguaagugggaaggauggucaguauaauacagauuaaguauacuuuauccaaaaacuuuuuuuuuuuuuaaacagacagacuugggaccagaagugucucagauuucagauuuuuuuuucuuuuuuuguuuuuuuggauuuugggauauuugccuuauauacuuaaugguucagcauuccuaauuugaaaauccaaaguuggaaaaugcuccaaugagcauuuccuuugagugucauggauacucaaaaguuuuggauguuggugcauuucauauuugggguauuugcauuagagauacuccaccgcuaggccaagaauaugagauuggcuguguauacuguauucaacuagaaagaaaggaacaggacugaagauagaagucugaggaauggauuauuuuggacgugguaagagcuaacuguggcucgaacuaaauuuggucucauuaacauaaaaagaauaaggauauugggaagcaaugcauuguuaggccuuagcagaggaucgaauauaggauaugugcaccuauaguaggaccuuuguguuagagaugaaguaauaaucauuucuuacuaacaucaagauacugacauaaaaaggaugcaucucuguauuguuuugaauuggggauuuuuuguuuuguuuuguuuuuagaggcgggauaucacucugucacccaggcuggagugcaguggugugauaauagcucacugcagccucgaacuccuggacucaggcaguccuccugccucagccuccuggaacauugggauuaugguguuugaauuguagcgucuguaguaggggccucuaugagguaccuguagaaacuagacuguauggugcugugcaaacaacuguaauacauacuuauuuuauuuuuauuuaguuuaaggaagaaaucucuaaacguuuuaaaucacauacugaccaacuuguguugauauuugcuggaaaaauuuugaaagaucaagauaccuugagucagcauggaauucaugauggacuuacuguucaccuugucauuaaaacacaaaacagguaugguuuuggaagauguacagcuuuaaaauuguggauaaauguucguacuucuaaaaguaacuaguguuggcuguaaauuacuuucccugucauuaauauuuaaauaguuaaaauucuuuccuugcugucgauaacaauuuuuuuaaaaagugugauuccauguuaaugcuuacgugauugucagauaaccauuucauauuuuacaagguucauugguauuuaguuauuauaccuaaauuauuugcauuagaacaggcaaguuuuuagcuuuucuuuuaguaaggaaauuuuuagacaaagaucaugaguaacuuaucuccuuagcaaaccacgaauugauaaucauauuucuuuaagucuaaggaacuuuuuuuuuuuuuuuuuuaagagacagagucaugccauguugcccaggcugggcucaagugaugcucccaugucagccugggacuguaggugcgugccacaguguccagcuggcaccaccaguuuuaaagagauaccuuuguguaucacuaagaaagaauacugcuaacugaauugauguuuucuugucacuuaaaauguuuauuuuauacuuagugaaagagcuccuuuagacuuacauggguauggaauuuuaucauaucacucuugcauaacauacgaagacuuaguugucaguguccauauuuuuucauacaguaucaaacucuguucugucaagaguguuggugguguagcauugcuuaaaagagcucuccaguauuuucuccaggauuuuguuccaagccauuaacacuccuguaaguuuuuaugcuguuguuuaccaacagcaaauacuugcuuuacucauucaacauauuccuucuauuuuggugcuauucugaauacaugguaacuucugucagugccaauuaauaguguaauuauuuugaagacacuuaaugugguaauuaagcccguuacauaugauacaacaguguacccaggcauucaguugaagucauguagacuacaugugcaggcauguaguugaugccuggcugucagcaauuguaagacagauccugauuucggagauguuaaaauagaaaaaugugugccuuagcuaaauucagggaaagaagcaaugaguggcauucaaaacucuuaucugguaucaucuggaaggguuuuuuuuauuuccuuacuuuuuuuuuuuuuuuuuugagacggaauuucacucuuguugcccaggcuggagugcaacggugcgaucucagcucacugcaacgucugccucuggguucaagcgauucucccgccucagccucccaaguagcuggaauuacaggcaugcgccaccacgcccggcuaauuuuguauuuuugauagagacgggguuuccucauguuggccaggcuggucacgaacuccugaacucaggugauccaccagccuuggccucccaaagugcugggauuacaggugugagccaccuugucuggcuuauuuccuuuuagagauaauacuaaguaauaaucaggccaggcgcgguggcucacaccugaaaucugagcacuuugggagggugaggugggcagaucaccugaggucaggaguuccagagcagcgugguaaacauggugaaacgcugucucuacuaaaaauacaaaaaauugcccagcacaguggugugcaccuguagucccagcuacucgggaggcugaggcaggagaaucgcuugaaccugggagguggagguuacagugagccgagaucaugccacugcaccuccagccugggugacagagcaagacucugucuuuaaaaaaauaaauaaauaaaguaauaauuauuaaucauauugauuuguuggcuuucuuuuggugaagucucucgcuuuuuauuguuuucaagaauuucaagggccagaguaaaacuggcucauaacccucaagaacuagaaggggauagauaaaaaaguuguggguuuuuuuguuuguuuguuuguuuguuuuucaagagucucucucugucacccaggcuggagugcaguggcgcaaucuuggcucacuacaaccuccgccuccuggguucaaguagucuuccugccucagccuccugaguaccugugauuacaggcaugugccaccaugcccggcuaauuuuuguauuuuaguagagauaggguuuuaccauguuggccagacuggucuugaacuccugaccucaguugaucgccugccucggccucgcaaagugcugggauuacaggcgugagccaccgcaccuggccaagauaaaaaaguuuuuuauauagucaagcuuuguggguguaacuggucauuggcuucccucuuaugagauaaccuaccuccaucucuuacauaagcaauaugauugaaacuaaugaaauauuuguguacauuauacucaaagaggaggggcaauugcagcauauuuuguauuuuguaggguuuuauuuuauuuuguauuuuuuguuccuaaugcuuaguuuucucaggcuuuuuacuaaaugauaauuugauuuggucugagaguuuacccuuuauuucuagaugucaggauuucagugguucuuuuuuuuuuuuuuuuuuuuuugagacggagucucgcucuguugcccaggcuggacggagugcaguggcgcgaucucgcucacugcaagcuccgccuccuggguucacgccauucuccugccucagccucccaaguagcugggacuauaggcacucgccaucacgcccggcuaauuuuuuguauguuuaguagagaugggguuucacuguguuagccaggauguucucuaucucuugaccucgugaucagccagcuucggccucccaaagugcugggauuacaggcgugagccacugugccuggccuuuggugguucuuuuaaaaauaaucagcucuacugcuuacucugugauuaauuauuuucccuaggccucaggaucauucagcucagcaaacaaauacagcuggaagcaauguuacuacaucaucaacuccuaauaguaacucuacaucugguucugcuacuagcaacccuuuugguuuagguaagugucuuuagucauuccaguagggaugggaaaaaauacuccuuucccuuccuggguaguuucagauaaaaugagaaaauaaaacauuaugucacuuuaacaacaaaaauuaaaaaaaaaaaacauacauuccuauaauuguagauauuaaggaaguaguuggggauauggauauucuuacauaucaguuggcgccuuucuuuuuaaugaugaaagagauguaguuuguguauaccugaucugacuaccacauaauuuaguaugaguaagauuagcugguuauuaaucguaagccagcgucccugaauaauaauuuuuucauuuguaaaaggaagggaucagacugcauuaguuauuuuguaacuguccugaacacauggaagggggucugggaagccagccucgccuaaaacugcuuuuguuuuucuuauauuaguuuuuguuuguuuguuuguuuguuuuuuuaagagaggcaggaucuugcucagucacggaggcuagagugcagugaugccauccauagcucacugcagccucaaacuccuggcuuacgguguccugcuggugucccaaaaugcuggguuacagaugagagccacugugccuggccuguauuagauuuauauauugagguucuguggaauauauauauauauauuuuuugagacagagucuugcucugucgcccaggcuggagugcaguggcgcgaucuaggcucaccgcaaccucugccuccuggguucaagcgauucuucugccucagccucccgaguagcugggauuauaggagugugccacuacgcccggcuaauuuuuuuguauuuuuaguagagacuggguuucaccauauuagccaggauggucuagaucuccugaauuugugaucugccaaagugcuguuauccauuuucuuuugauaauagauagccaaacucaguggcuuauuacaacaaagcuucauuucuugcugcauuuuucugcaugcuacgcuuuuuaccgguuuguaaggugcccauccauauagucccucagagacucaagcuaaugaaagucauuuuucauucugcuguauuauagcucuaccauuuggaacacggcagaagagacagcuacaggguuuuaaguugaaccugcuauacuuuggccagaaguggcauauaucauuucuuguaguccuuuggcauuucacauaggccuguccaagugcaaaagaaauaauaaggcugcaaaaugaaauguuuggugagcacugcuaucugcuacuguaguuagucauacugaaguuuuugugguuucaagaaugcauuaauacauuuauuuuugugcuuuuuguauaugguguucauugugccuaguauucagucccccuccuaaccuucuucacguuuccuugccaaaguauuuaugcuccagacucauuaaguguuaucucuucuucugaaaguagccauuccacuuggguuauauuaccauaauauccugugaauauucuuuacugaaguacuuagcaucuguauagacauuuauuuucuugucugucuuuccuacuagauugaguucugaggaugucuuucuuguugccuuauucucaauacauauguaacacagucucuggcauauauaaaaagugcucaguaagugagaacugaaugcauuuaguugguuauguaauuuuacgaaguaaacacuuugugguaagcacuuggucauccuguugcucuguuagguuucuccuugauugaaguccuccaaagagaaaucuauuuccagguauucccuggcucucugucuccuugacuggcaguaucagcccucuuguacccaguguuuauaggugaauucugcuuccuguuaauaaaacuuaaacuagucuuuuggaaagauuauuagaagcauagucugguguguguauuuauuauuucuuccuuuagcuggcauaaucuggacuguuuuuucugacaccagccaauuguccaauaccagcucuguguccaagauucagcuucauuucugauacuaccuaccuacaguuagugucugaucucacaaguuagcagacucaguccugcaagacugccccuacuucagauacuggucacaaguucuaggccaucuguacuucugacugaccagcucuaaguuggggguuccccugaccuccuccucagguucaauaauugcuagaauggcaccuagaacucaaggaaacacuuauguuuaccuguuuauuauaaaggauacaacucagaaacagacaaaugcuuggaagauaauuauuagggcacaagguauggguaugugggggauggaaguugggcucaaagguuccauccagguuuccucagcgcacaacccuccuaacacucagaugugcuuuucauuuugaguuuucuuaauuuuauuguugaagaauuugcauagagcucuaucuccaccucccuacccuuacuuucuugguggguggggcugaaaguuuuagcccuuuaaucacuuugucuuucuggugaccagcuccuuucugaggcuuuccaggggccuaagucacuucauuagcauaaugaucaaaagggcuuguaaugaauaauaaaagauacuccugucacucagaaaauuccaaaguuuuaguaacucaggaucaaggagaaagaccaaauauauuuauuauuauacuacauacaugaaaauauauuuuguugauuuuauuacuuuaauuaccaaaguguaaauuuuuggcuaauuucaaugauaggaauuaaauauuaguaauagguauucgauuuguuuuuaaaugauuucuuguaauagacuauugggucagcuaauacuuuuuugcaucuucauauuuuaugucauguuaaugauaaauuuucugacuuugauuuguauguuuuugcccuuuauccucuuagguggccuugggggacuugcaggucugaguagcuuggguuugaauacuaccaacuucucugaacuacagagucagaugcagcgacaacuuuugucuaacccugaaaugaugguccagaucauggaaaaucccuuuguucagagcaugcucucaaauccugaccugaugagacaguuaauuauggccaauccacaaaugcagcaguugauacagagaaauccagaaauuagucauauguugaauaauccagauauaaugagacaaguauguggaaaguucuuucaguucguuuagcuaaaaaaugauauauuuguuauuuaauuuucugugguuaaugagauuguccuguauguaugguuaagcuaaagagagaaauccuuaucuugguuuaagaaaacucaacaaagcgcuaauuuggcuguuugaacucugaauuuucuguuaaauugaaggaucuuuguaaauaguuuauuuugaaggcuuaagaaucaaaaaguccaaugcuggagaugggaaauucacucauaacaaagugcuuccuucuuuauguuauuugaaugcuaaguugcuuuuuugaggugaaauacaccagggauuauuuaaaauaaccuccugccuuauauguugaauacaaaauugcaacaacuuuaaagcuuuaauugguuuuuauuugugauucuagaaucagacaacaccucauuuuauaaaauagaguguucucaugagcugagcagaagagguuggcuuuauaggcauaaaagggcugaagaaagcaaaaacgaacaaaaagcagaugggucauuucgaaguuacuuuccuaauaggguuaaaauggagggaacucuuucuuguuacagugacucacguugacugcagcuuacuaugguuuugggggggaaacuggccccuuucauaguucacuuugauuacauggcacuuggcacaaguggcucuauuuugguuuguuguggucugcuggggcauagugcaggaggcugguccaaaacaguggccuccuggccgggcgcgguggcucacgcuuguaaucccagcacuuugggaagcugaggugggcggaucacgaggucaggagaucaagaccauccuggcuaacacggugaaaccccgucucuacuaaaaaauacaaaaaaaaauuagcggggcgugguggcgggcgccuguagucccagcuacucgggaggcugaggcaggagaaugggugugaacccgggaggcggagcuugcagugaaccaagaucaugccacugcacuccagccugggcgacaaagcaagacuccgucucaaaaaaauuaaaaaaacaaaacaaaacaguggccucccauaaacuuuguuuaauggcaguuaauaaaguaauuaauguaauucauguguauuucaaugccuuuuuuuuuucuuuuuuuggaaauauuuuucguagacguuggaacuugccaggaauccagcaaugaugcaggagaugaugaggaaccaggaccgagcuuugagcaaccuagaaagcaucccagggggauauaaugcuuuaaggcgcauguacacagauauucaggaaccaaugcugagugcugcacaagagcaggugauccacuggcuccaagguucaggccaaggaguagcuucuguuuuaacacaaauauguguaugauugaggguagcuuuuauaugaggaaugugguuuucaauuuuuaaaaaguucaguggccgggugcaguggcucacgccuguaaucccagcacuuugggaggccgaggcggguggaucccgaggucaggagaucaagaccauccuggcuaauacggugaaaucccgucucuacuaaaaauacaaaaaauuagcugggcgugguggugggcgccuguagucccagcuacucgggaggcugaggcaggagaauggugugaacacaggaggcggagcuugcagugagccgagaucgcgccacugcacuccagccugggucacagagcgagacuccgucucaaaaaaaaaaaaaaaaguuucauaucuuauuuaaaacaaaagcuuauucuuugugauuuuuuaugucuuuuauuacaguuuggugguaauccauuugcuuccuuggugagcaauacauccucuggugaagguagucaaccuucccguacagaaaauagagauccacuacccaauccaugggcuccacagacuucccagaguucaucagcuuccagcggcacugccagcacuguggguggcacuacugguaguacugccaguggcacuucugggcagaguacuacugcgccaaauuuggugccuggaguaggagguaugcuuuuaacaacucaggcuuuuuucuuuguuguccucauuuacauaauuaaaacauuguuuauacucuuauucuuugugcuuuuguguguauguauagugaguaucuuuuauaaacuauauuuuucauguugcuuuuguuuuguuuuguuuuguuuuuuugagauagagcuucgcucuuguugcacaggcuggaguacaauggcacgaucucagcucaccgcaaccucuuccuccuggguucaagugauucuucugccucagccucccgaguagcugggauuacaggcaccugccaccaugcccggcuaauuuuguauuuuuaguagagacaggguuucuccaucuuggucaggcuggucuugaacuccugaccucaggugauccgccugccuuggccucccaaauugcugggauuauaggugugagccgcugcaccuggucacauuuuguuuuuuaaaggaagcuuuaaauguagagagaacacuuauuuacuuguguaguuguuacuaguuaccuguguaguuguuacuagagcacauguuugcugucuuuagccugguuuuguauuuuagaucaguagauugucaagcacccgucuugaggucagggcuauacuggcugcaucagagcaccugccagguuuauuaaaaaucagauucccagaucuuacccucagacuuuguggagccaaaucuuucauagugggguuaagaucuguguuugugugaagcagauucucaugugugaacagguuagaaauuuacuuuuguccacuuuucuguagacugaacucagaugucuuccuuucagcuauucagauacuacaugcggauguuuuguccaugaauuagguccaagaucauuagccauagugacaauuuuaguccuaauacuuggcguauaaguaggaagaaauggagacaugggagcacuucucuaagaugagauagacugggcauguuuuaaaagaugccuguacuuuggcagaggaaguggaaagaugaggugcuggaugaagaauuuuuaaaaauucauugcugaaagaagaaucagaaugagaagaguaauuaaugaucacaguugauauauauucuuuuauagaauacaguggauaucuugagauuuauguuuauaauauagguuuuguaaaaccugaaguaauaccauuuuuaaaucaauaaaaauauucuguucuauauucuacuuaauccuuacuuugauacuaacaaucuuuugagaggguugcaauguucuuacuuuaaaggguauagagcaggcaaagauuuaaucauauuuccugacugguuaagcuguuguuuucuuucccuuuaccaugauugucuacaguaauaacuuuugucuaaaaaaccaaaaaccaaaaaucaguuuugcauccuuuuacucagauacuuaaugguuugauacuuuaacauuucauguuaauauuuccaucaagggaaaacaagaacuagcaagaaugaacuuacucugcuggccuaucagauugucagcauauuuguacaguauuaugauucuuacucaacugugacauuugaugcauacauauaugcacacauacacauguaaagaugaaauucuugacucuucuuugguccuguaagcaccuacucuagaauguaaggaaguguuagagcaggaguugacagauuuuucaugugaagggucagauaauacuucagguauuacuggccaagaggcaaaauggagaauguauuacaucaagagacaaaacaaauucccacaaauuuuuuaauugaaaaaauaaaaaaauugguaauauuuaguuacaauauuuuccuuguaucuacugauaagaggaaugggacuucuuugggggaauaacauuuugcauaauugggguucaguguucuguuuaccagaauugcaaaguucaucuguuaauacugauauguagugagacuugacugacuuauucaaaauacguacucauuccaaaagcauuugauuuuaauagcauauuuaucaguguggaaggcauuuauagaauuccauuagauaauguuguuuuuaacaugccauuacauucagauuaaucacuucaaagugaaagguaguagcuccucaauugcacaguuaagugaacuuugaaugucaguugccuuugcauuugcauugaggucugaaaaauguugcuggugguaugagcucaaaaguaaaucugcaaauuugugagaauggaggucuugcuucuugugauuuuuuuuuuuuuuugacggcauaggaagucuguaaagcaccuugacauugcuugugauucaaacaauuuuaguugucaaaaugacuuuaguaugaucacacauaaaugcugcuuugcuuuguaguuuuagguugaauucaugcauaagcauuaccaacucucuaacaaaaacgaauucauauaguaauucaauguuugguuguuggaggguuggcaggguagugguucucauuuacuaaaauuuuaaucuuuggcaugagcuaauaaaauaaugcaaugaaacuuuaccucugcuaagccaccaucaaccuucugugugguuaggcaugucagaauauugaguuauuguuaauaaaaauucaugaaguugacugguuaaguuuacaggaguuaacagugcuccucauugauacuccugguucaguaacaugauagauccaaauguuuuccagaguaccuacugaugaauaagacagucaauaacuauagucuuuaaauaccuuacauuuuuauaugcuuugaaaauauguccaacuaagucguuuuaauucugcacguuuuugcugccaugagauguagcacaucuuagcagauucuacuucaaguuguaccaaauucuuauuucucaacuuuuuaaaaaauggucuuacccugguuguuccauucagacuauuuauagaggguaauuuuccggucacuucagacuuaccauugacuccccauacaauugagcaguaucaguaacaucugucagcuuaucaagaacuuagaaauagcacucagaaucauuugcguuguuuuuaaauugaguauugacauccuuaacucugagaaaaacuguuccuccugagagccgaguagacuucagugaguuuauuuucucuggacacauuugguuacugcaaucaagauuuaauuaacuguuaaauuagucaucacuaguacuuggcuuccuuuggcuaacaagccacuuggaaacuuaacuuugguugcagucuuauuuucauuuuuauuuuuugugaaaaaguggcuaugaugagauauuucauucuaaaguuuauauuucuucugaccauugcuuuucugugaguggggaguauugugaugagugguugguccggcagugcuuauauauguuguauucuuuuagugucauugcauaagaaacacaaguuuugccaucucauuuaguaaaauauauuccacugugccuuaaaaaccugacauuuguaacucuccuucuuccuuuuuucuuguucuggcaugauugguauauacugguuauuuuuuuuuuuuuaaugcugcagugauuuugugcugcaugaguauaacugauucacuguguuuuguaguaguauacugaacaacaguacgaaggaggccagguguggcaugguggcucauacuuguuaucccaggacuuugggaggccaagguggguggauugcuugagcccaggaguuugagaccagccuagccaacauggugaaaccucaccuguacaaagaagacaaaaaguaaccgggcauggugugcagcuguaguacagcuacuugggaggcugaggugggaggauuaccugugcuuagggagguuaaggcugcagugagcugugauggcaucaccgcacuccagccugggagacagagcaagacccugucucaaaacaaaacaaauaacaguaugaaggagugacaguaccauagacaguuucuguugcaaguacucacugcuuuuguaaaagugcaaaacacccauagacaauaagugagaaugacuguuccaauaaaaugguauucaugggcguugaaauuugaauuucauauaguuuucacguuucacaaaauauuuaucuuggauuuuuuuucccuuaacuauuuaaaaauaaaaacguaagcgcaguuuuuuuuuuuuguuuuuuuuuuuuuuuuuuuuuaaaagaccgagucucgaccugucacccaggcuggagugcaguagcaugaucacggcucacugcaaccucugccucccagguucuagagauucucgugccucagccuccugaguagcugggauuauaggcacccaccaccacaccuggcuaauuucuuuguuuuuuuucuuaguagagacaguguuucaccauguuggccaggcuggucucaaacucccgaccuugggugaucugucugccuuggccucccaaagugcuaggauuacagguguaagucacugcacccgaccaaaaauuguuuugguuuuuugguuuguuuuguuugagacagagucgucgcccaggcuggagugcagugguauaaucuugagucacugcaaccuucuucuccuggguucaaacgauucucccuucucagccuccccaguagcugggauuacagguguguaccaccacacccagcugauuuuuguaucuuuaguggagacgggguuucgccauguuggccaggcugcuugaacuccugaccuaaaaugauccacccgccucagcgucccaaagugcuggaauuacaggugugaaccaccaugccuggccuugaaacauaaaagcaauuuuuaacucauuagcuuagcagaaacauguuguaggccagauuuguccugcaggcuguuauuugccagccuaucuuagaauacagauauaccucauuuuguugugcuucacagauagugugauuuucacaguuugaagguuugcagugacccugcauugagcaagucuguuaguaccauuuuuccaacagcaugugcccacuucaugucucugugucacauuuugauaauucucacaauauuucaggcuuuuucauuauucuguuguggugauucuguaaucagugaucuuugauguuacuuuaguaauuguuuugggguaccaggaaccaccuuguaccuggcaaacuuaaucaguaaauguauguguucugacuguucaacugacuggcuguuccacuugucucucuuccucuucuugggucucccuauucucugagacacaacauugaaauugggucaguuaauaacucuacaguggccucuaaguauucaaguauaaaaaaagacuccugcaucucuuacuuuauaucaaaagcuagaaauaaucuuguuuagugagggaggcauaucagaagcuaaaauaggccaaaagcuaggccucuugcaccaaacagccaaguugugaaugcgaaggaaaaguucuugaagaaaauuauaagugcuacuccagugaagacaugaaugacaagaaagcaaaacaacuucauugcugauguggagaaaauuguagugaucuggauagacgaucacaccagccacacuauucccuuaagccaaagccuaauccagagcaaggcccuaacucucuuuaauucuaugaaagcugagagguaaggaaucugcagaagaaaaguuggaaaguagcugagguugacuggcuuauguuuaaggaaagaagccaacuccauaauguaaagguacaaggugagguagcaggugcuguuguagaagcugcagcaaguuauccagaagaucuccuaagaucaucaaggaacguggccacaugaaacaaccaguuuuuaauguaggugaaaaacagccuucuauuggaagaagauaucaucuagaauuuucauuucuggagagaagugaauucuuagcuucaguucuucaaaggaaaggcugacuguuggggcuaaugugucuggugacugaguugaagccagugcucauuuauuauuccaguaauccuagggccuuaaaaauuaugcuagaucuauucugccuaugcucuguaaacaggaaaaaaaagaaaaaaagaaaaaaagccuggaugacagcacaucuguuuacagcaugguuuacuuaauauuuuaagucuacuggugagacguugcuaaggaaaagauuccuuucaaaauauuagugcucauugacagugcauguagucacccaagagcuuugauggagaugugcaaggagauuaauguuguuuuuaugccuguuaacuaacacagcauucauucugcaugcagcccauggaucaaggagcacuuucaacuuacaagucuuauuuaagaaauacauuuaauuagacuauagcugccuuagugaguccucuaauggauuugggcaaaguaaauugaaaaccuucuggaaaggauucauucaccauucucaaugucauuaagaacguuccuaauucauggagaggaugucaaaauaucaacaugaacaggaguuuggaagaaguuuguucugucccucauggaugccuuugagggguucaagacuucuauggaggaggggacuguagaaguaguggaaauagcaagagaacuagaaugugaaguggagccugccagguguguuggcucauaccuuuaaucacggcacuuuggaagguucgggcaggaggaucccuugagccuaggaauugcaggcagcagugagcuauguucgugccacuccccucacuccagccugggugacaaaagcgagacuccaucucaauuuaaaaagaaaaaaagagguggagcaugaacacugacugcguugcuacaaugccaugaaaaaacuuguacagaugaggaguugcuuuuuguagaugagcaaagagugguuucuugagauagagucugcuguaagugaagaugcugugaacauuauugaaaugacaacgaauucagaauguuucauaaacuuuguugauaaagcaguggcaggguuugagaggauuggcuccaauuuugaaaguucugcugugguaaaugcugucaaacagcauagagugcaacaaaguuuuccugauguggcaaacuucaucguugucuuauuuuaagaaauugccacagccaccccaaccuuuagcgaccaccagcugacucacuguuagcagcuuucggcaauaaaguauuuuuauauuuaugugcagaguuuuuuuuuagaccgaaggcuguggcauacuuaauagacuacaguaucaugcaaacaacuuuuguaugcgcugggaaaccaaaaaaugugugugacuugcuuuauugcacagcagucuggaaccaaacccacaguaucuccaagguuggacucuaggaugugaaaaaaaaacuaaguuaaaauuuacaacaugagaaaauaggaaaaacaagaacuauuaaaaacagaauuauaauaaacuagaaagauaagugagaagagucagaugucuuaagccugauauaacuggauggaauagcagaaaggagaugaaaaaccuaaugaguugacuuggcauaguaaguuugagaauauauuugaguuugaguguaucuaguuggcaguugaagaucuaggugugagucaagcaaauuaacuuaguuuucaaagaaaauuugccuaaauauacaguugucaucacauauggaauucacauaaauucagcuguagcccuuggcaauaaaaggaaaaacaauaaucauaagugcuuuguacauuaauuuucuuacaaccacccuaugaaguagauacugcuuucuccauuuuacagauggggaaccugaaguaugaagacgcuagauaacuugcccaagaucacauggguuagauuagauuugaacccacguaaucaggcuccugauacugcuuggagucacugugcucuaugguuucaaauguuaaaugugccuaccauuuuacucagugaguggcaguacacagugaaaauggguggaggcauuacaucuuuuguugccuugggcaugaaggcuuacuucuuucauaagggugggcaauauuaagugccgaauaugauucuaauuaauucuuugcagucuuggaggaaaaguuggcucaguccuuuucacuuuauggaauuuuucagcaguaauuuugaccauacguaauuuuugccuuaaguugacuucagaagcuagcucuucauuagacaagauuuuacuguaaaugcagaauguuuaaacucaucaguccucuuuuccugguauauguugggcauguacuuuuagagauguuuuaguuuuaaaguucuuucguaguucaguugauacauaauauguauaaucauuuguacuuggugaaauuaaacacagugcauauuauauuuuaaagcuuuaacuuuuguuuaaguauuuuuccuuaauaugucuuuuuuaaaaacaaacuuucagcuaguauguucaacacaccaggaaugcagagcuuguugcaacaaauaacugaaaacccacaacugaugcaaaacauguugucugcccccuacaugagaagcaugaugcagucacuaagccagaauccugaccuugcugcacaggugaguuuguaauuguauugaaaaagacugugcagugugaauuaaaauaaccuaaucuuguaauugugauuuuggcacauuuguguuguguaugauaucuuaauacacuagaaaaauaaguaaacugugucuccaauuuuuuagaccguguguuucuuugcaguaaauuaauacuucauauguaauuaaaacaacuuuaucucugccauucauugacuagaaagaagugcagguuuaguuuguuucuacauauguugaguuaggagacaaguacagaguucuggaaugcccacucuuuugaagauaaacuacuuaaugaaauguaaaucuugaaagcaauuaagagcaauguuaauacauuugaaauacuuuuauuuaguagaucacucagauuauaauagucaugcucagaauggcaguuguaaaauagcauuuauuaaagacgggaauuugucagaacaauguucuccuucuuucaacuauugauuccccugcugaaaaucguauacaggucccuuauuaauguauuccuuuuucuaauuuguuucuaaagagaccacagcuaagaaaauuggggaucuuaaugcuggcugaacacucaggaucacuugggaagcuuuauagacaguaccgaugguuggggccucauccuuagagauuuugagauaauugcguccgauaacccuuucucccucaaguugccuagguacuaucuagguuccauaccacagggcuugaaaaaccacggagaaugugaaauaaaccuugauaaucuguaguuuauauuugcuguucguuaaaaauggcuucuguagugugucaggaauuuggaagacuuuauaguuaaucucaucccuuaaauuuuaaaagcuuuaagucaaaugaaugguuuuuauuuucuaaauucuaaaacuauauugauucagguaucuuuguguauaauucucaguaauaacuuaugcccucaccaaauuuguggaauuggaaauaacaaauuuuaagaagaauuuuugugucugugauucuguauauuggagguacauuuuauggaagauugauuuaugcauaugaaacuuaucagacugaguuguuaguauuaaaugcuucaauuuaccauaauaagccauuuuaaguguguauuuggcuaauacugaaugugcaucuugcuuuuaaaauuugacuuuaacaagcacaugcguagcaauuuuguaauaaucuuacuuuaguaaagugacuugagcacucacauacuauuuuuuuacucuaaaacaaaauguugcuaguacuagauuggcaugucuuuuauuacagauaauuuagaaacuuuuacaauguucuuguuaucugcagauuaaaauuugugguuuuucuauucuuuugauuuuuaaauauuuaaaaagacucuugaguguaaaaacuugugguauaagcacucagguaaguuauaagaaguaucuaauaagaugauuaucugugaaaggauacguuuaagaugacaugcuuuuuuaagaugaaaugaagugaauuccaaaagauaugugugauaaccucguuaauauguugaugauaaguauuuggaaccaauaaagaagcagguuuguugaccuuaagccuguaugaguuuacuuacugugaacuuacuggucacuuugaaauaaauacuguauguuccugaaagguugucugacaucugcuuuuguuauuguauugaaauuaacuaaaagaucacuuugcaagaauuggggcgaauuuucucuaccagcauuuacauugcucuuaaauacgguuaacuucuugagggcaaggaucauuuccuccccagacuuuggauagauaaauaggcuaucaguaaauccuuguuaguugacuuuuuacuccgccuggggaaaaugauauaaaaugugucuuuugaagcuacaagaauuuauuagcucugguuaugcuccuuguguauuuuaaucuuauuuucagguauaugacaucauacuaauaaugauccugauuuuuaaauucuuaacguuuauuugaaguuuaggagaugccacuuuucucaucucugguaguagugaggugaaauccagaugcuaaucuugguguucucaaauggauuuacaucuuuuaggucuuaaaucauuuuaauacuuuucccagaggacuguuggugcuaggccugacugauuuucaccuagcagcuccauuucucuggcaaguugguugcuguuuugcgguguuauuuuuuuggaccuaauauuagcuguuuuguaguaggcagguagauguagugguccuuuucagaucuagauuuucucugugccugccacuuguguguugagguuucuaagcaagccauguuacauaguucauguauugauguuuauguuuauucugccaguguaguagaaaauauaucuucaugaaugccaguuacucccauuuuucuuucaauggcauauauucacguuuguucaaggaaaagccuaagaaaaugauugcuuuuauuuuuuaggauauugcaugucauuaucauaaccaccauucucauugagagagaauaugccucauuuuuuuguuuuuguucuucuggagaucccucuuguggacaguaucuucccuuuuccuuuuuuuauuuauguucuaccuuccucccuuuuaagugccagcugaggcacuugggggaagauagaauaaaacaagguacauuacuuguuucagauauuuccaguuaaaauuguuugaacacuugccccauagaugaugcugaauaauccccuauuugcuggaaauccucagcuucaagaacaaaugagacaacagcucccaacuuuccuccaacaagugaguaagacaagauguuagcuaucuuggguaaugauuugcuugaaaaaauuugaugauaaacauuuuuccuugcucuucucuggcugauagcaaaacauagaauagagaccaauaaugcugucaauucguagagaauucagcuugaucuucacugagucccauuucacugcugaccuuuugcuuauguuucuuaaacauacauucugaggaaagaacauuuuguuuuugcuuuugaggaccuaggauuuugaaugcuuuguuaauaccauaaaccauuuccuuucauuguacuaacuuugaagugcuuccuugugucauguuacgcuuuaugguuuaacuaauuuugaguaacaggaaagagcuacccuauucuauuuuauagguuuucuuccaaauuaguagaaggcuuuuuuuccccaagggguagaucucauuuccucaaacucgggauuaguaagauuaaaauagucaguguugucauauaaggaaguaaggaagguuauaguauaaacgaguacuugagauugccaugguauuuuauuauuuaaaacgacaaaagagaagucagucuugguguuuugaaacugguaguucuagggccucauguauuaugcaaaugacucucagaccuguaaaccauuuuccaagguugguguccuugaucuauuguaaugauguaagccuaucuuugguuagucaggugguguauauuuggaaguaguaaagcuaaacucaggauacauguauuaacgucaaauuuggaacuguuguuuuagaguguaccuuacugguaaaauuguuauauuaguaacagauaacacuugguuagguggaauauguggcuuuuuaccauauccacgucguaagaauugugccuuuggagguugugucuuagaaguaauacuuuaucuucuguuggagaaggggaauaguuguggcuuccaaaguagcuccugauuuucuuccauuauggaaauggcuuucaugauggacuuaggaggaggucaaguaauaauuugcacacuagguuugcugucaaagaggagauacuugcguuuauuuugggaaagaaauuauggauuaccaguguccaggaguaagguuuuagauuuucuccagaagcauaacagagaaaagauuuaaaaauuuacguucacugauuuuaauuccuuuguaaccacuaguuuucuuucuuccuuagaugcagaauccugauacacuaucagcaaugucaaacccuagagcaaugcaggccuuguuacagauucagcaggguuuacagacauuagcaacggaagccccgggccucaucccaggguaggcuuauuuggggaagauaaugaaaguguauaaugguuacuuucucugagaauuucagauuuaguauuauucugccugccuuuuuuuuuuuuuuuuuuuuuuuggugggauacagggucucgcccuucgccuaggcuaugagugugggggcgcaguuguggcucacugcagccucgaccucucgggcucaagggauucucucaccucagccucccaaguagcugggacuacaggugugcaccaccacaccuagcuaauuuauauauauaauuuguuguuguuacuguuuuuagagauggagcuuugccauguuauccaggcuggucucaaacuucugggcucaagagauuuggccucccaaagugggaucagagacaugagccauagcaccugguucucccccaccguuuuuauuuauuuauuuacuuauuuauuuauuaagagaucgguuuuugcucuuuuacccuggcugaacuugaacuucuaagcucaggugauccucccaccucagccuccccaguaguugggacacagugccuggcuaugauuguuuuuaagucaggguuuucaaaguuaaaaaugauuauuauuauuuuuuaaauuccuuuuagagauagucucacuccaucgagcagacuggagugcaguggcgcgaucucagcucacuucagccucuaccuccugggcuaaagcaauccucuuaccucagccugccaaguaacugauacuacaggugugcaccagcacacccagcuaauuuuguuuuuauuuuuuguagagaugaagucucaacaauguugccuaagcugaucucaaauuccugggcugcugggaucaucggucucccagaaugagccacugcaccaggccaaaagggcuuauuuuaagaagauggcuuagcuuauauuaaaauguaacugauuuacggacuggcuucugguuuugcaggaccuuaggauauuuccuauuugugcuuucuguagguuuacuccuggcuugggggcauuaggaagcacuggaggcucuucgggaacuaauggaucuaacgccacaccuagugaaaacacaagucccacagcaggaaccacugaaccuggacaucagcaguuuauucagcagaugcugcaggcucuugcuggaguaaauccucagguaucaguucuuuuccauucaaguuuuguauuccuuaauguuggaaauuuagaaauuuccaaaaagaaggaaaaagggagaaaaaaggaaagcaguaguucuuagguguuuagauuaaugaaaaauacagucuuaaggauauugaguaagaaaacaggcauuacaaaaauuguugacuuuggugcugagacacuaaaggaaacguuguuacgguuguagagaagacaugcuacaaccuaaagucuuauuuuuuagaaauugccuuuaaaaaugcauuuuuuuuguuccuauuugaaaaucauuugaaauagauuuugcuuuaaaaaaguucuuagggaggaauggaaacuugauuaucccaaguaccuccagggcagcuguauucuagucugucuuuugacuggaaaaaaguccuaacuaccuuaacuccacccaugacaccaccuccugcgguagcuuguguuacauauauauauaucucguaaauauggcuaaagaauauggacccccuaauaaugugguugcaucuacaaacauacauugguuuuacuaauaaugugccauuauauaaagaugaucgccaguuuaaaccuguuuuauuagguuguccccaaacuucuuaaugucucaaggucuguuaggugcuuucuguuuucuuuucuggguuucuuuuuucuuucccuuucuccuuuccccuuuccuuuuccuccuuccucuuccccuuucccuuuucccuuuccucuuccccuucccccuuuccccuuuuuccucuuuccccucuuugccuuucccuuuuuuuuuuuucuuucccuuucccuuuugacaaagugcccaggcuggaugcaaucacagcucacugcgaccugcaccuccugggcugcagcaauccucccaccuuagccucuggaguagcugggauuacaggcgcagaccaccacaccuggcuaauuuuuguauuuuuuguagagcugggguuucaaccguguugcccagguuggucucaaacuccugagcucaagcgaucucacccgccuuggccucccaaagugcugggauuacaggcgugagccuggccugcuuucuguuuucaagccuuacuaaauauaauaaauaggguaggguucugucucauacauaucuguauuccugauaagcuagcguagcauaguuucuggcucuugguagguacucaguaaauauucauggaauaaauaagaaagaaggauuuggaguauuagaauuaauugugacauaaguuaacuuacaagccuccaaauuaucagguaggccuaggauugauuggucauuuauauggagauuuuuuuuuuuaacuucauuucugaagaaaagauuugaugcugcugaaaugucagaauuaagaguauaauuuugggccugaaacugaagcucuuuucuaagaauugacuguccagugcaaaaauuaaacucacauucauucgaagaaucauugaagcuuuagaauuuuauacaugaggauaccagcuuuuauaguuacucaauuggucaguagcuacacaaaucaucuaauucugaacuaucuguguguguguguguguguguguguguguguguguguguguauauguauauguauauacacacacacauacagguuuuucugcauguacgugauccucuaaaauaaugguugauguuuauuaagcuuuucucccccuccccuaaaguagagucgugaucuauuugacaugauuauuuagguacaaacuagacuauuuaaaauaaacugcuaauggacuuuuaaauauguuggauaaguuucaagaggugggcaguguuuuuaaagcucaguagaucagcauauguuauaaaaaagcaauuaaaaaauuuuaaaagucauguguggcagggacuggcuuccuuuagaguuggauuaauuuuuuuuuucuuuaauagcuacagaauccagaagucagauuucagcaacaacuggaacaacucagugcaaugggauuuuugaaccgugaagcaaacuugcaagcucuaauagcaacaggaggugauaucaaugcagcuauugaaagguuacugggcucccagccaucauagcagcauuucuguaucuugaaaaaauguaauuuauuuuugauaacggcucuuaaacuuuaaaauaccugcuuuauuucauuuugacucuuggaauucugugcuguuauaaacaaacccaauaugaugcauuuuaagguggaguacaguaagauguguggguuuuucuguauuuuucuuuucuggaacagugggaauuaaggcuacugcaugcaucacuucugcauuuauuguaauuuuuuaaaaacaucaccuuuuauaguugggugaccagauuuuguccugcaucuguccaguuuauuugcuuuuuaaacauuagccuaugguaguaauuuauguagaauaaaagcauuaaaaagaagcaaaucauuugcacucuauaauuugugguacaguauugcuuauugugacuuuggcaugcauuuuugcaaacaaugcuguaagauuuauacuacugauaauuuuguuuuauuuguauacaauauagaguaugcacauuugggacugcauuucuggaaacauacugcaauaggcucucugagcaaaacaccuguaacuaaaaaagugaagauaagaaaauacucuuaaagcugaguauuuccuaauuguauagaaucuuacagcaucuuugacaaacaucucccagcaaaagugccgguuagucagguuuguugaaaauacaguagaaaagcugauucugguuaucucuuuaaggacaauuaauuguacagacacauaauguaacauugucucaacauucauucacagauugacuguaaauuaccuuaaucuuugugcagacugaaggaacacuguaguauaccccaaagugcauuugccuaggacuucucagcuucucccauagguaguuuaacaggcauuaaaauuuguaauugaaauguugcuuucacugaaaaagugucuugauguuucaguuauuuuuaaucgccauaaaaaaauagaacuaucuuuuggguuuaucuguuuucucaugcacaggcaauacacaaauuuaaaaugaguugugagccaauuguuucugaaguguuuugguaguucuauuaagaaauaguuaaauauugugcuuuucagagccucagagaaagggggacgggguggggggguggggcagcggaaucuguccuggauggggccagcuuaaauaauacuggcaaccaagauucuguuaggauuucugugcauauaguguaguaaagaaguaucauucaggggugaaaaacaaagagccguuuuaaugauguugaguacauuuggcuguuuuauagccuuuuucuucccucccccaaagaauucuguuugccuaacucccaaacuguuggggugguacauuccuuuaggaccaauuaaaacauaauugagggucagugauacauuuggcugacucugguucaguauucucuuaggugauuauauucucucauguacaguuacaggaaauuaaaauguuaaaguaaccuaaaaugaauucagaccaauaaaaucaagggaaauacaaguugauugcauuacuucuguauguugcuugcuauuaaaaagguuaagaggccagguuacccaccaguccuugcacuguucugacacuuuccccaggaggaaaacaaguacaaagguuacgguggaggcauaaguagaagagauuguuaagaaggguauucaugugucuuugcucuuucugcuuuaugccucaguuugguuuaaaaacuucuguacuggcaaauggugguauucagugugggauagugucauaacuaauuugacaauuuauuaaucauaaaauaacaauaaaucucuagcuuuuacacuuga

SEQ ID NO: 192429 - RNA, 78417 nt, Homo sapiens
gaggcucucacgccgccuccuccgcccgggcuucccuccacccuccgcccgcccgccugcucucagccgcgcucuccccgccccucaccgcagccugcagccgcgcucaccuccgcgguccgccccggcgccccgggacccguuagugcccagccugugggccgaccgcgacccccgcccggcgcgagccugcccccagcucugccgacacuugacccagaccagucccaacgcccagugcggccgcccggggagccgcgggagaggcggcggcggggggaggagggagaggagggccgagccggcggcacgggaggcccggugaguacgcggaggcgggcccgccucgcggguguccgcuccggcaccccggaggcguaggcagcggcucgacagcgcuccccucggcgccccggccucggguggcggggacucggccugaggcgacgggccccacugaccggagccgcugggcagagggcacgggagggccgcggcccgacgcucggcgcaaggcucggggcggcggggagggacucgcacccgacucccaggccggcgaccgcugagccucccgagaccccgugggggccgcucgagugacaggugccaccguccccuccccgccgcuggcgcccgcgcucccucccggggagccgggcgcucggaaauuucuggagcaacgaccugacucguuuucucccuuucagguuuugaagccgcuucucugcccgaguuagguuucgcccagcgcaauuucuuucucuauguacuuugcgaauaaguuucggagcaucgguuaacagccuaugggugaaauuuggcuuucauucaugaaugagguauagugaauuacuuuuugaauauagugcuccuccuccucccccgccagcuauugaaaagugauuuuuuuuucuguuauuguuuggaacagccuuaccgaauuuuugucagaucucuagcauuaaggugcuucauaaauauugaacaguaacgacaaaaauaguuuaucaaauuggcugauugccuuuucucuuccuccucuuuuucacucuuuaccuucgccagauuuuucagaguagaugcaagugcuuucauuagaagaacuaaugaaagaucgucugucuuacacuaaaaagccggagacacuuuucuucaccauuuagcauugucuguuguguaguaaaugugcuugggauuguaacuggaaucauuuaauaaaugugacuuguagcuauaaaaauauuugagaagcuuuuuggcaaauuaaaauauuaaaaaucuucauagaagucuagauuucuuuucucaacagauuuauaacacuauaguagcuucaauucuggaguaagagcaaaacccagaaguugaccaaaagaaccuugugugaaaauagauguauuuuacucgugggagaaucccucagguccucacugaguaccugcuuguauuuuuuguuuaacuuucuuggccugcagaaagugggagcugcagauuggagagggaucucaguacuuaacuaugagaaaaaaauggaguuuggggcauacccauuggguuuacaucacuuacaguaaguguguuuggagcagaguuuuaguaugcacuucacacuugcugauugugaacccuauuuuuuuuuuuucuugaggcggaauuuugcucuuguugcccaggcuggaguguaauggcgcgaucucggcucacagcaccuucugccuuccagguucaagcagcucuccugccucagccuccugaguagcugggauuacaggcgccuggcuaauuuuuuuuuuuuuuuuuuuuguauuuuuaauacagacgguguuucgccuuguuggccaggcuggucuggaacuccugaccucgugaucugcccaccucugccucccaaagugcugggauuacaagugugagccaccacaccuggccugugaacccuaauuuuuaagaagccaaagugaaagauacuguuugguuaucugaagaacagaacaugaaauaacacaauuuuuuauuucaccagguguuaaaucagugauacuuggugccauuucauauuacgcucaguuaauuucgaucuaaguuauauuucagugaggccacacuaauuggcaucuacauuaauaccuuuuuuuggucaggcuaauugguaguguuaauagaagauggcuaucauucaucucauaaaaaguaauauauuugguuguucuugauuuaaggauuuuauauguauaauuguguguguguguguguguguguguuuucugaaguucccuaauuguggucuucuggacugagauauggcugcugcugucuugauucuagugaggucauaguguagagggauaaggucauaauggcaaugugccuccaaaccuugauagaggccaagacuaccagccacuuaggaauucuucugcuugggucgggcuugguggugcaugccuguaaucccagcccuuugggaggccgaggcuggaggauugcuugagcucaggaguuugagaucagccugggcaacauagugagaccccauguauacacaaagagaaaaaaaaaauucuccugcuuguagcuuaggcuauucauuuuuagaagcaguuuacuuaagcagccaaugcauccuaguucucuuaaauuaacacuuuaguuuuucauuuuuuugagacagucucucgcucuguugccaggcuggaaugugguggcgcagucuuggcucacugcaaccucuaccucccugguucaagcgauucuccugccucagccucccgaguagcugggacuacaggcgugcgccaccaugcccagcuaguuuuuguauuuuuaguagagaugggguuucacuacguuggccaggauggucucgaucucuugaccuugugauccacccgccuuggccucccaaagugcugggauuacaggcgugagccaccaugcccggcuggcuuaaaucaacacuuuaaaaccagauaugcuuccuagacaaaauugguuguggcaauuaguuuguuagaauaguacuuaccguaaugaaacaacuuugaacugcuaauaauugcucaugcacaucugcguuaugggaauugaggauugucuauugugcacuucacauauuucuuuuucuacuuguagagcacauuuuucacugcauagacagcuguguacuugaagaauguaaacaugaagaaaacacuaaguucaauaaaugugucuucuaugugccagauccugugguauuuguaagggauagaaacucuugucuuucaggaucuugaaaucaggaucauaggggcuaggcacaacaauaaagagaauuuuuuuggaguccauucaauaauaguaaguuuaaaguauggaaauauuacagaggagggaauguuuaacuucaggaacaggucagagaacgcuucauagauaugcuagcaccugagcaggauuuugaggaauaaauggaaguuuucaguggaagagauagauggcauuguagacaaaagagaacagcauaguuaaagauaugaacaaguaaacuaauuguguguucaagaaauuucaaguuguuuuuucuuggaguacaugcaaaaucugaagaaagaggguugcuagagaaagcccuaacgcaugcuauuacauuuaauaagucaaauaauuggcuuuuuggguaugaaguauauguaaaauaaagacuuuguuauauuuuugacauugcugccaucuuuuuuuuuucuuuuucuucuuugacaaagggucucaggcuguaacccaagguguagugcaguggcacaaucacugcucacuacagccucgacccccaggcucaggugauccuaccaccuuagccucccaaguagcugggaccacagucaugcaccacuaugccugcuaacuguuguacauuuuguagagaagggguuuugccauguuucccuagcugaucuugaacuccugggcucaagcaaucugcccaccucagcccuuccaaaguaccaggauuacaggugugaaccaccauguguggccugcugccaucuuaaguauaaauuaauaguuuguacuagugguagucauuacauuauggaagauaguagaagauauauuuauuuauggugaacugccugcauauugagaauguguguuuauuucacauuuugcccugaaacauuucuguuuuuaaaauuaucgugugaauuuauuuugucuuccuucaacuauacauuauccuugaaauuaguuuuaucauuuauuuuaugagauacgguuuugcuauguugccugggcuggucccaaacuccuggacuuaagugaucuccugcuucagucucccaaguugcugaaauuacaggugugcaccacugagcccagauauccuugaaauuauuuuuaaaaggaacucaaagggaggaggggaaaaauauaaauaaaauaaucauuagauuucugcaccaaaaaccugauuuguguaguaguuuaauaauauguaaauguuuaauauacaguauuagccaccauauucauagacuaauuuaaguaacuuaauuggcaguccauuguauuuucauuugcauuguauggcuuaauuauauuauguguauauaaaugucuaagcauagaagcaucuaaauuuuaaagaccaaguguauuugaaggagaaaaaguauagagagggagggagaagagcuguguuugaaucuauuuauccuaacaucucuuagaugugacuguauguggagaugcagaaguuuaggacacaagacugaaggaauacuaacccuagccaugaccugaaauauaguaucuuuuaaaagccuaauguuuuccuagucucccuauuuguuucuucuuaucaagauuaaaaaaaaaguuacagaggaauuccuggauugcauaacaugacuaucuuuuugaaaauucugaaaaauuaguuaacgaggguaguguucucuuaaaaguaugcaacauauuagucuucgauaguugcucucugucguuugacuugucugucacugaugugaauggccaaaggcgucucauugucaauucugaccuguaguugcccuuucuaaauuuugacacagggcaaaaaaaucaauauuguauugauuacauuaugcuuaacuuuuucaacuugaguauagauaaccauuuuuucuuuuugagguuguuuuucuuuuuuuuuuuuagaacuaauaucauuguagagccgggcaugguggcucauuccuguaaucccagcacuuugggaggcugagguaggaggauugcuugagccuagggguucaagaccagccugggcaacauggcaaaacccugucucugcaaaaaauuagccaggcauggugucacgugccuguagucccagcuacucuggaggccgaggugggagaaucaccugagaccaggaaguugaggcugcagugagccgugaucacaccacugcuccagccuuggugugugaguaagacccugucuaaaaaaaaauauauauauauauacguguauauauauacguguguauauauacauauauauguauacguauauauauacguauauauguguauauauauguguauauauacguauacauauauacguauauauguauacauguguguguguauguauguauguguauauauauguguauauauauauuuauauagucauuguagaauauuuggggaaauaguaaaaaccauagaaaggaaaauaagcauagugaguaaucccaugcauuucuuucuucauuuugguauguguaugaauaauagacauauuuacaaauuggggauuauuuucauguuaaguuuuauucccuucuuucauuuaaaauuacauuuccuucucuucuacuucugaaguacuggucguuguaccuuuugacauaguauguagauuucugucaaggcuguugcaguagaugauguguugauauguuggcuauuuuuuuuuuuaaguauagcauagcacagaugauugaacucuuccaguuguuucaucuccuauccccuuagcugcagauuaaguagugcuauuuuuugucuuuaauauuuacuguuauguaaagucuaauauaaugggaaguggcugccacugucuuacucuuuuugcacuuuacccugaucaaacaagaggucauuaaaggggcauuucccccuuuccauuuuagcuuuucagaaguaaccuucugacagaaguacccuuucagacauguuaacacauagguugcugaugugacauagcacagguagcugcuuuaccagaaaaauaauuuugucuuuugaguguuugucauugguucuuuucuugauuaacaguauuugucauaauacuuucuguuugcuuuguguuuguuuuguuacuucuuuucauucauucaagaaacguuuaauaucuauuguaugcccacuauuuaagauauagucucaacugugacucuuggguuucugguagauagguauuuuccuuccguaguauguuauguguaaucuuuaggucuuugacucuuuucaguggcugaccacucaccuacuacucaaugccuaaaaacuuuuuuauuucaaagauuaaagccuuagcuuguauaggggccagauguugauaaaguuucaaaacacuuuucaauggaguuaggcaugcuuagucaaauuuuuagauaguuuguaccaauucuccuaugccucauagcgccucauggcacauuucagucuaauaagaauaguaagaacacccauaaaugcuuauauagucaugugcugcaauaacuauguuuuguuuuggucaaugauggacauauauaaagugguauuuuuauuguaccuuuucuuuagauauacaaauacuuaccauuguguuacaguugccuccaguacagucacaggcuguacagauuuguagccuagaagcaauaggccauaccauguagccuagguggauaguaggcuguaccaguuaggcuuguguaaguaaacugugugauacucauacaaugaugaaaucaccuaaugaugcauuucucacaacguauccccaucauuaagugaugcuugaguguauugaaugcuucuggcuacuguucuaaguacuuuauguauauuaacuuauucagucuuuacaacaacucaagagagaucaaguagguugcucaaguacuuacguuaaguaguaaguugggugugaugggcauucuggcuccaggucaguggucuugugcuggugcucccugccauuugccuuuugcauuacugacauaaagaaccagaggcaucucauucucccaaaacuggaaagagauuuaaaggugucuguacugaacuagauggaaaaaaaugugaaaaacguuuuuguuauaguauaggauaaguaaaacauaauauaaauuuauaggaaagauacuaaauguugaauuucuauaaaacuucagacucuuuucaggguuucuaaugagagaauuguacuugcuucugugaacauuaacuuuucauuuuaaaaucaguuuauccaugaaauaagaauauucaguuccugaucuagacuuuuaaauaaugauuucuuagaauugaguacccauuaaaauuucauuuguaugaguagguaauaaaaacaaacaauuuuuaucuaagcauucaauaauuuacaacaguuggaauuauuuuuaaauaaucuaacagcucuuuucaucaaaaauguaauagaaaauuucuugcgauaaaaaugaaaggauuuggggcaguugcgguggcucaugccuguaaucccagcacuuugggaggcuaaggcgguaggaucacuugagcccaggaguuggagaccagcuuaggcaacauagggagacccccaucucuauaaaaaaaauagaaaaaauuagccaggcaugguggcacacacuuuuagucccagcuacucaggaggcugaucugggagaaucauuuuagcccaggaagucgaggcugcagugagccauaaucauguuacugcaauccagccugggcgacagagcgagacccugucucaaaaauaaacaaaugaauaaauaagcaaaugacaggauuucaaauucaauugaccuuucuaauuucaaguguuuaaugacaaagcucuaggugacagaaagcauaugcauuguuugagcagucaccuugcagcuagauuugaugcugcugaaaaugcaugucacuggcaaauggguaaaaauauaaucaauauagagauuuaaggcuguugcuuuaaggaaaccuugcucacuagauuuugggcucccccauucuugacuugcugcuuauucuacugugugccuugcuguuuaggcaccuugaacauaaucuuccaacaguuucacaagccugucuaugauaauggguagcagugcauucugcaguugucugaugagguagauuacuaggacuuggagcacuucccuuuucauaguugacauaacuccagagcagcaugugcaggagcuacccacugaggagcaccggaugagguuucuuguaucuggaagugacuggaacagaggcuuuuacuuuuucagggguuuccuggcuaccccaaggccuaagggaaacuuuaucuaaggauacccugguaagauagcucugccuuaugcuacagaaagaaaauuucuaugagccuuggagagauguuucagaauagacauuuaugaacauuuaaugcaugcaaauaauccauauaugaaauucacaguuuucauaucaguccuagaaugggaagaaauuuuuuuguguaagguguaagucuugauaaggcuucaguagcaaucugaaaaucucagcagcugaaagcagcaaaguugcuuucuugcucaagcuaccauguccaccacagguuaguaagggggcuuuguucauugugguugcagacuuuauuagaucuggcugauagaaauuccaucucacuauaugcuucugcaaucgcagaagcagggaaaagagaacauguugaaccacacacugacuuguaaagcuuuuuaaaguuuauauuucgcuggccaaaguaaguuaccugguuaugccugccuucaacagagaagugauguauaguaucauuccccuucagggagagacagugaauauuugugaacaguaauacagcugccacuugcaauuaauagucccaacauuuaaaauugaauauuaaugauaguugaacaacuauguaggauaauuguaccuugagugcucaagaaaguaaaauuuuauauaggauuauuauuuuuuuuugagagagagucugacuccguugcucaggcuggagucagucgugcaaccucgguuugcugcaaucucuacuuccuggauucaagagauucucaugccucagccucuggaguagcugggauuacaggcaugcaucacuaugcccggcuaauuuuuuguauuuuuaguagagacagggucucacuauguugcccaggcugguuucgaacuccuggccuccagugaccugcccaccucggccucccaaaguacugggauuacaggugugagccacugcacccggccuauaagguuauuuuaauaagauauguugagguugaagcagaauucaucuuuuccauaauauuucuggaauuucuuuuccauuuugaaacauuuucuuguuuguaguaacuuaugaagcauucguucucaugcuuguagaaaagauuggagccaaaaaucugucacgguuuaucaaugugguaucaucucuguacauugugauauuuuaucuugauuugcauauuucuagcaauuugucuuaacaugauacuguaauaaaaugcuaugacuuaaugacgacuagauggcaucuucagacaucaguucuuacugugauuuuucuucauuguauaccaaaaacuugaaagauuuccaaauauuuuucugguuacuuaagguggaagauugaauacauacuucucauuuuucuucccuccugaaaacauacaaacgauaaugugugguuagcuuucagaauggaucuuaaugauccuuacuucuuaguauucaccuuuacauagcccuuuccugcaaugaauaggguggaccugugugauaaugugaauauaguaagaaauauauauguaaccagugggauauuguggaaaugacagcaguucauucaaauaugaucacugugaaucaaggcauagaauagaacuauaaagaaaagcaaaggaguaaguuauacaaaaaucaggauacuuguuaucucuggcuggugcagugggggaaugcaauuggagagaagcauaggagucaguuaacguuuuguuaaccuuugugcuggcuacuuggaguguucaucuuaauuuuuucaaauugaauauucaguuuuuaccugaaacauuucaaaauacaaauuucugaguugccauucuguuaagacaaucuuugucuuuuuuaauuagaagagcacuuagucuucugguuguuacagggcuucuuaauuuggacuuucagaauaagguucaacaaaucuagguccagguggagacucagccgcuaacuuccagaaagaacuaagggaagucacauaaccaacuuaaacuccacuuaccuuagcuguauaacuaaaggauuuggauuaggaacuacuaggggacuuuuaagaucccuucuaagucuaaacgguuguggaaaagcugacagcacauggaaugaagcuacacugaccuaugcuugcauggaaacuagugaacuaaacauaauguggaaggcauuuugaaaaguuuccuuugguugagagaauuuaagcucuuuauuuuugcugucaguucuaaaucacagucucuagaaucaaaccuaugguaguauuuuauauaugauaagagugguauuccgucuuuacuccuuuuuuucuuguauuggaaguugggaguuaacauguaguuggacuaaaggucuuuuuuuuguguaucaugaaaaaaugauauucuuuuccacuguaaaccauauugauuuaggauguucucuauaacuauguauauauuucagaaugauugagagaggaagacugugaauuuuuaaaguauacauggaaaaaugaguacauuauaucugugaaaucucauauuuuucuauuguaaaauguuauaucguuuacuuaaauauaaaaguauguuauugcuaauagugcuguggguauuaauccaaauuuacuaaauccagugucagaagaaauuuauuuuaucuacauaugguuguuuuagaaucuacaacagauuuuacucuguuuguuuacccaucugccuacucuucugccuccccacagaaauuauucuugacagaaguauuuuaaaagaaaaaucuuuacgauggccucagcaguacuuaguucuguucccaccaccgcuucucguuuugcccuguuacaaguggauaguggcaguggcucugauucugaaccuggaaaagguaaaggucgaaauacuggaaagucucaaacuuuaggaagcaagucaacuacaaaugagaaaaaaagagagaaaagaagaaaaaagaaggaacagcaacagagugaagcaaaugagguaacacaauuaucuguguugucugcuuucccaguagaugguaaucauccugagaacagauacuaucuuguuccccuguguauccauaguaccuguuccacagguacucugaaaauauuacuucaaugaauggaugugaauuuguguauauuuaaaaucaaauguaaugaucuuuuuuuuuuuuugagacagggucucacucugucaccuaggcuggagugcagugggaugaucacaguucacuguagccucaaccuccuaggcucaagguagccucacaccuuagccucccaaguagcugggaccacaggcacacacugccaugccuggcuaauuuuugcguuuuuuguagagauggaguuuugccauguugcauaggcuggucuugaacaccugggcucaagcaaucugcuugccucagccucccaaaggguugggauuacaggcgugagccaccacacccugccugaacauuuuuaaaguacguuuuuucugacuggaaguuuguguguucauugcauaaaguuuaaaauaggaaagucuuaaaaggaaacaggucauuuauagauauaaccagagauauaaccaauuaauauuuugguauguguuuucuguacacauauauaaauuuauaugaauauauacauguauguauauauccuucuaauacuuaaaugaaaaugggguuauauaauagacuguuuuauaacuggcuuuuaaaaaaaauuaaccaugagcaguuuuccauauugguaaauacagaucucuguuauuuuaaaugaauccacaguuuacaauauuuaauuacaugguuuuuuuuuuauuuuuuauuuuuuuuauugaucauucuuggguguuucucgcagagggggauuuggcagggucauaggacaauaguggagggaaggucggcagauaaacaagugaacaaagguuucugguuuuccuaggcagaggacccugcggccuuccgcaguguuugugucccuggguacuugagauuagggaguggugaugauucuuaacgagcaugcugccuucaagcaucuguuuaacaaagcacaucuugcaccgcccuuaauccauuuaacccugaguggacacagcacguuucagagagcacaggguuggggguaaggucaccgaucaacaggaucccaaggcagaagaauuuaucuuaguacagaacaaaaugaaaagucucccaugucuacuucuuucuacacagacacggcaaccauccgauuucucaaucuuuuccccaccuuucccccccuucuauuccacaaaacugccauugucaucccggcccguucucaaugagcuguuggguacaccucccagauggggugguggccgggcagaggggcuccucacuucccaguaggggcggccgggcagaggcgccccucaccucccggacggggcggcuggccgggcggggggcugaccccccaccucccucccggacggggcggcugaccaggcagaggggcuccucacuucccaguaggggcggccgggcagaggcgccccucaccucccggacgggguggcuggcccggcggggggcugaccccaccucccucccguacggggcggcuggccgggcggggggcuggacccccccaccucccucccggacggggcggcuggccaggcggggggcugaccccccccaccucccuccuggauggggcggcuggccgggccgggggcugacccccccaccucccucccggacggggcgucuggcugggcggggggcugacccccccaccucccucccggacggggcggcuggccgagcagaggggcuccucacuucccaguagggguggccgggcagaggcgccccucaccucccggacgggguggcuggccgggcggggggcugaccccccccaccucccucccggacggggcggcuggccgggcggggggcugacccccccaccucccucccggauggggcggcuggccgggcggggugcugacccccccaccucccucccagauggggcggcuggccgggcggggggcugagccccccaccucccucccggacgggguggcuggcccggcagaggggcuccucacuucccaguaggggcggcugggcagaggcgccccucaccucccagacggggcggcuggccgugcggggggcugaccccccuaccucccucccggacggggcggcugccgggcggagacgcuccucacuucccagacgggguggcugccgggcagaggggcuccuuacuucucagacggggcggaugcugggcggagggucuccucacuucucagacggggcggcugggcagagacgcuccucaccucccagacggggucgcggccgggcagaggcgcuccucacaucccagacggggcggcggggcagaggcgcuccccacaucucagacgaugggcggccgggcagaaacgcuccucacuucccagaugggauggcugccgggaagaggcgcuccucacuuccuagaugggauggcggccgggcagagacgcuccucacuuuccagacugggcagccaggcagaggggcuccucacgucccagacgaugggcugccaggcagagacgcuccucacuucccagacgggguggcggccgggcagaggcugcaaucuuggcacuuugggaggccaaggcaggcggcugggagauggagguuguagcgagcugagaucacgccacugcacuccagccugggcaccauugagcacugagugaaccacacuccgucugcaaucccggcaccucgggaggccgaggcugguggaucacucgcggcuaggagcuggagaccagcccggccaacacagcgaaaccccgucuccaccaaaaaaguacgaaaaccagucaggcgugguggcacacgccugcaaucgcaggcacucggcaggcugaggcaggagaaucaggcagggagguugcagugagccgagauggcagcaguacaguccagcuucggcucggcaucagagggagaccguggaaagagagggagagggagaccgagagggagaggggagaggggagaggggagagggagcuacaugguuauuucauacuuuauuuaauugaacucaugauaagcauuuggguuguuuccuauuuuuuacuguuauaggcaaaaaucauaugacuaguuguuuuuguuuuuuugagacggggucucacucuuguuacccagauuggaaugcaguaguaugaucucggcucacuacaaccucugccucccaggcucaagugauccucccaccucagccucccaagcaacugggaccacaggcacacaccacuacgccaggcuaauuuuuuguauuuuugguagagacaggguuucaucauguugcucaagugauccaccccaccuuggccucccaaagugcugggauuauaggugugagccaccaugcuggccucuuuuauuuuuuuuuuuuaaagagaagacagaaucucucucucuuguccaggcuggaguucaguggcaugauauagcucacuguagccucaaacuccuggguucaagcaguccuguugccucagccucccaaguagcuaggacuacaggcaagcaccaccacacccagcuaauuuuguuuuuuuguagagacagggucacaguacauugcccaggcuguucucaaacuccuggccucaagcaguccaccugccucagcuucccaaaaugcugagauuacaggugugcaacacuauuccugacccucuguaacuugcauugaauguacauuuuuaugcauucgauggucuuuuuuuuuuuuuuuuuucugagauggagucuuccucuguugcccgagcuggguuuuagugccgugaucucagcucacugcaaccuccucugcuucccagguucaagcaguucuucugccucagccucucgaguagcugggacuacaggcacgugccaccacaccuggcuaauuuuuauauuuuuaguagagaugggguuucacaauauuggccaggcuggucuggaacuccugaccucgugauccgccugccucggccucccaaaguacugggauugcaggugugagccacugcgccuggcccauuucuuuucuuuagaguaaaaacuguauggaaggcccuuuuuuccuagacauccuuagcuuuacuuaaaugcccaacauuuaauaugcccauuguuuuuaaaagaaauucugagcuacaacucuaguauguguuuuguuuaauagaaggagccguuggguauauaaggaccuuucuuuuuauuauuuaaugaaagaauaguguuuuauucucauaguaaugucccaagacuuagaaaaaagccuuuucaguuuauuuuuucuauuacauuuccaucuccauugcuuucugaauauucuuuaaaaugcuauccacacaguaacuuuaaaggaaagauacuuuccucacuggaugauaaccuuucagaagucagaucuuucagaacuuuugauugcccacuauuuucuuuuaggaauuaagaugauuugggggaaacagaaaauaaggcaauaauggaguuuauauuagagaauaagaaaauauaaaacagaaugagugugaaggauccacccuuuccacuucagccauuugcaguucuauaagccuuuacuuucuguaaagcaaacaguagcugaccuaccagugcuucauuuccagcagcaucuccuucugaauguccuuuccaaaucagaaaccagcuacuuacagugguguuucuaucuuacucccuuuugcagaacaauguauuugguaaaaaccacaauuacuuugcaccaaccuaauauuaacaguuaaaauuguugauccucaguugaaauccucuuuauuaguuucucagggcugccuuaaaaaaaaaaaaaacacaaacuugguggcuuaaaacaacggaaauuuauuuuuucacaguucuggagucuaguagagguucaaauccacagaucaaaagggccauuccuucucugagacucugaguagaaucuuuccaugccucuucuagcuucuggguggcagcugucaauccauggcauuccuuuggcuugcuguguccucaccccaaucucugccuguguuguuauguggcauucucuguguaucugugucuucaccucuuuguauaaggauaccagucauauuggauuagggcccaaccuaauucagcaugacuuuaucuuaacuugauuacaucuguaaagacccaauuuccaaauaaggucacauucagggacacuuggagguuagggcuucaagguaucuuuagggaggauacaauuuguuaaaaacuuaagacaaauuaaauugaacacuucaaaugugcaaagaccgauucacaauucagcagcccccagaaccagaauagauucagagcuacaacugggcugucaguuggucagauaguauuuguggacagaaaacggaagugagguacagaaacagcuggacugguuacagcuccaccuuugccuuauuugaacaugguuugacaguugaccaccugugauuggcuaaaacugggcgauugguacaaaaguagguuauaguuuguuuauacauuguuagguuacaguucacuauguauggagaaacuuucaaguugaacuuaaaauauguaaggaggcagugggggccgggcgcgguggcucacgccuguaaucccaacacuuuugggaggcugaggugggugggaucaccugaggucaggaguucaagaccagccuggccaacauggugaaaacccaucuguacuaaaaauagaaaaaguaucugggcgugguggcaugugacuguaaucccagcuauuugagaggcugaggcaggagaauugcuugaaccugggaggcggagguuacagugagcgagauugugccacugcauuccagcuggcgacagagcgagacucugccaaaaaaaaaaaaaacaaaaaaaaaacguaaggaggcagcuuuaggcuaaacuuuuuuuuuuuuuaaacugcuccuugcagaacagggcuaacucauaggcaguaugcucagugucugcuggcuaaacuuaauuuaacaaauucaguucauaacagccucucaguauuuuucucucguuucaacuacuuugucucagauuauuuuuauuguugggaguggcuuggcccauacuguuuuaguugauuauguuacuuuguggacuaggcccuguauuuuucaggacuagcaaaguaguugucagaguugcuuaggcgaucucucacuauuuaaacuuuuaaauguguaugcuuucugaacuguauuguuuugcauuuuauuuuauuuuuauuuuugagacagggucucacucuguugcccaggcuggagugcaguggcaugaucacugcucacugcagccucaacccccugggcucaggugauccucccaccucagccuccuggguagcugggaccacaggugugugucaccacacccggcuaguuuuuuuguuguuguuguauuuuuugugaagacuggguuuugccacauuucugaggcuggucucaaucuccugggcucaagcaguccaccugcuucacccuuccaaugggcuaagauuagaggggugagccacugagcccaguuguguuuugcauuuuaaaagcacacuuguuuuacuguuuucuacuccuauaaacuucuuuuuaguaaagaagaaugauuaaaauggugguauaauagaguauaauacauuuuucacuuaaucauuuuauauauagaucuaccaacauuaucucaaaugcuggcaaaauuaacauucuacaaagauuauagaaaacacaaauaauaacuuuagcugugugaguuagcaaaacgagugguuucaguagaaguauaaaaauaucauugguuuuuuuuuaauuaaaaaaaucauuaguaucccaggauugguaaacugaauuuaauauauuuuuuguuuguuuuauagcucaggaaucuugcuuuuaagaaaauuccccagaaauccucccaugcuguuuguaacgcucaacaugaucuuccauugucaaacccaguacagaaggauucacgagaagaaaauuggcaagaguggagacaaagagaugagcagguacaacuaaguaaauaaaauugcuuuguuuuucauugaauuuauggauuuuucacauggcagugccucugaauucacgucaccacuguucugagaagcaauuuguauuggauuaauucauauuuguugcuuuuaauaagagguucuguuuuugaucuacugaaaaacaaaagugauacauuuguuguuuauguuaguuuugacaauaggaagcaguuauuuugugguuuuaaaaaucaucugccuuuuacaaaucagggagagacagggaagguaggggaacaguauuaaauuauuccaaguaagaaaaucacauuuguagggcagaaaucucuuguuaaaaauacacagugacuaggcuggguguguacagccuacagguggcucacaccuguaaucccagcaauuugggagucugaggcggguggauggcuugagccuaggaguuugagaccacccugggccacagagcaaaacccuuugucuacaaaaaaaacagaaaaauuagccgggcauggaggcgcacacuuguggucccagcuacucagguggcugaggugggaagaucagagcucaggaggucgaggcugcagugagccaugauuuugucacugcacuccagccugggcagcagagugagacccugucucauaacaaaaaacaaauaauacccagugacaguuuugcuuaaaaaagaaauccuuugggaaacuuuacuguuguuuguuucuuuaaccuguuuacaugauauuuuguucuucuaugucucuauuaaaugucauuaacaaccaaauaaaauagauaacucauuaagacgaauacauaucuuuuuuguguguggaguccaggaaaauaacauacuaagccuggaauguacucuaggagaugcuauauguauaguaagugaugaauuauuuauuugccugucaaacuaucauuugaugcauucagaauaaguaucauucuagcagauguuaggucuaguagaguggcuguuucuaucauucuuggguuaccaguuuuaaaauagacuauacugaguuauucucuuaacauaaacugugcuaauuauaacauuuucuuuaggauuuugcagugccucaggcucaugauuaugagcauuaauuauuacuauagagccaugcaguagugcuguucaaauggcaguuccagguacugguauacuggauaaaucaucuuguacuguuucuagggguugauucuuuuuuuucuuauaaaauauucauuaugaccgauucuuguuuacaaauauaaauguuuugaugaucuacuuguuuagccaguaauagaauuuaccagugucuucauuggagagaauuucucccaguggccuaaaguuuacuggagaacuaaugaaggaaaacuacucaaauuugcaccaaaauaaauuccaugcaacaugggaacuugaucacagauaucugauugccuuuucuucugcucccacugauugcugcugaaaugagcagguaaugaugaaaaggaaauagugugacuuggcccugauccuauauaaggaugccguugaaggcccaggaacuuugacgaauuucugcugaguauacuacugaugggucacuuaggaagaccuggagccuuaugugggagacucacuuggaagaaaauaauguguggaaguagaguagaucuugggauaauuacacugagaggugaggaagagauaagggcaagccuugcaacugauggacaauauacugucuggaaucuaucuuauuaauagaguaauaauagauuucaaaaguagcuacauuuacagggaucaggcaaugacuauauacuaggcagaaagcauacaauguaggggguguucuuccugacacaguaugagaaauuucggggauggagggcugagccagacagaaagcuggacauggaaaacuuagcuguuacuuggcugcuuaugucaaacacgaaagagaaauuaugguaagaacaaaguuuccuacuccuaaaucaccauauagauaaugcaaauuuacaucaacuaagccuuagcauacaaucugagagcuagaauuaaacaccuaaccagauggacaguaggaaagcacucaguucgccuguuuaugagcaaacacuggaucucaguugaucuuguaucaauggaagaaaaguuucugccacaugaaggaaaagcacauuguacuuagugucuggagugaaagcacaccucgaaaaagauuugcugcaggaaauggaaguuuauuuuagauagcaucuauguuuugcuuuaauaaaaaucaagaggcuagaacguuuuguaaaagucaaggggauaguaauguuauauaagaaaguaagauaaaauaaugcacuaaaaugaaaaagugacugagagaaauuaaaagggagacgggugaauuaaaacugagauggggccgggugcgguggcucacaccuguaaucccagcacuuugggaggccuaggugggcggaucagcugaggucgggaguucgagaccagccugaccaauguggagaagucccgucucuacuaaaaauacaaaauuagccaggcgugauggugcaugccuguaaucccagguacucgggagacugaggcaggagaauaucuugagcccaggaggcagagguugugagccaagauugugccauugcacuccagccugggcaacaagagugaaacuccaucucaaaaaaacaaaaaaaagugagaugggugaauuuuaaaauuuaggaaguaaaaucauagcagauuaaaaacuuaauuagaaggaccagaguaucuacuaaagaaagcugagccaauucugugaaggaaaauuugagauaaguuuugcugauaaaauugacaugauagauuggaacacugaauuuaaauccaacagaggcauaauuaaugucccugaaacaaauagaagagacacagguauuagagauuauguugauaggccgagugcaguggcucaugccuguaaucccagcacuuugggagguugaggcaggaauauugcuugaggccaggaguuugagacuggccugggcaacauagugagacccuagcucuaaaaaaagaaaaaagauuauuuugauaaaaucuaagcuugaaaagaacaccaaauuuaagcguuuuaagaauuagauucuaauuuuaagaaugaggaauaaggaaauaguaguauaaauauauacacaggagaaaacugguugccuauacaggaugaagaaucaggcuggcuacuuuaaucaccagaaccaaaauguuaagaccaagaauuucacaucuagccuagaagucauuugugugaaugugaaagaaacacacuuaggcccagugcagcaggucauuccuguaaucccagcacuuuaggaggccaagguaggcagaucacuugagcccaggaguuugcgagaccagccuaggcaauauggcaaauccccaucucuacaaaaaaaugcaaaaauucacuggaugugguagcgcaugccuguagucccagcuacucaggcugcagugagccgugaucaugccagugcacuucagccugggugacagagcgagacccuaucucaaaaaaaaaaaaaaaaaaaaagacacucucagacauaaccauaacugagagaguauaccaccauuauccuuucugcaaauuuuucugagaugugcuccugucaauuaaaaagaaaaucuaaauaaagagcacaaacaauaaaaaaaacacuaguggugaguauuuaagcuaguucaauaaagaauuaacucuaaguagcagcuaacuuguaucuaucccagcacacuucauuguggaaaaguggucuuauauucccuacucauuuauuugcuuagauguauauaucaaaagauguguauguuucuuaauugaaaugagugucaugugauacaugauguauaaaaugauauguaaauuauaucccaguaaagcuguuuuuaaaaaaauacguagggcauggcuuugacuugguuguaugcauaauuuucacuuuuuuuuuuuuuuuuuuuuuuugagauggagucucgcucuugucgcccagacuggagugcaguggcacaaucucggcucacugugaccuccgccucccggauucaagcgauucuccuaccucagccuccugaguagcugggauuacaggcaugugccaccacgcccggcuaguuuuuuguauuguuuuuuaguggaggugggauuuuacaggccaggcuggucucgaacuccugaccucagaugauccuccccuccccaccuccaccuaccaaagugcugggauuacaggcgcgagccaccacacccagccacuguuuuuuaaaacgauuaaaucaagaucaagaaacauauuguucaccaacagcuguugccuaggaauaaaucucuguguagauguuuuucagguauaaucugcuuuaugcaugaugcacugauacuauugauuccaguguaccuuuuuuuaaaagucaugacucaaaaaauaaguagaaaaaucucuucuuaaggguuucagugauuaacagaccaaauuuuauuguguauuucuucuguuacuguauugauucaaacucuacacgucacugguauuuuucucacucugaagugacaugucuguuaguaugugcacaauagcaaguucucucuuacgugacauccuucaguucauuugauaaagguuuuuuuccaauagcuuguucugguuuuguuuguuugugaguguaauauuuaucauuaacuguguggcugguauaauaaaucccuuggcaguaguuugacuaccugguuuccuuauaaggaguguaaauucaaauaaauccauuguauuuuuggcucuuuagcaacaaaauuaaucacuuuuaugcuggaaagcauuacuuaguaguuguucuggaaagacuccuacaggucccuuggcuuuguuugaaagugaaacaaaaacugugauaucuucaggccacuggucucaccaaguuucuuucucucucuuuuuuaauuuucauauauuuuuugagauggggucuuacucccaucgcccaagcuggaaugcaguggugugaucauggcuaacugcagccuugacucccaggcucagaugauucucccgccucagccucccaaguagcugggacuacaggcacacuccaccauggcuggcuaauuuuuuguauuuuuaguagagaugggguuuugccauguugcccaggcuggucuugaacuccuggucucaagcaguccacauaccucagcuucccaaagugcugggauuguaggcaugagccaccacacccagucuucugaccagauuucaugacagguagcuaggagcaaauagauggaugacucaaaugaaaauuuuaaauauucauuaucuuaauuuucuguuuauaacuuuccuuuucugcuccuuuugugacaucacucucauccuaacacauacacguuuauauucuauauucacuguauuggaguccuguuaauuucaaaauuuauuguguuuuuauaaguugcauuauuuacgguucuauuuucauuacuacuuuuaauucuuuugugacucaugaaccauuuuuauugcuuggaggugugauaaagcauacaacaaaaauacagacuuaguaaaugcaaacagcacucagaagacauaaaaauacauuagcugagaugaacugaaugugguaaugaaugugaauuauauaugucauuuuuguagaacucugacaaccuuuagaauaauuauguucaauaagacuacuguaagauuucugggaaaauaaucuugccuuccaaauuacugaaagauauguagucuacacuuugaaaaucuaauggguuaggggaccacuaugcaccacugcuauuaaguccaaucaguuggcugcaaguguuagaugucuucagaauggugaucucuuuuguuuuauaguaacuauauuuccauguugccuaugagaauugaagacuaacucuucauuuggaauuuauuuuguuuggauuuaaaugaguaaaauuguaaugguacuuagacuuacaaauuaauuuuuaaaaaauguuaguaccaaaauauuuacuguccuuuagguuuuucauugguucuucauacucuuuaacugauugagcuauagguuugcuuaaauagaagaaaaaauguuuuacuacuagauggggaguaggaggcaaugaggaagucaagaggaaggggaucugaaguacuccaucuuggacacauguaaguaucuucuugaauucuguaggcauuuuagugccugcuauuuccucuuuuucuuccuuuccuccuacucccauaaauaaaaagaaaauaauaaggaacuucccauucgcaaacuuaaacaagguacuuuuuuaaaaguaugcuuuuauuugcauuuuauugccuggagccugucuuauaggcccagucucugucucugucucccucucucuuuuaccuauacauuuacugauuaaguagauugucagcuauaguuauagcagucuuugauagagaauaaagauauguuuagagaauuuugaaucacauuuucuuucucuuuucugauauguguuagucuugugcuaccauucucccuguuaucuaaggucaaaaaccuuaucuuugauucuuucacacuucauauugucaguguuccaaaacuugaucagucucuucuuuauuuucugcgcugcuacauuuugguccaggugcccauaugcugucugagauuacaauggcuuagucagacacauugauucuagguucucauucuucuaauauuccaguuuauaucuuaaaaauuacuuuuauuuaauauuagcauuccucuuuuuucugcccuauagccuuaaauuuuaggaagugucuggaaccuuaugcugcccuaacuaagcaaucuuauuuucuacuauucuccaacaugggagaguaauucuaauucauuugguacugcucuuaugccaggaacugugcuagguacuucauacauauuacaacuuuaaguccuuaaaacuaccuuguacaguugauauuccaauguccuuuuuaaauguucugagauucacaggaguuaauauaacuuguucaaagucacagcuagcauggguggaauaggaauuuaaauuaucaauuucugugaucucccaaagccuguguuuuuuccacaucuuucucuuguaauguuuaaaauucacuuuuugucagaaugacuuuccuuaguaucccauaguauaucuauucuuaauauuauaacauuaacauaauguggcucuuccugcaguucuauuucugccuauccaaauuguaucuauauuuaaauaccaacuuaaaaggauuuuuuuucuguauuccugaaucacauuuguuguugaucuucuuuuucucaacuuuuguagcucuuuuaaugucuuauucuauuuccuguaguucauacacguuaaucuuacauccucaacuggguaggaauucuucaagggcaaaagccaaauuuaugcugcugcuuuaaauuaagccccauaggcagggagggcacagccccuagaagacucuaaaugaauccuuaauggcugauuggucauacaaugaaauuuuuggaagauuuguucuaguuuucaaaaauuuaaauuuaaaucauuuuugucuaccugcauuuucuuguauacuaguuuguguuaacaauuaaaagguagauuuaaagucugagcuacaauuagaaucaguugcugggagggccauauguuuuuacuuuaaaauuucuauuucuauuuuccuuuuuuuuuuuuugagacggagucucgcucugucgcccaggcuagggugcaguggcgugaugucggcucacugcaagcuccgccuccuggguucacaccauucucgugccucagccucccgaguagcugggacuacaggcacccgccaccacguccggcuaauuuuuuuguauuuuuaguagagacgggguuucaccguguuagccaggauggucuugaucuccugaccuugugaucugccugucucggccucccaaagugcugggauuacaggcaugagccaccacgccuggccuaaaauuucuauuucauucaguuuuuaucaugcgauuagaaugaacugccuuaacauuuaaauucuguaaguuaauaugaaaaauaaaaaugacaucuaacaagacuuccaacuuccuaaccuguucugcccacuaacuuauuucuggaauaucaucagacuaugugacauauuagaaauaaucucaaaugcccuuucuauaauuaaaugucaucaauagggauuaaaauuuuaguggcaaauugaaaagcuuuguucagaauaaacaaguaguuuuguuacuuuuucuuuuuuucuuuuucuuuuuuugagacggagucccacucugucaucuagucuggagugcaguggugcaaucucagcucacugcaaccuccgccucuggguuuaagcgauacuccugccucagccucccgaguagcuggaauuacaggcaugcaccaccaugccaggcuguuuuuuuguuuguuuguuuuuuuguuuuguuuuguuuuguuuuuuguauuuuuaguauuucaccauguuggccaggcuggucucaaacuccugaccucaggugauccgcccaccucguccuccuaaagugcugggauuauaggcgugagccacugugccggccuaguuuuguuaauuuuucuguuaggaugauuacuguccuuuaaguuuagugaaacauuuuauuaucaguuugccaugagguuagguggagaaauugauggaaauuuccuuuuaccuuauaaccauugaauacccauguacauaaguguauauaguaagacuaaaagauuaauuuauuacuuuuucuugcuaauuacuaguucagaguaauucuucaauucuuuucaguuauuccauaaaguauguauaauuuacacugggcuuaaucugauuuucuaguucuauauauccuuaccauuuuaauucuaauuguauuuuucugcauucgauuguuuuucuguguaagcuuaaucuuuuuuuccucucuuuuuauuguaucagcauaggauuagaugcuuucaaagggaugacuuugcuuagaaauguuuaguucauagugucuauuaagauuuuucuaguuuuuaagguuucuccuugaaacagaucacuucuuuuuggaguugguuucuauuuuaguuuagauuuuuaaaaaucauuaaguaauagaaacaauuaugauuaacuuagccaaaaaccuuuuuugaaggauacugagugauucacagauuugaauuaaaaacuaaauaauuaggucuugaaaaagcuggaaaccaaggaauuugggagugcucagaggcaugagcuaguagaugucauuuuucgaggguuaucaucagauaauuaaacccaccugcuuuuccuuuguucucaaaauuuaauuccugggaggaaaaaaaaggaauuggaucacuugcccccaccuuuugucauuggugaugauagcuuggguguuugugugguaugguagugcuuaguguacagaauuaugcgacuggcuguucugcugaaaccaugggacuuuggaaugaagugcacuuauuuaaaggaaucgaggaagggauucuggacagauaaaaacaagagaugcccacuaaauuuaugcuuuuguuauccuguacacauagacacauacauguacacaaauccaggauguuuacccaugucauguugcagcuaucuuauauacagcugcaaacccacucaccuuaugcccaguaguggacaacucaaagucgcauccaacuacugcaacauucuguuuggcaauuaggaaaaguaagucuuguagagauuaauuggauuggaggguggugaaaacuggauuuuaaaaaguuaggugagauugauuagugaaaaagagaaacaaauauauaucacaaagaaucauuauuagaugacuuaaagcaaccauauaguuuaucauuuugagaguaaaaagaugcacuaugaacaauuauucuguaacaccuggcauaugccaggacauuuggcaaacuuauuuuguaccugugguuuuuucuauauucaugaaauggcauauuguguuuaauaaugcuuauugaguuauuuuuuaguauucuuauauuuuugaguaauaaucacucauaauuuuuaguguccuaaacugaauguugccuuugacaucuauuauagugccaauuauuugguaagauuuuuuuauuaagguaaaaaguaagauuauaucauauauaauagauaacaaugaagaggagaaauggaaaucucaaaauuggaaguuuguauuuugaugucuucuauagaauauaggcuuccuaguuuggcaugguuagauaacuuuggagaauccauauuguuuuuuaacauauuugcuuucuuuuccucuguauauaguaauauguaugguuauuuugcucaugugauguaaugauacugucuguuuauugugaaacuuuuuuuuuguagcugacaucugaaauguuugaagcagaucuugagaaggcauuguuacuaaguaaacuagaauaugaagagcacaaaaagguauuuacauacuuacugauuuagauauuuuagaaguuuaaguggugagagguuaaaaucaaccuacuugaauuuuacauaaaauuuuucuguaaaaguuuguccaaaaauucauuaccauaauaaaauauuaccaagaaguguuuauaauaggauuccuucucaaguuuugagauagaacagaaacaguuggaauuaagcuuuguccggugacuuggaauguuaaggaauuuccccacccaagaugaagggaagagagagaauaaaauucacaacagaugauuuuaauuuaauuuuauuuauuuuuauuauuauuuuuucuugggaccgagucucacucucuugcccaggcuggagugcaguggcaugaucucaccucacugcaaccuccgccucccagguucaagcgauucucacgccucagccuccugaguagcugggacuacaggcgugagccaccacacccagcuacauuuuguuuuuuuaguagagaugggauuucgccauguuggccaggcuggucucaaacuccugagcucugcugauccacccaccuuggccucccaaagugcugggauuacaggugugagccacugugcccugccgauuauuuuaauuuuaaaugaacauagaaaauaaguggauuuaaaauuuuaauaugggcuauuacaguacaggggcauuuauugagagacccucugccagaguugcacuacaaaucaaauaaaguagaaggccauuucugaaauuuuggccuugaaaacucagcauuugucacugagcuuugauauuagguuguguguugaaaugcauucuauagcuuguuauuaaaggaggauuuaaguaaaaagaaguguugguuuccaguuuccguauuuaaauugugugaguauucauuacguuaauaucauuuaacauuuuauuccguaacauuuacugggauccuuuuuugguuuauaacauuuguucaagcugugauuacucagugguugaucauaaauggccucuggucacccugaagacuuuuuggccauguccuugugcauuagugucuuuauccaaaaugaaaagaagugaauaauuaaaauucacagcagcuacucaggaggcugagacaggaggauugcuugaggccaggaguuugagacuagcuuggguuaacacagcaagacacugucucuaaaaauuuuuuuuuaauuagcugggcaugguggugugagccuguauucccagcuacuugggaggcugaggugggagaaccccuugaacccagcaguuagaggaugcagugagcuaugaucaucccacugcacuccuccugccugggcaagaaagggagaucccaucuuaacaaaaaaauucacagcauugauuuugcuaguuauuuauaguucaagggaaaaggaaaaaaguugcuaauaaagugggcuguauauauuauauguguuucauuuccauaucccuuucuguuaccucaaauaacgaagaaugaacuguaaccauuauuguuacauacccauuuagacacaaagcaggaaaauuaacaaaaauugauacagcuaguuuuacuaugauuuaaucauuuaaauggacugucagguuacaccggaaaaguaauccugucuugcucaauuaggagauaaaauuuaucaaauagaauauuauacaaaggugacuucuugcuguuagacuuauggauauaugucuagauucuaaagcuagaaggauuaccuguauccuuagaggagaaauagaguaaauaguguugauaaaaugucguacucccagccaguguucuuugcacagucauagguguaguacucaaaaucauugauuuuagccgacaauaaugacuaagagaagggaggaacuucuuuugugugcaauggguaguuugaugugaugacauugauggguagucauugagauaaaagucaauauucaauaaaacaacuuuuaauacaauuguuuuagccuaaggauuuuuauaacagauaacuaaaguuugggauggcauuuucuuuuucuuuucuuuucuucuuuuuucuuuuuuuuuuuugagacagaguuucgcuguuguugcccaggcuguaguguaauggcgcaaucucgguucaccacaacccccgccucccggguucaagugauucuccugccucagccucccgaguagcugggauuacaggcaugugccaccacccuggcuaauuuuguacuuuuaguagagacgggguuucuccauguuggucaggcuagucuugaacucccgaccugaggugauccgcccgccucagccucccaaagugcugggauuacaggcgugagccaccgcgccuggcugggauagcauuuucuguucuauucugucaguuauucaccaaauaauuauugaauagccaaagugugccccuugaguguaguggagggagacauaguguauaguauugagagauguauguucucagugcaguggaaauucagaauaauagaaggcuuuucagugccuuuguuggggauggguuuuaggaaaggauucuuuaaagagucuuauuacauguguuagaaguucaugagguagacaagaggaaaguaggcauucugaaggaaggaguggcaaguauauaagauguguacaugugaaagaauauagcauauuugaaaaacugucauuuaaggaccuagaacuucuggagauacagccagaaggauaggacauaaauuucuucauguacuaggcaaggagauuggguuuuauacauccauuggcagaaagcuguuuaaucauuuuaacuuuuagauugauuuuggguuuucauuuuagaaacucauguagcagcguagaagauggauugaggagcuaaaauuggagacuguugcaguauccaagcaaaagggagaugggggaaugacagaauguacaaagaacagagaaugaauuuaagauaucuucaggagauaaguuaaacaagaccuaguaguuaauuggcuguaagguguguaggagaguaggcaaggauacucugagguuuccaacuuagacagaugugcacauggugguggcauaacaagguacuucauaaaggaucgaguggggaaggcaggguagugagauggaaagauagaauacauuucguguggagaugcuuauugaacauuccaguucaguugucugucuauacagaaauaauuaguuuauugguagaacuuuaaacuuugagauugaagagcaguggguauaaagcauuaaaaaaauagguuaagagugggauaaugugaacaaccgcuacgcuuuugagaagguugaggaaagaagccagcaaaggaaacuuagcaguagucagaaauguauuaagaaaaccaagagaugcuugaaaaaaauaauguguuuuggauauggcaauaaagaggagauugaccuuaacuuuaguaucagagaccagcagaagccagauuucagugggaugaggcaggaaauugcugauuauugucuuaaauuuggucuugaaagguagaagguagcaaugaggaggggguuauaggccaagguaugacuuuuuuuguuuucauuuuaauguuuaagauguaagggauugaguaaaugaauaaagagguaucucuuuauacaauuuggcuagccuaaauuuugguuuuuuauuugccuuuuaucuuuaaaaaauaaacuuuaagaaacauauuaccuguuggugaguuuauuuuacaguuuguaaacugaacuuaauuguuguugguaauucuuuuuaggaguaugaagaugcugaaaauacuucaacucaguccaaaguuaugaauaaaaaagauaaaagaaagaaucaucagggaaaagacagaccucucacaguaucacuaaaagauuuucauucggaagguaauguauauacaaugcuauuaugcuaaaagaacuauucuacaucuguuuuauacuucaguuguaaaugucuuucuaauuuuuaaacaauaaguaaaaguuauucauguaucauguagaauguaaaaaauguaaaccuuugucuuaguucguuuuguacugcuguaacagaguaccugagaaugggucauuuauaaugaauggaaguuuauuggcucacaguucuggaagcugggaaguccaauaucaagaugccagcaucuggugagggccuucuugacgagucaucacauggcaagagugagagcaaaagggggccaaauuugcccuuuuauaaccaaucccaccugugaggguggagcucugauagccuaauuaccuguugaagauccuaccucuuaauauuguuacaauggcaauuaaauucuucuuuuuuuuuuucuuuuuuuagauggagucucacucuguagcccaagcuggagugcaguggugcagucauggcucacuguaaccuccgccuccacgacucaagcaauucuuaugccucagucucccgaguagcuaggacuacaggccuaugccaccaugcccaacuagucuuuuguauuuuuuaguagagacaggguuucaccaucuugcccaggguggucucaaauuccugagcucaggagaucugccugccuuggccucccaaacugcugggauuacaggcgugagccaccacaccugguagcgauuaaauuucaacaugaguuuuggaagggacaaaacuguuuggaaauaaacuaaaaccauuugggguuuuaaaguaauuuaaaaucagucauuaaaaccccauaaaacuuuaguaagaauuuaucuuuuuguauuuuugaguuugucucuuuccuaaaacuuacugaaaauaaaaacugacauuuguaguuugagucaucuugaaacauauuuuuuuccuuauacauaaacugauuuggcuuacaguagaucaggaauaguauuuucauauuucagccauuguuggucagccucuucaaguuaucuggaacugcaucuuagaaaauuaaaauacaaauuuuagaaugagacuuauuaccagaaaaguguuuauaguaucauuuguauuuuuuaucaaauggagaagacagaaggaauuuuacuauccacuaaacuuuugaagauaaacugcaaagcacauuauauuuaaugugggaaauguuaaaaauacuuagccugugcuguacaguaugguagcuacuauucauguguggcaauuuaauaaaaauuaaaaugaaaauguaguuucuuaauugcauuagccguauuucaagugcucagucacauaugacuaguagcuuccauguuaguccagcuauacaacauuacuaucaucacagaaaauuuuauugaacagcgcugugucuauacccgucagaauaguugcucaccguaugaacagcuauuuguucauugacagagcauuuuauuugacucauaugaauucagccuuaguacauugggcauuguucugugaggauaaauauuaccauagcaauaauuucaaaaagaaaaaaacccaaauacugcuuucagaaauaagccuuucuuugaaaaucagagaauauauuuagaagauuauauuguuuuccuuugaggaucaaggaaguuuuucccuguaggcugccagugauuaaguugcuuuguuuugggguuaaaagaacaaauacauauuaaaauuuccaaguuuuggucgggcgugguggcucacgccuguaauccuagcacuuugcggggacaacgcagguagauccauuucaggucaggaguucgagcccagccuggccaacauggugaaacccugucucuacuaaaaauacaaagaguaggugggcgugugguggcgugugccuguaaucccagcuacuccagaggcugaggcaggagaaucuauugaaccggggagguggagguuguagugagccaagguugugccacuggacuccagccugggacaacagagugagacuucaucuuuaaaaaaaaaaaaaaaaaaaaaaggcugggcgcguuggcucaucacgccugcaauuccagcacuuugggaggcugaggcagguggaucaccuaaggucaggaguuugagaccagccuggccaacauggugaaaccccaucucuacuaaauacaaaaaauuagcugggcguaguggugcauuccuguaaucccagcuacucaggaggcugaggcaggagaauugcuugaacccaaaagguggagguugcagugagccaagauugcgccauugcacuccagccugggcaacaagagcgaaacuccaucuaucucaaaaaaaaaaaaaaaauccaagauuaguaaaaaagauuucaccuaagaaaucuauuuugggcuggaugcaguggaccauaccuuuaaucccagugcuuugggaggccaaagcaggagaucacuugaggcuaggagccagaggcuagcuauagugagcuaugaucaugccagugcacucuagccuaggcaacagagugagaucuugucucuuaaaaaaaaaagaaagaaguggcugggcacaguggcucacgccuguaaucccagcacuuugggaggccgaggugggcggaucacgagguuaggagaucaagaccacccuggcuaacacagugaaaccgaucuuuacuaaaaauacaaaaaauuagcugggcaugguggcacgcgccuguagucccaacuacucgggaggcugaggcaggagaaucacuugaacccgggaggcagagguugcagugagccgagaucguaccgcugcacuccagccugggcgacagggugagacuccaucucaaaaaaaaaaaaaaagaagaaauacauuuuauuaaaaacuaggcagaaacauggaaagaaugcuuucuaaaacuccuguuuuccacauuugauuucuuaaaugguauguaaauuugagaaaaacaucaguauguuauuaaagagaaccuacacagcuuuugcaagucaugauuaacacaguugagguucuuccuuagguucuggcaucacuguaugcuaaauagagcgugcuagaagagugacugucuaauuuaccaagauuugguaguuugaucuaaaguuggugauuuuggcauuuacuguguuuauggacacuauucugaucaagaaauucuuuagagaacuggaccagcuuuuagauucucagucauaagaaaguuauauuuuuaguccuugagaauagaaaauuucugcuguacacaagaagcauuguuaaguauuagauaccugaucaucuacuuuaaauaagaauacuugcccacuauuuguacuuuauuuagagacagaguuuugcucugucgcccagguuggagugcaguagcaugauccuggcucucugcagccuccgccuccuggguucaagcaauuuucaugccucagucucccaaguaauugggauuacaaguguguaccaccaugccuggcuaguuuuuuuauuuuuaguagagaugggguuucaccauguuggccagccuggucucaaacuccuggccucaggugauccgcccgccugggccucccaaagugcugggauuacaggugugagccauagccccuggccuuauuuguacuuuagauucccuuaugcuuuccucauucugcucuugauaauuccuuuccagaaaugcuguguuguuucuaagccaauaauuuguuucaucuagauguauuuguuauggguuauuuuuuauguuaagucuauaaauauauaucaauuuuuagguuuuuuaauagugcuauuaaaucaccuugauauaugcuuuuaaaauaaaauagcuaguaguuuuaaaggacauaaauuacuauucuaccuuuucauuacacaaaagcaguaaucugaacauuuuuuguaguuauaguaaccugugauuugauuuuggacauacuuguguccccuugacuugcuccccccaccucccaaauuauguggaaccaaaaaacuagauuauguggaacucauaugcuuaaaaugcaauaauaucccuugauaugggugggauuuacuaggauaagacguuccuuaagcugaguaaauuaguaauuauauacugaauuuuaacaucuuaaaccuagaaaaguaaaucagaugagaauccuagaaaacucuuaaaugacuucuauaacucauaggagauaauuuugaaauucuuucaguuucguuuuuuuuuuuuuuuuuacauuuuuguauguuaaauuccuucaauaaaguuucaucuuuguuucuuuuucauuuacagaucacauuaguaaaaagacugagguaagucuuauuguagccaucuuguagaaaacacugaugauuuuaagaauaauacuuaaauacuuagcaguaagucuuuuuugagacauaaucauuuaaaggacaacccauagguuugucuugagugaacccagucauguuucugccauuauauaaggauguaaaaugcauuguuguagaauaaaaauaagauuauuugcaugaagcauaauauaauuuggcuuuaucauccuaauuuguauauauauguguaugagccaaagguuacuuugugugugccaagcuuaaaaucucagagaaaagugguuuaaucucucacucuauauuuuaaucuuuauuaaaaacuuauccugagaagaugucucauauuauuuuggaauuauggaaguuugaaauaaacugugauucuuuagauauacucauggguaaaaguaaccugauuauauacuucucuuaccauucacuguuaguguagccuacacuuccugguguuggggauuugggguuuuuuguuucuguuauuuaaauacuauaguauagccucuccaaaucuuuuaguugggagauugugcuauuaaaaaaaugcucuaacauugaggaagauacuaaugaaauguuaaaauuauuuuuaucuuuuaagguaauuucaaaguuuuauucuucuauuauauauguguucuuauuaggcauuccguuguuuaauuuuuuauggucagaugguccucgauuucacuuuagaauguguguguguguguguguguguguguguauauguguauauauauacacauauacguguauauauauguguguauauauauacacauauacacguguauauauauacacauauacacguguauauauauacacauauauguguauauguguauauauguauguauauguauaugugcguguguguguguguguauauauauauauauauauauauggcuucugaccauuuuuuuguuuguuucaaacauuugcuucacaggcuaggaaaacgaaaucuaucucuuaaaaaaaaucacaucuaaauaauuuugugauuguauuaauaauuuaguuccuaacuaugcaugcaaacacagaauugauuuguuguugaaacagauggucaauuuuuuuaaaaguuauuugcaaaccauugucaucauuuuuuagauuaaaauuuaaaugacuacauauauagacugaauauuaauuccauguuugaaaguggaaaacauacuuuugaacugauuccaauuuauuuuuguccauugauuuauuugggggauaguguuauacaaauaagaaagcagauacacaugguguaccugcuccuaagacaacucuauaaacuguuugaugcuugcguuuucuucuuuccugauuugaaagaagacaaaaaaugcaaacugacaagauccuaccuauuuaauauauuaaagaugaguuguauuuaaacaagcuucuguauguagaauaauauaucuugucuuuccuuauuuuagagcuguguucugucuuguuaaauaaucugauauauaauaaaauucauuuugaagauuucugauuaaguuccacauuuguaaauacagucuaauuaugauuuauuucccuuacaacuauauuaagaauuugguuauaagaauauguaauucacauuaucuuuauuuuuguuuuuguuuuuuaacuuuuaaaguucagggguacauguguagguuuauuauauagguaaauuuuggucacggugguuuguuauacagauuauuuugucacccagguauuaagccuaguacccauuaguuauuuuucuugauccucucccuccucccacccuucacccucugguaagccccagugugucuuguuccccucuauguguccauguguucucauuauuuaguucccacuuaaagugagaacaugcaguauuugguuuuuguuucugcauuaguuuguuaaggauaauggcauccagcucuauccaugucccugcagaggacacagucucauucuuuuuuauggcugcauaguauuccauggugcauauauaccacguuuucuuuauccagucuaccauugaugggcauuuagguugauucuaugucugcuauugugaacagugcuucagugaacauaugugugcacgugucuuuauaauagaaccauuuauauuccucuggguauauauccaguaaugggauugcuggaucaaaugguauuucuguuuuuaguucuuugaggaaucgccacacugcuuuccacagugguugaacuaauuuacauucccaccaacaguggauaagcauuucuuucucucugugacccugccaguaucuguuauuuuuugacuuuuuaguaauagccauucugacugguguaccuuuugauacuuguuaaaaguaugccgaaauuauguuccauuuccauuagaggcauuucuuucugggacuuaaauauuuaaauguuacaacgguuauaccauugaucuagaaauuuagaagaucuuuuuuuccacagagaauccaaaaaagccuaaagaaaauuccaauuugaacucucaaacaaaauguuauuugcuccuacaaaugaacuaguuuuguuaacgucguaugcugaaugauuaacuuaauucauuccaucuuuaauauauuacuuaggccaagggauuuuuuuuucauggcuacucuuaaguuccuaacaucuguggcaaauaauauucuucuuaccuaccuccccuuaaaucagauauuuauuggauaacauucagaagggaaaauauuuuacuuuauugaugggugaugagguguacuugaacugcauauauauucuuggugcuagcuaaacuuguucucagguuaauuucauuauuucuuuuuucuucugucuagaguaggugcuuguacauaccucuuuauaaaaucucaacaaaucaugccuuuucaggaguuuuauuugauucuuagucuuuuuucuucuguuggacugaaguuguuuuguuuuuuaauauguugcuuuuuaaaugccagaacuguuaggaaggguaucucauagauacucauuucucucuagucccaauuuuaucuggccuuccaaacuccaguccuucuaguaugguuuuaguuuuaaaaaucuuagugaucaucauaugucuugaagucuaaaugauccagucuucaauaugcuugaaugcacuaucauuggaggaguacccaagaaacuguaacagugguugucaaagguggcagugggggagauauuggacagagggauaggagaaauagccugccugcuuuuuacaguauaagcuucugaauuuucuaucauguccguguacuacuuauguaaaaauuauauuaaaaauaaaaagaacugugugaagaaaggaaccagggaacaaacccaguccuaucugucucuacaaccuacuuccuucuuauagcacugugcuuuagcacuaaugcuccacaugucuaccuuuagcugauuaugagcguggacaaauaauuuauucacuuuaggcccuaguuauauuaugaaaaguaauguuggaucuguugauuucuaaaauuaugauaaaugaucagagugcaauugaaauaaagaauaaagaaaaauacgcuaaaaaaaugaacccuauuguuaaugcuaccaacacacaggaguguagcaguaaucaaauuagacuauuaauuuuauuuuucuuucugagauggagucucgcuaucuugccaagcuggaaugcaguggugcaaccuccaccuccaggguucaagcgauucucgugccucagucucccgaguagcuggggucuacagaugugcaccaccaugcccagcuaauuuuuguauuuuuaauagaggugggguuucaccauguuggccaggauggucucuaucucuugaccucgugauccaccugccucggccucccaaagugggauuagaggugugagccacugcaccuggccuaaauuuuuuauuuuguuucuuuucuuuuuuuuagguuauuaaauuuuaaaagcaaauaaauuuaaucuagcuuuaaauaaaucucaccuagaaucugguuuuaccuaaagauucaaccuauuuucuauucuucucaguguguugagcucauucuuguuacuaagccuuuccuuguuuguauguguuacauuuguuagcucucuuugguuauaagcaacagaagcccaacucaauccagcauaaacaaaacagagacaguuauuugguuaauguaaccacaucauggaagaauagggggagaguugaccucauaguugacuggauccaggcauuuagacagcuuuaggacucuccauuucacucccuacucucagcugcuaucuguuccuucacuucaggcgagaucacaugauuacuugggaaucucgggguuauagcuuuacagaauuucuuauaaacuguuaauuagcuuuugagguuugauagauucauuucuuuuucuuuucuuuucucucucuuuuuuuuuuuuuuuuuuuuuuuuugagacagagucucucuguguccuccuggcuggaguguaguggcacgaucuuggcucacugcaaccucugcuuccuggguucaagcgauucuugagccucagcuucccgaguagcugggauuacaggcgcccagcaccacgcccaguuaauuuuuuauuuuuauuagagacgggguuucacuggguugcucaggcuggucucaaacuccuggccucaagugaucuaccggccuuggccucccauaguguugggauuucaggagugagccacugugcccgacucaaguuguuuucuuucaaaaaaaauuuuuuuuuccuuuuuaacaucugccaaggcucugucauccaucaaguuguuuucuugaggaguugagggaggcaagaauauuuccuagauggugugauauauuuccuaucauaucacaucggggucauagaauaugagguuauuuuuaugauguuaaauugauuacuguuucuaaaaccauucuccaguaaaaggaaccaggacucguuggagaaauggcuguaucuagggcgaugacagggaauauacaagacgagcccagagccaggcaugguggcuggcgccuguaaugccagcuacuucagaggcugaggugagaggaaugcuugaggccaggagauccagaccagccuaggcaacauagugugaucccaucucuaaaaauuuucauaaacaaaauuagcaggcucaguggugcacaccuguagucccagcuacucuggaugcugaggcaggaagaucauuugagcucaggaauuccaggaugagcuaugauagcaccaccgcacucuagcaugggcgacagagugagacuucaucucuuaaaaaaaaaaaaagaaggggccgggcgcggugggucaccccuguaaucccagcacuuugggaagcugaggugggcggaucacaaggucaagagaucgagaccguccuggccaacaugaugaaaucccgucucuacuaaaaauacaaaacuuaucugggugugguggcaugcaccuguagucccagcuacucaggagcugaggcaggagaaucgccugaacccgggagguggagguugcagugagucgagaucgcacugcugcacuccaaccuggcaacagagccagccucugucucaaaaaaaaaaaaaaaaaaaaaaaaaaggggguuucuguuuauugauaguuucuuuugcugugccgaagcuuuucaguuuaacuaggucccguuugucaguuuuuguuuuugcuacaauuggcuuuuuuuuuuuuugagacagggucuugcucugucacccaggcuggagugcaauggcacggucucagcuuacugcaaccucugccucccaggcucaagcaauccucccaccacagcagcugggacuacaggcacaugccaccacucccagcuaguuuuuuguauuuuugguagagacaggguuucgccauguuguccaggcuggucuugaacuccggggcucaagugauccaccuaccuugaccucccaaagugcugggacuacaggcgugagccaccgugccugaccugcaauugcuuuugaggaguuggucauaaacucuuucccaaggccaguguccccauugguauuuccuagguuuuauucuaggauucuuguaguuuuaggucuuacauuuaagucuuaaauccaucuugaauuaauguaaaguagguauagaccaggcacaguggcucacgccuguaaucccagcacuuugggaggccgaggcggguggaucacuugaggccaggaggucagagaccagccuggccaauguggugaaaccccgucucuacuaaagauagaaaaauuagccgggugugauggcacgugccuagagcaaaacugucuacaaaauaauaauaguaauaauaaaguaggaauaaggugauguuaacaaauaugauuuuuguuagguaugaugaugauaauaugguuaaauuggacaauuuuuuauagcugcaugugaaagaauuucgagaugaacuaucauaauaacugcauuuuauuauaaaauaccuaggcccaaaaaggagggcuaaauguagaaaauccuuaaaucuaaauguagaguauauggaugaaaauuuucauaauaaaaaguuaagaaaccaaacaaaaugaaauuauauuauuuagugaugcaucuguaaaacaacaaaaacauggaaaugaucaacacuaaguugagguaaugguuaccuugucgaggcacgaagaugagacuaagggaagaguauauagaugggccauaaggucuguagguaauauucuaguuuuuaaguagaauggugugggaucaaguguguuuuuuuuuuaaacagcuguauugaguuauaauuuaaauacuauaaaauucacccauugcaaguauauaauucacucaugguugugcagccauaaacacagucuaguuuuggaacauuuccauaaucucagaaaauucccucauagccauuuguagucaaucccuacucccaccuucagccccuggcaaccacugaucuacuuucugucucuagagauuugcaguuucuuguaaccuauaauggacucauagaauguauagucuuuguguuuggcuucuuucacuuagcauaauguuuuugagguauauccguguuguagcauguggcaguaguuaauucagccguaucacugaauaguauuucauuguauaaauguuguuuauucaccagguuauaggcuugcuaugcacauuugacguaugucuuuguguggauauguuuuaauuucucguaggugguuacuuaggagugaaauugcuggguuguguggugaauuuaugucuaacuuuuaaagagucugucaaauuguuuuucaaaaugacuaccauuuuucacucccaccagcaauauaugagaguucuagcuccuacgcauccuugccaacgcuugauauuaucucuuguuuugauuauagccauucuaguggguauguaauguauuugauuguaguuuuaauuugcauguuccuaauaacuggugauuucagacaucuuuucauaugcuuaucagccauucuuauaucuucuggaaauaucuauucaaauuuuuugcucauuuuuguguauuuucuuauugauuuguaugauuucuuuauaugucugaaaacaaguccucuaucagauacaugauuugcaaauacuuucuuccaggcuaugccuugccuuuucuuuuuaauuuuuuauugauacaaaauagauguacauauuuuggggaugucuuuuugguuuuuuaauugugucuuuugaagcacaaaaguuuuaaauuguuaucaagucuaguuugugacuuuauggauuguacuuuugguguucauuaaauaaaucuuugccuaacacaagucaugaugauuuauucuagaggcuuuauaguuuuaguucuuccuuuaagagucugugauccauauuuugaguuaauuuuugugaauuguggcauaugcauagacacuucucccagcacaacacucuuauauccuuaauaaaauaccuugacaccuuuuuaaaaaguaaauuugaucauaaauaugaaggcucauaucuagauucucaauucuguuccauugaucuguaugucuauacuuacauaagcaccauacugucuuauucauugugugcuugguaccaaauaggugugcagaauuugaauuaaacugaaauugaauuggcuagacuuauuauguuaaauauuuuauguucuuacauuugccauauuuuaaucuuuuuuucuggugugugugggauguaguaguugauuuauuuuugcuuuucuccccccuauaguuuguuaucaguaucuuuugaaaaaaaucccaucucuagaucaaaaagaaacuuuguggccucacucaaaaguacuuaagggacagaaugcccuuugugauaggcaugaugugaugguaaugggagcaacuaucaacaagcagggacauuggcuagaauuauaauuauaauuauaaucucuagugauaugaaauccagaggcugauuaguugcuagcaguauguuauucuuuccacagaagcucagcagugguuuuuagcauuucuguauuuauugcuguaaaauaaaaucuuacaagaauauacuggaacuauuuuaugaagcaguaauuuuagaguuaugccuguaucccuuagcaaucgcacaugcauucuuaaggccauaauuacuugggggggaaauaauacuugcucaucaacuucucaugauguuuaugaaauucaaauaagguaauguuuguuuaagugcuuugcaagauauaaaguguugcacaaccauuuuuaaugucauucauauaguaagcacugguauacaaauaaauuuuuuucaaacacuuuacuuucuaagauaaugugaagugaaaaguaugaauaauuauugaaccuuggggucguuugcccacagauacaauugugaauagcuguaguucaagaauguggggacaggcaugguggcucacaccuauaauccuagcacuuugggaggcugaggcggguggaucaccugaggucaggaguuugagacccacuggccaacauggugaaaccccaucucugcuaaacaaacaaacaaacaaacaaacaacaaaaaaauuagccaggagugguggcaugugccuguaaucccagcuauuugggaggcugaggcacaagaaucgcuugaaccuaaaggggugaggguuguagugagccgagauugggccacugcacuccagccugggugagagugagacugucucaaaaaaaagagaaugugggacauaggugaaaccaaugagugagaggaauguuuucuucagucucugucuucauaacaggauguugaagaggaaaugcuccuuuucuuggagaauguaaaauuucuaauauauaauuggauagacagugauaaaaaucuuaucuuuuaaaaaucuucuauuggcauguggaauuuauauaaaaauuauuuuaaaacguaauguaacgccggacgcagugucucauaccuguaaucccagcacuuugggaggcugaggcggacagaucaccugaggucaggaguucgagacgagccuggccaacauggugaaacccugucucuacuaaaauacuaaauuaccugggcgugguggcacaugccuuuaaucccagcuacucaggaggcugaggugggagaauugcuugaaccuggccugggaggaagagguugcagugagccgagaucuugccauugcacuccgccugggcaacaagagugaaacuccgucucaaaaaaaaaaaagcaguguaaacgauugagcaacauaaaacuauaauaaucaagacaaucugguacuggcauaagaauagacauuuacagauugauagaauaggauuaagaguucagaaacaaacuauugauuuuggacaagagucccaacgcaguuaaaagggcaaaagaauaaucuucucaacacaugaugcuggauauugucaugcagaagagugaauuucgacccuuucuucacaccguguacaaaaauuaacucaaaauggaucacagaacuaaacacaugagcuaaaucuguaaaacuuuuagaagaaaauauaggaguaaauuuuugaguuaagcaaugguuucuuggauaaaauuggacuucaucaaauuuaaaaacuucugugauacaaagaauaccaucaagaauaugccaagacaagccaugaaaugguaguaaauguuuguaaaucauauucaauaagauauagacauuuagaauauauaaagaacuguuacaacucaaaaaaacaaguaacccaguuaaaaaaugggcaaaggaucugagaagacauuucuccaaaaagauauacaaaucuucaauaagcacacaaaagggauguucagcaccauucgcugucagggaaaugcgacugaaaaccgcaaugagauagcacuucacacccgguggcuaucaugaaaaaggcagauaacaacaaguguugaugagaauguggagaaauugcaacccacuugacugcugaugggauuguaaaaugaugggcugcuuuggaaaauuaucuagcgauaccucaaaagguuaaacauagagucaccagcaguucuacucuuagguauauacccaagagaauugaaaauacguccacacaaaaucuugugcaugaauauuauagcagcacaauucguaauagccaaaaaguagcaacaacccaaaugucuaucaaccaacaaauggagaaauaaaauguagaaugggauauuuggcaauaaaaaggaaugaagugcugauacaagccauauauggaugaaucuugaaaauauuuugcuaagucagagaagccagucaaaaguucacauauuggauuauucuguauauacaaaauguccauaauaggcaaaucuauagagacaguaaauagauuaguguugccuggggcggguggcagguauuaggaggaaauggggagugacggcuaauggguacaguuucuuuuuggggugauggaauuguuauauaguugauuggggugaugguuguacaacucugugaauauauuaaaaaaccagugucuuguacacauuaaauuggagaguuguucaguauauaaauaacagaaauuuaaaaagcaauaucuaaguccaaaaaauaugaaguaugaaaggaaauuuccaaaugugucucuacuguuuuaucuucuggagauggagaaggaucaagucguugauugucucuuagcugucauuuuucuuucuuuuuuuauccuucuagugguugacuagguguacuaaaugcauaucccuucuugugguugacuagguguauuaaaugcauaucagugcauguugaaugauaguaaaucguaauucauuuuugacaggaauugaguucuucucagacuuuaucacaugauggaggauucuucaauagacuggaagaugauguucauaaaauucuuauuagagaaaaacgaagagaacagcuuacagaauauaauggaacagauaauuguacagcucaugaacacaaccaggcauguaaaguagaaaauucucuuaaaaucacagugaaauugaaauguaauuuuuauuuuuuaaacaaguaagcaguagaaucaaauuaugauuguauaaaguaguaguuuaggauaugaucuuaguaauuaucacgcaaagguauuuauauuaaaaaguaugaaguauacucauacuguaugacuaguucauucauugaugacuauuugcugagcaugugccauaagcuauguacuguuaggcacucguaugagggaguggaaacacgaagauggauaagaccuuucuucccuuagacacucagaguuguggggauauggagagguagaccuguaaaaggaucaucauucagcacaaaugaaaacuuuaagggggauaugaacaauaaaaaagagguuuugaauagcaaagguaauugaucacugcuugggugaauugugguggguauauaaaaagugacauuugggauggaguaugaauagugaggaacuguauaagcugagaaauagagaaagacuuugggucuaagggaacugagagaacagacguccugaaauauaaaaggcccuagaccaaauguuuaggaaacugaaaaauucugcaacuaagaaguuuacaguuaagcaagugugggaugacaugacuggagacauagauuagauuuaugucauaaaugucuuuucugugaaacuaagaaguuagaauuuuauccuuuacaacagggcaagcuauagcccaugaaucaaaucuggucaguggucuguuauuauaaggacuguaagcuaagaauggcauucauauuuucaaaauacuacuuaaaaagagaaaagagccuggcacgguagcucacgucuguaaucccaggaacuugggaggcugaagcgggcagaucacuugaggccaggaguucaagaccaaccuggccaacauggcaaaaccucaucucuacuaaaaauacaaaaauuagccaagcaugguggcacaugccuauaaucucagcuacgugguaggcugagacacgagaauugcuugaacccaggaggugggguugcagugagccaagauggugccacugcacuccagucugggugacagagcaagacuguguuucaaaauuaaauaaauaauuuuaaaaauuagaaaagagagaauauggcugggugcuguggcuuaugccuguaaucccagcacuuuugggagacugaggcuggcgaaucacuugaggucaggaguucgagaccagccuggccaacauggugaaacccugucuccacuaaaaauaaaaacaaaaauaacugagcguuguggagggcgccuguagucccagcuacucggaaggcugaggaggagaaucacuugaacccaggagucagagauugcagugagccaagaucacaccacugcacucuagccuggaugacagagcaagacuccgucucaaaaaaaaaaaaaauaugugacagagacuguauaaaacccauaaagucuaagauguuuguuguuggacccuuugcagcaaaaguuugccagccucugcuacaaaccaguguuacccaagauauauuaucugagggagaaaaagaugcuuucucuccucauaccccaguccuggauauaugggaccaggaagaggugagaccuacuccaagauccucacugccacaucuuaaauuccaucauacagagaaaguguguuaccucucagaccucuaugucugcauuuauuuuuaucaccaaaaccacuagucucuuacuucgucuuaacuauaaaccuguucuugacccuauauugaccuccaauccaucaauucuccuagcuugaaacuuguaguaauuucacuaauguccccaugaacacuuuacccuuacuuccuuaauuuucugugauuccuuucuugccaguauguagcacuggcucgcacaauauugucugccuugccuguuuuaauucuccagccaccagguguuuaaaagguauuucuaaaaacacugcuaauguucucaucugaaaaucaguacuauguaacuuuugccauagucucauuucuacuuaacaguccuuugauugaucucuuucuaaauuugacagauuccuacaauagccauuccaaauucgaauaaucugguucccaucuguuuccaucuuuucuucucuucaauggauguuaucgcuuuguuuacuacaaagacugguaaauucagucuuacaguaaauuaacaccaucuauuaacauuuguguuauaugguauacaggagaagcuuuaagaacuuuuuacucuaaugcagcaauaagguuugucuauaaauaacacuguuucuuauggaaaaucuauuuucgacucaguaguggggaauccuugccuacccugacguacucgugagguucuuucuggcauugaauuaaauuuaauuguuuuccugucuuuccucaacuuccaaauuuuauguacaauccaagcguauuaguccauucucaugcugcuaugaagaaauacccaagacuggguaauuuaucaaggaaagagguguaauugacucacaguuccacuuggcuggggaggccucaggaaacuuaacaaucaugguagaaagcaccucuucacaggguggcaggagagagaaugagugccaggugaagggggaagccccuuauagaccauuagaucucaugaguauucacucacuaucacaagaccaguaugggggaagccacccccauaauucaauuaucucccaccugaucccacccuggacucaugggaauuauuauaauucaagaugacauucagguggggacacagcccaacuauaucauucugccccggccccucccaagucucauguccucacauuucaaaacacaaucaugccuucccaacagucuuccaaagucuuaacucauuccacgauuaacccagaaguccaagucuaaaguuucaucugagauaaggcaagucccuucugccucugagccuauaaagucaaaagcaaguuaguuacuuccuagauacaaugggaguacaggcauuggguaaauacgcccauuucaaaugggagaaauuggccaaaacagaggggcuacaggccccaugcaagucugaaauccaaaagggcagucauuaaaccuuaaaguuccgaaaugaucuccuuugacuccacaucucgcaugcaggucuugcugauuaaagagaugugcucccaugguguugggcaacucugccucuguggcuuugcaggguacagccuccacuuacuggcugcuuucacggcuggcauugagugucugcagcuuuuccggugcaaaccguggguggaucuaccauucugggggcuggaggacagugguuccuucucauagcucugcuaggcagugccccaguagggacucugugugggggcucuugaccccacauuucccuuccacacugcccuagcagagguucuccaugagggcucugccccuguagcacaccucucuaccuggacauccaggaguuuccauacguccucugaaaucuaggcagagguucccaaaucucaguccuucucuucugugcacccacaggaccaacaucauguagaagcugccaaggcuuggggcuugcacccucugaagcaaaagucugagcuguaccuuggccccauuuuuagccauggcuggagcagcugggacacagggcaccaagucccuaggcugcacacagcagaggggcccuggacccagcccagaaaaccaauuuucccuccuaggcuuccagaccuaugaugggaggggcuucugugaaggucucugacaugccuuggagacauuuuccccauugucuuggugauuagcauuuggcugcuucucacuugugugguagacuugaauuucuacccagaaaauggguuuuucuuuucuacugcauugucaggcugcaaauuuucugaacuuuuaugcucugucaccucuugaaugccuugcugcuuagaaauuucuuucaccagauacgcuaagucaccucucugaagcucaaaauuccacagaucucuagggcaggggcaaaaagcuaccaguuucuuugcuaaagcauagcaagaaugaccuuuccaguucccaacaaguucuucaucuccaucugagaccaccucagccuggacuucauugucauucaacaagucucuaggaaguuccagauuuucccacauuuuccugucuucugaauccuccaaaguguuccagccucugcuuguuacccaguuccaaagucauauccacauuuucagguaucuuuauagcagccccugacucucugugguaccaauuuacuguauuaguccauucacacacugcuaugaagaaauacccgagauuggguaauuuauaaagaaaagagguuugacucacaguugugcauggcuagcgaggccucaggaggcuuacaaucaugguggaaggcaccuuuucacaggguggcagaagacagaacgagugcugagcaaagaguggaagccccuuaggaaaccaucagaucuugugagaacucacucacuaaccggagagcaguaugggggaaacugcccucuccaccuaguuucaccuugacacuuggggauuauuacaauucaagaugagauuuggguggggacagagccaaaccguaucaccaagcaaccauguuaauuaacauuuaugguuagcauauucacuucuuccuuuuucauugauuaugauuuuccuuuuucauuaugauuuuccccuuuguaguaucuuuuuuaaagccaccugagaucauuuuuggauagaaggaaugauauuuguauauuucaggacauacuuagguuccucaaggccuuuauagaacaaaguuggguauauaacuuuauauuaacaaguuuaaauaauuaaguagcaguaugauuuaaaccgaagugauaguuugacauaguggaaagagaacagacuuugaaaucaaacaguuuuaucgauuauuacauugggaugaaauuaccugccuuucuuacacuauuaggaaaguuauagauuauuauuuaaaauguuuagcagaacauguuuuccacaguaugcacucaauagauaauuauuuuuguacaagcaaaaaauggugagccccagaaaagauacacuguuaaaaugcuauaguaauucacaggaaaggggaucagagauggcuuugugaggagaaaauagcauuugaauuagaaacuuagaguagaauuuggguuuucuuugcucuuuuuaaagaaauuuuaauuuuuguggcuacauaguagguguauauauuuauggguuccaagagauguuuugauacaggcaugcaaugcuuacauaaucacaucuuguaagcauuuauccuuuguguuacaaacaauccaaugauacuauuuuaguuauuuuuaaauguacaauuaaauuauugacuaauagucacccuguugugcuaucaaauacuaggucuuauucauucuuucuaacuuuuuuguaccaauuaacuauccuaaccaccugcccacucccucacugcguuucccagccucuaguaaccauccuucuacuuuguaacuccauuaguucaguuguuuugaauuuuagaucucacaaauaagugagaacaugugauguuugccuuucugugccuggcuuauuucacuuagcauaugaccuccaguuccacccauguuguugcaaauaacaagaucuuuuuuuauggaugaagaguacuccaucguguauaaauaccacauuuucuuuauuuauucaucuguugauguacacuuagguugcuuccaaaucuuggcuguuagaaacagugcugugauaaacaugggagugcagauagcucuucaguauacugauuuccuuucuuucggguauauacccagcaggauuguuggaucaugugguagcuccaguuuuauuugauuuuuguauauggcaagagauaggugucuaguuucauucuucugcagauggauauucaguuuucccagugccauuuaucgaagagacugucuuuuccccaguguauguucuugacaccuuugccaaaagugaguucaccucagguguguggauuuguuucuggguucuggguucuguuccauuggucuguguguguguguuuaugccaguaccuuguuauuugguuacuauagcucuguaguauaauuugaagucagguaacaugauuccuucaguuuucuucguuuugcuuaagauaucuuuggcuagugugucuuuugugguuucauauauauuuuaggauuguuuuucuauuucugugaagaaugucauugguauuuuaauagggauugcauugaaucuguagauugcuuugggugguaucgacauuuuaacaauauucauucuucuaacccaugaacauggaauaucuuuccauuuugucaucucuucuucaguuuuguucaucaguguuuuauaguuuucauuauggagaucuuguuugguuaauuccuagguauuuauuuuuauuuauggcuauuguaaaugggaguaaaugggauuacuuuuguugauuuuuuuuucagguuguucucuguuggccuauagaaaugcuacugauuuuucaagguugauuuuguauccugcaacuuuacugaauuuaucagguucuaauaguuuuuuuguggagccuuuagguuuuuccaaauauaaagugauaccaucugcagacaaggauaauuugacuucuuccuuuccaauuuagaugcccuuuauuucuuucucuugucugauuacucuagcuaggacuuccaguacuacguugaauaacagggugaaagugggcauccuugucuuguuccagaucuuagaggaaaggcuuucaguuuuuccccauccaguauauuacuugcuguggguuucuuguguauggcuuuuauuauguugagguauauuccuucuauacccaguuuuuugaagguuuuuaucaugaagcgauguugaauuuuaucaaaugcuuuuucagcaucaauugaaaugaucaugugguuuuuguccuucauucuguugauaugauguaucacauugauugauuugcauauguugaaccagccuugcauuccugggauaaaucccacuuggucauaaugaaugaucuuuuuaauguguuguugaauucaguauuuuuuguggauuuuuugcaucaauauucaucagagauauuggccccuaguuuucuuuuuucgauguuucuuuguccgguuuugguaucaggguaauacuggccucauagaaggaguuuggaaauauucccuccuccucuuuugucagaauaguuugaguaggauugguauuaauuccuuaaguguuugguagaauucagcagugaagccauuggauccugggcuuuucuuuacuggaagacuuuuuauuauggcuucaaucuuauuauuggucuguucgauuuuggauuucuucaugguucaaucuugguagguuguaugugucuaggaauuuguccauuuucucuagauuuuccaauuuauuggcauauaguugcucauaguagccacuaaugauccuuugaauuucaguaguauuagucauaaugucucuuuuuuuaucuguguuuuauuuggaucuucucuuuuucuugaugugguuaaagguuugucaauuuuaauuuuucuuuuuuugauguuuuuuguuuuaauuuuuuaauuuuuagguuuuuuuucaaguuuaauuuuucaaaaaaucaacuuuuggauucuucauuucaauuucauuuauuucuuuuguauugcuuucuucauuuuaguuucauuuauuucugcugugauguuuauuauuucuuucuucucauuuuguguuugguuugcucuugcuuuucuaguucuuuaacauuaauuguuagguuguuuauuugaaauuuuucuucuuuuuggauguaggcacuuauagcuauaacuuucccucuuaguacugcauuuauuguauuccauagcuuuugguguguuauuuccauuaucauuuguuucaagaaauuuuucaguuuccuucuuaauuucuucauugacccacugaucauucaggaggauauuguuuaauuuccauguauuuguauaguuucuaaaauuccuuuuguccuugauuuguagcuuuauuucauuguggucagaaaagaugcuugauauuacuucaauuuuguuaauguuuuaggacuuguuuugugaccuaacacagggucuauccuugagagugaucugugugcugaagaaaagaauguguauucugcagcugucagaugaaaaguucugucaauaucuauuagguccauuugguuuauagugcagauuaaguccaguguuucuuuguugauuuucuuacuagaagaucuguccaaugcugaaaguggaguguugaagucaccagcuauuauuguauuggggcccaucucucucuuuagcucuaauaauauuugcuuuauauaucugggugcuccaguguugggugcauauguauuuaaaauuguuauaucuucuugcugaacugacuccuuuaucauuuuauagugaccuucuuuguuucuuauaguucuugucuugaaaucuauuuugucugauauuaauauagcuacuccugcucuuuuuugguuucccuuggcauggaauaucucuuuuacgucuucaugggugaaauguguuucuuguaggcaacagaucauugggucuuauuuuuuaauccauucagcuguucuauaaagacaauagaauuugaacaugcagagaugaagaagaagaaacugggaugccuugaguaaaaguauggagguaaugaaguauaaaccaguuuaauuaaaauagaagguuuauagaggaauguaauauaaauuugaaaaguuaaguuggaaaagacuguggcaaauuuaaaggcugguuuauaauuuagucagcagacguuaaagacuuuuugaagauuuuugagcagaaagcaaaguuuauuacaguaauauuaauuucacugcagugccuaggaaaaaaccgaaggaagguaaagacuacuaauuauuaggaaggauauagaacagcauuaacauaccacuagugggaauguaaauugguauaaccauuuugaaaaacaauuuggcauucacuuuuaaaguugaagauaaugggcaugaccuuauguucuagaaauucuaccccuagauuaaacccugaagacauguccaaaaaaaauguucaaaacucaguuguuuguaauagcaaaagaauaagagaagugaauaaguuguaguuauacauagcaacauggaugcauaucaagagcauagcauuuaaugaaaaacauaagucaccaaauaauaauuugaugacauucauauaaauuuuuuuuaauaacccugucucugcaaaaaaaaaauuauccaggugaguuggcaugcaucuguagucucagcuacucagaaggcugaggugggaggauugauugaaccugagaagucaaggcugcauagagcugugaucaugccacucccuuccagccugggcauugaagcaagacccugucucaaaaaaauaaauaaaaauuaaaaauagaaauuuaauacauuauuuagggcuucauauacauguaguaaaauacuuuaacaaaggaaaagaacgacaaaaucuguaaucauggauauccucagaagaggagggaaaagggguaugauuggggaggggcugccaagguauugguaauguucaaauucuuaaucugcuuuuugguuuauuuuucuuuuuaccuaaugugucguacauaaaauucuuuugcgcaugugaaguuuuucauaaaugaaaaaauuagaaguuuuucuuagcuuucauuaaguguaaaggagagaaaagaggauucaugcaguuuaaaaaauucuccacuucucuuucuguauauacuucuuuccucuauccaaugugcuccuuucucagagaaagaaagcucuucugcuuuccaagguuaaaauccuuuuuaacugugcauacauuaauauauuaggcauuuuuaaaggugaaaaguaaaucaacccuaagucugucugucauucaguuuuuuuuuuuuuuggagauggagucucugucaccuggcuggaguucuguagugcuaucuuggcucacuacaaccuucaccuccuggguucaagcaaugcuccugccucagccucccaaguagcugggauuacuggcaugcaccaccacgcccagcuaauuuauuauguauuauuuuuuuauuuauuuaguagagacaggauuuugccauguuggccaggcuggucucgaacuccugaccucaagugaucugccugccucagccucccaaauugcugagaucauaggcaugagccaccguauccagccuaguuucauuuuugaauaguguuuuucuaggaaaaugccuagaugcauagguauuuuaaaauaauuacaacaauaaugaaucuaguuuucuaaccccuuuuguaauccagguguuauauccugccaaaucaacaugcuguaaguugcuugguauuugcccuauuauugaacauuguuuagaauugauggcuugauauucacugaucauacauuuaauuuuuuggugaaucauuuccuuggaaucgauuuuuuaagauaauaauugaaucaaaggauauaagccucuguguugcucuuggugcauucagcauauugucuucuagcagcaggaugugagauuacuaauuucuccacaacugcaccaacgcuagguaggucaguuaucccugauccuguccccucuuguggccuucggggcucuguuuuauuaauuacccuugcggcauauuccauccuguuguuugauggauaccuuagucucacuguguucaaacccaggcucaucaucuuccucuccauaccaagcauuuggcuugacuucugucauuucaguuuuugguuuccucauuuuaucuagauauccagauucuacacuuuuuuuuuuucacuuuucuguuuuucaagauuuuuagaguuuuaaaucuuugaaauauuuuucagaucuaucuuuguuuccauucuuaccaacauuucucuaauuuaggcucucauuaucucuuacuggcauuauuucaguaaucuaaccaaucuuucugcuucuugccuuuaaugccauauaauguguuacacccugcuaacuaaugccuuuuuauaaaucauuacugccaucaugccaugcugugcccuuaaacuucagugucuguugaauuaaguacaguguccuugaccugacacccaaaguccuuaggcuaugcuuuucaaacugaguuucccaacccauucaauaggcccuaaaaucaguuuaguagauugcuaccaaaaaaaugggacaggagaaaaugucagaguaugugacaccuauuuauauuuugugaaauuuguuucuaugugugcauguguuuguauaaaaccuaucauacgucacugucaaauaaguuugaaaacauuguuauacaggauauccuuaacuuaauuaacuuuagcuguuuguacucuuccaauuuuucuucuagcuggagcagaccacuccugucacagaaugcugagugggucccagcuuuauucaagguucauuucauucauuucacaugccaucuccucccagaagcucucucucacugccccagccaaaccccaaacccgagacacggaaaaccuggauauaauuuuccuuuuucuauaccccauagcauuuuguuuuucuuacugcacauuucacacugcacauuuucccugucauuuuuaauagauuacagagcccuugucagcauaggcuuuaucuuguacaucuuuucauccucauuuuaguauaauauuuucuacuuagaagauacuuuuuaaaagguauuuauugaaauauaggacuucauugaaaaugaguauacauuaaaacaauaugacuuuguuuuaaaaaguaguaucucuuguagaaauuuugggaacugcugauaaguaaaaugaagaaaugauaauggcaaaaauaaguauuugagguuugcuauguauaugccaggcacuguguuaaguacuuaaaaugcaugaucucauuugauuauuaacaacuaacuaugaaguugguggguaucauuaucauccccaguuuucagauguagugggagaaaaaugacccuaaucucauucaccuagagaaaacuacuacaguacugauaauuugguguggucuuacuauggauauauucuuuuucccucauuaauguagaaacuguuagauggaccacuuuuucaguuaaauacaaaugaugagcauucaggacauuaauucuuuuuguuuuguuuucuuuuuuuuuuuuuuuuuuuuuugagauggagucucacuguguugcccaggguggagugcaguagcgcaaucucagcucacugcaaccuucguccuccagguucaagccauccuugugccucagcuucuccaguaucugggauugaaggcaugugccaccacacccagcuaauuuuuguauuuuuaguagagaaucaccauguuggccaggcuggucucaaacucccgaccucuggugaucugcucaccucggccucccaaagugcugagauuauaggcaugagccacugugccugggacauuaauucuuauacaugaaauaauucaguuuauagguaaauugccucuaaucacacuaagaaaaaaaaauuuuuuuaauguaccaguuuggcugggugcggugggucacgcuuguaaucccagcacuuugggaggccaaggcagguggaucgccugagaucuggaguucaagaccagccuggccaacauggugaaacccugucucuaguaaaaauacaaaaauuagccagcagugguggcaggcgccuguaaucccagcuacuugggagacugaggcaggagaaucacuugaaccugggagacagagguugcagugagcugagaucacaccaccguacucuagccugggagauaagaucgagacuucgucucaaaaaaaaaaaaaaaaaaaaaaguaccaguuugauaaaaccuggauuugcuuacuagugagauuguacuuuuuuuaauguuuguuggucauaugucugucauauugguugcaauuuauuuuguuuuuccuuuaccuuuuuauuuuguuacagugguuuuuuuuugagaucuuucaucaaaucacaucuaccaaucuuuuccauuuuuccucuuuuuuuugaugucaauuucagaagggcuucuuauucaaagauaauaaucauauucaucaagauuucuaaaaauacauauaugguuuuauuuuuauucaaaaguaaaacaguauuauuccaugauuauuuacucaguauaaaauaauuuugauaaaaggaaauuguaaacaauaaagcaaaaucuuugauaaacccauguucacgacaguuaaaguuuugguguauguucuuccagaauuuuuucuuugcacacauuacaacuuuggaaucaugcaaauauuauuuuauagcucuauaucaccauuuuuagugacuuaguuuucaguuuuugaauuuacuauauauuuaaccuauauccuauuguuuggcauuuaaacugauguccaguuuuuuguugugauaaaucuacaaugaacacuuuucauagauacuucccuaccucauuuaucuauuggagauaaauuccuagaagugagauuccagaacuuaauaguaguauauuucuaauuuugaccuacucaccucauugcuuaaacuagaaacuuagauuguaguguucaucuuccucaccugccacauucuuuaaaccuuucaucaaaugcuaccuccaaauuauuucucaaauauacuucucucuauuuauacugcuuucacccuaauccaaagcauaaucuuauuugacccaggguuagaguaguaauuaaaggaucuuucuaccugucuuaccucacuccauuucauuuccacacagcauggaaagggauccuuugcaaacauaagucucacacagucaaaucuaaccuagcaguccuguucaaaauccuucacugcuuucuguuuuacucagaauaaugugcagacuguucuuauggccuucaaggcccuccaggaucaguucucuacuggcuuuuccaaagucaucuuguaccaucuucccccucacuaucuuaccauacugguuuauuuuuuucuucaaauucuccaggcccuuccugcauggccuucaaacauacuguucuuucuaccuggaaagcucucacuuccccuuuuuacuuagccaguuccuacccaucacacaagguucaauuuaagugucaccacuuuagagagcuuuacuaaucuagaaaagaaacacagaaucuuuucaauucuguucaccaugguguacucagcuccuagaaguuagaugcucagugaguauuuguagaguacuacauugauguugccacauuacuccuuagauaaauagaaccauuuauauucucaucaaagguaugacuuuggggugauuuuuuguuuacacuaaauuuguuuauuuugguauauggugcaagaugacagggauuuaaccugauuuuucccaguuagccacuuguccuguaaccuaccauuauucuguaauucagcauuuucucacuuuuuaaaaguaucauccuuacauuacaauaaauucuuauaucugaagucucuuucuggauuucuuuucugguacauuguucugucaaccuagguuccaugauuuuauuuauuuugccuuauauaauugauagacaaaucuuucuucaucaaaucaacuuuuuguuugcgucuauccugaauucuccagaugaagucuuuacuaucuuuuuaaguuccaaagaacaacauccuauugggauuucuauugaaauguuauugaacuuacaaaguaaccuguagccuuccuauuuacaaacauacuuuguucugugucauuuucgagauuuuauaaauuucuuaguguugguccugaucacuuccuaguuuuauuguucugguuagcuuuucuugcuguugugaggaaauuauuuuucuaguucugucuucuaccuguuaauugcuaauacagugaaaagcuauuuauuuuaguuuucauauuuuuuauuaauuuuguauuuguagucauuuuuugaauuuuugaauuuuuaagauagacuaauaacaacaacuugucacagagcacuuuuaauauguuuguuccaggauagaaauauccuuugaaagcccugauauuguuugucaguauguuuggcuuaauuauaaauacuuccuugcuugcauuguguauuaggauuauauaauugagugaaaguagaaauguagucaacagcauaagguggccucagaaaauuaaggucagaauuuuuccucuuaaacuuuucacaaaggaauacuauaaaccagaauuagcggaauaaucaaaguccuaaaguguuguuucucucuuuucaggaagugguucugaaagauggaagaauugaaagacuaaaguuagagcuugaaaggaaagaugcugaaauccagaagcugaaaaauguaaucacucaaugggagguuuguguccauuuacuguuguuaaagaaaauaauucuauaaauuuucacguuuucuguuuuucuuauauguaaauauguuuaauaugcaauucaugggaauagucauucuguuuuuuauguucuuaaacucuuuaaugguuuaaagucugaaugauuauuuauuuauuuauuuauguuguuguuguuguuguuguuugagauggagucucauucuguugcccaggcuggagugcaauggagugaucucagcucggugcaaccuccgccuggguucaagcgauucuccugcccugaguagcugggauuacaagcaugagccaccacgcccggcuaauuuuuguauuuuuaguagagacagaguuucaccauguuggccaggcuggucacgaacuccuggccucaagagauccgcccaccccagccucccaaagugcugggauuacaggcaugagccaccgugccugguuguauuuuguuuuuuaaaaauccacuuuauugugguauaguuuacacauaguauaauuuauuuuuguuguuguaaaauacauauaacauaaccauuuaaaguguacaauucaguggggcauuaaguaccuuuauacacaguauuguguaaccaucaccacugucuauuuccagaacuuuuucaucaucccaggcagaaacucuuaacccacaaagaacuccccauucucauuuuccacaccccgguaaccucuaauuucugugaauuugcccauucuagguaccucauguaaguggaaucauacaguguuuauccucuuuauguguggcguauucacuuagcauaaugugguuuuuuuguuuguuuguuuuugugagacagagucucgcucugcugcccaggcuggagugcaguggcacagucuuggcucaccacaaccuccaccuccuggguucaagcacuucuccugccucagccucccaaguagcugggacuacaggcacgugccaccaugcccgcaccaccaugccuggcuaauuuuugcauuuuuaguagagacgggguuucacuauguugaccaggcuggucucgaacuccugaccuugugaucugcucgccuuggccucucaggguguugggguuacaggcgugagccacugugccuggccuagcauaauguuuuuaagguucauccacguuguagcaugugucagaauuucaucacauauuguagcugaauaauuuuucauuguguguauauauuuuguuuacuggugcauaaguaucugaguccuugcuuucaguucuuuuggguauguacauaccuaagaguggaauugcuggauuauauaauuccacauuuaacuuuucgaggaacugccaaacuuccauggcaccugugucauuuuacauucccaccaggagugaacaaagguuccaguuucuccacauccuuuccagcacuugugauguauacaauguauuuuuaacuacaaaucuuaccucuccccuuagguuuuuuuuuuuuuaaucuauuuuuuaaaucuguuauucauaucaaguaucauuccuuuuugacuaauaugaauucacucaacaauuauuuauugagugccuguaaugugccagauacuuuuugcgcccuguguaugugguagugaaaaaaaauaaaucaaguuccagcccugaugguucuuacauuucccuucuucuucuacucaugccuuuaagaaucaucccuacuaaaacuuuuuuugacugcacccacucauuuaccuuagcuuuucauuuacauuucucuucgcuuuuuuuuguacuagacacagagaauacaaagaugaguuagcaagaagcuuguagauuaauggggaagauaaacauguaaauaguugcaguacaauguaggauaugacagaaugcuccagaagaacagacaaaggaaugaaugaguugcugcuaucaaaaauugguaaagaucucauagaaaagaugauuuuuccagguagagagaauuguauguacaaaggcaugggaauaugauggaaggaagguacauuguggcugacauucagagaaaugggaaacuagaaguugaaauugcagauaugaguuggguucagaauuugaaggcauuuggauuuuagagaggucuuuaggccgggcaugguggcucacaccuguuaauuccagcacuuugggaggccggggcaggcggaucacgaggucaggagaucaagaccauccuggcuaacauggugaaacccugucucuacuaaaaauaugaaaaauuagccgggcuugguggcacgcgccuguagucccagcuacuuggaaugcugaggcaggagaaucgcucgaaccuggaagguggagguugcagugagcuaagaucgugccaugcacuccagccugggugacagagugagacuccaucucgaaaaaauaaaugaaauaaaauagagagggcauuaaaaaucuuuagaagguaagugacaugauaauuauuaaguagcuggcacguuacaagcauugaauaaguaauuuuuacaugaauuaauauuagucaaagaagaauacuugagaugaauaauagauuaaaaaauagauuuuuuaaaaagccuaagggaggagguaagauuugagguuuaaaauaaaauguauacauaacaagugcuggcaaggaugucgagaaauuggaacauguucacugcuggugggaauguaaaaugacgcagcugcugugggaugauauugagaagauauuugcgaugaugaugcauguugcugaggcuuggagugaagacagucugcuaaaacaauggauaaguauagaguguaagaggaagagcacgucuuugacugauuuggggaaugggaacuaauagauuucauuuuggauauguugcguuuuaaauggcuacuuuuuuagacagugcaguaacaacacguguauuuaauuuuaucaacuuuguaugcugucugucaugaaauuaaauaugcuagcaagaauguuauguauuucauaugugcucuuuauuagcuaauauguuacugguauuuuguacauuuauauuuuuauauaugcaguuuuuaagcaaugcaaauaauugucacagguaaucaugcucauuugcaauuuuugcuuuaugagcuauuuuagaccguaaaccuugaauaagagguaccuccaugaagacugaucuggaccuugaacaaaggcuugagccagagauagaguuuggugaaauacuaacauagguuggagcccagagggugggaauuucauagcgaguguaguuucauauucacaaugaauauuucuauauucauagcgaauauaguuguaguugaguguauguguuuucccccauuauauuuuuauguuuccauuugacuggucucccuuguucauuucugagcuucucagcagucuuucuacguuuauauucaguauggugcuuuacuucaguuuauuguauucacugcaguauuacucaguaaacauuauuuacuuaucaucaacaauuuaauggacagaguacuauuuaguaaaagccaucuuuauuggacuuaaaacacauuuuaauuuguuuuuaaaaaauuugaaucugguaacuucuauacauaucuauguauauguugagaggaaaaaaaugauuuuucuuauauuaauguuuucuuuaggguuuuguuuuucuauacuguguuaaaugcuuuguuuucucuaauguauuaauguauuaaaucuuuauaaaugauucaggcuugggcgcaguggcucacgccuguaaucccagcacuuuggggaggccaaggcggguugaucacuugaggucaagaguucaagaccagccuggccaacgugguaaaaccccaucuguacugaaaauacaaaaauuagccagucaugguggcacacaccuguaguaccagcugcuagggaggcugaggcaggaaaaucacuugaacccaggaggcgaagguugcaguaagccgagaucgugcuacugcacuccagccugggcgacagagugagacuccaucucaaaaaaaaaaaaaaaaaaguaaauaaauaagugauacagagaguguuauaagacauguuuaauaaggguagcaugggguaaaauugccuaaaauauggauguuaaugugggaacacaauccuuuuuguucauaaauguauacuuguaucauuuuuguaaugugagaagaagcuaagccaucuggaaaaagaaauugaaaaagaguugaaagauauuuggguaaaguacuaauucaugccagccaaaaauuauaacagugauuauuuaguuagugaaauaacaaacgauuagugaaucuucaacugagaagguauagaacuguccuauaaaauucaauauccacuacaagucuaucacauuuuaaauuuaaaauuaaaguuuaaaauuaaaaauucauuuuucucagucacacuagccacauugcuaguguucuuucaguagucgcauauuggacagugacaaauacagagcagauguagaaaguccuaguauauugccagacaguacugcuuuagaacuguggcucauuuuucuuuugguuuucauuuaaauuauuuugaauuguauaaggguuuuaucugaggaagaaaagaagauuauuuaggaaaauuuaguauuaucuugaguuuucuccacuuuuaucccucucuccuuuaauuuucaaucacguauaauauugauauguauuauugugccagggacuuaauuuaaguuguagauaguuccgaauacauuuuccuccauccuguuuguuucuaaaguaauuauaucuuugagcaagccaagaauucagagcucuguaaguugacaguaaaucauuaauuauaucacuuacuuuuaaaaaaacuaaaucuuuuuucuuugacuauuaggcaaaguauaaggaaguaaaggcaagaaaugcacaauuauugaaaaugcuucaggaaggugaaaguaaguggauuuuauguuuuuguaauuaaaaguuuaucuuaaauaauaucugaagguacuuuuucaaaugugugauuuaccaacucaacaaaaguguuugauagcacaauagggugacuauaguuaacaauaauuuguauauuucaaaauaccuagaagaaaagauuugaagugccuucaacacaaagaaaugauaaauguuugaguuccuggauaucuuaaauaccuauuugaucaguacacuuuguaugccuguaucaaaauaucacaugcaccucauaaauauauaugauuauuaugugccaauaaaaaaaauugaaaaaaagacucaacaaaguagaaagguuucccagagugauauaagcuacauaguuggccaagcaugguggcucaccuguaauccuagcacuuugggaggccaaggugggcagaucacuugaggccaggaguuugagaccagccuggccaacauggugaaaccacaucucuacuaaaaauacgaaaaguagccaggugugguagugcacaccuguaaucccagcugcucgggaaacugaggcaugagaauuguuugaacucaggaggcagagguugcagugagccgagauugcaccacuguacuugcagccuggggaacagagcaagacugucucaaaaaaaaaaaaaaaugcuggauaguugcugauaaaguuauuauuacaggucacucuuacagcaccuuaguuuuauaccaguuuauaacuauucagguaaaagaaacucuuaaaauuucaauucuuauaacuuacugaacuauauuuagagggaaaacaagccuaacauuugcuuaggauucugcuuuuucaguuauugaaggaggcagccugucaucacuuuagguuuuccuuuuuguuuccuuauuuccuucuccccuccccacugcucuucauacuuuugcugcuacucuguaaacuuuugacaagagguuaccagcaggaagccaaggaaaucaauagaaaaaaaugauugcagaugauaagauuaguaaagcugauauacaaaagccugccaaaucaguugcauuucucacuguguauauaccuagugacauuuaucuugaaaguuuuaugaaaauuuuccauucauaauagaaaaagaaauauauguuaauuuuuuaguaugagacuuaggcaaaggaaauuauaaaccacaaaagaaacacagauuaagacauaaaggagaaaaucuuucucugaauagacaaaauuaaucaacaguuuuccuguuaauaaaugcuaaugaaacuccaaagauagcuccugugaauauuguauagcucuuaagaaauugugaaauucaccuugaaaaaugaaaaaacaaaauaccaaaaaugguuuucagaugugaagauauagucagcccuccauauccauggguuccccaucuguggaucaaucaauuguggaucacaaauauauuuguugaaauuguacaugugcagacuuuuuucuugucauuacucccuaaacaauaacaguguaacaacuauuuacauagcauuuaugccauauuagguauuauagguaaucuagaggugauuuuuuuaaauuguuauuuauuuauuuauuuauuuuuugagaaggagucuuucucuguugcccaggcuggagugugguggcgcucacugcaagcuccgccucccagguucacacuguucuccugccucagccucccaaguagcugggacuacaggcgccugcuaccacgucuggcuaauuuuuuuguauuuuuacuagagacgggguuucaccauguuggccaggauggucuuuaucuccugaccucgugauccacccgccucggccucccaaaguguugggauuacaggcaugagccaccacgcccagcuaguaaucuagagaugauuuaaagcauauagaaggauaugcauagguuuuaugcaaauauacaccauuuuauaguagggacuuaagcaucuuuagauuuugguguccucgggauguccugcaagcaauuguauaccaagggaugacuauacuuggaauauaacuguccaaacaaaauuuaaacuacauuacaaaauaguugucaaacaaugaguaaaaaucagaaaucauguccaguugaacagaacaugaauacucuugaaguagguucaaccuuauauuuuuuauaacuuaacuauuacacaaauagaaguuaaagaauuauggggggaggccaggcgcaguggcucaugccuauaaucccagcacuuugggaggccgaggcagguggaucacuugagguuaggaguucgagaccacccuggacaacauggugaaacccuaucucuacuaaaaauacaaaaauuagccaggugugguggugcuugccuauaaucccagcuacuugggaggcugaagugcaagaaucacuugaacacaggaggcagagguugcaaugagccaagaucaugccacugcacuccauccuggcugauagagugagacuuugucucaaaaaaaaaaaaauacggggaaaaauauuauuuggacauuuagaugucuacauccugagauuaauuuagaccugugcauguuauugaucuccaugugggucuuuuaaugaacaaaguuaugaaaauaaaaaauuaaguuauuuagaagauauauuucuaagugcagaaaugaagaguaucauugcguauuggauguauaaauucuaaauauguaaaaauaaaauaauauuuccuccccauaaaacacuguggaaauugagaaaguuaacugauaaaagcuugcucucaaaaauagauuaaaaaucgcuaucaguaacaacaguguccauagcauaaguaauccaaguagaauuuuauauaggaucauuacaugaaaauacuuguaacacuuauaauguaaauguaaauauggucaguucuguaauaaugcagcauguguuccuaaaaaucacuagucucugcaaaaucacacaagauggccaggcacaguggcucacaccuguaaucccagcuuugggagguugagacagguggaucgcuugagcccaggaguuugggaccagccugggcaacaugacaaaaccuugucucaaaaauuauauguacaaaaauuauccuggcaugguggugcacgccuauggucccagcugcuuggaaggcuaaggugggaggauugcaugagcccaggaggcugagacugcuguaauccugccacugcacuccagccugggcaacagagugagacccuguugauaugguuuggcucugugucuccacccaaaucucaccuugaauuguaauaauccccaguugucaagggugggaccagauggagauaauugaaucaugggggugcuuucccccaugcuauucucauguuagugaguucucaugagaucugaugguguuauaagaggcuucccccuuugcucagcacuuauucucucuccugccaccuugugaagcagugccuucuacuaugauuguaaguuuccugaggccucccagccauauggaacuauuagucaauuaaaccucuuuucuuuauaaauuacccauucucaggcaguucuuuauaguagugugagaaugaacuaauacaccugucucaaagaaacaaaaaauccccacaauacuuacgagaaaaaggaagguuagaagcacagcacuuaaaaucguugucagugacacaugaaaaaaagaugggaaacuaauaaaaacaguaacgcaguuuuacacauguuaaaaugguuaaauacauaaauauuacauaaauauggcacuuuaccuugaagaaaaccugaaguuugcuuguggggaaguaggucucagaaggguuauagcuuguguguuacugcugcaugguggaaggauggaaaguugucagaccagauggguguguuuccuaacacacagugaaccaagguagcugguagauauucaaggaguacaugugggugugguuuucucuguucauaaaauuguacauaaguguauugaaaauuuguguuauguucaaguuguuaccuaauacaucaaccucauugaaacaaauuuguguuuucaaaacaagcauuauaggagaacugauuguaauugaaauauuacauaacucuuuaaaaucacuaguuuucagcaaguguuuauaauccuggggauggaggaguagaaagcauaauuuguaaaaguucccagguugauucuugagagacugaauugauucuugauaggguguuucaucuuaucauauuaaacuaugaaaaugaauuugaacuacaaucuuacauuggcagagcuguggugauaucaguagucauuuuccuccuuugcuaauuuuauuacaauuuuaccucucuagucucuccuaguuuguuuucaaagugaggaguuaguuuuucauacauuagccguuaccaugaguuaaggaaguucucagccaugugaaaauuucugaagcuuaggaaacauagggccaaaguauagauaccucgcuucucccaagagagagaagccucuagaaaaaaaugaauaguucuaagagaccacacaugucauaugaucauuugugaucauaugagcuacauuuaguugacauugccuuauugguaugaaaauuuauucagagaaauauaauuuuguuggcauuaugguaugcucaccacccccaacaauucaacaaaaaaagcacucugcauuguuuuuauuuauuuauuuugagacgaaucucacucugucacccaggcuggaguccaguggcgugagcuuggcuuacugcagccuccgccucauggguugaagugauucuccugccucagccucccgaguagcugggauuacaagaaugugccaccauaccuggcuaauuuuuguguuuuuacuagggacaggauuuugccauguuggccaggcugauuuugaaccccugaccucaggugaucugccugccucagccucccaaagugcuaggauuacaggugugagcuaccauaauuguuuuuaaaaucaugccuuaagauuagucaagguauuuauaaaguuuuuuccauaugugaaauuuuguuuucuuguauccuuguccuauuuagaguagauauaaaaauuaaucuugcaccauauuugugcaauuaaaaaauauguauuuuuuuauugacagagucucucucugucgcccaggcuggagugcaguggcaccaucuuggcucacagcaaccaccaccuccccaguugaagggauccuuaugccucagccuuccaaguaguugggauuacaggcaugcgccaccacaccuggauaauuuuuguauaauauuuuuuaguagagacaggguuuugccauguuggccaggcuggucuccaacuucuggcuucaagugaucugcccaccuuggccucccaaagugcugggauuauaggugugagccaccaugcccagcaauaaauauuuuaacaccacagaaaauguaaaauuucuaagaaaaaaaugcugugcugaugaugaucagaauuuacuggugaaaauguaaaacaaacaaacaaaaaagaauuuaccagugaaaaguaagagcuaugcaaggucaagaaguagauucuuuaaguaugacaagaaaucauuguucuaauugcacugcuaugucuuaguucccugaaguauuguugaaguauuugggugacuggaaaaucuauacugcuguuuuuccuuuuuugucagugaaagauaaggcagaaauacuucugcaaguugaugaaucacaaaguaucaagaaugagcucacuauucagguaaggaacuguggagcauacaugacugguuuucuuaagcugucuuuagucuugaauuauuaaacuuaacaaauacagcucaucaacacuguaaggauguaguauaaauuauacuuuauuauuauguaauagcccaugaaugaagauucuguuuacagcacuaaaagagguagguauguccuucccccugaagaauaggggaugauaaggcuguauuuuaaugaaccaugaauuuagagacagaaagggccaauagaacuuaacccuguaucugggcuugauuuuucuccccuucacauccuuauugucuucuucucucaggacaguuugccccaucuuuaacauagagcuguguacaauaccaaauggaaauuauggggggagcuucucuguuacucauccauuuagcugucaaaaaccuaucauugugaauauguuaagaauugaguauuugccaaaaaccccaaaaauucuuuuucuuauugaauauuugguuauaggugacuucacuucaugcugcauuagaacaagaaagaucuaaagugaaaguauuacaagcagaguuagccaaauaccagguaugcuuuuauaauuuauaaguguuuuuaucacaaauaauacauuuggaguagauacugugugagaauaaaugcaguauuuuauucuuaggccaaaauuuauucacuaaauauauugauaauuuuauuaucggucauauaauuuacaauguagaagauguuauucuagacauugguauauacagcaauaacuagcauaauucaggaaaauucuugguacuacauagaugauacagcauacaugccauugaaucauauuggggaaaggcacaaaaggacaauuguccuguuuauaagguugaucacuuggauacagugauaucuccuagauaucuccauuguaaauauauauuuucccuuuuauaauuaauaugugaggugauacuuuaagauuguaugaauacccuuuucaucuaguggcuuuagcauccauugauauuugugccuuuuuuugugauugcaaaauagugauuuucuaacucuaucauuucuucugcauuuacaagcuagcauugagcaguuuguuccaggaugaagcaauuaaaaauaccagugcuuuugugugugugugugugugugugugugugugugagagauauauuuauguguguguauauauauguguuucuaaaucauaauauaaaauacauuaacuggaaucauagccaaaaaaucucaaaagccacucaugguguggagaacauagcaguugauuagccguggcuuuaaaauugaaucaguccuagaaagagaauucccuuuaccugggauaccuugaaaagauucuuguguguuuguuguuuuggauuuuuaagaaaucucaucgagaagcaugguaggaguuuuauguauaguggguggguaucuauuucaaaaaauauuuuugcuaaguuuauuuuuauuuuucugcuaacuggaaauaaaucuuguuuuuaauacaugucauuacacaucuccuguuccaaaaaaccuauucauacuguuuuucucugaauaaauauuggcaaaauuuuuauauggucaggagugaaugacagcauucuuaugugcgaguauuguuucauuuuguuuuauaauguugauguugaaaugguuauuauagucagaaaaagaaugaaagaaacaaagagaaacugccaucauuaucaaaugagucugagcuccauaugccccugauacaaccaccucucuuuaagagaugcacuuccacagaaaagguaguucccaaacuuggcugaucauuggaaucacuuggaaacuuugaauuaaagauuguuagccaauuaaauaggugugggacaaagccuagaugucagaauucuaaaaauauuacugcuuagguaauucugaugaucaacuaaguuuggacaccauugccauaguuuuauaaaaaugggaaaaacuauacauacaacuauuauaaaguaaauacauuaaaccauuauuuaugguuaaauugaaggggguagaguagcuauugaugauuuuaauuuuauucuuugcauguuuguacuuuccauauuucuauaaugaauguuuuuuaaaucagaauaaaacagaaaauguuauguuauguuauguuauguuaaaauauuuauguaaaacccuucuuguccuuuaugcugccuuuccuuugcuuuggcucaagucaaauaccacaaaugauguuucauauggagcaaauuaaauacaaauuuauauaugcaacuaagcaauaugaaaagcauaaccuaguuuucaauccacuaaugaacaaaaucaaauuucuaaugcuaaugugagcaaaacgcaacagaacuugaauuauaaauugaauuacccaaaagguaaugaacugaauuacuaaauuugcugaucauauggaacaaauuuaaguguacuguuuauuuuaguauugaucaaaaacuuuauuuuuaauucuagaacagucaaaaugaguucuaaaaaaauaagauaucggugagcuuacuaaggcaagacucuuauucaaauagaaguaacuuuucuaaaaccaaccuuaaccauuuauaaaaaauaaccauauuaaaauaauguaacaguauguagacucaaauuuacaacaaaaucaaaaaagaaauugcuuccuucucauaccccaagaugccuuuggucuauauuuuuuaaaugaaguggucccaaaaugguauguuguaaauaauuuucccuauuuuuuuuuuuuuuuacaggguggcagaaaagggaaaagaaacucugaauccgaccaguguaggugauuacauuagccuuugaagucaacacaaaguuuaaaacuuccaggauuuugcaaaguuguauauauuuaaugcugugcaacugcuaaacuaugcaguuuuucuugaaggaacuaaaagcaacuagcucccuaauggucuauaauuuuauuucuuuuggcuuaaagugaaaaagaagaaauagagaauuccagcagaauucagugguugucuacuauccauacuucuuaucacuuuaguuuuucaucagucaauaaaauuaauuuacucuuccacuaa
